United States Patent 7,557,201 (NUCLEIC ACID MOLECULES AND OTHER MOLECULES ASSOCIATED WITH PLANTS) - sequence listing, part 2

SEQ ID NO: 6094 - DNA, 126 bp, Gossypium hirsutum
  Clone ID: uC-gsronu33B014b07b1
ataggggtaagatgggagggttttcttgcaagatccgcgccgggacttcgagcggtgctgaagatcaccttagtcctttggccctatatggtgggaacaacggggtctgccttaagaccgttgctg

SEQ ID NO: 6095 - DNA, 670 bp, Gossypium hirsutum
  Clone ID: uC-gsronu33B014b08b1
cgggtctaagttcgcggaggtgatacatgtatcaagaagcacaccgtacccggcatactatccatggcgaacgccggtcccggaacgaatggatctcagttctttatttgtaccgctaagaccgagtggctcgatgggatgcatgtggtgtttggtcaagttgttgaaggttggatgtggttaaagccattgaaaaagttgggtctagcagtggaaggactgctaagcctgtcgttattgcagattgtggacagttttgttaagaacaagaacaagaacaagaaatggaataatgttgactttggtctatgaatggtgattaatgtctgaaatttataatttttattgtgtttttttttgatggttactgggatttggcttaaggttgttcttttaagaaaatgtattggcttaaatatatgtacgttatataataaaattattggaccatattatttatttattataatatcctattttgtaggtattggaaatatatttaatttattgtattattgatttcgacatattttaatatctaatatatttttatttttattctattttatattatatattttataaattattctacttatttttactatatttggtactggctgtcattgctcttaattttttatacattatagtcatttaatttttattt

SEQ ID NO: 6096 - DNA, 177 bp, Gossypium hirsutum
  Clone ID: uC-gsronu33B014b09b1
aggtccgagaaggaggctgctgaaatgaacaaaaggtcattcaagtatgcttgggtgcttgacaagcttaaggctgtgcgtgaacgtggtattcaccattgatattgccctgtggaagtttgagaccaccaaatactattgcaccgtttttgatgcacctggaccccgtgccttttt

SEQ ID NO: 6097 - DNA, 148 bp, Gossypium hirsutum
  Clone ID: uC-gsronu33B014c07b1
cgcacccttacgggtgggatagtgtacgacctcctcccgcttctacaaatacaagtgtgctacaccaccaccaccccattgtgtatacgcttgacccgctcctgctcaccactactacgccacggctgtgaccgagctccactccaag

SEQ ID NO: 6098 - DNA, 330 bp, Gossypium hirsutum
  Clone ID: uC-gsronu33B014c10b1
aaagtatcaaccgataaggaccgattctacggggttctcgctggtgttgcaacccttggtgctgctgtgggatggtatctcaactctaaagacaagaagcaagaggcctgaaatgggggttaatgcgattggattctctaggtggaacatggcatgaatggtttaccccaatgccctgttcgtgtgcaaagtaactgaaaaataaaacaaactttgtaaagcagcttatcatgttttctgataacgtctgtgtttgaatcagtagtgttcttatgtacctcgatgccaatcatggttttctgcattgtcttttaaagaatctttgatgcc

SEQ ID NO: 6099 - DNA, 101 bp, Gossypium hirsutum
  Clone ID: uC-gsronu33B014c11b1
gaagtgtttattacttgttgcatttgctagtctaaacctgtgccactgtttctgaaagccgtgtggcatggaatgacctgttttatagacctgtgaggaac

SEQ ID NO: 6100 - DNA, 107 bp, Gossypium hirsutum
  unsure (1)..(107): unsure at all n locations
  Clone ID: uC-gsronu33B014d06b1
caagttgtgactngttgtcaactttttttgagaaggttgcaaccagggttaagcatcaaactgaaataaaggggatgaagtatggaagtttcaaggtgggtattttt

SEQ ID NO: 6101 - DNA, 389 bp, Gossypium hirsutum
  Clone ID: uC-gsronu33B014e09b1
tgcaataaagcaagagggaatacatcattttagcagactatcttcgccgcctcctcttgctcctatctcatagcagccatgatcattccagagaagaaccgccgcgagatctccaagtacctctttcaagagggtgtttgctatgcaaagaaagattacaacttggcgaagcacccagaaatcgatgttcccaatcttcaagtcataaagctgatgcaaagcttcaagtcaaaagaatacgtgcgtgaaacttttgcatggatgcattattactggtaccttaccaatgatggcattgagttccttaggacatatctgaatcttccttctgagattggtcccgctactttgaagaaacaagctaagcctgctggtcgtcccatgggccc

SEQ ID NO: 6102 - DNA, 252 bp, Gossypium hirsutum
  Clone ID: uC-gsronu33B014e11b1
gccattcaaaactggaattgaaatgactagaacagccctctaaaaaaaaacgggcgggtctatctatggtggtaactatattttccccccccctatagataagtgtttttattagtgagaagcccaaaactcgcccgctgtcccggctgtgcctccaatctctgggggaaacagggggggatataaaaaaaaaactcgtaacgggccccttcttttttttcaggttgtggatttgtaataagggcccccccc

SEQ ID NO: 6103 - DNA, 269 bp, Gossypium hirsutum
  Clone ID: uC-gsronu33B014e12b1
ctcaaaacagcagagctacgacggtacccgagaagcaaacgcttctctatcaccacaaggaaaaacacttcaccgccggagagatcgttcgcgacatcatcatcggcgtctccgatggtttaactgtgccctttgctcttgccgccggattgtctggcgccaatgcctcgtcttccattgttattaccgctggtatcgctgaggttgccgctggagccatctctatgggactcggcgggtatctttgcggttaaaagtgatgccgttct

SEQ ID NO: 6104 - DNA, 431 bp, Gossypium hirsutum
  Clone ID: uC-gsronu33B014f01b1
gtgataaccacggcctatcatctcacggacgttcggaatctagcattcgctgagagtatgctccgccgccgaccatgaagggggacaacatcacttccatcctcgaaaaaggtggtcaattcaccactttcatcaagctattgaaagccacacaggtggctgatcaactaaacaaccagctaagcacaccggaccctaacgacgggatatcgggtgtttgcaccgagtgacaacgcgttctccggacttaaacccgggacgttaaaactcactttccgtccaagagaagcttcagttggtttagttccatattctccctaccgtcatgtctacgctttctatttttataccttttcttatcttcttttgtcctccttctcttggtttttattcaatacgatatttcgttatacttatctttctctcatttt

SEQ ID NO: 6105 - DNA, 515 bp, Gossypium hirsutum
  Clone ID: uC-gsronu33B014f06b1
aaaaagagaaacaaggaagggtttgattggcttggatatcggtgcaatcagcacttcccctcggaatcatagctggaatgctctgcgttatgggcaatgctcagtatttcatccacaaagcttatcacggccggcccaagcacatcgggaacgatatgtgggacgtcgccatggaaagaagggataagaagctcttcgagaacctctcttcctccgattgatccctttttagttttcttctggaaacttggtcgatgttgtgagagaagaaataaaaagtgctctatgatattctgtaatgctgaagaagactaaagagcagatgaactcgagtattttctttttcatggtaatgttaagcatgaacttctgaaatgttgcacttttgacacactttctaatgtttacgctggtggtgtatggagatttgttgcttccaaattcttgtgatcttctattgcaggtctatgaatattctggattaatcaagagtttgatttgagttttgaaattta

SEQ ID NO: 6106 - DNA, 102 bp, Gossypium hirsutum
  Clone ID: uC-gsronu33B014f07b1
gggaggttggaattgcggatctagctgcagctgcggatctggctgcaattgcggtgagaactgttaattgaaccctagccttgggtgctcggagaagacatc

SEQ ID NO: 6107 - DNA, 328 bp, Gossypium hirsutum
  Clone ID: uC-gsronu33B014f09b1
ccttgtactcattcgaaagagacgtctttttcccttggaatcttaattaataaagcgattgaataagaaagtatggtaattaactgcttgttataccagaaattctggggttatggcgaagaaccactttcatcaagctattgaaagccacacaggtggctgatcaactaaacaaccagctaagcacaccggaccctaacgactggataacggtgtttgcaccgagtgacaacgcgttctccggacttaaacccgggtcgttataactcactctccgaccaagagaagtttcagctggtctcaatttcatatacttcttacgttattg

SEQ ID NO: 6108 - DNA, 442 bp, Gossypium hirsutum
  Clone ID: uC-gsronu33B014g03b1
tccgttagcattggcgggctaaataatccatctaccaaatgcctttcaatatatatccacccaaagtttctgcaccccgaaatttacaaacaatccgctaatttccagtcataagaaacatgtcaagagcaaaaaccagaatttgaactgggatgcctagtcacatttttaaccgaataatgctttttccggcaaacaagctcatcaaccaaagcaaaacagaatcttcacttatactactccggagggaagacgaagaacaagctgccctccaaagacactcttaatataatagtaacagaagtctgctaaaatgaaagtttggacaatttccgaaaataagaaccatggagggccacaatccataacccagggctaccagcaagtgttctcgactgtcttaaacctggagaaaccagtgagcacagctgaggaaccttgc

SEQ ID NO: 6109 - DNA, 504 bp, Gossypium hirsutum
  Clone ID: uC-gsronu33B014g05b1
agagagagagagatatggtgagttaaacagaggagacccaattgaacaggcttgaataccaggtagacaatggaggaggaggtgcttgggagtatctttgccttggtaggaagctcaaatgttggcgttcactgaaaggtttgaagtatttgattataggtctttttcgaccactaaaaactttttttgttttccccctttttaaattgtactcctctttgtgctaacaagcctcttgttttttataaaaatctccatggtttcatatttttattttatggtttgttttaattcctttttctttaaaaaatttttttaataaaaaataatgtgtatctttcattctctctttttattaaaagtattactattcttttttctgttttgtataaccttttgtttttattttatttttttttgtagttttttctatttttttcttcttattttaattttttttttctcccttattctatttaatttattttttttcatttttctttt

SEQ ID NO: 6110 - DNA, 354 bp, Gossypium hirsutum
  unsure (1)..(354): unsure at all n locations
  Clone ID: uC-gsronu33B014g11b1
tctgttcattatgcgggggggataagtctagcatatccacccgttcttaccggatagctgatatgctcgacagaggggccagcaggtgactctctgaatcccattaaccctattgaaaagctagaaggagctcatcagcataagagagaacttagatattacaactctgagatgcataaggctgctttttcgttgccttcattcctgaagagggagngtgaggctactttgcgactagcaggaatctgcgtgtctcctagtcctaagcaaatatgtagtgataactcccatttggcagtagagtaaataaaatggtttgcctgcgatttgtcttattacactggaaacttactg

SEQ ID NO: 6111 - DNA, 388 bp, Gossypium hirsutum
  Clone ID: uC-gsronu33B014h03b1
atagccttcctaggtggggtcatatgtggtgcaaatgggtacctttcacaatgggaccaatttactgcacatgttgagccgattgctgtaaccgttcctttcatgattgcaagtggtaaccatgagcgtgactggccgggaagtggatccttctacgggaacaaggattccgggggagaatgtggcgtgttggcggagactatgttttatgtccctactgaaaacagagcaaagttctggtactccacagactacggcatgttccggttctgtgtagctgacacggaacatgattggagggaagggacagagcaatattaatttaattgagcactggcttgcatatgttggttgacaaaaagccaccggggctggattttcctttgac

SEQ ID NO: 6112 - DNA, 359 bp, Gossypium hirsutum
  Clone ID: uC-gsronu33B014h04b1
ttgtgccggagtgtttgcagcgataaggtcactatacgtgtgagcattcagatgatcagatggctagctagagcctgtggatgaggtgccactgacttcagatggtgcctggatgggattgaatattgtgctgccagaatgaatgtaagtagaaattgttgtgtaacccctatcacaaggtagccgggaccgaactggatctcagcctacatgaaccagcctaagagacttcttcataagccttgcaagggataggggggaatttgccatagtcaaatgattgttaaggagtttttcttataacttaaggtaaatgcatttagtttggctaacaaatttattcgcattgcattgatttt

SEQ ID NO: 6113 - DNA, 277 bp, Gossypium hirsutum
  Clone ID: uC-gsronu33B014h09b1
aatgggaccactttactgtacacgatgagccgagtgcttcaaccgttcctttcatgattgcaagtggtaaccatgagcgtgactggccgggaagtggatccttctacgggaacaaggattccgggggagaatgtggcgtgttggcggagactatgttttatgtccctactgaaaacagagcaaagttctggtactccacagactacggcatgttccggatctgtgcagctgacacggaacatgattggagggaagggacagagcattatcaattcat

SEQ ID NO: 6114 - DNA, 149 bp, Gossypium hirsutum
  Clone ID: uC-gsronu33B014h11b1
ggggacccggccgtttcttccccgaaaaccaggttgataatggaggaggaggtgcttgtgagttcctttgccttgtgagaaagctcacagtttggcgatcagagaatgtttttgaaatatggtttattcattctttaaatgttccctca

SEQ ID NO: 6115 - DNA, 619 bp, Gossypium hirsutum
  Clone ID: uC-gsronu33B015a07b1
taaaatttaaaaacctcatgaccttcgaagaagagaagcaaaacccaaagctagcaggaagataatgacaggtctagtaatgatgaccaaaggaggtggctgtggtggcggtgggaagggcggaactaaaggaagaggaggagggctcaagagctgtgaggaggaagaagaacggcagaaccagatttctgtcgtggcctttcttttggctgctttgaggaaatccatggtgtcttgtcgtgttgatagacgagacgaagtaatgtcttcttccaccgttcaccatatggaaatcggatggccgaccaacgtcaaacacatcacccatgttacatttgatcggttcaatgggttcttgggtcttcccgttgagttccaagtcgagatccccggtcgggttccaagtgctagtgctagtgtgtttggtgtctcagccgaatcaatgcaatgctcgttcgattccaaagggaatagtgtccccactatactcttactaatgcaggagcggctttatttacaaggagggctaaaggcagaaggaaattttccgataaatcccgaaatagccaggaggagcatggtagagatcagctcaataggggcatagtgcccgataata

SEQ ID NO: 6116 - DNA, 111 bp, Gossypium hirsutum
  Clone ID: uC-gsronu33B015a10b1
tccacgcgtccggttccctttcgatttgggcgaaggggatgcgattgaattgatctcttgttattgtatctatatatctttattattgtatgtatttatctatctatatac

SEQ ID NO: 6117 - DNA, 323 bp, Gossypium hirsutum
  Clone ID: uC-gsronu33B015b07b1
tttttataaaaaaacaaaaaaataaaaaaaaaaaaggaaaaaaaaaaaaaaaatacacaaggttaggggtcgctggctttcgcgggtccaggctctccgacccggccctccaatggggtggcttccctactgggactcccttatgggcttccttggccgccctttgacagacacttggaatggtaacactccgccgttccttggcttatttgctttcgcgcgtatcgctttttcgcccggtggcgcgctctcggctggggccgcccctgtcgcccttcctgacatccgcacagttcttagggccaaggggccgcccgctcgat

SEQ ID NO: 6118 - DNA, 515 bp, Gossypium hirsutum
  unsure (1)..(515): unsure at all n locations
  Clone ID: uC-gsronu33B015b10b1
gtgatattggtactaaggatgttacctatatgggcaaccactgttatattttggaccgtatatgcccaaatgacaacattttcagtatcacaagccacaaccatgaaccgtcacatagggaaatttcaaatcccaccagcgtcactcactgtattcttcgtcggaagcattctcttgacagttccgatttacgacaggctcatcgctccaatcgctagaaaattacttaaaaacccacaagggttaacccctttacaaaggatcgctgttggtttagttttatccattatagcaatggtagcagcagcattgaccgaaataaaacgattgagagcagcaactacgaatggtcttgcgaataatccaaccgctcaaatcccattaagtgtcttttggttggtccctcagtttttgcttgtaggggctggtgaagcctttacatacataggacaacttgattttttcttaagggagtgcccaaaagggatgaaaacaatgagtacggntttattttt

SEQ ID NO: 6119 - DNA, 61 bp, Gossypium hirsutum
  Clone ID: uC-gsronu33B015b11b1
tccacgcgtccgaaagttaaaaaggcatgaagcctctactttgagaatgaaaaaaagaaac

SEQ ID NO: 6120 - DNA, 592 bp, Gossypium hirsutum
  Clone ID: uC-gsronu33B015c02b1
gtaatcttgcgtttctccgtctgatttccaagtttcagggcggagctcaacatcgaggaaatctcacgacacaacatccatccagtaacttgttttggttactggagacaatggacttctggttcaagggaatcagtgaggacacatctgcgtactcatttaatgagacagacattcagaaatgtccatttcttaagaacattaacaaacccaccaacttttcattctcttcaatgagttttcccatgcctgtacagggagctagaggtcctttatttgaggatggtccaaattttgatatggcatttaagctttttcatgggaaggatggcattgtacctctctcagggaggtctgatgttccctgtgacagagacaaacaggagcctaccatccaatttaacccattagcaggaaaagctgcaacaattagcctttcagcttttagctcaagagggcccttcagctttggtcccttctcagataaaaggaagaaccagaaaaagaaattcgactcatctaacaaacaagaaccctcttctcagaaaggaaattcatcaaatcatgatgcaatggggaacgagtggttaca

SEQ ID NO: 6121 - DNA, 532 bp, Gossypium hirsutum
  unsure (1)..(532): unsure at all n locations
  Clone ID: uC-gsronu33B015c08b1
aaaaaacccagtattctgtcatcactatggaggccaaatggctgctatgttttacaatggcagcactaatggcagtgtcaaatggccaggaatcagtgaagccattggtgaagatagttaaaggcaagaaactttgtgataaagggtgggaatgtaaagggtggtcacagttttgttgtaaccaaaccatttctgattatttccgaacttatcaatttgagaaccttttcgctaaacgtaatacaccggtggcacatgcggttgggttctgggattaccattctttcattacggcggcggctcagtatcagcctcatggttttggtaccaccggcggtaagctccagagcatgaaggaattggcagcttttcttggacatgtcggcagcaagacttcatgtggttatggagtggcaactgggggaccattggcttggggtctatgctacaacaaagaaatgagtcccagcaaattgtattgtgatgattactacaaatacacctacccttgcactnnctgagtttcttacca

SEQ ID NO: 6122 - DNA, 609 bp, Gossypium hirsutum
  unsure (1)..(609): unsure at all n locations
  Clone ID: uC-gsronu33B015d05b1
cccattcgtccgcccacgcgtccgcttgttgatggtggccaatctcagagaacttttgtttacataaaggatgctattgaagctgttctgttgatgattgaaaacccgggcagggccaatggtcacattttcaatgtgggtaacccaaacaatgaagttacagttaggcaacttgctgaaatgatgactaaggtctataccaaggttagtggagaatctgcactggagactccaacaattgacgtcagctccaaggaattttatggcgagggatacgatgatagtgacaagagaattccagacatgaccataataaataaacaacttggttggaaccccaagacatcgctttgggacttgcttgaatctacactgacctaccaacacaggacttatgctgaagctattaagaagtcgatggcaaaacctacttcatcctaagtaagcaaacgaacaaacaaaaattttaaagatatgcctaagcaaggactcgcataaaatgtgctttattcgcaaatgtttcaatttcttttatattttnctttaggaagtcttaaatatatatatccaagtgtattttttgttatatgccaaatattcttttggtgg

SEQ ID NO: 6123 - DNA, 546 bp, Gossypium hirsutum
  Clone ID: uC-gsronu33B015d07b1
tttttatctttccctgaaaaatttcctttccttttcaagaaagaaaagaaaaatctttagttccaaaacttcccagacgccaaacattagccatttgaatcaatggaaccaatggagttacagttttgtaatggcggaaacggttcgtcactgggcgaccccttgaactgggccgcgtcagctcagtcaatgaaaggtagccatctggatgaagtgaagcgcatggttgaggagtacaagaagccggtggttcgtcttggtggtgagacgttaacgatagctcaagtcacggccattgcgaaccgcgacgtcgccgttcaggttgagctctcggaggcggctcggccggccgttaaggccagcagtgattgggttatggaaggaatgaatcgaggtacggacagttatggtgtcaccactggctttggtgcaacatctcatcggagaaccaaacaaggcggtgccctccaaaggagcttataaggttcttgatgctgagttttcgggcaagcaccgagcatgccattctttgcccacactgaacga

SEQ ID NO: 6124 - DNA, 584 bp, Gossypium hirsutum
  unsure (1)..(584): unsure at all n locations
  Clone ID: uC-gsronu33B015d09b1
taaattccttttaagtaccccttttattgttcatcttcatgagtgtaaattaagtttccttttagcttccaaaaaaaaaaatctcaccatctttccatcaaaatcccatacttttccttccatccaaacaagatattcatcaatgaagaagataaatctcctacttaggaaatgcaagagcttgtcgagacaactaggaaggtcatcttcatatagtagcttaagatcgaaatcaactcgagaagatcatcaccgttatatatgggatcatttaagaagaagaacgaggaggaacgaagatggagacaattatgataatgatgatgaacatcaatgttacgaaacggtttatgtcgggagtacgaggaaacgatacgtggttagttcgaagtaccttaaacatccattgttgcatgctttaatagagaggcctaaacaaaagcatggaggggaagatcacatattggttaaatgtgaggtagtttctgttgatcatctttngtggatgattgagaattctgatccaaatctcattttggattcattggaggaattgactgacctttatgtgtctggatcaatta

SEQ ID NO: 6125 - DNA, 421 bp, Gossypium hirsutum
  Clone ID: uC-gsronu33B015d12b1
ttacatgatggtgataaatggaattggtggggccctgttaatctaccctgtactacgaggcaaatgggatagtgggacataggtggcgtatcgcagacggggcgatcttgtacatcgtggcgatgctccagaccgctccgaaggggccgtcgggggagaagaagggagcgcacaaccgtgagagagtggaagggtgcatgaaagaggggtggcattgcaagctgtaccttcctcactaccgttccatagaggagtggaaccgacatctcgagaagcaatggtcgagactcgccaagaggaaggccgagctggatcctatgtgcatcctggcacgtggacaaagcattactgaagggactagataataatgataattaagtaggcacttgggatctcgttgttactacacatagatatatat

SEQ ID NO: 6126 - DNA, 581 bp, Gossypium hirsutum
  unsure (1)..(581): unsure at all n locations
  Clone ID: uC-gsronu33B015e05b1
cggtttcgtgggcggacgcgtggggttccttcaggcatcaaaaaggacccccccgatcaaatttatcttttctggtttcgctatggcatcgaagcgaatcttgaaggaattgaaggatttacaaaaggatcctccaacatcttgcagtgctggtcctgttgctgaagacatgtttcattggcaggcaactatcatgggtccaccagacagtccgtatgctgggggtgttttccaagtgaccattcattttcctccagactatccttttaagccacccacggtggcatttagaacaaaggtattccaccctaatattaacagcaatggaagcatttgcctagacatcttgaaagagcagnggagtcctgcactaactatttccaaggtattgctatcaatatgttcattgctgaccgatccaaatccggatgatccattggtgccggagattgcacacatgtacaagacagacaggaacaagtacgagacaactgctaggagctggacccaagagtatgccatgggatagggaggctcaatgtttctttcttttttgtaaatgttttgggttttttttttaa

SEQ ID NO: 6127 - DNA, 291 bp, Gossypium hirsutum
  Clone ID: uC-gsronu33B015e08b1
tggacgcgtgggctcaacattaatattcttccccctcatttacactgtaaagcacaagcatgtaattcattccttataacatcagtttgcagcgtttgtgtttttgcaaattttagcgattttaagcatttctgtttatctttttcccaatgagtagccattgtagcttctttacaaatctaatgcataccaacatttccatcaaaaaaaaaaaaaaaaaaaaaaaaaaaaaaaaaaaaaaaaaaaaaaaaaaaaaaaaaagggcaaacgttctaaaggaatccggggtgc

SEQ ID NO: 6128 - DNA, 545 bp, Gossypium hirsutum
  Clone ID: uC-gsronu33B015e09b1
tatatttcaaacccagatttgttctctctctctctctctctctatttccaatcaattaattcctccattggaggagcttagggtttgttggtgttctggtctttgctttgtctgaaaaataaacagaattataaacgaacaccaacgccatgggaagatttgatgagagaggattcgattcagtggtttgccctaagcctatccgaacctttagatggtctaccaacagctgttatcagactgagatggctgcttcaaacactggtgcagagcttgttgatataatccttcccgagggagggtttggggccgagaatcccaccaaccaaatggcttcattaccaccgtatttctgtggatcatcgtctagcaggtgcgtctatttggtttttccaagatgcccgattcaaacgactagcagtcggagcttcctttactaacattcctagcactctcctcaaggggtggatgcttgtggttgtatttgggccgatgcctatcttttgtttcattgcagattttgtttggctttacctttcttggtc

SEQ ID NO: 6129 - DNA, 470 bp, Gossypium hirsutum
  unsure (1)..(470): unsure at all n locations
  Clone ID: uC-gsronu33B015f01b1
ctcataccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggtgaaaataatgtataagccatttggttgggagcaaattgtccttttctccaaaggatttttgctgctcattcatggtgacttggtttatggttttatctgttgttgttaaaatcttataaaaatatatatcggttgctgctcttggtttgtctaanaaaaaantaaaaaaaaaaaanncaaacattgtaccccc

SEQ ID NO: 6130 - DNA, 524 bp, Gossypium hirsutum
  Clone ID: uC-gsronu33B015f03b1
cccacgcgttcggtttttttcacaatccgatggtggaatccagtgaccttcgaagacatgcagcctgaaggaacatctcatagaatttcgtggccttacgtagaagacaaagcttacctttggacttggctgtttggggttccattagctgcttataccctctggcaagttctttacttcctcattgtcaacgtgctacgtcggcagaggttattaagagatcctgaagtcatgacatcttacagggaactttcgaagaaggccaagaaagcaaataacatatggtggcgtttaggtgggttgcttggggatcaaaaccgattcctgatgtacattctatgtcaagccatttttacagtggcaaccatggcactcactgtctccatcttcctatcatacaaattccacgtgattttccaaatactgaaggtttctgcgtcagtctggaatggaggaagcttcctgttagaagtgatgcctagacaggtaattggtgaggagaaaaagaaatcagatattcagat

SEQ ID NO: 6131 - DNA, 510 bp, Gossypium hirsutum
  unsure (1)..(510): unsure at all n locations
  Clone ID: uC-gsronu33B015f07b1
gtgctttcgtttgaaaagcttcgccaggtcaggcgcaacctagatcaagccaagaccttacttgaggctttgattaagagagaagagaagaagagagatgttctggaatgtgaagttagtcttcagaggatccaaatgaagtacaagcacgaaactgaactcctcgaagatattacgcttcctggatttccaccaatatctagcaagtttgcttctagtgaagatgagtttatggactcggatgaccttgcaaacagccgtccacgtgcacgacctgctgcagttcagaatccacctctaacagattctaatgtaggcatggctcctactgcaagtgttaagcaagagttccggcggcgacatttgttgcatggatggctccataaactggatcctcttgagccagttttgttgttcacaaaaccactagttccggataagctggcagctgcnaacattgtacccccatctgatacttcaacaaaaaatggtgcctctacaccaccttat

SEQ ID NO: 6132 - DNA, 527 bp, Gossypium hirsutum
  unsure (1)..(527): unsure at all n locations
  Clone ID: uC-gsronu33B015f10b1
taaataaaatcagattttataaaaaaaaaaccagattttgtcgaacaaattctgagcaagtgtccgtcactgctactccaaacgaatgctaaaggtcaaactcctttgcacgttgcagcagggtatggacattctgctattgtgaaacttctaatcaattcttgcgcaaaagctagggatggagattttgagctgggaatggatcaagtaagtgcagtgagggagatgctgaggattagggatcaagaatccaacacggctttacatgaagcagcagggtgtggcaatgttgaagtggtgagtgcttgtggttcctgcccttcccccaaccccaaacctaaacctaaacctaaaccaaagccaaaccctactccctccccatcttcttctggcaagtgccctagagatgctcttaaactcggtgtatgtgctgatttgctccgtggcttgctcaacgtcaccattggtacccctcctgttcaaccctgctgctctctcatccaggtccngctgatcttgaagctgcg

SEQ ID NO: 6133 - DNA, 596 bp, Gossypium hirsutum
  Clone ID: uC-gsronu33B015g09b1
taaaaacagagaaagagtactttcttttttcttcttcttttggttctgtttcactgccatggcgaaaacgcaaacaccccatatagcgattcttcctagtcctgggatgggtcatcttattccactcgttgagttcgctaagcgatttgtacagcaacacaatttcactgtcacttttgttatccccaccgctgattctccttcgaaagctcaaatatcaaccctggattcccttcccagctctatagattatgttttccttcctcctgttgacttgagtgacctccctcaagacgcaaagattgaaaccgtgatttctttaacggtggctcgctctctgtcgttccttcgggatgctttgaagtcgctggctgcaaagacaaaactcgtcggtttggtggttgatctttttgggacagacgcatttgatgtcaccggagaattcaacctctcgccgtacatattttacccctccacggccatggccttgtctctgtttcatgacctgccgaagcttgaccaaatggtttcgtgcgagtacaaggagttgcctgaagtgaggatttcaggctgcatacctattcgcggcaaagact

SEQ ID NO: 6134 - DNA, 496 bp, Gossypium hirsutum
  Clone ID: uC-gsronu33B015h07b1
taagataatgaaaagaaagaaaagaaaagaaaaagagataagaaatgaaaccaagataaaaaaaaaaataataaaataaaaaaaaaaaatggggcggtcgtttttagaggtttcaatttaatgtacctgtgtttgcgggggggtcccttttaaaaggttaaattttttttaaaggggggggccgtttttaaaattttttttttggggaacaaaattgtaattactcagcttttttttttagggtcccatatttaaaatcccggggggttgtttaaaaaaaggggttggggaaaaacctttttttcaacaattgtatatgttggaaggggaatggcacttttccttttgtgtgaaaaattttacaaaaggccgatgggaaattgtctctccccatgtggggtacatttaaggggggaggggggggggtttttgaggggttttaatttcttttgggaggggtttttccgcactatttttcattttttttttgggtttt

SEQ ID NO: 6135 - DNA, 557 bp, Gossypium hirsutum
  Clone ID: uC-gsronu33B015h10b1
tttcactcgtccgaaattttccctctcatttcctctctggcagcccgcttgagaaatcaaaattcaaaaccctagttagggtttttatcttcctcaatctcccgttgtcacactgcaaatcggccacaatgtcgatgtccaagagttccaaaatgcttcaattcatcaactaccgtatgcgggtcactatccaagacggccgtcagttggtgggtaagtttatggctttcgatcgtcacatgaatctcgtactcggtgactgcgaggagttccgtaagttgccgccggctaaagggaagaaaaaccccagtaccaatgaggagcgtgaagatcgtagaacgcttggtcttgttcttcttcgtggtgaagaggttatttctatgactgttgagggtcctcctcctcctgaagagtcgcgttcaaagtctgccgctgctaatgctgttcctggacctggtataggtcgtgctgctggtcgtgggattccgactggtcctcttgttcaagctcagcctggtcttgctgggcctgttcgtggtgttggtggacccgcttct

SEQ ID NO: 6136 - DNA, 569 bp, Gossypium hirsutum
  unsure (1)..(569): unsure at all n locations
  Clone ID: uC-gsronu33B015h12b1
tccacgcgtccgaagggtatcgacgaattggcttttattttcttttttagttttgaagctctaagtccagctagattttcacttttcgggtggagaatgccgatttctcgaattgcagtaggctccccagcggaagctagccaatccgatgccctcaaggcagctctagctgagtttatttcaatgctcatctttgttttcgccggcgaaggctccggcatggcttttaacaagctcactgacaatggctcatcaacaccggcgggattagtagcggcatcagtggctcacgccttcgcgttgtttgtggcggtttccgtcggtgctaacatctccggtgggcacgtaaaccctgccgtcacattcggtgcctttgttggtggccatattacattgttcaggagtattttgtactggattgctcagttgctcggatccgttgttgcttgcttgcttctcaagttttcaactggtggactgacaacatcagcatttagcttgtcatctggngtaggagcatggaacgcagtggttttcgagatcgtgatgacctttgtttggtttacact

SEQ ID NO: 6137 - DNA, 585 bp, Gossypium hirsutum
  Clone ID: uC-gsronu33B016a01b1
ctcaaagcctaatggatctcctcttcttggagaaggccctcctgggccttttcgtggcggtggtactagccatcaccatctctaagcttcgtggcaagcggttcaagctccctcctggaccattacccgtgccggtgttcggcaactggctccaagtgggtgatgacttgaaccaccgcaacttgacagatttggccaagaaatacggtgacatatttttacttcgaatgggacagcgtaatctagtggtggtgtcttcacctgagctagccaaagaggtgctccactcgcagggagtggagttcggctcaagaactaggaacgtagtgtttgatatattcacgggtaagggtcaagacatggttttcacggtgtacggagagcattggaggaaaatgaggcggatcatgacggtaccattttttaccaacaagggttgtgcaacagtacaggtttggatgggaaggacgaggctgctcgtgtagtggaggacgtgaggaaaaatcccgaggcagccaccaacgaatcgttttgaggaggagattgcagctgatgatgtacaacaacatgtacagaatcatgttc

SEQ ID NO: 6138 - DNA, 564 bp, Gossypium hirsutum
  Clone ID: uC-gsronu33B016a02b1
cccacgcgttcggttccaacaggtcgaagggatggagtgatctcaaatgttactgaagctaacaacaatattccaagcccattcagcaacttcacaactctccttacacttttcaacaaccaaggactcgatacaaatgacttggtcctcctatccggggctcacaccatcggcatagctcactgcccagcattttcacgccgattgtacaattcgaccggccctgggggagtagacccaacgcttgacagtgaatacgcagctaacctcaaaacaaacaagtgtacaacacccaatgataacaccacaatagttgagatggaccctggaagccgtaagacctttgatcttagctactacacattgttaaccaaaagaaggggtcttttcaattccgatgctgctttaactacggactccactagcttgggtcttatcaaccagcttctttcgagccctcagtcgtttttctatgcttcagttgcaaagtctatggagaaaatgggtcggattaatatcaaacaagatcccaggtgagataggaagcaatgtgcactcgtcaca

SEQ ID NO: 6139 - DNA, 439 bp, Gossypium hirsutum
  Clone ID: uC-gsronu33B016b01b1
cccacgcgttcgaaagttaggaaaaggtgtacgcatgttgacaaataaatggcttttcttttttgcaccttttaatcaaataatttcgcatagaagaagagctgcgagatagatactttagaagaggaggaaacggagaacaagtggagctgcaagtaacaatgacaacaacaaggaccgcaagggcagacaaaaagacacgggggggggggttacagggaaccaaattttgcagaccccgtgagcaaagcaagaagcatttaaatggggcggcaaaaaaagaactaaaggggggtggataacacattggtgggggggaaaaccttggctggcccgacctaaatggcttggcggaccacaccctgttcgccatcggggtgaaaaggaagagggccctcaacggggcccttcccacagagggggacatcttaaagggaaa

SEQ ID NO: 6140 - DNA, 436 bp, Gossypium hirsutum
  unsure (1)..(436): unsure at all n locations
  Clone ID: uC-gsronu33B016b04b1
gcagtagacggcctgctgaggattggactaggacatgcaaaacttaaggccagccgaactggatttaaaccttacaaaaggtgttctgtggaagccaaggaaaatagagtgatgaacaccggcagtcaaggtgaagagagaggtcccaagagggtacgattagaaggggaagcttcgacttgacttttacgctattgcatgcaattaacaaatgcgatgtttgtttgttcaatgcaatccctaatttttttttcccatatcttatttcctttttatatgttgatcttaaagactagcattacattgcagctcacgagacgctttcgtgtggtggngttgtactatctaatatctacattgacttaatcgtctttatagacttttttgaattaaaaactcctctgagatagaagcatgaaagtaagtactgaatctt

SEQ ID NO: 6141 - DNA, 453 bp, Gossypium hirsutum
  Clone ID: uC-gsronu33B016b08b1
tttttagctttcgtgtttgtctattgaattctttccttcactttctcgagaaaaaaaaatgtcttcaggttgcaattgcggatctagctgcagctgcggcgacagctgctcatgcagcaggaaccttaaccttggatactcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagcaataacaggcctctgtaatgatttattttcaaggatgaatgcctgcaaggtctatgactataattatgtctctgtctgtgtcttgtgtaatagaagctttgtttgtggtgaaaataatgtataag

SEQ ID NO: 6142 - DNA, 463 bp, Gossypium hirsutum
  unsure (1)..(463): unsure at all n locations
  Clone ID: uC-gsronu33B016b12b1
tgtttctctcttctatattttcccaagattattttctctttcctttttttcctccctattttttttctcgggaaaaaaagactttttttccggtatacccagatcttgtttaggtccaagctttaggttgtcatcgctttctcgaggttttaaactatgggtatctcttgaatttgcgaagcaaagggagaaatattggttaaaaactagtagcagggtattgaatcaagttttacaaaaaaagaagttaaaaagaaagatgaaaatccagtgtgatgtttgtgagagagctccagcaacagtgatatgttgtgcagatgaagctgcactttgtgctaaatgtgatatcgaagatcatgcagctaacaagcttgctagcaaacaccaaaggcttctggtttaaaggctttctaacaagcttncttcttgtgatatatgtcaagaaaaagcagcttttatcttt

SEQ ID NO: 6143 - DNA, 494 bp, Gossypium hirsutum
  Clone ID: uC-gsronu33B016c07b1
cccacgcgtccgcaattttatccaacaccttgtaccacaactttcaaacttaactttttcttttcttttctttttttcctttttgtttttctttttatggctgccactacttctctatctctactgccttcatctcttggttttccaaatgaacgcccttccagcacttcacaatcctcttcatattcttgttcttgttctgttttcttcaatgctgggacccgtctcaggtcccacgacagcttcgcttgtgtgacttttccttcttcttcctctacatgttattggagattcaataatagggctggtactcaccggtttgggaccacggtggtggctgcttctggggactattatgctactcttggcgtacccaaatcagcctccggtaaagaaattaaggccgcttatcgtagattggctcgtcagtatcatcctgatgtcaataaggagccaggagcaactgaaaagtttaggagaacagtgctgcatat

SEQ ID NO: 6144 - DNA, 476 bp, Gossypium hirsutum
  Clone ID: uC-gsronu33B016c10b1
tacattttcgatattaggtacaatgcttgcaagccatcccaatcaatccgatctcatcacagacgagtcttcaaagctgtatggcatcactctttaccccttctcatttccatatcttctgatcttcaaatcggactgcacaaaatgtagaagtacctttctgtatctgacagcatgttcgttcccatgagagagcaacttccgcatttgctctcattttgctctgttgctgcttgatcctcgtttttgcttttgaactgaagtcttgcaactcatccaagaagaggagttggtcaatgaacatgtttttgattctgaagctaaacttatacagtatcgacaaaccagtacggaatctggattttattgaatcaggggaaaacgtatagctcaagaatgctcaaaatttttaatgttttccctttttttggacgttacaagtaattggtgaagctctactggcatatatatctact

SEQ ID NO: 6145 - DNA, 362 bp, Gossypium hirsutum
  Clone ID: uC-gsronu33B016d01b1
ttccttatggaaggctaaaggctcaaagcaggtaggtgaagcgatagatcctaggaagaacttgatcactttcagagagatagacggagatcaactgaaagagtataagagctttgtagccacgcttcaagctttgcctaagaacaagggttgtggcagcatagtgcactggactgtggaatacgagaaactgcaccacgggattgcacatcccgagactctgttgcaattcttggtggatgcctccaaggacattgacgcttaccttacccaaccaaactaaaggatcgatttagaacatcccatgtccggactgctcacttctactacctgaagcagtccttacctaattaagaataaat

SEQ ID NO: 6146 - DNA, 191 bp, Gossypium hirsutum
  Clone ID: uC-gsronu33B016d05b1
aaatttaattaaaaaaaagggcggacgaatatagaggaaccaaagataacaaaacacatgcatgcaacaacataaggggtggatggtgtcacgtaaccaagattccctgcccgtcgttgcacagcgttcgcgtctggtatagccctggctgaaacccaatttaatggccttgcattaccatcccccttggc

SEQ ID NO: 6147 - DNA, 468 bp, Gossypium hirsutum
  Clone ID: uC-gsronu33B016d06b1
cccacgcgttcggaaactttgtatcaagggatgtccgatttcagatatagccatcgaagcactcggttccggttgtcccaatttggtaaaaattaaggtgaggaaatgtagaggagtgagcagtgatgccggcgaatggttgcgtgaacaaaggggatcgatgttgatcaatatggatgcttgtgacacagattgtgggttcgaggctagtgtcagtgacattggagttcatgaaaccggtgggaggttggccaagtaaccgctgttggtgcttccacgagcagcaatggtaggttagctttgttgacgtcaaagctggggcattttgctggtaggaatttagcagcaggcacgttgagaaggcggcctaattgtgatgataatttaaatatcaacctggcgaaaagatctaattgtagatgtttgggaaacttactctttggtttgatcctcatgcaggctttgaaa

SEQ ID NO: 6148 - DNA, 444 bp, Gossypium hirsutum
  Clone ID: uC-gsronu33B016e04b1
ctgcctcgcccggcccgtgtccggaccggactgggctcgacccacgcgacgcgttcttttttttgccaaaagactaaaaaagctaagaacagcccatggactatatgtaaaatgcgcatcccccaccaagttatatatagttactgaaagcagattgatgcagataaatctggcttttgcatttgatcttacagtgcagttcttgcctgtacctttactgaaggcctacttgaaggaagcaagaaaaagcttggggacctggttagtactggaaactacttttctactgcttagattgagtttagtgagcttgagttgggggcctcttaaaggccatgtatcaaggcgcattgttgaccatcatattgaggagcaaccccctgttgatccactttaaaagcgggttctcctattggccattggtcaagctggcaaaaaaggaaa

SEQ ID NO: 6149 - DNA, 556 bp, Gossypium hirsutum
  unsure (1)..(556): unsure at all n locations
  Clone ID: uC-gsronu33B016e06b1
ctcttaagccagtgcttttgactggaagcatgcaggatagtttcttcgctagctttgctcttggttggctcatcacaaatggtgctggccttgcatcttacccaattgacactgttcgtagaagaatgatgatgacttctggtgaagctgtcaaatacaagagctcgctcgatgccttctctcagatcttgaaaaacgaaggtgccaagtctctattcaagggtgctggagctaacatccttcgtgccattgccggtgctggtgtgctcgctggatacgacaagttgcagctcattgttttcggaaagaagtacggatctggtggtgcttaaatttagggtggtactatctcccttcttttgttatgttttaggttttaaagatggcgatgaaaagctcgacacattgagaaatttatttcggcaaaaaaattcattaataattcagatttagggggggaaaattactccctaaacgatttatacatttgngatgtgaaattttgatttacccatctcggattttggtttggttttaagaaagaagtgtggatgtt

SEQ ID NO: 6150 - DNA, 553 bp, Gossypium hirsutum
  Clone ID: uC-gsronu33B016e07b1
cccacgcgtccgaaagatgtagttgcgcctggcaaaatgaaacgaaagatcgtcaacccacgtattattcttcttgactgtccccttgagtataagaaaggggagaaccaaacaaatgccgagttggttaaggaagaagattgggaagttcttttgaaaatggaagaagaatacattgagagcctttgcttgcagattctgaaattcaaaccagacttggtggttacagaaaaaggacttagtgacttggcatgccattatcttagcaaggctggtgtcagtgcaattaggagggtgagaaagactgacaacaacagaatcgcaaaggcatctggagctgttattgtgaatcgtcctgatgaattgcaggaatccgatgttggtactggagctgggctgtttgaggttaaaaaaatcggggatgagttctttgcattcattgttgattgcaaagatccaaaagcttgtacggttctctaaggggtgctagcaaggatctcctgaacgaggttgaaagaaatttgcaggatgccttgtctgttgctagaaacat

SEQ ID NO: 6151 - DNA, 243 bp, Gossypium hirsutum
  Clone ID: uC-gsronu33B016e08b1
taatgagttcttgttatagacaagcttctttttttttttttacttggggtttaaatttttttgtatttggtctctttatgtttcaagggaagaaggtttgggtgaaaaggaagttggttttgccagatttggctatataattcagataggctagttttaactgaacgcccattctatttctatggtagtaagaaatgattccattaaaaaaaaaaaatcaaaaaaaaaaaaaaaaaaaaatat

SEQ ID NO: 6152 - DNA, 138 bp, Gossypium hirsutum
  Clone ID: uC-gsronu33B016e10b1
acccacaaaagcacaaacaaaagaagaagcacaacacacaggacgacaaaacccccaacgccccgaggggagtgaaacacacggaaagtagagacgcccagcccgagaccggacccgagaaaaccaagggaacaaaac

SEQ ID NO: 6153 - DNA, 698 bp, Gossypium hirsutum
  unsure (1)..(698): unsure at all n locations
  Clone ID: uC-gsronu33B016f03b1
tagaacttttgttcttgtgaggttacctcctctcttctttcgttcgagtctcgaagcgacttaactagcttgctagtggtgtcaatccgaactccattgaacttatcaccaaatcggtgtggcgttcaaccatcttcctatacctttggttcttacctccatataggtaacgggtcaaggtccgcttctatccttcatcaaaattcaccttaagcaatataagactcggggcaatactttttagtattgaatcattcttaaagtttgagttctttatccatttccacctatttatcatctttgtaacttaattctttgttaaaccgaacctatctttcatcaaaccaaaacccatcctttgaacccattttgcctaccttccgcttataaaacattcaaactccatctatctacaaatttgaacgagcttctcgtcgacgatcaggcatcttaagtgaacccgactcaatcaatcgggccggatcacatcatttggtatcagagctactaaaatgaggagcgccgacgttcgtaataaggccgaaagtaggttcgaaacgtgaaaaaaaaatcaaaaaaaaatttgaagtggaatttaattttttttccctggatttagctactatggnattggagtaccaaaaaaaatcaaaaaaattcgaaaaaaattgattgaaaaaatcaaaaaaagtgaaaaa

SEQ ID NO: 6154 - DNA, 526 bp, Gossypium hirsutum
  Clone ID: uC-gsronu33B016f04b1
ctcggtgaaagatcgattcatcagtcttcttctctaagtagaggttttggatttgtaagcatatacaatgtcttcgtcctatctcccagcaaccaccgactcaattgctcaggccttagaagccaaaacaccatctgaagccatctcgatcctttaccatgtaatagaaaatcctgcatctgctcctgacgctctacggattaaagagcaggccataacaaatctatctgatcttcttagacaagagaaccgagcagaggagctcagaagccttctgacccaactgaggcccttttttgcactaattccaaaggcaaaaactgctaaaattgtccgtggtataattgatgatgtagctaagataccaggaacatcagatctccagatttctctttgcaaagaagtggtgcagtggactcgtgctgagaagcgaactttccttcgccaacgagttgaggcaaagcttgcggcacttttgatggagaacaaggagtactctgaggcactgaatctcctttctggctaa

SEQ ID NO: 6155 - DNA, 538 bp, Gossypium hirsutum
  Clone ID: uC-gsronu33B016f06b1
gccgttgcttcttcatcctcgaaaccagggcatgagcttttactttttgaagctctgcaagagggtttggaagaagaaatggagagggatccccgtgtatgtgtcatgggcgaagatgtgggtcactatggaggttcatacaaagtgaccaaaggactggcaaaaaaatttggggaccttagggttcttgacaccccaattgctgagaactccttcactggcatgggaattggggctgctatgactggtttgagaccagttgttgagggcatgaacatgggatttctcctccttgcttttaatcagatctccaacaactgtggtatgcttcattatacatccggtgggcagtttaccataccaatagtcattcgtgggcctggtggtgttggacgtcaactaggggctgagcattctcaacgtcttgagtcatactttcagtcaatccctggaatccaaaaggttgcatgctccaccccatacaatgccaagggcttaatgaaggctgcaatcagaagtgagaaccctgttatctttt

SEQ ID NO: 6156 - DNA, 823 bp, Gossypium hirsutum
  Clone ID: uC-gsronu33B016f07b1
ttaaattcccaaaaatccatcgccaccaagaggaaaaaagtaaaagaaccctaccgacgatgttccggcaagcgtcacgcctcttggctcgaactaccaccccatggaggagaagtcgagcattttcgtcagatctaccagccacacccgctcaagattcgaacttcatcgaatcatggtccaaagtcatacccaacatagaccctcccaagacaccatcttctttcatgacccctcgccccgccaccccttctgctatcccttctaaactcactgttaactttgttcttccttatgcatcttagctctccgctaaagaggttgacatggtaatagtatcagcaacaactggacagatggttgctttgccaggtcatgtccctacaatagctgaactgaaaccagggaacttgtcggagcatgaagggaaagatgttacaaaatttttagctaagtcattgttttgggcagaaacaagcctacaatgttgcggattttattagatgaggtagcaggagcagggctttttggggtttctgttttttttcctaaaggaatatccaaattttgggaggaatgccttgaattttcttggctagaaaaagtgttccaacattttttttttttttccgcccttttgttttttacccagctcttttttttggctcaaaccgcccccttttagaaattgaaaaattatttttttttattttaaagtgaaatatttttttattaaaatgggtctctttccctggaagggccaaaaaggcccttttatatttttaaaatgaacctttttctttttaaactcctcttttttttt

SEQ ID NO: 6157 - DNA, 200 bp, Gossypium hirsutum
  Clone ID: uC-gsronu33B016g12b1
ttccacgcgtccgaaaaattccatcaatgtttcactctagcttttcccaatgctgttgtatgattctgtggcatataatctcaatttggaactaggatagagtcaatagaccgaatttcatgcacttgcatattatgtgacatcttctctctctctctctctctctctctgaaaatgaatacctctttgtttctttcttt

SEQ ID NO: 6158 - DNA, 553 bp, Gossypium hirsutum
  Clone ID: uC-gsronu33B016h03b1
cccactgcgttcggttacaaggtccaaaccgatcctctcaagaacacagttgaccctgactgtggtggtgttggtatcctgggtattgcttgggcctttggtggcatgatctttattcttgtttactgcactgctggtatctctggaggacatatcaacccggctgtgacctttggactgttcttaggacgaaaggtatcactgatccgagccatcatgtacatggtggctcagtgcttgggtgccatatgcgggtgtggattggtcaaagctttccaaaagacttactacaacaactatggaggtggggctaatgagctccaaagtgggttcaacaagggcaccggtttaggtgctgagatcattggtacctctgttcttgtctacaccgttttctccgccactgatcccaagaggaatgctaaggatttccatgttcctgtgttgggaccactccccataggatttgcagggttcatggttcaacttgcacaataccggtcaatgggactggtttaaaccctgctaggagctttggagctgctgtgatata

SEQ ID NO: 6159 - DNA, 603 bp, Gossypium hirsutum
  Clone ID: uC-gsronu33B016h04b1
atcgtttagagctttcctttttttctctctatattttctcatctccttttccaccgccgtcgatctcgatccttatccccgttttcaaaaaagctccaaaaagatggccaatgctgcatcgggaatggctgtgcatgatgattgcaagttgaagttcttggaacttaaggcaaaaagaacccaccgctttattgttttcaaaatcgaggagaagcagaagcaagttattgtggagaagcttggtgagccaaccgagagctatgaggattttactaaatgtcttcccgctgatgaatgtcgttatgctgtgtacgattttgattttctaacggccgagaacgtcccaaagagcagaatctttttcattgcatggtctcccgatacatcaaggatcaggagcaaaatgatatacgctagctccaaagacagattcaagcgagaactggatggaatccaagtggaattgcaagcaacagatccaaccgagatgggtctcgatgtcttcaatagccgtgctaactgaatacagttctttaggctttttgcacggggtagcttcctttcttctacagtatgtcttttacttaagtgaaatgtttatag

SEQ ID NO: 6160 - DNA, 424 bp, Gossypium hirsutum
  Clone ID: uC-gsronu33B016h06b1
ctcatacgttggcttgcatgttgtcaagctatgcagatactactgcagagggcactgtgggggttaccattggtatgggaagtgctgctggttgacgcgcaagataagttaattgacacgtgatggtacactagagggtgttaaacaatgaactggcgtgagaaatgccgagtacattgcagtgtatgaggatatgtaacccgctctggtacccaaacttgaaaggtagtgtgagactgtgaatgaaatggttacccaaatgcttaattatcctttaggtctgacttgcatacggagcatgatacccctaatgctcatccaaattctattccatattccagaattcaatacagtggtcaggaaactgatcaggcttatcatgagaagtgctccagggttacttccacgtcgactagctaggggc

SEQ ID NO: 6161 - DNA, 505 bp, Gossypium hirsutum
  Clone ID: uC-gsronu33B016h08b1
ttcattcgtccgcccacgcgtccggcagaccaggaaaacctatgaacaaaaatgttctcaaatgagaaaccgcaacactaaacgagatggcctctattctggtgacaaaactcgagctgaagtaaaagacttgcatagcagaatcttggttgcaatacgaagtgcagaaacaatctccgaaagaattgaaaaactgagggatgaagagttgcagccacaacttattgagctgctacacggactaatgaggaactggcagataatgttggaatcacacgaaactcaaaaccgaatcatgtttgaagtaaagtctttcaactgtcccacttacggaaagttttgcaacgactctcaccgtcttgctactcttcagctcgtggcagaacttcataattggcgttcttgcttcgttgcgtatttatgttcacaaaagtcatacattgaagctcttagtggatggcttgcaaagttcattgcacccgaagtagaattatgctccaagaag

SEQ ID NO: 6162 - DNA, 100 bp, Gossypium hirsutum
  Clone ID: uC-gsronu33B016h09b1
tttattgatccacgcttggtatgtagccacgcccaagacatatggaccgaggggaagaatcgacaaggaatccataacaaaaaaaaaattgtgcaaaact

SEQ ID NO: 6163 - DNA, 443 bp, Gossypium hirsutum
  Clone ID: uC-gsronu33B017a02b1
tctttatttacgccttctttcttcttcttcttattcctttattgctttttagaatttttcttaatcgaaaatgagagagtgcatttcgatccacatcggtcaggccggtatccaggtcggaaacgcttgctgggagctctactgtctcgagcatggaatccagcctgatggtcagatgccaagtgacaaaactgtcggaggaggtgatgatgcttttaacacctttttcagtgaaactggtgctgggaagcacgtccctcgtgccgtcttcgtggatcttgaacccactgctattgatgaagtgagaactggtgcttaccgtcagctctttcacccagaacaactcatcagcggcatggaagacgcagctaacaactttgcccgtggtcactacaccattggcacggagattgtcggcctctgtttggaccgcatcaagaaac

SEQ ID NO: 6164 - DNA, 302 bp, Gossypium hirsutum
  Clone ID: uC-gsronu33B017a03b1
aaattatttgaggagcaaggctgagcctgcaaaaaagaaggtcaaaaaataagcatttgcaaccaaagatcacatctcatttcgagagagtggtgattcaggagaaatatgggctgaaaggaaagcaatgaaacacggaagaaaatgttttgaagcctcatttcttttgttaaatgattgtaggattttgtttggtcagcttttggcctgcacaattgttatgaaaaattgatgtttttagttatccttacataatggtatactgatttgaactcagaattttcagttgacaaacaacggtt

SEQ ID NO: 6165 - DNA, 403 bp, Gossypium hirsutum
  Clone ID: uC-gsronu33B017a04b1
ccctcgtgttcgagcgggtgcaatcccaccattgatacaaattctggaaggcaaggtaagggaagccgatgaagcggttgtgaatgcacagaggaaagctattgcaagacgaaatctgggaaaacggaagcgattacattgctaaaaacgcaggcgtggaagcgattatcaaaatcatggaaaccgcaagtgtgaaggctcaggaaaaagcgctttggatattggaaagggtattcggagtagaggaacttagagtgaagtatggggaatcagcgcaagtggtgctaattgatttagctcaaaaaggtgatcccaggctaaaatcaacgactgcaaaattgttggcccagcttgaactcttacaatttcagtctagttacttttgagactaccattccttaat

SEQ ID NO: 6166 - DNA, 283 bp, Gossypium hirsutum
  Clone ID: uC-gsronu33B017a05b1
gagttttctgtttcaatcgtccctcaagagaaactgtcacgaaaaaagacattgggtcttcccaaatcttggctttgcattgatggcggatctcaggtcagcatttctcaatgtgtattcccagctcaaatcggagctccttcaggatccttctttcgagtttaccgatgattctcgtcaatgggttgaacggatgctggactacaatgtgcctggagggaaactgaatcgtggactctctgtgattgatagctaccgcctgttgaaagatggaagggatttc

SEQ ID NO: 6167 - DNA, 442 bp, Gossypium hirsutum
  Clone ID: uC-gsronu33B017a07b1
tattctatttttttaagaggtgaaggaaaaaaaaatggaagattcatcatcaaagtcgttcttgagaaagcaatgggatgaatacaaagaattctgggccgatcgatttccgttcactaatgtctattcaagatacatcggccgtgaacagtcccttccttcatggtctgaatccgatgttaacgagttcatcgcttctgatccggttcatggacccaccttgaagactgccagggaagcagcaaacatcgccttatacggaagtgctatcggagctatcacaactgcaggttttgcctggaaatactcgaagagtttacatggtgctggactgtctttcgtaggaggagccgcttttggttggacatttggacaagaaatcgcaaatcatgcgtatcaactctaccaggttggacacaatggctggacaagccaaatttat

SEQ ID NO: 6168 - DNA, 872 bp, Gossypium hirsutum
  unsure (1)..(872): unsure at all n locations
  Clone ID: uC-gsronu33B017a10b1
ttatctttaacgcattgagatttatgtacttcgattatctatttcattcgaactgttcatacacaattgccaaattgttgcaattcaaaagaaaactgaaattactctttaatttccttagntnaaaaaaaaaaaaaaaaaaaaaaaaaaaaaaaaaaaaaacaaaaaaaaaaaaaaaaaaaaaaaaaaagaaagaaaaaaaaaaaatagccataaaaaaaaacctgggggggggcctttttgtggtcgctagcttccgcccgctgaaagatggaaagggaattgctctttaaggcaaacatatttccatcaccgggccgtttgtttacaagaatggtattggggaaaacccttgtgtttttaaaattaaaaagcctggaccaaccccccctttaaacagtttgtttttttaaaaggcccagtttttcccccctcctcacaattttgcagcttttattgtgaatttaacccccccttttttaaaaatttaaattcggggggggtggggggttttgtcaatttttctcttttttttttcgagggtctttaaccccccccttggaaaatttaattttttttttccacgggggggtttttccggaataatttaattaggggtgccccttcagggtcttttttttttataggccccttccccaaacaaaatatatgtgtgtttcctaattggcccccaaaaaaaaaactatttctcctgggaaagaacatctttattaatatttttttctctatataaaaaaaaaacactttattttttttttgtataaaaagtccccttcttcataaaaaagaccaaaacaacactcccgtttataaattattcttatgtggttttgagaaggcccttttttttt

SEQ ID NO: 6169 - DNA, 533 bp, Gossypium hirsutum
  Clone ID: uC-gsronu33B017b01b1
gaatttcattgtttggtggtgctcgcccacgagaactggttctaaaggaaagagggatagatgatagaaatcatgagccagttcaacatgttgatagggtcaaacataatgttacgaggactgaaaaagctgctgaccatgcatatggtgaaagagtcgagaatcctcctgttgatcagagaggtggaagaaaatctgagaggaaccatcgtgttgacaatggaagagttgacatgcagaggaggaattggcgaaatgaaaataggcggaatggccgggaaactgaaagaccgcagcaagcaccgccagtgaaggagaggcagccttcacctgagacttggcgtaagcctgtggagaatactaatccagtatctgctcaggtggctggtgtacgttatggaaaagtaacatcagctctggagcttgcccaaagccttttgaaatcattcttcgatcagaaaaagatgaccatttggtgggcaaggtgtacaccgggccgacccaatgccatctctcggtgatgggtccacttc

SEQ ID NO: 6170 - DNA, 452 bp, Gossypium hirsutum
  Clone ID: uC-gsronu33B017b03b1
ccctctcttccgggaagcaacagcaacgaaagttgttggtacatttggttatttggcaccagaatatttgagtgatggacttgcatcatcaaaaagcgatgtgtatgcatttggtgttgttctgtttgagattatatctggaaaggaggccatcatacggactgaaggcagtgcgatgaaaaacaccgaaagacgttcattggcatctattatgttagcagctctccggaacacaccagactcgttgagcatgtcaaacatgaaggactatattgatccaagtatgctggatctttaccctcatgattgtgtcttcaagatggctatgttggccaagcaatgcgtggatgaggatcctattgtacgaccggacatgaaacaaattgtgataaacttgtcacagatcctattatcctcagttgagtgggaagcaacacttgccggtaacaccc

SEQ ID NO: 6171 - DNA, 324 bp, Gossypium hirsutum
  Clone ID: uC-gsronu33B017b07b1
ttctctcgtacgcacaagcggccgaccaatgatgacgtataataaaggagacaagagataacctggcaaacccaggtttgagaacataacccttgatgcttgacttgttgttaggagacagggagctccgggcgtcaaggcgaagaccatgcttgactgatatccaaaagacccacaggagccgacaactccactacaggatgcttgttaaaaacacacgctagaaggggggacatacggttcaatgagagatacacattgggcgccaccggtcattgaacattcggtagatggatttgacaagtcaaatgacaagctggtgtt

SEQ ID NO: 6172 - DNA, 342 bp, Gossypium hirsutum
  Clone ID: uC-gsronu33B017b08b1
tttctgtccatcgaactctttccttcactgtgtgttgataaagaaaaagacttcaggctgcaattgcggatctaactgtagctgcggcgacaactgctcatgcatcatgaaccttaaccttggacactcggagaagacatccagtactcagaccattatctccggagttgctccagtaaagatgacctttgagggaccagatatgagcactactgaatcaggacatggatgccgctgtggatcaaatcgcttatgtaatccatgcctctgctgaaaaagctttatgaatgccatagattatgaaacaagaaagctgctaaatatcaggcctcctgcatgatt

SEQ ID NO: 6173 - DNA, 278 bp, Gossypium hirsutum
  Clone ID: uC-gsronu33B017b11b1
ttttttaagaaagcagcaaaaataacaggcctctgtaatgatatattgtcaaggatggatgcctgcaaggtctataattatgtctctgtctgtgtcttgtgtaatagaagctttgtttgtggtgaaaataatgtataagccatttggttgggagcaaattgtccttttctccaaaggatttttgctgctcattcatggtgacttggtttatggttttatctgttgttgttaaaatcttataaaaatatatatcggttgctgctcttggtttgtctcac

SEQ ID NO: 6174 - DNA, 584 bp, Gossypium hirsutum
  Clone ID: uC-gsronu33B017c02b1
tcctcgcgttcgcccacgcgtccgcgccatagcaagcgcacgcgccgctgaactttatggacttcaaatcctagccgatggtatccaagacgattcgagtaatgtgacgcgcttcgttatgttagctcgggagccaatcatcccgcgcactgaccggccattcaaaacgagcatcgtattcgcgcatgataaagggacgagcgtgcttttcaaagtactatcagcgtttgcgtttaggaatatcagtttgacgaaaatcgaatcccggccacaccgcaataggccgatccggttggtagatgacgccaacgttggaaccgccaagcatttcgagtatatgttctacgtggatttcgaagcgtcgatggcagaagttagagcccaaaacgcgttggccgaggtccaggagttcacttctttctgagggtattgggcagttacccaatggatatgacgccttggtgccctttcagcggagaataacaaaacttatgaaaggtaaaaataaaaaaaaggaattatttgcacaaaaggatattgtgaaatcaattttatttacccttatttttttgggatcatgagaa

SEQ ID NO: 6175 - DNA, 580 bp, Gossypium hirsutum
  Clone ID: uC-gsronu33B017c03b1
cttgttagatgttcccgtgcggttgccaatgcttgagttattgtctgtaaaaacaaacatcgaatgttttagtttggtggcgatggttatcaatattttactagttaaaagaactcaggtgctcttttcaggggggaaaattggaagaagattgaaaaagagggagggagttgagcattgcttgtttcgggtacaaggatcgtagtacctgttcagacaaaggagctccagcatccatgctgtgactagcaacctttccggctataacatttgcatcagtttcgagaatgatgctgcacaaagataaagaacagtcaaacagggataagagataagcattgtcacgggggcagttgcttcgggtgaccgccccttatcattctttttctttttctctctttttctttttatagagacaaaccgctataaggtactataagtgattagtgcagcatccatatgtttaacctagtctaccatcaccgtgtttgccagtaatttacgaaggtgcggatggagaatcaagagacattttcagccaagaattgtattggtttaatgaaatatttgcaaaacccac

SEQ ID NO: 6176 - DNA, 379 bp, Gossypium hirsutum
  Clone ID: uC-gsronu33B017c06b1
ctggctcctacttgatcaacacatggtctgatatggctggttgtctagaccctacaattccaccatccattgatcggacccttcttttcgcccgataccccccacatccctgtgtttcaccacattgaatattaaccaccaccggcaatgaagatttcacccgtgtccaccggttctgaaagcacagaagccttcattttcaaattgaccctggatcaactcaatgcactcaaagcaaagtgctaggaagatggtaacgctgtttactattatgtcatacccaatgtcttcaggtaaccgagtggggacccagtctgcaaggcacgtggacttgaatatgatcaagggactatactgtacacttgccaccgagggaagg

SEQ ID NO: 6177 - DNA, 475 bp, Gossypium hirsutum
  Clone ID: uC-gsronu33B017c11b1
tcctctcgtccgcgagggctgcatttggaaagccgatttaataataagctttggcgtatggtgcattcatcggatccttgatctttcgctgatggaaagccgacccgagctgtggggaaaatacacttacgttcttaatcatctccagggtgtcatagatccggcattttcgaaaccccgttccccaatgttatcctgcttctgccttcaaatcccggcagattaccagcaaaggtcgagtcctccagtttcaaacggaatgttgcccccaaccgcgaaacctggccggggcaagtgtacgaatgcagccacactcttggatataatcaaggacgtggagatcgctatttcttgccggaaaggtcgatcgggcactgctgccggcgacgtagctttcccgaggggaaaagagaacttggcttctgttcttaaacgctacaaacgcagattgtccattctagttggcacacatgaa

SEQ ID NO: 6178 - DNA, 469 bp, Gossypium hirsutum
  unsure (1)..(469): unsure at all n locations
  Clone ID: uC-gsronu33B017c12b1
tttttaacaacagagaagaaaacttcatcaaacaaggaaaaaacttgaagtaaaacaattgagagaagatgtcgtggcaagcgtatgtcgatgatcacttgatgtgtgatatcgagggcaaccatctctctgccgccgctatcattggccaagacggcagcgtttgggcccagagctccaatttccctcagttcaagccagaagaaatcactggcatcatgaatgactttgctgaacctggatcgcttgctccgactggattgtaccttggtggcacaaaatacatggtgatccaaggtgaacccggagctgttattcgagggaaaaagggccccggaggtgttactgttaaaaagaccaacctggccttgatcattgngatctatgacgagccaatgactccaggccagtgcaacatgattgtggaaaggctttggtgattatctcataaaccaaggtctttgatcac

SEQ ID NO: 6179 - DNA, 367 bp, Gossypium hirsutum
  Clone ID: uC-gsronu33B017d07b1
tcctttcgttcgggggaatgtgtcataaccgtttgctaaaaccaaggcgaccaacttgatccgacgggcgataatattggcatcacgagtgccatcaccaaaggcggctccggcgtctaggatggtggtggttaggcctgtctctagcgaaacagaagctctataggtggaaccagaagccgtcgcctacttcaacatgaagaccgtacaaatctaccgacggaattccagattaccctaccaaaccccaggtccatgactacaaaatcgacttaaaagaatgcgggcctatggaccatgacgccctgattaagatgaataacgagaactacccgatgctcacctttcgtcggtcctgcccgggagg

SEQ ID NO: 6180 - DNA, 436 bp, Gossypium hirsutum
  Clone ID: uC-gsronu33B017d12b1
tctgtctcgtgggttccttcttacccagatctataattgattttggttgtaaaattatttacatttgcagggaccccaaagatacatttgtttcattgtatcatttcattgcagggcactgcaaatccaaaaatgctcaacccattcaacttgatgaagcgttcgaattgttttatgaaggtgtaagcccgtttggcccttattgggaccatgttttggggtactggaaagcaagtttcgaacatccagacaagttaatgttcttgaaatatgaagaactggttgaagatactgttttgtatcttaagaaaattgcagagtttatgggttatcctttctcgtcagaggaacaacagcaaggggtgcctgtaaacattgtacagttgtgcagtttcgacaatttaagtggcctggaagtaaataaaaccgggaaaca

SEQ ID NO: 6181 - DNA, 453 bp, Gossypium hirsutum
  Clone ID: uC-gsronu33B017e01b1
gcgatattctcgttttgttagttcgtgagtgaaacaggtaataaaaggaaaaaaaacgatgggtgttttcacatttgtttgcaggagcaaaggcggtgagtggtctgccaagcagttggagggagagattgagagctctgctgcttccacttacgagctccagcggaaacttgtccaggccgccaccgcctgcgactcctctggtggtgtcacctcctctttctctgtcgttacccctaattctgccgttttccaggtggttattggaggtgctgtaggcggagccttcatcgggggtggaggagctgctgccgctccggctggaggcgctgccgctgccgctgaagctcctgcagctgaggagaaaaaggaagagaaagaggagagtgatgacgatatgggattctcttcttttgattaagctcctttactgccttactgcccgtttagatc

SEQ ID NO: 6182 - DNA, 435 bp, Gossypium hirsutum
  Clone ID: uC-gsronu33B017e02b1
catatttatgcaatgacattctctcagtcattgataagcacctcattccatcttcctccaccggggaatcaactgttttctactataagatgaaaggagattattttcgttatttggcagaatttaaggcaggagatgatcgtaaagaagctgctgatcagtcacttaaggcttatgaggctgccacttccactgcaagctcagatttgcctccaactcacccaattagacttggcctggctttgaacttctcagttttctactatgagatattaaattctcccgagagggcttgtcatctggctaaacaagcatttgatgaggctattgccgagcttgatagccttaatgaagaatcttacaaggatagcacccttatcatgcagcttcttagggaccaccctaccctgtggacctcggatctgccagaggaag

SEQ ID NO: 6183 - DNA, 458 bp, Gossypium hirsutum
  Clone ID: uC-gsronu33B017e03b1
aaggaattcccagttatggaagaggacatggaacaagagaaacatgtgctctacacactgccaggctttcttgcgacaccttggtggatttctggtcagctcttggagaagaaactcggcaatctcttttaagaatgaaggaagaagatttcattgagaggctcatgtacaggtttgacagcaagagattttgcagagattgcagaagaaacgttatccgtgagttcaaggagctgaaggagctaaaacgcatgcgtagagaacctcgatgcactagttggttttgtgttgcagatacagcctttctgtatgaggtatctgatgacagtgtccaggctgattggcgtcaaacttttgctgacacagttggaacttatcaccactttgagtgggcagctggaactggggaaggaaaatcagatatcatggaatttgaaaatgttggcatgaatgggact

SEQ ID NO: 6184 - DNA, 306 bp, Gossypium hirsutum
  Clone ID: uC-gsronu33B017e08b1
ttccttctcgtccggtctgagggctgggcacgggggtcccagttctgaacccgtcggctgccggcgcactgttcgagctgttcccgcggcgagagcgggtcgccttgtgccgtccgggggactgactggtaacggctccctcgtgggccttcctcggtcgacgaacaggtcattcagagctggcacttgacaaggggaattcgactgttttaccaaaacacacaatttgacttgggcctggctgatgcttacgcagtgttgtttatgagcatattcaaattcatgccgagaggggcttgtcatctg

SEQ ID NO: 6185 - DNA, 496 bp, Gossypium hirsutum
  Clone ID: uC-gsronu33B017e10b1
ttttctcgtccgcccacgcgtccgctcaactcggtcctgctgagcggttcctaaaagttttggtcgacattccttttgcttttaaacgaatggaagtgctgctttatatgtgctctctttacgaggaggttacttttgctagagagtcttttgaaacattagagattgcatgcaaggaactcagaagtagccgcttattcctcaagctcttagaagctgttcttaaaaccggaaatcgcatgaatgatgggacattccgtggtggtgcacaagctttcaagctcgacacacttttgaagttatcagatgtcaaaggagtagatggtaagaccacgctattgcactttgtcgtccaagaaattatacgcacagaaagtttaagagctgcccgtgctgcaagagaaaacaaaagttctctttcttgaggatgtttcccccgatttggaagagcacttccataccctgggcttgagggggttcacgtcctaatagtgaa

SEQ ID NO: 6186 - DNA, 459 bp, Gossypium hirsutum
  Clone ID: uC-gsronu33B017e12b1
ttcctctcgtccgcggagagggtgtgcaggattaaagggtcaccattgtttccaatatgatgcttaataataagtttttgttcttatcagctttgttttgcattgctgtagctggcgttttaggccaagctcctcctactcctagtaatcctccgacatccacgccggcgccgccgactccacccgcttccacacctccacctactactcaaccacctccaacacccacaactacttctccgccaccagcttcctttcctcctcctacttcatcaccaccaccagtttccactcctcctccagcgactcccccgcccgttagctccccaccaccagcttctccttccccggctactccacctcccgcaactcccccaccggcttcttcaccttcggctaccccaccacctgcttttcccccttctgctacttcttcttcagctaccccaccaccagctc

SEQ ID NO: 6187 - DNA, 523 bp, Gossypium hirsutum
  Clone ID: uC-gsronu33B017f01b1
ggcctgttccaaggtaatcctgaaattgaaagtgcatgtactaaagatccactcaattccattcaatgctttaaagcacacagccctcctgaatttgcctttcaatctttaggggggttgaatgtatcagccacattctcaatgcccgaagcccttctggctacagaatgtcaagagccctttgggggtatgctagtagagggtgccggaagttctaaagacttgagaaacttatgcccttcagcagcggaagccgccgtagatgagacaccacctccatattctgatctggctctcaagcaggccacaactacttatactcgatcaacacccaatttaacagctaggcaggaaaaaacaagtgtgacggtttaggctacatacagagaagatataattagatttcggatctccttaacttctgtatggtagaactgaaagaggaaagtgccaaaaagcttgaagctgatgtgggtacttttgaaacaagtttttgatgaggataatgatggggtttgatagc

SEQ ID NO: 6188 - DNA, 424 bp, Gossypium hirsutum
  Clone ID: uC-gsronu33B017f04b1
ccctcttctttccgcgggtgtttgttcttctgtagagaatggagatctcgagtctgctatggtaaatcgtaaatcaaatgccatgggacgaaagaggaagagagaactggaggaaacatgtcaaaaggttggcagtgatggctctattagaagcccatgcgaagggctgaggccaagggctcggaaagatgcactccagcagttttgatgcagacaaagcatcctcagaggggctgcagacaaaagagacgaggaaaccttcaactcatgcccataggaagataatcatcaaaaaagggtctcatggatgtgacctggaaggctggcatatgagtttcaagacatatgaagagttgtggttgcacaaacgccatcggtgtccgtacgaaggcttgggaaagaagtttcgttcccacaaaatgca

SEQ ID NO: 6189 - DNA, 542 bp, Gossypium hirsutum
  Clone ID: uC-gsronu33B017f10b1
ttttttccttggggattcttggggcaggaccatcagataaacgtcttgttagtaatgagagaccgtatcggatgcattaaattggatttgcacaaaggcaatgctttccacggggcatcaactacagtaagctttttgtgctgtgctggatgatacttgagcctttgaataatgggtgggattcttttttgggcatggaaataaaagttggtatttaaagttgagtgcttatgggtggatttaaggtgtatccaccaggcgggatttgaatccatgtaaaaagtcggctgagctaaaaaaggttttactaacatgtgcagggcatgccggagcggcctttccacaattttttttttttacagtttctttttggtagtgaatccagtaatttgtttaattgtatagctcaaaagtggcaggagaaaaaaaaattgaaatgaatatgccaggaaaaaagtggacattatcagttttgaatatttttatttgacaacattaaaatttgtgggcataataatgggtgcgaatttgcttgctttttt

SEQ ID NO: 6190 - DNA, 409 bp, Gossypium hirsutum
  Clone ID: uC-gsronu33B017g01b1
tcctctcttccgcccacgcgtccgctcaatttattctctaagaatatgaatacagcagttgagaactttcagttagttctggattcgcatcgatgggttccattaccagcagttggcttttcagccactagcatcagtgaagaaagtcaggaggatgtaacgccaccatcttatttgatggaacatccgcctcttgctgtgtttgttaatggtgtttccgccgcaatgaacgaactacgttcttgtgccccagttagtttaaagaatgttctatctcaagaattaattaaaggattgcaggctgtttctgactccctacttgtgatacaacgtctcttggatgcttagagaaaacgatatctgggctttttcctttccctttgccgagcaattattgaggccgttttcc

SEQ ID NO: 6191 - DNA, 286 bp, Gossypium hirsutum
  Clone ID: uC-gsronu33B017g07b1
ttcatgcgtccgccctttcacgctggttgacggagagccttatcctttagacatgagaggcgagctggatgacactgctgctttcaagaacttcaagaagtggggtaatatcgaattcccaatgccttttggaagagttatgagtgcgaccgaatgctatattcacgggctagacgagaagaccagggcatcggtgaaatttacggtgttgaaccctacgggacgcattttctcaatggctgttccccaaggtgcaagtgtcatcttcgctgatacgggatggaga

SEQ ID NO: 6192 - DNA, 416 bp, Gossypium hirsutum
  Clone ID: uC-gsronu33B017g11b1
gattcaccattgtttatttcaagcacaatgatatggaatctctagaaaaaactcttgagaaaattacagcacagaacatgcgggctaagaaattacggcgctacattgtggttgaatctgtgtatcagaattcaggtcaaatagctcctttggacaagatcatcaggttgaaagagaagtatcgcttccgtgtcttattggatgagaccaactcatttggtgtacttggccgtactggaaggggtctgactgaatactgcggggttccgatagagaagatagacattgtcactgctgccatgggacatgcattggcaacagaaggaggattctgcactggaagtgctcgagtcattgatcatcaacggttgagcagttctggctacgtcttttctgcatctttacccccatatttg

SEQ ID NO: 6193 - DNA, 429 bp, Gossypium hirsutum
  Clone ID: uC-gsronu33B017g12b1
ccctctcgtccgctcctctgtttcagaatcaaaatctctctttctcgtcaatatggcagcaaatggcgttgtttctgacaagagcttgatcgtcagcttcggtgagatgctgatcgattttgtccccactgtctccggtgtttctctagccgaagctcccggcttcctcaaagcccctggcggtgctccggctaacgtggccattgctgttgctagactcggaggcaaagcgtcatttgtcggaaaacttggggacgacgagttcggtcatatgctggccgatattctcaagcaaaacagtgtctccggtgacgggatcttgtttgaccaaggcgctagaactgctcttgccttcgttacgttacgcgccgacggagagcgtgagttcatgttctataggaatcctagcgccgacatgctgttgaagcc

SEQ ID NO: 6194 - DNA, 280 bp, Gossypium hirsutum
  Clone ID: uC-gsronu33B017h03b1
ccccttcctttttgtgtttgattttactacgttgctgatttttgttttctttgcattttccttctttaagttatgaagcagaatagaaaagctttattgctcgggttttgaggttcggttggggaacttgttttcattctttcccttgcccgctttgtcaaaaacagtcagttttatgcatatcgatatttaagtttgtatgctgtaaaattgaattggattgatcatgtttctggtttatatctcctatcaaaactctataaaccataactatgtcggc

SEQ ID NO: 6195 - DNA, 448 bp, Gossypium hirsutum
  Clone ID: uC-gsronu33B017h09b1
ttcctctcgtccggcaccatagcaaaaacctcaagtaaacaaatagaaactccaaaaaggaatcgaaccgcccttctaaaatcatttcaccaactcctcagttaacgaaaggcccccgagattcatagatttaggaggcttttagcctttgaacctcctctaactattgggtcttctgcaaaccaaaccatgtctgacctagacaggcaaatagagcagctaaagaagtgtgaacccttgaaagaatccgaagtgaaagctctttgtctcaaggccatggaaatccttgttgaagagagtaatgttcaaagggtcgatgcccctgtaactatatgtggtgatatccacgggcagttttatgatatgaaagagctttttaaagtaggaggtgattgccctaagacaaattatttggttcttggagattttgttgacagaaggttttact

SEQ ID NO: 6196 - DNA, 430 bp, Gossypium hirsutum
  Clone ID: uC-gsronu33B018a05b1
gtaatatccgacgaaattgccgtgaaggaagaatgggaaggtggagtcaattcgtggttgcggtgactattctggcggtgggcctcctttcggcatcagccaccgctagaccctgcaagacattcttcgtcgcctcctattctttctcttttgaaaaccctaacgacccttcttcctccaccggattcgtcaccgtcttcaccgagatcggtcaattgaacgtcgtaccaccaagacccaagccctccgatgtcttgagctctctccgtgagcgcagtaaggacatccttagcgtggtcgtcgctcttctcttcggcgtcggtagcggcgctctcacggcggctaccctctacttggtctggaccctcttctcggcccggtctgattatcatcgtgcttgtttggaggatgatgagagcgacggagaact

SEQ ID NO: 6197 - DNA, 456 bp, Gossypium hirsutum
  unsure (1)..(456): unsure at all n locations
  Clone ID: uC-gsronu33B018a09b1
cccaccaccagctcctttggcttctcctcctgccacggttccagctccggcccctagcaagaccaaagctaagtctccagcactatcaccttcggcctccagcccaccgtctccatcaaatgaggcccctactcccagcctcggcgcttcttcaccaggccctgctggaaccgatacgagtggagtagagaaaacatggtccataagaaagatggtgtggagcttggtgattggatggggtatcctcagtttaatgctttaaaccaagaagtcttttcttcaccatttgtgtcttagctatggtttttgttttcagtgttttaatttccattatatattgttactggcttaagtctctttgatggggctttttactatgcatatttgagcttacatttatttatatatatttgnattctttgggagattttttttgaggggagcctttataatttt

SEQ ID NO: 6198 - DNA, 370 bp, Gossypium hirsutum
  Clone ID: uC-gsronu33B018a11b1
ggttctttgtgttatttaagtgtgtaatcaatagtttgtagtggaagttaatcatgaatgagaatcttcccttttgttggtgtaaaaaaaaaaaaaaataaagaaaaaaaaaaaaaaaaaaaaaaaaaaaaaaaaaaaaaaaaaaaaagaaaaaaaccaaaatataaaccaaaaaaaaatcacaaaaaatagccggcattactgataaaaagtcaagacacagagggaggaaaaaatttcaaaaacttaacaatgaaggggttgcataagtgatttaaattaaaggattttagaactcctgaaacaactgttatattgagggctaaagaaaaatttaatcaaccctcaaatttttaaaaaggtctatttg

SEQ ID NO: 6199 - DNA, 98 bp, Gossypium hirsutum
  Clone ID: uC-gsronu33B018a12b1
ctcaccagcagtctaatatggtgtctcgtgcaatgtaagactataaattatcatatctcctattaaatataagggaaaatagatatatttttatggat

SEQ ID NO: 6200 - DNA, 431 bp, Gossypium hirsutum
  Clone ID: uC-gsronu33B018b04b1
gcttctacttccttcttcttctctttctcgtgaaccaaacagaaatttcctaaggaaaaaaaattcaaaagctgatgttaatttatgaataaatgttgaggatctgaattttaaaccaagcgagggagtgaaagagagacgagagaaggatttgaggaattgttagatacactagaagagattggagggaagttttttgctggttctgataactaatcgtgaagatttctttttattttgttgaagtttttcagaacctatgcatttggaagatagaagagctacttcggggagaaatttcaactgaattcatctgcaaataagcagatcaattgctgacatattcaaacattagaacccttcatacaatcacagagagtttcgaggaataggctgcaaatgtcactattttgttgaaaatttggagtaga

SEQ ID NO: 6201 - DNA, 370 bp, Gossypium hirsutum
  Clone ID: uC-gsronu33B018b06b1
ctgaatctcctcttttccctatattttatctgtccggttccatctccgttctctacgaaatggcttcccacattgttggctatccccgtatgggaccaaagagagagcttaagtttgctttggaatcattttgggataagaagagcagtgctgaagatttgcagaaggttgcagctgatctcaggtcagctatttggaaacaaatggctgatgctgggatcaagtacattcctagcaacactttctcttactatgaccaggtgcttgatgccacctcgatgctcggtgctgttccaccgagatatggttggaacggtggcgagatcagattcgatacttacttctccatggctaggggaaatgcctctgt

SEQ ID NO: 6202 - DNA, 477 bp, Gossypium hirsutum
  Clone ID: uC-gsronu33B018b07b1
ctcacgcgtgcgaaaagctggtgctgaaatgcttgttatggcatatggtaggtcatatgggctacctgtgataacaacccgtggaaacaacgtttatggtcccaaccagttccctgaaaagttgattccaaagtttattctcctagcaatgaggggaaagactcttccaattcacggtgatggttctaatgtgaggagttatttatactgtgaggatgtggccgaggcatttgaagtcattcttcacaagggtgaagttggccatgtttataatattggaacaaagaaggagaggagagtgattgatgtggccaaagatatctgtaagcttttctcgatggatccagagaccagcatcaagtttgttgaaaacagaccattcaatgaccagaaggattttcttgatgatcagaaagctgaagaacttgggatggttccggcgaactgtatgggaagaggggctgaagaagaccattg

SEQ ID NO: 6203 - DNA, 474 bp, Gossypium hirsutum
  Clone ID: uC-gsronu33B018b08b1
gcgatctgaggtggcacttgatgatgtgatcctctttctcctgattacagccattttttgccattttcttgctaacttgataagcttcttagcattgaccatattgctttgctctaaggttaataggaaagaactccgagatgaaaggaaaaagagggatgatttaggcttgaaactcttctggatataaagcaatggaaatttgatgaatatataactagaaggtgagaaacagtccctttaatgaatagtacaatgccggtattcattggaaacaaagacgtggtaggtagatatgtgtagtctgcaaggtgaccatgtttacttttattggatgattaacccccagcaaagtttgatcatatatagaaggtcatatatacatctttatgtaacttacaagtgatttaacaacaataacggccaggcatgaaagcggttagatgatccacatgttttggattgatgagtttt

SEQ ID NO: 6204 - DNA, 407 bp, Gossypium hirsutum
  Clone ID: uC-gsronu33B018c01b1
cggtcgcgtgggcggacgcgtgggcggacgcgtggggttttggaaattgttgatatgatttgaaattttattgtttatttgaaatttttttttgatgctgtagaaaccagagaaaaatgaccaagtgttacccaaccgttagcgaggagtaccaaaacgccgttcaaaaggctaagaggaagctaagaggtctcatcgctgagaagaactgtgctccactcatgctccgtctagcgtggcactcagctggaacttttgatgtcaagaccaagaccggaggtccattcggaaccatgaagcaacctgctgagctcgctcatgctgctaacaacggtctcgatattgcagtcaggcttctcgagccgatcaagcagcagttccctatcctttcatacgctgacttctat

SEQ ID NO: 6205 - DNA, 385 bp, Gossypium hirsutum
  Clone ID: uC-gsronu33B018c11b1
tttaccaccaccccattatgtctactcttcacctgctcctcctcaccactactaagtgatgacggctttgaccatactcctaggagaagagaagattgtgattcaaataaagccacaaaagatgggttgaaaagaaatctagagggaatcataaagaagaagattggaagcccagcctacctagtctccgcgtttgaagtgaataatgttagataaattgtgtgttattcagtggcttcactcgtgtttatttctgtttaaaagaatcatatatgtaactgtgtatgtgctctgcaaccattttgcaaatgcatgggtttatattatataaattattaatgtgaaaaatggttaaaactcttgggtatcacaaatttaattgggg

SEQ ID NO: 6206 - DNA, 78 bp, Gossypium hirsutum
  Clone ID: uC-gsronu33B018d02b1
cccatgcgtccgagtctattgaattctttccctgatttatgctacaaaaaaaagataaaaaaaacccagacgactact

SEQ ID NO: 6207 - DNA, 427 bp, Gossypium hirsutum
  Clone ID: uC-gsronu33B018d04b1
cttttctcctagcccaaaaaaaaaaaaccctctttcctttctctcgatctttttcccgttcaatcatgtcttgcttcattagcaaatatgccgatgagttggctaaaaacgctgcttacattggaacccctggaaagggtatccttgctgctgatgaatccactggcaccatcggcaagcgtctttcaagcattaatgtagagaatgctgaagataacaggcgtgctctccgtgagctcctattcacaactccaggagctcttcagtacctcagtggtgttattctctttgaggaaaccctttatcaaaaaaccgcttcgggcaagcccttcgttgatgttttgaggaaggtaggtgtcctccctggcatcaaggttcgacaagggtaccggtgagcttaacggaaccaatggcgaaactttcaccc

SEQ ID NO: 6208 - DNA, 453 bp, Gossypium hirsutum
  Clone ID: uC-gsronu33B018d05b1
aaggtcactctcggacaatacgagagtcacattgttttcactcttccagggctctaccgcgttgttgatgggatcgatgtttttgatcccaaattcaatattggctgccctgcagctgatatgagcatatacttcccttacacggaagagaagcgtaggttgatgaagttccacccggagattgaagagcttgtttacagccctgatgagaatacagagcacttatgtgtactaaaagaccgaaacaagccgattctgcttaccatggcaaggttggaccgagtgaagaacttaactgggctcggagagttctatgccaagaacagccggctgagggaactgggtaacttgattgtagtaggtggagataggaggaaaggaatccacggacttagaagaaaaggctgaaatgaataaaatgtatgaacttatcggaaaatacaagttggatgg

SEQ ID NO: 6209 - DNA, 441 bp, Gossypium hirsutum
  unsure (1)..(441): unsure at all n locations
  Clone ID: uC-gsronu33B018d10b1
ggaccgagtccatgcctgccacacttaaagactcagcttcctcaacgtggctttccattgctgctaatactagaacggttttcatgatggagcaggcatccggagtcacccacagttttaatcccgattcgaagacctggtacggacccttcgatctccgtccggatcggagcatttacttttcggtgataacttgtgttggggacaacttgattatgctgggtctgcttggagatgccgaggatgtaaactatgtaaaattgtgggagctaaacggggagtcgttagagtttggaaaagaaatcggggtgatgccgacggagttggtggagaagctgaaaggagagggaacaagcttgaattcaataagagtaagttgtatgggtggntttttctatatatataatcctggggagcctggggaattggtagcgttggaag

SEQ ID NO: 6210 - DNA, 432 bp, Gossypium hirsutum
  Clone ID: uC-gsronu33B018e02b1
gcgcctttttcgtgcgcatggagctcaggggctgcacctgatgatccacgtggacctactcctgccactagaaatagaacgcacatatagggcagcgatggttcagcataatggcctgggtctgacggcgggaggagcagctaaagaatggcaggacgagacatagctggaatggagaacacaatccttattatcggtgctatagtagcgaacaggttggcgaagagaagatccaggaagagatgctcggacttcgaaaagcttggcaatcaacctgttgctgctcttgcttctaatgaagtgcaagaaataaaaacagtgaagtccttcctttcacttgatagccaggcacttgatacacccatttcaataaggctttgaccccctcctattgaccgtaacaaatattcgatgatgaagaggtttttaaaa

SEQ ID NO: 6211 - DNA, 460 bp, Gossypium hirsutum
  unsure (1)..(460): unsure at all n locations
  Clone ID: uC-gsronu33B018e03b1
ctaatattctctaaacatggctctgagatggtttctgcattcagcatgtcattttctggggtacctacatgagtctgatgacatgcagtactgcaagaacatggcaagtgaacaaagtggaggagtgactcagagctcaaaggtgtcctccaacgctgagctgacggtggttaaagcgaaaatgcatccgggttcggggtttcagatgccgctgcactatcctcgttacgcgaaagcggattacgagaaaatggaggagtggaaagtggacatgcttctcagggaatatggactaagtttggagggcaacctcagccttgatatgagagcatatgcaatgggcacattcttgtggcctcatcagtattgatccatcttttaatcattatcgcgccttaatcaagctgctagctaatatcatatgcatacagnttatatataattaaatatagtacatgta

SEQ ID NO: 6212 - DNA, 456 bp, Gossypium hirsutum
  Clone ID: uC-gsronu33B018e05b1
cccactcgtccgctcaacaagggatgctgcttcgctagatttggttgattggctgatgaagaggcctgagtggggtataatgggagggaaagatcattttctcgtggctggtagaattacctgggatttcaggagattgagtgatgaagaatctgattggggtaataagcttctgtttctacctgctgcaaggaatatgtcaatgcttgttgttgagtcaagcccctggaatgcaaatgattttgggattccatatccaacctacttccatcctgcgaaggatgaggaagtgtttatctggcaagatcggatgagaaaattggagaggaagtggctattctcttttgcaggtgcacctcgtcctggtaatccaaagtcaataagggggcagattatcgatcagtgtaggaattaaaggtgtgcagttgttggatgtgattttggggagagcaaatg

SEQ ID NO: 6213 - DNA, 409 bp, Gossypium hirsutum
  Clone ID: uC-gsronu33B018e08b1
tttataacgttaaacgcggctttctctctatttcttttttgcagcgagttactgagtcaacaccacgatggccgaacgaatctaccccggtgactcaccaccgtcttccggcgaacactcgaatcccaaaccagctcctccttcttcagataaacctattccacaacccggaacttacgtcgtccagatcccgaaggaccaagtctaccgtgttcctccgccggagaacgcccgccgctacgctcatctgtcgaaacctaagtcgggtcgcagcacctgttgccgctgctgctgctgctttttaacaactatcctctctctcctccttgccgccgccattgccgccgctgtgatctacttcgttcttaagcccgaagctccaaactactccgtcgggagcgttgcgatc

SEQ ID NO: 6214 - DNA, 534 bp, Gossypium hirsutum
  Clone ID: uC-gsronu33B018e10b1
gttttatcaacgaaatcaagaagaacccaaattacaattcccaataaccttgatttttttttccggaaaagtttgaatttttccgttaatttgcaattttttttatctgggtcgatggcagaaatggaagacagcaaggcgaaatcatcatctgggtcgttgttcttcaatcgttcgttcacgatgaactctacggcggcagctgagtcgaattcccccaaattccatctccttctcaacagcccttcgtctctcaatcgagcagcttccatttcgaggttttacaattccttcgattccgtcaaaggtaaagttaaaaagctttgcaatgtgttcgaatccgctaagtcttcgtcttcaccatcgaacttagccagtcctaaagaaacttctccaaagctgttttgagaccctcgaaatcattgcggattcgtactcgttttctttgagctctaataactctccgataaggttaccgtgcactgaagatcgaattgttggttatttaactagtttgcgagggatttcgaagac

SEQ ID NO: 6215 - DNA, 404 bp, Gossypium hirsutum
  Clone ID: uC-gsronu33B018f02b1
ccctttcgtccgggagaaagaaactgatgatggagaagagttcatgagcctcttcattgatggaaaagctgagctatatgtttcttagatcgtacattatatagtccccattcagtccttgtgtaactatgaccctcaaatgttcagattcatctgtgtatgctttcataagatagggaaaaaaatctcaatactttttcttcctgtaattgagaaaacctatgatgtggccatgaaaattgaaaatggaacacaattacagttttttgtctaacaaaatgattcacataacacaaaaaaaagaatagtaacataaaaaagtttgaattgttaaaaaataccactactatgagagctcacagtgatcgtataaatcccaaataaatttccatagggggggggcc

SEQ ID NO: 6216 - DNA, 461 bp, Gossypium hirsutum
  Clone ID: uC-gsronu33B018f04b1
cccactcgtccggtggctacgacatccccaagggatcaaacgtgcatgttaacgtatgggcagtagcccgagatccagctgtgtggaaggaccctgaagagttccggccagaacggttcctagaggaggacgtggatatgaagggtcatgatttccgattgcttccatttggtgcagggaggagggtgtgccctggtgcacagctcgggatcaacctggtgacatccatgttgggtcacttgttgcaccacttttgttggacaacagcggagggagtgaaggctgaggaaattgacttgcttgaaaaccctggactggttgctcatatgcggactccattgcaagctattgccactcctaggctgccttcttatctctacaacgtgtggccgcggatttgtaagctttttccctaacttctaattcttattgctcttagcattagattttggattttaaac

SEQ ID NO: 6217 - DNA, 310 bp, Gossypium hirsutum
  Clone ID: uC-gsronu33B018f05b1
ccctttcgtgcgcccacgcgtacgagtctttagcttttcgcttgaagagagaccatgttggtttaccaggatctcatctccggtgactagcttctttctgactcattcccatacaaggaaatctagaatgggatgctgtgggaagctgagggaaagcgccttgttgcaaggagctgacgatgttgacattggtgccaatccttcaatcgaaggtgctgatgaggatgaaggtgcttgatgaccaatctgcgaacgttgttgacaatggtgacactttctaggcttaggagcaaccccctttcgacagaag

SEQ ID NO: 6218 - DNA, 355 bp, Gossypium hirsutum
  Clone ID: uC-gsronu33B018f09b1
cgcgttttcgcgagggttctgatcctcggccgaggacaactctttgtgctgagtattagtgcaaccatgttactcgtggattggacatcttattagatggccagactcataaagtctagatgttctgtttacacacgaactatcctgggcatgcagatttaaattcatacataaagtgcaactttgatattctagatggaggatcattaccggatgttaacaactacaaaaatcgaattactccaagcaccaaatgggagcaggtgagggaaattctaggtgactgtggccgagcggatcttcaaacacaaggttgctaccagcaattctattggctctactattggtcatggct

SEQ ID NO: 6219 - DNA, 469 bp, Gossypium hirsutum
  Clone ID: uC-gsronu33B018g01b1
attttcttgatttcctcgcaagccaaacagatttcacctcttatctccgaattatctcatctatggctcgtaccaagcaaacagctaggaaatcaaccggaggaaaagctccgaggaagcagctagcaacaaaggccgcgcgtaagtccgctccggcgaccggtggagtgaagaagcctcaccgtttcaggccaggaactgttgctttgagagagatccgtaagtatcagaagagcactgagctgttgatcaggaagcttcctttccagaggttggtgagggaaatcgcgcaagatttcaagaccgatctgaggttccaaagcagcgccgtcgctgctcttcaagaagcggcggaggcttatctcgtcggactgtttgaagacactaatttgtgtgcaatacatgccaagagagttacaatcatgcctaaggatatccaacttgctaggaggattagaggtgagagagc

SEQ ID NO: 6220 - DNA, 469 bp, Gossypium hirsutum
  Clone ID: uC-gsronu33B018g03b1
ccctttcgtccggcatttgccattcttgtcgagctttctgataagaatctactcactttggtgaaagacccacgggttggagatgcgtacagtagttattatgaaatctgtgttactcaacatgatgtgttgagagaccttgctcttcatctgagcaatcaaggggatgtgaacgagcgaaagcggttgcttatgcctagaagagatactgaactccccagagaatgggaaagaaacacagaccagccattcaatgctcagatagtttcagttcatacaggagaaatgagggaaatggactggtttcgcatggaattcccaaaggctgaagtacttatcttgaatttttcctccaatgaatacttcctgcctcctttcatagacgacatgcccaagcttagggcacttatagtcataaattatgggtcaaatgaggcaatacttgagaatttttagtcctcaccaatct

SEQ ID NO: 6221 - DNA, 318 bp, Gossypium hirsutum
  Clone ID: uC-gsronu33B018g05b1
cgcgcgtatgtgtgggttgctctttcaattctctgggcacccctctcagatcttccaatctctcaccatccagaataaaaggatggggctttcttttgctaagttgttcactcgcctgtctgccaagaaggacatgcgtattctgatggtgggtcttgatgctgctggaaagactaccatattatacaggttgaagctcggagagattgtcaccacgattcccactattgggtttaatgtggaaactgtggaatgtaagaacattagcttgaccgattgggacgttcgcggtcatgacaagatttgacctttgtgggg

SEQ ID NO: 6222 - DNA, 190 bp, Gossypium hirsutum
  Clone ID: uC-gsronu33B018g06b1
cccttgtgtccgcaagggtgtcttattttcttgctttcaatgtattttatttcgtacgtttttgtcatctttgttcatccttatcctctcttcttttttcttccggcggtgcttttcatgttatttttttaatgcataattctacaagtcaaatatattgtttgttttagtgtcaaaacaaaaggaaaat

SEQ ID NO: 6223 - DNA, 536 bp, Gossypium hirsutum
  unsure (1)..(536): unsure at all n locations
  Clone ID: uC-gsronu33B018g08b1
gcgggcncgcgccgcggtattcggggcgcgccacacgcgcgcgctttcgtcctgtatttgccattcttgacagagctttctgataagaatctactcactttggtgaaagacccacgggttggagatgcagtacagtagttattatgaaatctgtgttactcaacatgatgtgttgagagaccttgctcttcatctgagcaatcaaggggatgtgaacgagcgaaagcggatgcttatgcctagaagagatactgaactccccagagaatgggatggaaacacagaccagccattcaatgctcagatagtttcagttcatacaggagaaatgagggaaatggactggtttcgcatggaattcccaaaggctgaagtacttatcttgaatttttcctccattgaatacttcctgtctcctttcatagacgacatgcccaagcttagggcacttatagtcataaattatggttcaaatgaggcaatacttgagaattttcagttttaccaatctggcaatttgtgaagcctatggcttg

SEQ ID NO: 6224 - DNA, 243 bp, Gossypium hirsutum
  Clone ID: uC-gsronu33B018g11b1
gcgtttttaagccatgatttacattaaataaaagtaattaaacataaaatggtaggaataaacacactattaatatgtgtaacaaaatgataatgaacatgataatacatgcataactaatatgagcaacaatagaaataaaataaaatacataaaaaacaaatgaagtatatatgaaataataagtaaataaaaagggaactaaagcatttcctaaaacaaaaatacgtacaaaaaaataaa

SEQ ID NO: 6225 - DNA, 561 bp, Gossypium hirsutum
  unsure (1)..(561): unsure at all n locations
  Clone ID: uC-gsronu33B018h01b1
cccattcgtccgcgcacctccaccagttccagctccagcacctgcacctgcatcagcatcagcagcaccacaaatggttcgaccagtaaccggacaagccggtcaaggctactacaccaacgtgcagagaatgcctcatgaagtttaccgggagcaacccgtttacaacatggtggcccaacctcaacctccgcccactcaacaccagccgatatcaacgatggcacaacaggtggtaaggccgccgagcagcggtgtaacagatgctggatatggacacgtggcagcgtacgacagacaggcttactatactgcacagggggggtgtcgtgccttctcagtatcaaggcgttggtgtggcagttagtggtgacaaaagaggcaacgtcgatggcaaagtggtatataaagtttcacaaggttcagtttaatttctaaaattatgaaagattttacgatatatctgttagttttaattggtattattacgtattactatatatatcaagtataaatcaaaatcttagcacttaatttattttagctatatgaanatatgag

SEQ ID NO: 6226 - DNA, 309 bp, Gossypium hirsutum
  Clone ID: uC-gsronu33B018h02b1
cctttttatcgggcgacgcgtccgtaagggcataacggtaaggatcagctgacactaacgcgataattttggaatcaagtcggcattatccttggggggggtcagcgaggaacagcgatgtgacatgtaaagactcatataggacgaaacggaattgtattgaatcacatgctgcacctatgggatggggatagagaaagagggaacgccgcggatgtcacatagagctgttgatcaaactgtcaggctgatggatcgcgcactgctcggtcaaagagaaaacgggtcagatggtataggatcaaacct

SEQ ID NO: 6227 - DNA, 130 bp, Gossypium hirsutum
  unsure (1)..(130): unsure at all n locations
  Clone ID: uC-gsronu33B018h03b1
actatatccactaccttactgtaactattaaacaaagttaaaaggcataaagcctctactttgagaatgattcatggagaagatgattgtttaaatnaaaaaaaaaaaaaaaaaaaaaaaccananaaaa

SEQ ID NO: 6228 - DNA, 279 bp, Gossypium hirsutum
  Clone ID: uC-gsronu33B018h05b1
cccatgcgtccgcccacgcgtccgaaaaaaaaaggaaaaatttaaaaaagggagaaagataaagacgaaactttgtaatctcagttggagtgagtccttgtttattgctgaatacagaaggattccaagtcatattgcgcaaaccactaaaatactcaacttaatacacatgcatcatatctcactttatacagattatccaataactatatgacaactgacggtaactgcatttggaacaaaagagcacaacacagaaggggggggtggcgcctttta

SEQ ID NO: 6229 - DNA, 475 bp, Gossypium hirsutum
  Clone ID: uC-gsronu33B018h09b1
tttttaaccaatttagaaagctcgattttattgggtgcaaatgttatgcttacagcttatccacaactaagtccattattttaatattctagatgatattggcttgcttactcactttcaacctattctagttgcagttattgcaactttttcactatccacaactagatctaattatcaatgatgataatttatgaccatgattactgaatgaatactttaggtatgcagggagaacaaaaacattttgttgatgctctatgattattcatattcatgtcattatatgttattcatgttgagggagagatgaaactaaaaataagtgtggaaattattactgactgaatagaactctaattctgcaagattgtaatgagaagtgcagatatatgacctgaagagcaaaatatggaagacaaacggagaagaacaaggcaatgcttagaaggaatctattgagcgcctgaagctg

SEQ ID NO: 6230 - DNA, 591 bp, Gossypium hirsutum
  unsure (1)..(591): unsure at all n locations
  Clone ID: uC-gsronu33B019a02b1
gaactatgagaggagaagggagaacatgaatactcgagatagtcagatgcctcctcaaaatcagggcatgcagaatgtcgctccaaagactgctgggatgcctcccaacaacatgggagggatgccaccccgcaacatgggagggatgcctccccagaacatgggagggatgccacccaacaacatgggaaggatgccacccaacaatatgggaggaatgacaccgaatcaaggatggtccgttaacatgcctggaaatgctccaaacttccaaactggccccaactatggaaacgctcctggaaatgcgcagaacttccaacctggtcctggtcctaactatggaaacacaccttaccaaggtgctacacccaatgctcaatatcaccagaataactatcctcaaatgttggtggaggaaacatgcctggtgggaactaccaatctaaatctntgttctaatatgaattcgagaacattgtagcttttagcattgntgtagataagataaatgctagactatggntattggctactaaagaatgctattgatatgttgggcaactatagttatacagattattgttgcat

SEQ ID NO: 6231 - DNA, 414 bp, Gossypium hirsutum
  Clone ID: uC-gsronu33B019a05b1
ccctcgcgtccgcccacgcgtccggtgtttgtctattgaattctttccctcactttctcgaaaaaaaaaatgccttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgccaaggatggatgcctgtacagactataattatggctctgtct

SEQ ID NO: 6232 - DNA, 445 bp, Gossypium hirsutum
  Clone ID: uC-gsronu33B019a11b1
atttaaagagaaaagggggatttttctctctggggaagacccagaaccggccaagggatccggccaacccccaccgtggctccgccgtgcgccgcagcctccagcagtcgccggccactgcacgcggtggccggaattccgaaaaaggcaaacggtggtggagcagaggccacttgcaggcgtcggtggtggatggcgtggggggcatgtgctgacggctagggtttccttagcttcttcttttggttttttctttaatgtaatgggctagggtttcctttgaaattgggttttgggtaggttatttgggttttaggcttagtgggttcaatgggttttgggctaagggccaaaattgggcttgtacaattgtgttgaattctttaaatttggaaataaataatttagatatttctttcccccggtgggataaaaccctcaaaaa

SEQ ID NO: 6233 - DNA, 402 bp, Gossypium hirsutum
  Clone ID: uC-gsronu33B019b07b1
tcttcaatgcagagcatccacagataatatttgataatattctcaaccgtaaaataccttggccacgggcaccagaagaaatgagccttgaagcaaaggatttaattgatgggttgttgacagaagatcctaatcagagacttggagccaaaggagcatcagaggtgaagcaacatgtatttttcaaagatatcaattgggacacccttgcaaggcaaaaggctgcctttgttcccagttcagacagtgcacttgatactagttactttaccagtcgctactcatggaatacttcaaatgaccacacatatcctggtagtgattttgatgattccagtgatgctgacagcttaagtggcagtagtagttgcatgagcaaccgacaagatgaagtgatagatg

SEQ ID NO: 6234 - DNA, 309 bp, Gossypium hirsutum
  unsure (1)..(309): unsure at all n locations
  Clone ID: uC-gsronu33B019b09b1
aacttcatagatctggggtggcgtctcttgagttcccttctttgcccgccgtttttcgccgccgagactgttttttctcgggcgccccccttttaattgcctgtcggttattatccccctttcgccgggtgaaatccttgtttttccgcccgcttcctgttcgttgttgccaaccccttttttaccctgtttggctattgggactcggcctgtcccggttcttttttcccagtggttggtgtgctttcttggcgggtgggccctccccttggccgcgcctttacgcccgttgctttnggttttttccct

SEQ ID NO: 6235 - DNA, 596 bp, Gossypium hirsutum
  unsure (1)..(596): unsure at all n locations
  Clone ID: uC-gsronu33B019b10b1
cttggtcgttgtcgtcgtcttttcttcttcaatagagtcagaatgtcttacgcttacctcttcaagtacataatcatcggtgatactggagtggggaaatcatgcctcctccttcagttcaccgacaaacggtttcagccggtacatgatcttaccatcggggttgaattcggggccaggatgatcaccatcgataacaaacccattaagctgcaaatctgggacaccgcaggtcaagaatcctttagatccatcacaagatcctactacagaggagctgctggtgccctgcttgtctatgatatcaccaggagggaaacttttaatcacttggctagctggttggaggatgccagacagcacgctaatgctaacatgactattatgctgattggtaataagtgtgaccttgctcatagaagggctgtaaccaccgaggaaggccagcaattcgccaaggaccatggtttgatcttcatggaggcctctgctaaaactgctcagaatgttgaagaggcattttaaaaactgcttcaaccatatacaccaagattcaggatggngttttgatgtctcaaatgagtcttatggcataa

SEQ ID NO: 6236 - DNA, 504 bp, Gossypium hirsutum
  unsure (1)..(504): unsure at all n locations
  Clone ID: uC-gsronu33B019b12b1
ctcacgcgtccgcggacgcgtgggtgtgtgtgcaaaaatggggttaattcccatgagaaacatacacattcttcttgtttttacggtgacaatagtactccttgaaacaaatggttgcaaagctgcttttctagtgaagagcaacttcagctacaagtgcaaaggccgtctcaacgaatgcaggatcgctgaggctttggactcggagctagagttggagttggacatggtgatgaattctaacgttgttagaatccttcagagcagtaacacgccggtaaccagtaacacgggaaaccggaatacgccggtgcaacagacttgcccgagtcctcagtatgctagttgtcttgccacaggaggtagagctaattgtaggggaacttactgccgcggctaatccatcttttgtatcattcctcttgntattatatgggcaaatgctaaatgagccaagaatgatccaaaatatgcgtagttgtattactttatatggnatatata

SEQ ID NO: 6237 - DNA, 387 bp, Gossypium hirsutum
  Clone ID: uC-gsronu33B019c07b1
tttggtttcaacaatggcggaaatgggtttgcattgtgtgatgggttatgggaacttgaagatgaggctgctaattactatactttgttacagtctgaactcttcatgtagcttcatggccggagaaactacgaagcagaaagaaatggtaggggtaaaaattagagaaggggaaaaaaagggagtgcggggggaaatatgaaaaatgaaggcgattattttttttgggactaattcattttggaaccccccaacttctttgaaaatatcaggactttccccttgtttatttgttcaatattaaaactaaaatgttgaaaggagggatcttaagcaatggaacattttcttgaaaaaaaaagggtgttaatttttcacgtggaaatt

SEQ ID NO: 6238 - DNA, 73 bp, Gossypium hirsutum
  Clone ID: uC-gsronu33B019c10b1
cactatagggaaagcgggaacgccccggaggaacacggaccggaatatcccgaggtcgactccacgcagcccg

SEQ ID NO: 6239 - DNA, 233 bp, Gossypium hirsutum
  Clone ID: uC-gsronu33B019d01b1
gggcaccgccccaatatcccgggcgagacacacgcccgcgatattaacccactgcgcgggcacgacaacacggggggcttagaaatcactagcccttcgcatccgcaacatgtcactggcactaaagagacaaccagaaaacacagggggaccatcaaaaacggaaaaacgaagccaatctctcacacaccaaaagaagaccgagcgagcaagggcaccacaagcaaaagagc

SEQ ID NO: 6240 - DNA, 537 bp, Gossypium hirsutum
  Clone ID: uC-gsronu33B019d04b1
ggtgcaacagcttacctgaaaaaacagcgaattttgctgatgagaacttttcagtaagtgtgagcaaatcagcaaatgaggttgttgctacctatacaaaagatgagaccggaatggatctcattattcgtcttcctgcatcttacccattacggcctgtagatgttgactgtatgaggagcctagggataagtgaagtgaagcaaaggaagtggttaatgtctatgatgatgtttgttcgtaatcagaatggagctttagctgaagccatacgagtatggaagcgtaattttgacaaggaatttgaaggtgttgaggagtgccctatatgttacagtgttatccacactgtgaaccacagccttcctcgtcttgcttgcaagacttgcaagcacaaatttcatgcagcgggcctctacaagtggttttcaactttttacaaatcttcatgccccttatgccagtctccgttctaaccttgggagtcaattttgagttaatggtttttgtggcatttttgctcccttgatatgtgat

SEQ ID NO: 6241 - DNA, 551 bp, Gossypium hirsutum
  Clone ID: uC-gsronu33B019d09b1
tttacgcgtccggttgccaaatacttcattacaagcccaagtggaggatccttgtcgcctatgttagacttgtatcaggacaaagtcactatggattcctggtaccacctgaaagatgcagtcttagaaggggggagtccatttaacaaggcacatggagtaaagaccagtgagtatatgaaaaaagatccaaggtttggaagcatcttcaaggccgctatgatggattacaacaagcttttcgtggaagagatgttgaaaagttaccgaggttttgatggcttgaattcattggttgatgtaggtggcggcaatggttttattctccacagtattgtttccaagtaccctaccattaagggtattaactttcgatctgccacatgttattgacaagtcaccctcctatcctggaattgagaatgtggctggagatgttttcaagagtgtaccaaaaggagacgccattttcaccagttgggtactccatcattttgaggacaagcaatgcgtggaggtacttaggaactgctacgaagcattaccggcga

SEQ ID NO: 6242 - DNA, 507 bp, Gossypium hirsutum
  unsure (1)..(507): unsure at all n locations
  Clone ID: uC-gsronu33B019d12b1
ttttatctccaagaaatcctggaccttcaagatgctaagcagaagattgccagggaaattaggtttaaagatggtgcagtccttgcttttgctaataaacttaaggaggcggagcaggttctcgatgttctagttgatgattattccagttatcggaagccgaagaggttgaaattggaggataatggtgtgaaggatgctgctgctgctgatggtgattcttgtaccactacagttgtatctcgtttaaatttgtcagatattttgtcctatgcacatcggattagttacactacttttgcacctcctgagtttggcgccggacaagcaccgcttcgaggggcgctcccccctgcgccacaggaggagcagatgcgtgcttctcagctttataactttgctgatctcgatgttggtttacctaagacagcctagactaaggagaaaactgtcgaggctatcattgagccaccgtctgcacagnctgcaaataccaatccgttggct

SEQ ID NO: 6243 - DNA, 553 bp, Gossypium hirsutum
  unsure (1)..(553): unsure at all n locations
  Clone ID: uC-gsronu33B019e03b1
cgctgttccagttggaagacctcacatggctgctgtcgctgacttgtcagataccccgaaccagtgggaattcagctgtgatttggaggtagattttgagtctgaagagaatgcttcaatagtctatgctgcattgggtgttgataaagagttgcaaccagataaagtgaagaggcaaatgtggatctctgatgggaaactttctgtgcactttgaagcagttgaagctaggtttctccgtgcatcattttcagctttcgttgatgtactcacacttgcctcaaaaaccatcgaagaacttgggccaggaatnggtattgtgatctttgattattgcaattttacaataaatgctgtgggattctggcattaatgcattctttttcgttattcttgtactttcgcttttgtattcttaataatacacatgtaattttaattaggatgtaagcttagcttctagcacaccgttatctccaggttttttttttatgtatgttgacaagtttaacatttggactatactagttatgccgattcttctttttacgac

SEQ ID NO: 6244 - DNA, 405 bp, Gossypium hirsutum
  Clone ID: uC-gsronu33B019e04b1
tacttttcattttgttctaggattcttcctattcgtgggtcatttatggcacgcgggatgagctcgcgcagccgcagcgggatttgaaaaaggaattgatcgtgattttgagcctgttctctccatgactcctcttaactgagataactgagacaggagatccaatgcttaaggtaggaatcaatttgattacactatatatattgaaggaatcaggtgatatttaaaaagtattctgttttcctttcgtttcaactcattttctatctaaaatattttttttctggctcggctattccacccagccgagccattaccttttattaatattaagattcttaattaagaagccaggaaaagagcaataaagttttaataatgtcaatattttttgcattctgaacc

SEQ ID NO: 6245 - DNA, 427 bp, Gossypium hirsutum
  unsure (1)..(427): unsure at all n locations
  Clone ID: uC-gsronu33B019e09b1
ttatttttgcactgtctgggcatgataatactgtttgctcagtttttactcgaccaacggatccgcaaattgttactggttctcatgatacaaccataaaattctgggaccttagatacggaaaaacgatgtcaactctaacacaccataagaagtccgtgcgagcaatggcaccacatcctaaagagcattcttttgcatctgcatcagctgacaacattaagaaattcagtcttccaaagggagaattcttgcacaatatgctctctcagcagaagactataattaacaccatggccgtcaatgaggatggtgtaatggctaccggaggtgacaacgggagttttgtggttttggaaggaggnaagtttggtcacaatttccagcaagctcagacgatcgtacaacctggctcgttggatagtga

SEQ ID NO: 6246 - DNA, 523 bp, Gossypium hirsutum
  Clone ID: uC-gsronu33B019f01b1
ccctctcgtccgatttatatatatacacacactccgttgtagaaaggaaatatattcccatcttcaaccgttgccttattgtttcttcctcttttagattttctttctctccgttttctttccttacttgtatggcagccaatttgaagagtggtggagggatcgccagcttggggaagcgacttcttaaccgcacctccactcgcaccccttctcttttcatctccacttcttcacctaccaggagtcctcacgcgtcggcatacgacaagaacctggatgatcaggtccatgcggctgtggttcctgatgatgtgattcagcctcaatcggacaagtactgggctcctgacccgcggcaggggtatttggccctgctacggagcaacttaacgcattgcgggtggggagcagggcatccattcagtggtgcaaactcggtcctggaggaaaggcgtggttcccgcccactagtattgaggacttggagagccacaccatactaagtcgctgatatgagcct

SEQ ID NO: 6247 - DNA, 557 bp, Gossypium hirsutum
  Clone ID: uC-gsronu33B019f03b1
gtttgtttactctgaaggggtgctctgagtatagatcacatagaaaaatggtgaaagcagtggctgtccttagcagcagtgaaggtgttagtggaactgttttcttcactcaagagggagatggcccaactacagtgacgggcaacatttctggtcttaagcctggcctccatgggttccatgttcatgccctaggggacacaacaaatggttgcatgtcaacaggacctcacttcaatcctgctggaaaagagcatggtgctcctgaagatgtgaatcgccatgctggtgatctaggaaatgtcactgttggtgctgatggctctgcgagtttctctattgtcgacaaacagattcctctctccgggccacactccattattggagagcggtcgttgtccatgctgatccggatgaccttggcagggggggcacgagcttagcaaagcaccggaaatgctggtgtagagtagcttgcggtatatttggtctgaagggtgaaattttggcctgtgagcggataatacttgagtggagatgcaatgcctagagcaact

SEQ ID NO: 6248 - DNA, 563 bp, Gossypium hirsutum
  unsure (1)..(563): unsure at all n locations
  Clone ID: uC-gsronu33B019f04b1
atctttaaattccttatcgggaaaaatcccagaccagatagggaaccttcaaaagctcaccgtcttaaacttagctgataataaaatcaacggcgaaatcccaagctccattgttcaactttccagtttaaaacacctcgatttaagcaacaacctcctcaccggcgaagtcccggccaactttggcaacctgaaaatgctgagccgtgcattactgagtggaaaccaactcactggaacgatcccaatctccatcagcaacatgtaccggttagccgacttggatatatcgagaaacaaaatacagggtcaaataccagcacagttaggcaaaatggaaggtgctcgcaacgttggacttaggcagcaacatgctcaccggcgaagtaccgcgggcggttctgggcagtaccggtttgggtatcttaaacttgagtcgaaactccttgaaggcaacattcggacgttttcgggccgaaatcgtacttcatggcacttgattatcgttaataacttgaaggtccggtcccgnatcttatcgtcggcgaagtcgtcgacattag

SEQ ID NO: 6249 - DNA, 595 bp, Gossypium hirsutum
  unsure (1)..(595): unsure at all n locations
  Clone ID: uC-gsronu33B019f06b1
cactttttctcttatttgaactcaaagtcccagctaatattagaatcatgggtgttgtcacttatgactatgagaatacctccccagtcgcccctgccaggcttttcaaggcctttactgttgaagctccgaaagtttggcccacggctgcacctaatgcagtaaagagccttgaggttgaagctaatcctagctctggaagtatcgtaaaaatcaactttgttgaaggccttccattccaatatatgaagcaccagatcggaggacatgatgaaagtaatttttcatacagttacgatttaatcgaaggtgggcctttgggggataagcttgaaaaaattagctatgagaacaggtttgaggcagctgcaggtggagggagtatttgcaagagctcaatgaaattctacactataggcgataatgttatcactgaagacgaaatcaaggctctcattaaagggagtgagggagtttacaagcctgttgaagcttacctcttggctaatccgagcctgcaactggatataggtgcttaattgaattttatgctgctttaaagagggttgatttatgtgngctttgaatttctttt

SEQ ID NO: 6250 - DNA, 547 bp, Gossypium hirsutum
  Clone ID: uC-gsronu33B019f09b1
gttcacggcaccgttagacaacctggggatgccaaatatgcccatttgaatcaacttgagagagcatctcacaacctccaactcttcaaggctgatgttctggattacgattctctttgttccgccattacaggctgcaccggtgtcttccatgttgcctctcccgttccctccaccatcgttcctaatccccaggaggaagtgattgaaccggctgtaaagggcacacttactgtgctcaaagcatgtgttgaatccaatgttaaacgagttgttgttgtgtcttctgtgactgctgtttccttgaaccctaggtggccggtgggtcagatcaaggatgaggcttgctggtctgacaaggaatactgcgcagcaacaaagaattggtattgcctttcaaagacagaagcagagagtgaggcttttgagtttgccaaaaagtctggacttgacgttgttactgtttgtcctactctcatatgggggccaactttgcagtccaccatcaatgctagtagcaagggttttattaatcttttaaaagagg

SEQ ID NO: 6251 - DNA, 558 bp, Gossypium hirsutum
  Clone ID: uC-gsronu33B019f10b1
ttttagtcgccctttactaatacagagtaaagaacagaaaccaaagcaaaacccaaaaatggcgacggcactcgcaaacagagctgcgcaaaatcaaactactgggctattgagactctccttcaacttcttcagaaacctctcaactgcgacttccacagaaaaaactggcgcctcctcttcagcttccaaaaagcccaagagaaaaaagaagaagaacctcttcgaggtagctcagttcttacccaactgggggcttggttaccgcatggccaaaactcattggactgatgtttcatatcagatcaccaagatcaatctttataaggatggaaggcatggcaaggcatggggagtggtccacaaagacggtgctccaactgcagatgctcccaaaaaaataagtggagttcacaaacgctgctggagatacattccacatctgtccaaacctggagatacccctccaaccttgatgaaaccaacagaaaatgccccaaaggctgatgctgaactagcttgatgcattgctttaaaatatagatgctggtaacttga

SEQ ID NO: 6252 - DNA, 587 bp, Gossypium hirsutum
  unsure (1)..(587): unsure at all n locations
  Clone ID: uC-gsronu33B019f12b1
ctgtcgcgtgggttgcgggaaaaaaaaatgggttcttttctttcaagcttgttaggctcttccggttcaccatcagaggattcaccatcttcatctgagtcttcaagggtctcaaccttccattcagctccaagatggcaacttcacttcaattctgtcaaagagagcccaaagcttatggttatagatttctcagcttcctggtgtggaccatgcaagttcatggaacctgttctgaatgaaatggctgctaaattcactgatgttgactttgtaaaacttgatgttgatgagctgcctgatgtggcacaggaatttggagtgcaggcaatgccaacatttgtgttggtgaagcaagggaaggaagttgatagggttgttggagctcaaaagaatgagcttgagaagaaggttgagaagaatagatgctaaaaagactatatacgatatctgcaatttgaaatttcagtttgaatacttaaattaataaatatgtcaaatggagtttcttgagtatgataatgctaaataatgcttttaactcttattgtggataatgatgntntatgtatgtaaaattgataatc

SEQ ID NO: 6253 - DNA, 508 bp, Gossypium hirsutum
  Clone ID: uC-gsronu33B019g02b1
atttgtcggaaaacttggggacgacgagttcggtcatatgctggccgatattctcaagcaaaacagtgtctccggtgacgggatcttgtttgaccaaggcgctagaactgctcttgccttcgttacgttacgcgccgacggagagcgtgagttcatgttctataggaatcctagcgccgacatgctgttgaagccggaggagttgaacgttgatcttatcagatcttccaaggtatttcactatggatcaataagtttgatcgtggagccatgcagatcagctcatttaaaggcaatggaagtagccaaaggagctggtgcattgctctcatatgatccaaacctttcgttgccactttggccttcagctgatgaggctaggaaacagattttgtccatttgggataaggcaaatattgtcagggttagtgatgtcgacttcgagttcctcaccggtgcacaaagtcgacgcgaaactgcctgaaactttggcgacccactttacact

SEQ ID NO: 6254 - DNA, 344 bp, Gossypium hirsutum
  Clone ID: uC-gsronu33B019g04b1
gaagctggttatgactctatacttctacagagtgttttggaacttcaataccgtctgacacaagactttcatgctttataattaattgctatgtgattgagttatgcatttcatgcatcacacgatatctttgggattgaattgattgtttctcttttgagtgaataatcttgcagatgcatttagcttacggagatttactatgtttttcattgctttaggaagcagattctatcccctagagagctgtattttgttttggttttggttttttttttaatggaaaggagctgtgattagaaaaaaatgaaactgaagagaaagaaccaaaaaaacaaaagacc

SEQ ID NO: 6255 - DNA, 344 bp, Gossypium hirsutum
  Clone ID: uC-gsronu33B019g09b1
ttatatcgcgagggccgcccttttttttttttttttttggtaacaaaaaaactttttttattaatagaatagaagagttggagttaataaggtaattgtattatttacatattacaactaaatattgggaaattcattggctataattgacaaagttaacatatgaaaaatccaacaacatagtgttaaacaattcacttgacagtcgtagcatgcattgatatgcaagaaatgagccactttaattgataaggatttgtagcacacttaattgctttatgatcaggttgcatgtcgattttgtcatctggagaatggaataaaatttaactgggtcaagtact

SEQ ID NO: 6256 - DNA, 560 bp, Gossypium hirsutum
  Clone ID: uC-gsronu33B019g10b1
cttataatatcaaatccctcgaaaaatcctccccatccaatcaccacccgaaaccatggccactccttccccacgcgaagaaaatgtctacatggccaaactcgccgagcaagccgagcgctacgaggagatggtcaagttcatggagaacgtcgtctccgccgtccccgctcccgacgaactctccgtcgaggaacgtaacctcctctctgtcgcctacaagaacgtcatcggcgcccgccgtgcttcctggaggatcgtctcctccatcgagcagaaggaggaagggccgtggcaacgccgaccacgtcgccgtcatccgtgactacagggccaagatcgaggccgagttgtccgagatttgcgctggaattttgaagctccttgacgagagcttgttccggctgctggaaatggggattcaagggtgttttatctgaaaatgaaggagattacataggtactggctgagttcaagactggcgatgacggaaatctgctgcgagataccctcatgcctataatctggtcaggacatgcagtagctgagctagcccact

SEQ ID NO: 6257 - DNA, 500 bp, Gossypium hirsutum
  unsure (1)..(500): unsure at all n locations
  Clone ID: uC-gsronu33B019h03b1
ctcttttttattttttcttttgaataatcccagttgtccaatccaatctcagctctccgtctctcttcattttcacactctctcaagttgcttcgctttttgcagatcgaatcctgaaattgaacttggatctctatcggaacaagaaaaccagttgtctcttttaacaaaatcaaaataatgggtcaaattcaatactctgagaaatacttcgatgatacttacgaatacaggcatgttgttcttcctcctgaagtggccaaacttctccctaagagtcgcctcctctctgaaaatgagtggcgtgcgattggagtacagcagagtcgtggttgggtccattatgctattcatcggcctgaaccacacttcatgttattcaggaggcctcttaactatcagcagcagcaggagaatcaggctcagcaagctatgcttggccaagtaattaaaaatagcntttggtattttggaagaaaaagggaggaaaacccgatatg

SEQ ID NO: 6258 - DNA, 397 bp, Gossypium hirsutum
  Clone ID: uC-gsronu33B019h07b1
tgtttttataagcgtttgtctcagatttttgaagatggcccgtaccaagcagacagcccgtaagtcgactggtgggaaggctccaaggaagcaacttgctaccaaggctgcccgtaaatctgccccaaccaccggaggtgtgaagaagcctgatcggtaccgttctggaactgttgctcttcgtgaaatgcgaaagtgccaaaagagtactgagcttcttatcaggaaattgcctttccagaggcttgttcgtgaaattgcccaggacttcaagactgatttgcgtttccagagccatgctgatctagctcttcaggaagctgcagaggcatacctagcgggtgttttcgaagacaccaacctctgtgcgatccacgccaagccgtgtcacatttat

SEQ ID NO: 6259 - DNA, 286 bp, Gossypium hirsutum
  Clone ID: uC-gsronu33B019h11b1
gggtgataaagaaatgggatgcggtttttgaagctagtgatgctactaccgctgactatgactggacccaccatcaacatcagctcattacctgtattcattctcacatataactcaaagatggcaactttacgtcaaacgcgccacagaaagacaaaacataacgttgatagatttttcacgtttgtgggggaaacaatgaatgaccagggaaccggttcgagaataaatgattggaaaattcaacgaagttgactttgaaagacatgatgcttgacaagctgac

SEQ ID NO: 6260 - DNA, 176 bp, Gossypium hirsutum
  Clone ID: uC-gsronu33B021a02b1
atgaccactaccgaaacacgacatggaagcaagcgcggatcaaacctgctcttgtgatccatgcaactgttgaaaagctcgatgaaagccacaaattatgaaaaaaagaaagcagcaaaaataacaggcctctgaaatgatatattgccaaggatggatgcctgcaaggcctataa

SEQ ID NO: 6261 - DNA, 459 bp, Gossypium hirsutum
  Clone ID: uC-gsronu33B021a03b1
ttccttgagctagcctggataaacaatatgagtgagtttgcattcccgtatctattacagtttatccgagaatacactggcaaagttgatgaacttatcaaggacaagattgaggctcaaaaggaagtaaaggctaaagagcaggaagagaaggatgtgatcgcacaacagaacatgtatgcacagttgctacctcttgccttgcccgcaccgccagtgccaggcatgggaggttttgctccaccacccatgggaggaatgggaatgcctccaatgccagctttcggcatgccaccaatgggcagctattaagtcgtaacaggtctgttcaattgaaacattttatgttacctagtggatcaatggggctccatatagctgcaatttcgaggctttcattctttttcccctctttcgttttcatttgtctgatgagggaagatcaaaatttggaataat

SEQ ID NO: 6262 - DNA, 576 bp, Gossypium hirsutum
  Clone ID: uC-gsronu33B021a04b1
ttattatacaagaatttatagcagatagagaagaagaaatgattgaaattttattatttatattatcatttctttttgtgtggaaaattaagggagaaaggggaagatgaagatcacgtcgttattggtgttgaagtgcaacccagaaggatcggatccgatcatattagcgaacgcaactgatgtgagccatttcggttacttccaaaggtcaagcgtgagggagtttattgtctttgttgctcgaaccgtcgccaaacgtacacctcccggccagcgtcagtccgtccagcacgaagagtacaaggtacacgcttacaacagaaatggacttgttgccttgggatttatggatgaccactatcctgttcgaagtgctttttcgcttctcaaccaggtgctagatgaatacctgaaaaattttggggaatcatggagaactgtgcacgctgatagtgctcaatcttggccctacctggaagaagctctggtaaaatttaggatcctgcagaggcagataaattattgaaaatcagagggagttggatgaaaccaaaatcatccttcataaaacta

SEQ ID NO: 6263 - DNA, 540 bp, Gossypium hirsutum
  unsure (1)..(540): unsure at all n locations
  Clone ID: uC-gsronu33B021a07b1
gccgcacgtacccggccttaatgcccggaccgacccacgcgttcttttctgtgtatcatctttctattaaaagaggcactttgaaaacctatgctttttttgacctattagctgtaatagntagacgcccactaggggaggctccaagctcggtcccaaccaattcaccggcgtcttctaaccctactccggctcccaaggtttttccaaccatgtatgaaaccgctacaccaaccggataagggccagcaacatccactatcccggcttcaggccctgaatcttaaccaacttcctcttccactacttgtaccccagctcctctcgctggttctccccctggctctccccctaccgctggaactcccacgaactccatcagctagacaccaggcaggtctcccacttctcctacgagtgcaggcgcttggaacaaaatcacccggcgtggatctgccgttgcaaacgtctttgctgcttaggtgattcagatctgacctttgggggaggacaggatttggaattgaagattttaattta

SEQ ID NO: 6264 - DNA, 288 bp, Gossypium hirsutum
  Clone ID: uC-gsronu33B021a08b1
ttcaagattttgttgagtgcgctgtgataatggcatgtctctttgaggttatcttatatttcatcttcatcatggaagagaatgactatgttttaggtctaaagttcattgtaaatgtaggtgtggggagggagcagtgactttgatttagttttcacataatcttacttactgtcaatggatcccttttttctattttgttgtttcttggtataggcatgctttctttgaagtgggatttttatggtgttggatccgacactatggatttgacagaagaatcatatg

SEQ ID NO: 6265 - DNA, 346 bp, Gossypium hirsutum
  Clone ID: uC-gsronu33B021a12b1
tcgtccacgcgtccgcttaaacgaacattggcggggtttattaacacaatatgactattgatatcgagaccacggcggagcaaggcggcggagcggagctctcagcgaaggactaccaggacccaccaccggcaccgctgattgacttggaagaactcaccaaatggccgctttatagggcggcgatcgctgaggacattgccacccttcttttcttgtatgtcacgggggagactgagatcgggtataaagcccaaaccgacccgggaaagaatactggtgacccggattggggtggtggcgggatacttggtattggctgggctaatggtgggaagatctttat

SEQ ID NO: 6266 - DNA, 703 bp, Gossypium hirsutum
  unsure (1)..(703): unsure at all n locations
  Clone ID: uC-gsronu33B021b03b1
tgttcacgcgtccgcgcgagagacagaagatgaagcgcatcagccttggccttaccaattgtcccagaaactcacctcccattagtaccataactttggagactaggatggaaataatggaaagatcagatgaggatagtccatataagaggaagtgcaagagctggtcatttgagtacttggatgaacaaagcatatccccatgtaaagagcaggaaaacagaactctggagctattcccattgcacccggaaggcagatgaagggtttgaaaataaaacaaatagacccaaaccaaaaagaagaaaaaaagaaagctgttagaaaaccaaaactctgttcccattatgatctgctttgaagtagatgatgatgatgatatgtgctagatttttttctttctttttttttcttcttttggttcgggaaagaagaaagacaaaggttgtctttccttaactctactgcttattaattcctgacttgaaaccaaagcagatttatgtcaaaanaanaaatantaattatattatatttttatatattttttntttattttattttttattattttttttnatnattattttaantttttattatttaatatatttatattaatatttttttttttttttatattttnnttgaggggggtgtttataaaaaaaattcttcggggggggatttatttttttttatg

SEQ ID NO: 6267 - DNA, 582 bp, Gossypium hirsutum
  Clone ID: uC-gsronu33B021b05b1
ttattaaacaaaccactctcacattaaatattggtagtgaaacaatggcgtcttcagctctgataagtaagcttgaggcagatgtagagattaaggcttctcctaagcagttccatgaaatgtttgcccacaaaccgcaccatgtgcaccatacttgttatgacaagattcaaggatgcgatttacatgaaggtgaatgggggaaagtcggtaccattgtccattggagttatgtgcatgatggaaaggctaaaaaggcaaaggaagtagtggaagcagtagaccctgataagaatttggtcactttcagagtgatcgaaggagatctaatggaagagtataagagctttgtaatcacgattcaagtttcgcccaagagcgagggtagtggcagcgtagtgcactggactttggaatacgagaagctgtacggtgggattgcgcattctgagactctgcttgcaattcgttcaagatatctctaaagacattgactcccaccttaccaagcaagcttaacagtttcacatggttgctattgttgccgttacctgaagcactgttcatcttattaaggaataa

SEQ ID NO: 6268 - DNA, 515 bp, Gossypium hirsutum
  Clone ID: uC-gsronu33B021b06b1
tcattgctcatttttgtttttgctggcgaaggggggttcatggcttttaacattcttactgacaatggctctacaacaccggctggtcttgtagctgcatcggtggcccatgctttcgctctgtttgtggccgtttctgtcggtgctaacatctcgggtgggcacgtaaaccctgccgtcaccttcggtgcctttgttggtggccacattaccttggtccgaagtattttgtattggattgctcagttgctgggatccgttgtcgcttgcttgctcctcaagttttcaactggtggattgacaacatctgcatttgccttgtcatccggtgtgggagcatggaacgcagtggttttcgagatcgtgatgaccttcggtttggtttacacggtttacgccaccggtgttgacccaaagaaagggaacattgggatcattggacccattgcaatcgggtttcattgtgggtgccaacatcttggctggtggtgcctttgatggagctttcatgaacc

SEQ ID NO: 6269 - DNA, 635 bp, Gossypium hirsutum
  unsure (1)..(635): unsure at all n locations
  Clone ID: uC-gsronu33B021b07b1
tccacgcgtccgctccccgaaggttgccccagaggttattgctgagtacactgtccgtgccttgcagcgtaccgtccctgctgcagttcccgctattgtgttcttgtctggtgggcaaagtgaggaggaggctacccttaaccttaatgccatgaacaagctccagaccaagaaaccatggtcactctctttctcatttggacgtgcccttcagcagagcactctcaaggcctgggctggaaaggaggaaaacgtgaagaaagcacaagatgctttccttgttaggtgcaaggctaactcggaggccaccttgggtacatacaagggtgatgcaaagattagtgagggtgctgcagagagccttcatgttaaggactacaaatactaagaatttagtcttgtggtctgtgtatcagagaaattttctgtattgatgatagacgtttagtgctgtttttgggggttgtccgtttcttctcatggaatttaggttgtgaaatcagactcaaataagcttggngggccttagttctcgctgagtgttcatggtttttgtttgcttcaatttaaaacatattctcagcatatacaactgagtgtgctttgcactttttaaaaaaaaaaaaaagggcggc

SEQ ID NO: 6270 - DNA, 609 bp, Gossypium hirsutum
  Clone ID: uC-gsronu33B021b08b1
tcgttcgccttctagtcaagtatctataaaaagtaaaaagaagaaaactgaaaagagtggtcaaaagcgcaagtctttttctactgctaagggttctccaactgcggatcgtaatagtggtgccaaaagtagtacggaacaaccatccaaagatcaaagaagcgggaagagacacaattcttttggttcaacaaaacctgataacatcgatgaggaaccaagagatagtaacagtagcaattctcttccccgtttcatgcaagccacggaatctgcaagagctaaagttaatgctaataactcaccgagatcaagtcccgacgtgcaaaatggagatctttatatcaaaaagagacattccttacccggtgctaatgggaagcagcattctccaagaatccaaccatcgtcgggtgcaaaaggaaatgatagaaaatggcaaaggtgaaggcttgtatgcgaagcaaccttattaacatgttatcatggtaatcgacatttcggatcacaaaccggtgcagaatgttggtctttactatctagttttatatatatacacacacatatatatacatattatcatgtaaaactttctgcatggatagtatg

SEQ ID NO: 6271 - DNA, 88 bp, Gossypium hirsutum
  Clone ID: uC-gsronu33B021b11b1
ttcctgcaaaattgatatatttgccacatttgctccggacagttggcatataattcaaagttgatataacatccttctttgatttgag

SEQ ID NO: 6272 - DNA, 635 bp, Gossypium hirsutum
  Clone ID: uC-gsronu33B021c01b1
ttccattcgtccgtggatatattggctgagagtgggcggaattcaaagatggaggaattcaggatccgtagggaaagagatgtgattctaagggaaatggagcgaggtcgagggtcaaacagaggaagctatttttgaccatttgcattcaactgctttacaatacactactcttggtagaactattctgggacctgctgataatgtgaagacaatcaccaaatggcatctgctgaactatattcagacacactacaccggccctagaatggtcatagctgctactggagctggtaagcatgaggaaattgtagagcaagtagagaagttatttaccaaggtatcatctgatccagccacagcttcttagttaggtgtgaaagaaccagccacttttactggttctgaggtcagaatgatcaatgaagatatttctctggcgcaatttgcagttgcttttgaggggagcacttggacagatccagattccattgctctaatggctatgcaggctatgttgagttcttgagcaaaatgctgggggtggaaagcacaagggtctgagctgctcacgagtcggatcatgaattgcgaaggatgtggtttcaccccactgtaagatctggcttttgagc

SEQ ID NO: 6273 - DNA, 552 bp, Gossypium hirsutum
  Clone ID: uC-gsronu33B021c03b1
tccacgcgtccgcccacgcgtccgatgttgcactccctattttggtaaatctggcaaatacattaacttaaaaggatactcggaatggtgaatatatgggggacggtgggacttttgttgcatgggaaaagatgaagctggtagaatgtattttatattgtaacaacatatatatattgttgattatttttggttgtatatggaaggtgatgactttcatttgtaacgttgacgatgttgtatactactagttcatcaaagtagtcaaataccattaccaatcatcagagtttagctacagattggaagcttcattttgaagcaggtatgaatcgaggggtgagggagtggggcatgtattgtgcctttgcacggagacatgcttcgtaaatgatggagaaaagaggggtgatcatgtctgcaaaaagatgatcaacaagaatgggatttgccttgtgtgacgtagagggggaaaacagggtcgtactttgatgtctgcaaatgcacgttggggaccgacatgcgacttatctagtcattttgtttgtcacg

SEQ ID NO: 6274 - DNA, 429 bp, Gossypium hirsutum
  Clone ID: uC-gsronu33B021c06b1
tttttcgttgcttgattccatggggagcaaatggtggcatgtatttgaaggaggttgatcgtgttcttagaccaggtggttactgggtactttctggtccaccaatcaattggaggaacaattacaaagcatggcagcgtcccaaggaggagcttgaggaggaacagcaaaagattgaggatgttgccaaactcctttgctgggagaagaagcatgagaagggtgaaatggccatttggcaaaagagagtcaatgatgagtcttgtcgtggtagagaagatgatttttaagccaaattctgcaaggctgaagaggctaatgatgtctggtacaagaaaatggatgtgtgccgttacttcatacacttgtgttagtagttcgagtgaaagttgctgttggggaatttgaagtcatttcccaaagaggctt

SEQ ID NO: 6275 - DNA, 400 bp, Gossypium hirsutum
  Clone ID: uC-gsronu33B021c10b1
ttaaaaaaaaaaaaaaaaaaaaaaaaaaaaggaaaaattataaaaaaaaattttcatttaaaaaaaaaaaaaaaaaaaaaaaaaaacccaaaaaaaaaaaaaggggggggccgtttaaaaggacccaggttaccgccccggggcaggcaacgaaaaagctttttaatggggcccccaaaatcaaatccccgggccggggtttaacaccgcgggaacgggaaaaccccgggggtacccaacttaaatggcctggaaaaaaatccccttttcccaagtgggggaaaaaggaaaagggcccgacccgaccgcccttccaaacagtggcacacccgaaagggcaaagggacccccccctgaacgggcccataaaccccggcgggtttgtgggaacccccaaggg

SEQ ID NO: 6276 - DNA, 531 bp, Gossypium hirsutum
  Clone ID: uC-gsronu33B021c12b1
tcgtattctggtgccaaagttattgtcagtggaggagctgttggtgaaatggcattacatttctgtgaacgttacaagttaatggtcttgaaaatcagctcaaaatttgaactgaggcgtttttgccgcactacgggaacttctgctcttttaaaactcagccaaccaaagccggatgatttgggatttgttgattcaatttcagtcgaggaaattggtggttctcgggtcactgttgtgagaagtgaagaaggtggtaacaagattgccactgtggttttacgaggaagtactgatagtatattggatgatcttgaaagagctgttgatgatggagtgaacacatataaggcaatgtgcagggacagtcgaatggtacctggagctgcagctactgaaattgagttggctagaaaattgaaagagttctccttcaaggaaacaggattggatcaatatgccattgccaagtttgtgaaagttttgaaatgtaccaagaaccctagcagagaatgcttgtcttaatccaat

SEQ ID NO: 6277 - DNA, 586 bp, Gossypium hirsutum
  Clone ID: uC-gsronu33B021d01b1
ttacttaccaaaaaatgaattcccagtcctggctggaattcctcttgtttctctccctttcctccctattcctttccctttcctcctccactaacgacaccgacaccctcactctcttccgccgtcaagccgacactcacggcaacctcatctccaactggacaggccgcgacgcttgttcctccgcctggcacggcgtcgtttgttcctcaaccggtcgtgtcatttccctctcactaccttccctttcccttcgtggtcccattgctgctctttctcttctagaccaacttcgtatcctcgaccttcaaaacaatcgtttgaacggcaccgtctcaccgttaactaattgttctaaccttaaactagtttatctttccgataatgatttctccggagacatcccaccggaaatttcgcgtctcaaaagggtgctccgacttgatttatcaaacaacaacatacgaggcaatgttcctaagaaatctctggtttgaaacggcttattactcttaggcttaaaacaatgcataaccggcgaaatcccagatttctttttttttttaaaagcttaaaagagcttaat

SEQ ID NO: 6278 - DNA, 404 bp, Gossypium hirsutum
  unsure (1)..(404): unsure at all n locations
  Clone ID: uC-gsronu33B021d02b1
tactttgtcgcccgagtgcaagagagacagagacgctngattcatttccatcaccaccgagtccaagttccccccttatattcntcactaccatatgagatccgtcattgtcctttagatttcaattgcttgttggccttcacttatttccacatcaatttcattatatgtaattttactcctaaaacatttgttttcgtgataatattatttaaacatagattacaatctcttgacaggggacaagagcattatcttgtaagtataagtataagaagcttggattcgatttcaagaaataaaagtctatttaaaaaaaaaaaattttggtgtgtgaaaaaaaaagacgaacaatccgataaaaagacatctgtcaggtgagagtttgcctgctaagatatcat

SEQ ID NO: 6279 - DNA, 492 bp, Gossypium hirsutum
  Clone ID: uC-gsronu33B021d03b1
cctgatctcggcactactctccggggggtttagtgcagaatctattggatcagctcccttcatcgacagtcctactcatcaattccttcgcgctccatcctctaacgatgcctttcagtcagagccaatgttgctacctgaagttggtgcgactgcatcaggcttgcttggttttccaccacccattacactttcagctgctggctcatctaagctgaatgaggctctcatttctaatccatttgatagacctcgtgccgtttttatgcttgaagttagcggagttgatgatcctcttgttgttggacccaagaatgctcttttcgacaaagccttgaagagtagtggtggtcttggttcaactaaagtggacattcaacttccagatgaagagcaaggatctggtatttccttggacgagcctctaagagattaccctgaagaagagatcaatgactttgcatcttggttgggtggatcatatgtccctga

SEQ ID NO: 6280 - DNA, 313 bp, Gossypium hirsutum
  Clone ID: uC-gsronu33B021d06b1
tccttgcgtccgcccacgcgtccgagaacgggggctttgattgcgtcgtctctggcgacgcgactcttttacgcgccactatctctttctccctccctcacctcaactgccttgtctaccctttctgtgattcctctgtttcacgactcattccgacctccatccgctcagctttagactgccctttgaactacgctcgaagctacttagccaatctccttccttcatgcggccaccgagtcgagtaccctgactcggacctgggtctcatcgacgacagagctaaacttgccgaacctcactgggagacaac

SEQ ID NO: 6281 - DNA, 242 bp, Gossypium hirsutum
  Clone ID: uC-gsronu33B021d07b1
tctcgtcttcttcttcactatgggttttccacagtaagattatcttaagttgctttatctcattcttacattttcagaataatatttttttttcgaaatactcgaaaatcaaacttataacaaacaacaaacaactgttgagttgtgaaccattttacattttttgtttttgttatgattttgaggggaatataatattcttacctgccaaaaaacaaaaaaatttaaatatcactaccaat

SEQ ID NO: 6282 - DNA, 463 bp, Gossypium hirsutum
  Clone ID: uC-gsronu33B021d10b1
tccacgcgtccgcccacgcgtccgccagcgggttcgtttacacgtccgttggttttttatgagctccaatttagtagtcagtggcataaagatccaaaacagtcctcagtttcatatgaaattcgatgggtgcgaaggggttttgatagaaaaactagtgatatcaacccctaaacttagcccgaacaccgatggaatccacattggaaacacaaaatctgttggtatatacaattcaatgataagcaacggagatgattgcatttcgatcggtccaggatgcttggatgtgcacattgaaggtgttacttgtggtccaagtcacgggatcagcattgggagccttggggtgcataattcgcaggcatgtgtttcgaacataaccgttcgaaacacagtgataagagaatcagacaatggggtaaggatcaagacatggcaagggggcacaggttctgtatca

SEQ ID NO: 6283 - DNA, 93 bp, Gossypium hirsutum
  unsure (1)..(93): unsure at all n locations
  Clone ID: uC-gsronu33B021d12b1
tcgtccacgcgtccgcccacgcgnccaaggggggggttgatgaaaccttcctgcgtcaacacggacgaatcggccagccttaccggggggggc

SEQ ID NO: 6284 - DNA, 270 bp, Gossypium hirsutum
  Clone ID: uC-gsronu33B021e01b1
agaccgcgagcggccccccaacggtgatgggtggaaggagatttggctttcctacaccccccttgaaaaaagaaatcatatatatactagattttaactgggaacggtatatatagactggatctactctatgaaggggctctattgtttcggcttctggctttggtaactagaccgactctgggtctttctttttgatccaatgaagaatgataagaaggtctcttaaaaaaaaaaaaaaaaaacaaagaagaaaaaagcaaaccataa

SEQ ID NO: 6285 - DNA, 518 bp, Gossypium hirsutum
  Clone ID: uC-gsronu33B021e03b1
tttgttgttgaggccagggatgaattgcatgggatgtttaatgaagatgaactgctatatgctgtgttgcttgtttttgcaaacaagcaggatcttccaaatgcaatgaatgctgctgaaataactgacaagcttggcctccattcccttcgacagcgtcactggtatatccagagtacgtgtgcaacatctggtgaggggctttatgagggcctagattggctttccaacaacatagctaacaaggcctgaagctattaagaagatttttgcaatgtgggaagttctggaagcaggggggagcattatatcggcttattattattatttttcattctcctttccccctcatttttcatctgagacagtcggattgttgttatgcctttatttgcattttgtgatgatcattaatttagttgggaacttatgggctatattgtaactaaaaaactggctggttggatatataatacctttggataattttttttaaaaaaaaaaaaaaaaaagggcgg

SEQ ID NO: 6286 - DNA, 229 bp, Gossypium hirsutum
  Clone ID: uC-gsronu33B021e04b1
ttgattattgcctctctgggagctggcccggggggcgttatttaaagcggcggtcattttaccacccctcattttggcttcattctgtgctctggctgcgggcattattgcaactctgaggctgcctgatctggcaagttccttcaagtcatctggatctcattttggctaaggaacaaaatggccccaaaaacccaacaagccctctggataagaagggtcggcaacc

SEQ ID NO: 6287 - DNA, 536 bp, Gossypium hirsutum
  Clone ID: uC-gsronu33B021e06b1
tttcctcgcgtcccatctcctgtctctgttttgcggccatttctttcttcaattatcttttctcttcaaagatttcaactcttttctcagaatgggaagtactgatgggaccagctatggtgcttacacctatgatgccctggagagggagccttactggccatccgagaaactccgaatttccatcaccggtgctggtggcttcatcgcttcgcacatcgctcgacgtctgaagagtgaaggacattacatcattgcttctgattggaagaagaatgagcacatgacagaagatatgttctgtccacgaatccaatctgtggatctcgagggatgggaaaattgcttgaaggttaccaatggaggggaccatgttttcaaccttgccgctgatatgggtggcatgggctttatccagtccaaccacttctgcattatgaccaccaccaccatgatcagtttcaccatgctcgaggctgttcgaaataggggagtaaagaggtttttttacgcctccagggcttggatctatcctg

SEQ ID NO: 6288 - DNA, 434 bp, Gossypium hirsutum
  Clone ID: uC-gsronu33B021e10b1
ttaaaacttgtgaagacagcactaggcggcgccctgcttattagttggtcacctttggcagacggtgaatctattggagaaagcatacacactgagacaggcgatatgtttgaggagtctggtggtcagaaaatagattcagttactgcagcagggtttgagatgctggatctgctaatacttgctgctcaggtattaaagggaaaaaaccaaacctgctctttaaccacaccctgatattattctggtacctgctcactctcgatttcaacttcgacatacatacatgtggtccaaactgtttgtattgaacaattacgaattgctgaagaaaacaaagttctcggtttccctcaccgcagcctgctggcaggtaagaaaagcaaaatttgggcaaaatgtgggataatgatgggagggaatacatggctatg

SEQ ID NO: 6289 - DNA, 427 bp, Gossypium hirsutum
  unsure (1)..(427): unsure at all n locations
  Clone ID: uC-gsronu33B021e11b1
gcagaagcaagaaaagcttgttgtggaaccgggttgttggaaacatcaatattgtgcaatccgaaatccattgggacatgcgcaaatgcatctgaatatgttttctgggatggattccacccatcagaagctgcaaacaagattttagcagatgatctgctgagcagtggaatttctcttatttcctaaggcccaaaaaggaaaacaatactcgcttatgtcataatgaatttggttgtactctttgtttccatgttgngattttcatttctatttatcacttgaattatgaatggaaaaagaactggttctgcttagaacctgtgattttccatttgtttcataagtatctgtaataacccaattcagacatacaataaaaaaaatgatatctttatcctttaaaaaaaaaatataattattttat

SEQ ID NO: 6290 - DNA, 511 bp, Gossypium hirsutum
  Clone ID: uC-gsronu33B021e12b1
tcttccacgcgtacgcccgcttggtcttcgggggagtgttttaaatattgaggctttctcgaactaagagaactctggctttccttttgatgcttggcttttggaggagtctctcttggtgcagttcacaaagtgggcgattccaccggctggactagtcttgggaatattgactacctcaagtgggcttccaccaagaattcccatgttggcgactctcttctttttcagtacaaccctcaattccacaacgtgatgcaagtgacccacgacgatttccagtcatgcaacggaacatctgccatcgcctcctacacctctggatcccgactccgtaaccctcaaaaagggctggcccacttttatttcctttgcgggggtccaggccactgccaagccggccagaaaaggcgacgtatggggcaaatacatcggccaaagccccaattgcaagtcccagcccatccactttagggtaatcgcctgcaaaccccaccttcaaaaatgttgg

SEQ ID NO: 6291 - DNA, 497 bp, Gossypium hirsutum
  Clone ID: uC-gsronu33B021f02b1
tttattgttggccgtcaaatggcagagaccggggtcgatccatttgatatcgaatacgttagctgctcctgataagtataaatgttcggatgaagttatttccattgctgctatgctttctgttgggaattcgatcttttaccgtccaaaagacgaacaagttcgtgctgatcacgcgaggatgagttttcataccagtaacgtcggtgaccatattgctttaatgaatgtttacaattcctggagggaaacgaactactcgacacaatggtgttacgaaaattatgttcaggttaggagcatgaggcgtgcaagagacatccgggatcaactagagggtcttttagagagagtcgaaatcgaactaacaggctgtcctaatgatttacaggctataaagaaggccattatatctgggattttttctcattcggcccagttgcagaactacggttcttacccaaccgggaagcatccgcggatcgtccatatacatc

SEQ ID NO: 6292 - DNA, 367 bp, Gossypium hirsutum
  Clone ID: uC-gsronu33B021f06b1
ttatttctttacttaagtgaaatgtttaggggggggttaatggcaaactcggtatttccagagccatgccataagacttttatgagactcgatgatgataaaccccgagtttcgggcatatgtgatttgctatctatagaacctatgtattgagtgcctttgcgtagtcttaatctctttcaacgctaaatgcaactgtttgggagggatagacaacacatttaggtcgttttcaagttttttttttctttaaatttctttgaatattgacccttggttatttgtttcagagtgttaaaaagggcaagcctttatgtctttcgaggcacttattctttttgccattatttatggacactggattcga

SEQ ID NO: 6293 - DNA, 561 bp, Gossypium hirsutum
  Clone ID: uC-gsronu33B021f07b1
ttccacgcgtccgcccacgcgtccgcgggagggcctcttcaatcttcttattctttctttacccactctctaccttccacagccgcctcatggccgattccgccaccgcgtcttcccccctcaaagtcattgctggagctgattctttcggcgccgagctaaaagacgccatggtatcccacctccgctccctcaacatagaagtcgaagatctcggaatcacctcctactacaacatcggtgctgaagccggccgtcgagtctcttccgccaccacctccccctccgtggagacccgtggcctccttgcttgcggaacgggcgtcggagtcgggatcttcgccaacaaattccccggcgtattcgccaccacatgtctcactccggacgaagctcgcaacaatcgctccatcaataactgcaacgtcctggcactctccggcatgtcaacgtccgccgataccgctaaaggaaaacgtcgacacttggctcaacactccttttaaagcgctgggcccggcccttaagccccgccttggcccaggaaatctcaaatttttt

SEQ ID NO: 6294 - DNA, 441 bp, Gossypium hirsutum
  Clone ID: uC-gsronu33B021f11b1
tcccaaccccaaccccaaccccaaccggatccatcattgatgagccagatttctcgtgggtcaattccctcgttaaagatgttacaccctcctccagcggctcgatgcagcaacagcagcaacaatacaacatcagtaaaggtgttcgagaaaggcttccaccatgggtggaacaaatgtacatagaacaagagcagatggtagcataaaagagaccctttttgctcattgctttaaatctaacttccatcaagtttgtaatagtaattccgatagtagcgttagtcgacggtagaatactccgatcggtcggtccacgaagtaaaaagaaaaattacatgggcaggaaaggtttaagttactgctcatgctttagaggttttaggagaaagatgaaaactaagcaaaaacaaaataaatttattgattagttcatattct

SEQ ID NO: 6295 - DNA, 569 bp, Gossypium hirsutum
  Clone ID: uC-gsronu33B021g06b1
ttcctttcgtccgattggaaccccacctcaggccgtgcttattgccatggatacttgctttgatgctgcttgggtgccttgcactggctgcattggctgctcttctactgcttttgactttgctaaatccaccactttcaagacccttggctgccaagctgctcaatgcaagcagatgccaaaccccacttgcggtggaagcgcgtgcacattcaacatgacctacggtggctcaaccatagccggtaacctttcacaggacaccacaaccttagccactgacccaatcccaaactacactttcggttgcctccaaaagacagcaggcagctcagtgccaccacagggcgtattgggcctgggccgaggcccattatccctcctttctcaatcccaaaatttgtaccagtcaacattttcatattgcttgcctagcattaggtcacctaacttttctgggtcattgagacttggaccaagtgggcaacctgtgaggatcaaatacaccccgttgctcaagaccctatgagacccttacttttattacgtaaatttgattggaattaggg

SEQ ID NO: 6296 - DNA, 797 bp, Gossypium hirsutum
  unsure (1)..(797): unsure at all n locations
  Clone ID: uC-gsronu33B021g10b1
tctgtcaagagatcaggaatctgatgtggatgtctgattgtgtggctcaaaaccaaaagtctagggttcatgacagtgtggtgttcatattttagatgatggaggattgggtaggaataattaatcgggttgaatcagctgtaaattttcgtttctcttcttaatttatcaacatcccatattataattggagtggtttagctgctctgtttctaagcagtgtgttgttaaagaataaatgccatatgattattatatatatgtttgatatggttttttgggggtaaaatgttgtattcagattgattaaaatgtattgttgtcttgaatttgaggttgttttcaatgatttaatgatgaagtttctaggaaaaatataacttttttaatatcttctttacttctcttaacctatatttatttttattttctttttctttctttttttttactccttttatttttttcctctttttctttttctttactttttatccttcttccttctttttttcctcttttttttactcctttttctttttcatttatttttcttccattatttttactttttacatttctttttctctccattatctttttactcttttctttatttcttttactccctcttttattacttttattttaattttttttttcttantttttcttctttttcatcattttttttatttcttctctcatttcttttatcttttctttataatcttttattttttttttttttcttttttcttcttttatttttcttattttctattttttttatattt

SEQ ID NO: 6297 - DNA, 421 bp, Gossypium hirsutum
  Clone ID: uC-gsronu33B021h01b1
tttcatcctctatcccagacttcttgtactgggactgcatctttagactttgaaattgctatttctcaacttcccctcagagatttcactcatcagatttgtgcttggggttttcctcatctcttagttaaaaccatggattttagccatttaaatcgtgggcagatgactctgatgggatctgcgttttgtgtggtgctttcgttgcatttcacactgcagcttgtgtcacagcattcttttttactggaaaaaccccaaggagcagaaagctatacttattattattcttatggctcctatatatgctgctgtctcctttgtggggttatcggatattagaggaagcaaagccttcttcatgtttctggaatctgtcaaggaatgttactaggcttttgtgatccgttaagtcatggct

SEQ ID NO: 6298 - DNA, 405 bp, Gossypium hirsutum
  Clone ID: uC-gsronu33B021h02b1
ttgactcgtgggcggacgcgtgggtatccgaggaggcattgttaggatcttcttcaccagaatctgatatcactttcttcgatttctctgattcaaagtgggatgacaacgaacttttcggtttggaaaagtacccttcagtggaacatgattgggaagccatcagggaactatctgagtcttacaagaaaaaaaaaattacagctactatcatgtaatcttattgcaatttatcaggtcaagtatcttttgtttggccatgtaggtctttttagtggcgcctgcaatgatctttaccatgaaatatttgacatttcgagaggttaattaggccccattttataaaccagttggtctttctccctacttatcaccctccagccccttccctctaaacctgctcat

SEQ ID NO: 6299 - DNA, 603 bp, Gossypium hirsutum
  Clone ID: uC-gsronu33B021h07b1
ttccacgcgtccgcggacgcgtgggtttcatgttcaattaagaataaaatctagggttagggttagcgaaagagggtaaacccgaaaaatggaaggctgggacccgaatacgaagtcgacgctgacccagatcccgctattgacgacgaaggcgggccccagagacggaacggcatggactcagaggcttaaagaggaatacagagctctaatagcctacacccagatgaacaagtccaacgataacgattggttccgtatatcggcagccaatcccgagggtacccgttggacaggcaagtgttggtacgtccataatctccttaagtacgagtttgatctccagtttgatatccccgttacttatcccgccactgccccggagcttgagttgcccgaactcgatggcaagactcagaagatgtatagaggaggaagaattgtttgaccgtacatttcaagccactttgggcaaaaaattgtcctcggttcggtatagcgcatgcactttgtttgggacttgctccatggcttgctgcagagattcccattcttgtggattctggtatgatcaagcataaggatgatgcgaccacttcgaat

SEQ ID NO: 6300 - DNA, 377 bp, Gossypium hirsutum
  Clone ID: uC-gsronu33B021h08b1
tcgtttcgtcattggatcatctctcttccagattatcatgtctagcgaccagcgtaggtatggcataagtctgcacttctgatgttaaggaattgcgaggagactggtcatgcattgggctttgcttttctgttcgttttgtagggaaaaactgaagatatatttactagagagatatgcttacgatgtgaaatgtttggaatttgaataagacctccccttttgttgtctgttcattgtgctttgtctgctacttttttcatttatggaatgagatggactaaatactgatatattagtggttgaaccgagttatccgaataactcgatatttgaatggttaaaaaaaaaaaaatccatggactttataataaact

SEQ ID NO: 6301 - DNA, 571 bp, Gossypium hirsutum
  unsure (1)..(571): unsure at all n locations
  Clone ID: uC-gsronu33B021h10b1
ttaaaaagggaataattttcgtctccattcgggctttctgctgctgaccattctttcctaagggcattatggatgcgagattcgggctcttgttcctcttcatgttgggtgctacttgggcatgtaacgcccgacaactagaagttgttgaggtagtaatctcggatccatcagttgtccaggtaaactggaggcaagatgaaaaagtgatagaaacggtagctcggaatgacaacgtgtgcaccttgtgtgaggaatttactactgaggcagttgattacctttcacagaataaaacgcagactgagataattgagattcttcacaaaagttgctcccgtttacgagcttttgagccccagtgcattacacttgtggactactatgcacctctcttcttcttggaaatatcttcagtacaacctcaagatttctgtacaaagttcaacctttgtaaaaagttgcacttatatcttcacaattccgcgagatagttgtggcatgtgccaccgtgctatttctgaagtactaatgaaggtgcaagatcccgatacanagttggagatactcg

SEQ ID NO: 6302 - DNA, 231 bp, Gossypium hirsutum
  Clone ID: uC-gsronu33B027a01b1
cgtcactcggtcagtccacgcagtgggttgacctgttggcttgaagcaagccggtgctcgcgtcattgccaccgagatcgatcccatctgtgcccttcaggctctcatggaaggacttcaagttttgacccttgaggatgttgtctccgaggctgatatcgttgtcaccaccactggttacaaggacatcatcatggttaaccacatgaggaagatgaagaacaatgccat

SEQ ID NO: 6303 - DNA, 165 bp, Gossypium hirsutum
  Clone ID: uC-gsronu33B027a05b1
attacattgggccggttattcttggagaataatattctggtgtgtcattacaattggagaagctccttcgtatttcatcttgtcatttccttttcctttcttcgccggcattgtttgaacatggggttgtgcgcccgtccatttcagttaaatatggtgactttt

SEQ ID NO: 6304 - DNA, 97 bp, Gossypium hirsutum
  Clone ID: uC-gsronu33B027a09b1
aaaacagggccttacctttggcccttgttaacaggtgtgcattctgagtggaaaaagggacgacccccgcaccagaaagttaagggttttctttttt

SEQ ID NO: 6305 - DNA, 201 bp, Gossypium hirsutum
  Clone ID: uC-gsronu33B027a10b1
tcgttaaaacaggaaactgagtttccttttatcttctgttttgttttgttgttgctgttatgcttatcgctttctagttttacttgacatagatgaaaaggcagatgtgtgagcaatgtaaaacaaatgcttcaggcttgtaagataaaataaaaaggatatacatcctggagctgtatccataaaaattaaatacctttt

SEQ ID NO: 6306 - DNA, 120 bp, Gossypium hirsutum
  Clone ID: uC-gsronu33B027b02b1
tccacgcgtccgcccacgcgtccggtttaaattaaattaataattatttaaaaaaaagaagacggccgacaccgcggaggagctccaggtcgccctatagtgaggcgccttacgcgcgct

SEQ ID NO: 6307 - DNA, 243 bp, Gossypium hirsutum
  Clone ID: uC-gsronu33B027b03b1
tacactttctcaacctaactacaatgactaagagaacgaagaaggccggaattgtcgggaaatacggtacccgatatggtgccagtttgaggaagcaaattaagaagatggaggtcagtcaacacagcaggtacttctgcgagttctgtggaaagtatgcagtgaagagaaaggctgttggaatctggggctgcaaggattgcgggaataggcaagacaacatgtgcagttactaggaacact

SEQ ID NO: 6308 - DNA, 139 bp, Gossypium hirsutum
  Clone ID: uC-gsronu33B027b04b1
gtcaataccttttttcagtttcaaacctctcgaatatggcctctttcaattgctttgttttagcattgttcatggctttatcgttttcaagcgtcaacgttgtctctagctacttgttatactttatatttgctaacat

SEQ ID NO: 6309 - DNA, 584 bp, Gossypium hirsutum
  Clone ID: uC-gsronu33B027b09b1
taaacgcagccataagtccttacgagaggaccatgacggaagcttattggtctcctgattttcttactcaaacgaaggagccaaatcctccttgtgagggcgaactattgcaacacacacgaaaaggtgtacttagatggaaacgagtcaatgtctacatcaacaagaaatctcaggtaacaaacaaacaaacaagatggtaaaaatgcgagaaaacatattcagtggtaaagttttcactttacaagctcttacagacgctctattgtcaggtcatgattaagctaaaaagcaaacacgtggtagggtgcattttctaagaacaataaatgtaagtattgcattactctaccctctaatttcgcattaatctaatgacttctcatctaattaatccctttgcacttcctttttatgttagtttctttcttttactttgactgatagagctttagcaaaaagcaactttttgacacaaaaacactaccgccacccacgttacctgtaactttaaaatattataaacatattcttatcagacccgttactattcatgcaacactcgattaccatacttactatct

SEQ ID NO: 6310 - DNA, 461 bp, Gossypium hirsutum
  Clone ID: uC-gsronu33B027c01b1
tttcattaaaggtttccatgaatgtttaagatggttcagggtttattttgaagctttagatgaaagtttcaatagaacaagcaacgaaaagttgatgcttgaacgagccgccggccgggccatcgttgacttagtggcttgttcgccgtcagagtcgatagagcggcgtgaaccagccgcgcgttggtcaaggcggttccatgcaagtgggttcagtcctgtgggtttgagtgatgaagtgtgtgatgatgtgcgcgccttggtgagaaggtataaagatggttggtcgatgacacaatgccctgacgccggaatattcttgtcgtggaaagatcaggtggctggtttgggccagtgcatggcggtcttgacgacggcgaccggtggcagtgggcgtttttcttttctttcctttttgatgcatggcaggggagtggctcacacgtggtatggattttttt

SEQ ID NO: 6311 - DNA, 271 bp, Gossypium hirsutum
  Clone ID: uC-gsronu33B027c07b1
tgtggatgaaagaagactgctcccggggggttttttatttttttaaggactcaacccaacggttcaaattaaaatgtaatttaaatgacgatgcttttatcaatccgacggtcgaaccattcctaacttaatggcatgcatcgccggcagagtcgatagagcggcgtgaaccagccgcgctcatgacatagaggtatcatttaaagtgggttcagtcctgtgggtccgagtgatgaagtgtgtgtatgatgcgcgcgcattgatgagaagg

SEQ ID NO: 6312 - DNA, 164 bp, Gossypium hirsutum
  Clone ID: uC-gsronu33B027c09b1
ccggaattcccggcccgacgccacgctgtcttgcaccacaccgtatacgcgaagctgttgttttaagtgaccgtataggaatcatggttaaaggcagactcagctgccttggaacctcgatcaggttgaagtcacgattcggtactggaatcatcgctaatgtc

SEQ ID NO: 6313 - DNA, 137 bp, Gossypium hirsutum
  Clone ID: uC-gsronu33B027c10b1
tatcactcgtgcgaatagggggaacccaaacaatctggtaaactcagatgaggataggcaccgctctagaagatcaagatccagggagaggggcacgaataatgatagaaaacaaagaaaagatttggatggaagat

SEQ ID NO: 6314 - DNA, 58 bp, Gossypium hirsutum
  Clone ID: uC-gsronu33B027d01b1
ttacatatggatttgatggaatgttttgaagcatcaactgttatagagagagaacacc

SEQ ID NO: 6315 - DNA, 242 bp, Gossypium hirsutum
  Clone ID: uC-gsronu33B027d03b1
tatttaaccagtctatgctgggttcacagacacaagagctcaaccgtggctcgttcccaagctcatcagctcatggcaacaatggtgtacgatcatcgaaacctgatcagccgacaagcgttgcaaagaatcccaagaagcgaacaagggcatcaaggagagcacccactacagttctgaccaccgacacaacgaatttttgagcaatggtgcaagaattcactggaatccctgcaccacca

SEQ ID NO: 6316 - DNA, 114 bp, Gossypium hirsutum
  Clone ID: uC-gsronu33B027d04b1
tgaaatcatgggagttttaggcaaggaggtggaacccttttattataaacttacgatgtatactttccctcacttgatcttttttgttttttttatctcttttttttctttttt

SEQ ID NO: 6317 - DNA, 185 bp, Gossypium hirsutum
  Clone ID: uC-gsronu33B027d10b1
tacaattctgggcatttgaggaaccctaaccatctggtaaaatcagatgatgataggcaccgctctagaagatcaagatccagggagaggggcaagaataatgatagaaaacaaagaaaagatttggatggaagatgtgatcgacaggagacatgtttaaaacgggaacaaatcattgagagaat

SEQ ID NO: 6318 - DNA, 629 bp, Gossypium hirsutum
  unsure (1)..(629): unsure at all n locations
  Clone ID: uC-gsronu33B027d11b1
cccttcttttttcctttcttcttctcctctttttactctctctctctctctcctctttcccctttccctctttcttccttcttccttctctttttcttttcctcttcctttcttcctcttttcttcctttcctcttttcttcttttctttctctttcctccttttcctctatttcctctcttctccccttttctctctactccctccctctctttctctcacccttttcctctttctcatcttttctcttctctctccccctctttccccattctctctctccttcattcttttcatctcctccttcttcccttctcttctttcttctttctttctctcttcttcttccttcccttntctcttcttccctttactctctcctcttccttctcctttcttttctctccccttttattctctttttcctccttttcctatttcttcatctttcttctttccttctttcccttctctcacttcttttcctcctcttctttcttcccctctctcccccttcttaccttcctctcttccccttcctttctcttctcttcttcttcttatttttcctttctttctcctttttctattctcttctcttttcctattctctctttcctcctcctccc

SEQ ID NO: 6319 - DNA, 450 bp, Gossypium hirsutum
  Clone ID: uC-gsronu33B027e01b1
tccacgcgtccgattttcttcaagcccagggcgaggaattacgacgtactttagcggagaaaaggcataggcattaccgtgcgctactagaggcagcggaggaatcggtagcgaggaggtttagagaaaaagaagcggaagtggagaaagcaaagcgccggaacgtggagttagaggcacgtgcggcgcaacttggcgcggaggtacaggtttggcaggcgaaagccaaggcacaagaggtgacggcggcttcgttacaagcgcagctccaacaggccataatgaacggaggagctggtttgacgcagcaagatagcaagagagggtggggaagaactgccggaagtgcgccggcggtgaatcagaggcgcaggcggaggacgcccagtcggcttacgtggaccggaacgtgtcgtagcagctgcttctggcccatgttgaaaggcgtgt

SEQ ID NO: 6320 - DNA, 437 bp, Gossypium hirsutum
  Clone ID: uC-gsronu33B027e06b1
gaaaataccaataactatcagctaacgatgagttattacaatcagcaacagcctcccgttggcgttcctcctcctcaaggttatccaccggaaggttatcctccaaaggatgcttatccaccaccagggtatcccccacaaggatatcctcaaggttatcctcaacagggataccctccgcagggatatcctcctcaatatgctcagcctcctcctgctcagcaaaagcagagttcgggtttcgtagaaggctgtttggctgctctttgctgttgctgtcttctggatgcttgtttttgacgaccttttctccaatggcagcttacaaaaatattgaattgataggaggagagctgaattcaattaccatttttaaacttcaatttcaaatgttcttctttcccttcatcgctttttttctgcttaataagtgaacc

SEQ ID NO: 6321 - DNA, 499 bp, Gossypium hirsutum
  Clone ID: uC-gsronu33B027e07b1
tttcacgcgttcgggaggctgaagctcagtcaaagtgctgtcttaaaaccataggtgttgagctcactttcaggtgccatggagtaccagggctggaactggtgtagaaagcaggcgtggggatctgcttaataagtatctgtacttgtctgggagagtggacatgaggcaaattgagaggacaatccagtacttgattggatcgggaatggatcctcatacagagaatagtccttaccgaggattcatatacacttcgttccaagaaagggcaacttttatttcccatgggaatacaggcaggctggccaaggagtatggggatattaacttggctcaaatttgtggtagcattgcctcagatgagaagcgccacgagacagcctataccaaaaatcgtgaaaagctgtttgagattgatcctgatgaaacagtccaagcatttgctgatttgatgaagacgaaaattgccatgccggctgagttcatctatgatggc

SEQ ID NO: 6322 - DNA, 293 bp, Gossypium hirsutum
  Clone ID: uC-gsronu33B027e09b1
cttactgctggactttgttgtattataaaaaaagaaagaaatgttcaagtattgtgtgtaaatagtattgatagggccttttaagttatgatacccatttatgaaagttttttattgtaatttattccccctttttaaggtttttttttaaattatgtagctatataatattatatggagttgttctgaaaaaaaaattttttttctctcctcttttatcctcatatatctctattcctctctttactatcaaaccacttccctaattttttccctcaaagttctttaatttt

SEQ ID NO: 6323 - DNA, 205 bp, Gossypium hirsutum
  Clone ID: uC-gsronu33B027e11b1
tccacgcgtccgaataaaaaaaaaataaaagataaaaaaaaaaaaaaaataaaagaagagccgctttcgcagaattaggtttgctttccggtgcttgctgagtcatatttcactcactgactggcttgaattcagtactgtggcctctggtttaccactaacagtatggtacttccctgggtgtgcccactttaccgttttggct

SEQ ID NO: 6324 - DNA, 310 bp, Gossypium hirsutum
  Clone ID: uC-gsronu33B027f01b1
ttgaatttgtcgcttcgccacaaggagcatatcagtgcctatggtgagggaaacgaaagaagactgaccggaaagcatgaaacggccagcatcaacacgttttcatggggagtggctaatcgcggttgctcaatccgagttgggcgtgacactgagaagaatggaaaaggttacttggaagatcggcgtccggcatcgaacatggacccatatgttgtgacagcattgctggcagaaactacactattgtatgagccaacacttgaagctgaagcacttgctgctcaaaagattgctttgaatgtctaaa

SEQ ID NO: 6325 - DNA, 494 bp, Gossypium hirsutum
  Clone ID: uC-gsronu33B027f05b1
gagaacttacatagctcagacttcgatcatcaatttagggtttcttaattcgattccccgattacccgataccccaattttacagatcaggtctgagtgttctagttgttcggctgtttctatccgctaagtttcatgtctgatcttgacatccagattcctactgcctttgatccgtttgctgatgcaaatgctgaagacgctggtgctggtgccaaggaatacgttcacattcgtattcagcagcggaacggtaggaaaagcctgaccactgttcagggattgaagaaagaatttagctataacaaaattctcaaggacctgaagaaagaattttgttgcaatggccccgttgtccaggacccagaattaggaaaggttattcaacttcaaggagatcagaggaagaacgtcttcactttccttgttcaggctggtattgtgaagaaggatagcatcaaaatcacgggttttaagtctcggctcgagagttt

SEQ ID NO: 6326 - DNA, 429 bp, Gossypium hirsutum
  unsure (1)..(429): unsure at all n locations
  Clone ID: uC-gsronu33B027f09b1
ttccacgcgtccgcttattagttctcaactctctcaaattcaccatggctgacaagtgcggcaactgcgattgctctgacaaaagccagtgcgtgaagaaaggaaacagcttggtcattgagactgaggagagctacatcagcactgtagtggccaagcctctggcagagaacgatggcaagtgcaagtgcggaactagctgcagctgcacaaactgcacatgtggcagtcactaagcagacatataaaggttgatagtttgggacctaaaaagataaaagttgggttgataatttgtgtcttttggtgtagttgagtgttgtttttcttgtttatctgcccgatgtttgtctatgtctcttattttatacaatgaangaatggccatgtcaatggcccttgtctgattaatgaattattattagtatc

SEQ ID NO: 6327 - DNA, 492 bp, Gossypium hirsutum
  Clone ID: uC-gsronu33B027f11b1
taacactgttcctgtgccaaggcactggtctcagaaaaggaaatatttgcaggggaagcgcggtattgagaagcaaccttttcagcttcctgacttcattgctgcaacagggattgaaaaaattagacaggcttacattgaaaaagaggacagtaagaagttgaagcaaaagcaacgtgagcgaatgcagccaaagatggggaaaatggatatcgactatcaggttcttcatgatgcattctttaaatatcagacaaagccaaagctgacaactcatggagatctctattatgaagggaaggaatttgaggtaaagttgagggtagatgaagccaggctctttatcacatgagttaaaagaagctcttggtatgccagagggtgctccacccccatggcttatcaatatgcagaggtatggtcctccgccatcatacccacacttgaaaataccagggctaaatgcacctattcctcctggagcagctttgg

SEQ ID NO: 6328 - DNA, 452 bp, Gossypium hirsutum
  unsure (1)..(452): unsure at all n locations
  Clone ID: uC-gsronu33B027f12b1
tccacgcgtccggcaacccttgttttactcaaaaagatccctctccaacaatggcttctaatcccaaggtcttcttcgacatgaccgtcggtggccaaccagctggtcggattgtgatggagctctttgccgattgcactccccggactgctgagaacttccgtgctctctgcaccggcgagaaaggggtaggccgtagcggcaaacctctccactacaaaggctcatccttccaccgggtgatccccaatttcatgtgtcaaggaggcgactttaccgccggaaacggtaccggtaggtgaatccatctatggagccaagttcgcggacgagaacttcatcaagaagcacacgggacctggcatccctttcatggcgaacgctggacccggaacanacggatctcaattcttcatctgcacgaccaaacggagtggctggaccgaagcacg

SEQ ID NO: 6329 - DNA, 209 bp, Gossypium hirsutum
  Clone ID: uC-gsronu33B027g02b1
ctcttcttgagatcggttgcaatgacagacaccgaaaggatccttgattctaagtatggcgcctgtgttaactacaaccagaacatgcaatacgatgaacattggatgttctgggatggaccattcataggtgacatccttggtgcaatctatgaccagcttattctgcgggcacacgctgttaaagctcttggatccttaaggagcag

SEQ ID NO: 6330 - DNA, 97 bp, Gossypium hirsutum
  Clone ID: uC-gsronu33B027g03b1
ctccactcgtccgtttttttcatgctagtcatactacactagagcctagactagtacaactcagacataagtaaagcaataaaaaaacctaattcat

SEQ ID NO: 6331 - DNA, 88 bp, Gossypium hirsutum
  Clone ID: uC-gsronu33B027g05b1
cacgcgtccgatggatgatgtgttagctctggggagtggtgggttactacccctctcttaaggtagccaaattctcttatatttttat

SEQ ID NO: 6332 - DNA, 166 bp, Gossypium hirsutum
  Clone ID: uC-gsronu33B027g10b1
tcgttttatctccgtgtcaatcatatatatgtgaactcagaagacataaaggaaacggggtacacttacatcatgccaaagaacattttaaagaagttcatctgcatagcagatttgcggacttatattgctgtttacttgtttggatttagtcctttctgtcatt

SEQ ID NO: 6333 - DNA, 53 bp, Gossypium hirsutum
  Clone ID: uC-gsronu33B027h01b1
tttaattaataaactagatataaaaaatactgcggccaggaggatccactaat

SEQ ID NO: 6334 - DNA, 291 bp, Gossypium hirsutum
  Clone ID: uC-gsronu33B027h03b1
ttcactcgttcgaggggctgcatttgtgaggaccaaaatgcgcaattatatcactggaaacactgtggagaaaacgtttcgagctggaagtacgattgaggaggcaaacgttttcaaggaatcgaagcagttcacatacaaagatggttcccagtttgtcttcatggacctgaacacattcgaagaatcccgtctaaatgaggcagatgtaggtgacaagacgaagtggttgaaagagggaatggactgcaatttgctcttttggaacggaaagataattgatttttgagc

SEQ ID NO: 6335 - DNA, 413 bp, Gossypium hirsutum
  Clone ID: uC-gsronu33B027h04b1
tctcactcgtccgcccacgcgtccgaacttctttgtcaagattgtcaatgcaactgctcagagatattataaaaaacagatggacgagcaggtagacgataacgtatctgcttcaactcattctgattaagaagagtctgactgcatttatctcgataaaacagttgtgttagtgaactacaaggtaacctgtctttccataaattattacccattggaactacttcaaaagaaacccctgcactaagctagtcccttgttagaaagtttgtatagacagaacaaaaattaggaacacagacaacagaaggtagaggtttaattttattatatcccatgtaatgcttgcgctggggttttaatcattgtttttggactgtattttcttcccattgttaaagcactgtttcata

SEQ ID NO: 6336 - DNA, 270 bp, Gossypium hirsutum
  Clone ID: uC-gsronu33B027h05b1
gcgttcactcgttcgcccacgcgtccgatgtcttttgtttttatggtcaatgcaactgcgcacagatacaataaaagatagatggaggagcaggaagacgattacgtatttgctttaacttattttgattaacaagagtctgactgtatttattttgataaaacactctgtgttagggaactacaaggtaaccctgtcttttcatatattattacccatttggaactactttaaacgaatctcttgcactaaactagacccttgttagaa

SEQ ID NO: 6337 - DNA, 775 bp, Gossypium hirsutum
  Clone ID: uC-gsronu33B027h06b1
tgtaatagtttataggcgcttttgattgagaactcaccggacagtacacctttccatacttgaaaaaaaaaaatattaaatttaataatattatataaaataataataaattaataataaatttaattacattattttataattttactatttattttcttattaattattatttatatatattatttttatttattatttttattaatcattatttatatttataattttaacaaattaattatatattattattattatttttttattaaataattatttatattattattatattaattttattttatttttatattaattattattatatatattattaattatattataatttaataaaatatatactttatatattattcaatttattatacaatatttaattttatatatattatttcattttatattcattatataacatttatttattttatattttactttatatttataattcttactatatttttaattataatatattatatatttttaaaatattcttatataatttaatttttatttcttataatatatttttctatatttttttatttacatcaatatattctttataattatattaatatattataatttataatatatatatataatacataatctatagtataattattatttatttataatataaatattgtaaattttattatatttattataaatatatttaaattatataaactttttaataattattttataatattttaatttataatta

SEQ ID NO: 6338 - DNA, 111 bp, Gossypium hirsutum
  unsure (1)..(111): unsure at all n locations
  Clone ID: uC-gsronu33B028a04b1
ccacgcgtccgcaaatcctcacagtttttgttcccagtgaccctttggggtgcttnttcttatcatagccactcctccttctttagatggggtggcttcaatccctgtttt

SEQ ID NO: 6339 - DNA, 704 bp, Gossypium hirsutum
  Clone ID: uC-gsronu33B028a10b1
tgtttaaggaagctttgaaggaaaagtttgagggtctttgcaaggtcatcaaggatgtgctgggtgacaaggttgaaaaggttgtggtttctgatcgtgtggttgactcaccttgctgtttagtgactggcgagtatggttggactgcaaacatggagagaatcatgaaggcccaggctttgagggataacagcatggctggttacatgtcaagcaagaagacaatggagatcatcccggagaaccccatcatggaagagctgagaaagagagccgttgcagagaagaatgataaatctgttaaggaccttgttctccttctttttgtgactgttctcctcaccttttgctttagtcttgattagccttacacctttgttatcttttttcacagttttctttactttcgctttagcttttattaggatgctttttaaggttatagctgttctttttattcttctctttgtatttttttttttcttttcttttttttattcttttacttattctttctttcttttttttttctattctctaaattttttttttatatttaattatattttttactcctacttatttcctcttttttcttctttatcttttcttttctttcttatttttttcttctattttatttctttttttctatgttatcttatcttttctatttattttttttttttttttattttcttctt

SEQ ID NO: 6340 - DNA, 887 bp, Gossypium hirsutum
  Clone ID: uC-gsronu33B028b02b1
ccgttagccgttataaccacatacgagggaaaacacaatcacgatgtgccaactgcaaaaactggtagtcatgatacagcaggaccagtagcaatgtgtgggccatcaagggttagatcagaagaaaatgatgccattagccttgatcttggtgttggtattagttccgttcccgaacatgcttcaaatgagcaacaacaattggattctgaactggtccaaagccgcccacaggctggtggttcaagtttcaaatttgttcaaccaactatgatggcatattacggtgctctaaatggcagcatgaatcagtatgtttctagagaaaatccgagcgaaggccgtggtgttgaaattacacccctaaatactcttatgcatttccacagagcatgggaagaatactaaccggtccgtataaatctattaacaacgaagtgaggatgaataaaaattggactgggtttcatttctcattctttttactggtaaagggaagggtaaaattggatttgaaaattcggttttctacatatgttggatgtatgatggaaaggatgttaagttaccatttcatctttcatataaggttttcattatttctgatttacttgtagtcttctatgattatctctattgtttttttctttctattattacatatattcctttttatgtattattaactttttctcctttttgatattttatatattaatattctttctatttttttaattttttttttatttttttctttatcaatatccttttatattgcacattaattttttttatttaccttatttttaatatcaattcatattccttttttattacatatattttttttcttttctttttttttatttcttaactttttttct

SEQ ID NO: 6341 - DNA, 93 bp, Gossypium hirsutum
  Clone ID: uC-gsronu33B028b05b1
cctgcttgaaaaaagacaggacgcatcacaggtgtcatgtggtcatacaaatcacacaaatcgccccgaaggaaaagaggaaccaacttcaat

SEQ ID NO: 6342 - DNA, 958 bp, Gossypium hirsutum
  unsure (1)..(958): unsure at all n locations
  Clone ID: uC-gsronu33B028b06b1
cattcttctcatgcattggccaacagacatagtattagtaggaccagctaaagaaccagagaagaaagagggaccaaagaaagaaggtgatgccaataaagaagatgaacaaatgaaagaaggtgaacccaagaaggaagatgaacaaacgaaagatgaatcaggacatggatgcaagtgtggatcaaactgctcttgtgatccatgcaactgttgaaaagcttgatgaaagccctagattatgaaaaaagaaagcagcataataacaggcctctgtaatgatttattttcaaggatgaatgcctgcaaggtctatgactataattatgtctctgtttgtgtcttgtgttattgaagttacgcttgtttgttattttttgttttattatattatttgatatttttttttatttattttcttatctttttttttttcatttattttttattttttttgttttcattttttttttttttttatttctttttttatttttttcttttttatttttttttttttttattttattttttatgtttaaatttttttatttattttttaattctctatttctctttttattttatatttttttattctttttacttttttacattttcctttttttttaatttttttattgtcttttttttattatattatttattttatctaaaatttttaatctactttattttttctattttcttttattatctctaatgtgtctgtcctttttctattttatttttttctttgcttattgttttctatttattaacttatttctttatatcttttatttctactctttttttattcttttgttttttttattttttattattattctatttattattttcttttttattcttttattcttttntgtttttttttttttattttaattttatttccttatttaattttatattatatattcttttattattt

SEQ ID NO: 6343 - DNA, 508 bp, Gossypium hirsutum
  unsure (1)..(508): unsure at all n locations
  Clone ID: uC-gsronu33B028b07b1
cacatacgagggaaaacacatttacgatgtgccaactgcaaaaactggtcgtcatgatacagcaggaccagtagcaatgtgtgggccatcaagggttagatcagaagaaaatgatgccattagccttgatcttggtgttggtattagttnccgtcccgaacatgcttcaaatgagcaacaacaattggattctgaactggtccaaagccgcccacaggctggtggttcaagtttcaaatttgttcaaccaactatgatggcatattacggtgctctaaatggcagcatgaataatattgtttttagaggaaatcccagcgaaagccgtggtgttgtaatttcaccccttaatcaactcttatggctttccacagagcttgggaagaatactaaccggtccgtaaaaatttttttacaacgaaggtgaggttgaattcaatatggactggttttaattctccatctttttactgggttaagggtaggttattaacttattttacaattt

SEQ ID NO: 6344 - DNA, 135 bp, Gossypium hirsutum
  Clone ID: uC-gsronu33B028b11b1
cctggtcgaatcaagacaggatgtaactattctgtcatgcggtcatacaattcacacaaattgcctcgtaggaaatgagggaccattttcaatatgcctgttctccttattacataaatggttttttattattat

SEQ ID NO: 6345 - DNA, 225 bp, Gossypium hirsutum
  Clone ID: uC-gsronu33B028c07b1
cgtgcgagaaaacgcgtccgcttgggggctttttctagaaaccaaaaggttgagtcccgaacaatggcttttgcttgcatgaaacccacaaaacccggtttgggggaatcccaagaagcctattttcaagattcatgaatcactctttcctccaagaatgtgaaaaaccttgagaaagtttgtgctgatttggttcgtggtggccaggataagagactgagggtt

SEQ ID NO: 6346 - DNA, 965 bp, Gossypium hirsutum
  unsure (1)..(965): unsure at all n locations
  Clone ID: uC-gsronu33B028c11b1
atacaaacacaattaaaaaaaaaaaaaaaaaaataataaaaaaatcaaaacccacttttaattttacaaataatgacggggagccacttaatataaatatattttgcgcggcgtcttttgggttcccttgttttctttgcctggtcctctcatttgtttactttttttttcggtggtcctccaatttattttgcttgtcccctgttttcccccctcttttttggtttccccttttttttccccctttttttgggttttttcccattccctcttccccctgtgggcttttttacaagtggccccccccggttggctttttccaaaagtggcccttcttttttttttttttgggccgctccttttgtcttcttctttttgttgggttgttttttttttttcctttatttccccctttttcttttttttctcctttttcgctctctttattgttttcctctttctttttttcttttttttttttttttccctattcgtctttttgtgtttttctttttttttcttttttttttttctttctttgttcccctttttttttttttttttttcttcttctctttttttctttttcttttttcttttttctctcttttttttttttttttttttttcttttcctttctcttctttttcttttccccctccttcttttttcttatatcttctttttctcttcttcctctatcttctttttttatctctattactctttttttgctcttcttctttattttttctatttttctttttctctctttcctcttctcctcttctttcccttctttttctgtcttttatttctctcttcttttttcttttttttccttcttctatactttttctcttttttctttttttntcttttttctttctatctacttttttcttctctttttttcttcttatcttcttttcttcctttcttcctttttctttcttttccttct

SEQ ID NO: 6347 - DNA, 153 bp, Gossypium hirsutum
  Clone ID: uC-gsronu33B028d08b1
tcgtcccacgcgtccgttctctcgtccgatcacgcgtccgcgcagacgtgggcatgctagcaacttcatagaccacaaccgcccttaacccttcctgagtgtcatcgcccagaacataattagtgtaatgtacaacacatttgaccctgtcta

SEQ ID NO: 6348 - DNA, 391 bp, Gossypium hirsutum
  Clone ID: uC-gsronu33B028e02b1
caaataatggctccaccgaaagcagggaaaacctttccatcgataacggaatgcgatggattgaagtacgaatcgatcgccgccgatctggatggcacgcttttaatctcacgaagctctttcccctacttcatgcttattgccgtcgaagcgggaagcctccttcgaggtcttatccttcttctttctctgcctctggtcatcatatcttatctcttcatttccgaagctattggtattcaaatcctcattttcatctccttcgctggactcaagatccgcgacatcgagctggtatctcgcgctgttcttcccagattctatgctgcatatgtaaggaaggaaagtttcgaggtatttgacagatgccagaggaaagtagtggtaacgg

SEQ ID NO: 6349 - DNA, 181 bp, Gossypium hirsutum
  Clone ID: uC-gsronu33B028e05b1
ccctctcttccgaccacgcgtgcgtgcagactcgggcatgatggctagttcaaagaccgtaacgaccctagagcattcttgagtgacatagcccgttgcataatctgtctaatgtacatcgataagaacctgtcggatgatctaaatgacctaagatgggcgatagatcctaacgatatgc

SEQ ID NO: 6350 - DNA, 158 bp, Gossypium hirsutum
  Clone ID: uC-gsronu33B028e06b1
cgtcccacgcgtccggccatgcgtccgggcaaacgtgctaagagaggtgggcgtgatcaataatatagaccccatggcgtccctccaccctacgagtgtggactcgacgggtgaataactagtgtggagtactacagactttgcttttctgcaagtgg

SEQ ID NO: 6351 - DNA, 118 bp, Gossypium hirsutum
  Clone ID: uC-gsronu33B028e07b1
ttctcgcgtccgatcacacgtgagtggagacgagggcttgctaacaagtttaaagaccttaaccaccttaaagcattcttaactgacgtagatagttacgtaaactgagtaatttact

SEQ ID NO: 6352 - DNA, 300 bp, Gossypium hirsutum
  Clone ID: uC-gsronu33B028e11b1
ttctctcgtccgagcacaagacagagcacagctggtcatgaaacctacttttcagaccgtatccatcacagaccctgcataaccgacatagctattttgttgctcctagcactctaattcgggatttgcctgtctgatgatgtataccacctatgagcagcaagagagcaacaacgataacgcagtttacaatcagcgtacaatcatgtatgtcttatgagaatgcaatataaaccgcacggtgactaaggtatgccgattcgggaagcctgagtacaaacgctcgtaggacattgggta

SEQ ID NO: 6353 - DNA, 341 bp, Gossypium hirsutum
  Clone ID: uC-gsronu33B028f04b1
cgtcccacgcgtccggccatgcttccggttaaaggtgcgaagagtgggggtcttgatagctagtatagacaccacagtggcccttgaccctgcgagagagtcatttcgctatatgtaattcgtttgtcttacaaggtagtttccttggcttattgtgtttattttctatttagttttttatttattttgtgcattttttttttactttcgtatgtcatttatatttctttttatttttgtataatttttaatattattattcttttgttttaattgtaaatttttttccttattaaatatttttcgatatattttaatttttttttattgatattttattt

SEQ ID NO: 6354 - DNA, 244 bp, Gossypium hirsutum
  Clone ID: uC-gsronu33B028f05b1
gcctctcttccgaccacaggttcgcagagtcaagggcgtgataactacttcaaagaccgtagcgccccctgacccagctttacagaccaggcccgatcgatatactttttaatgtacttctataagatcctgtccacggatgttcttgacctaaggagtgctactgggcttgacgagatgcatgatgcaaatgaagactaaatcaggtgagtgtcgtcaagggatacatgaaaatactgatgaa

SEQ ID NO: 6355 - DNA, 207 bp, Gossypium hirsutum
  Clone ID: uC-gsronu33B028f06b1
gcctctcttccgagcacgggtgagtggagacgagggcctgaacactagtttatactacgtagggaccccagggcgtgctagagggacttagctagttgcgtacactgggttatgtacatcgctatgaacctgtcggataatataaacaacctaagtggggggcaaggactgaacgagatcgctgtttgcaacgaagcctgattcaat

SEQ ID NO: 6356 - DNA, 210 bp, Gossypium hirsutum
  Clone ID: uC-gsronu33B028f10b1
ttctctcgtccggccacaggtccgcgcacacgtggtcatgctaccaactatatagacagtaaccgccctagagcatgatatacggtcgatgccatatccataaactttattatggacatcagtatcagcgtgtccaatgtagggcctgaccaaaggcgggcgaaagagacaaaagacatgcatgtatacaacaaaagcataatcactgag

SEQ ID NO: 6357 - DNA, 244 bp, Gossypium hirsutum
  Clone ID: uC-gsronu33B028f11b1
ttcactcgtccgatcacacgtccacgcacaccaggtcatgctaactactttaaagaccttaacgatcctaaagcatgctaaacagacatagctctttacatcaactttctaatttaaatcaataataccctgtctgataaaataaatcacctaagacatgctaaagaacttaacgataagcaagtttaaaacaaaggcatattcattgatctctgaataggatgcattatataactcaccatga

SEQ ID NO: 6358 - DNA, 56 bp, Gossypium hirsutum
  Clone ID: uC-gsronu33B028g08b1
tttcatgcgtccgaaaaaacgtaaatgcagagggggttcttcttttaacaataccc

SEQ ID NO: 6359 - DNA, 534 bp, Gossypium hirsutum
  Clone ID: uC-gsronu33B028g10b1
ttattcgtccaaaaaaacataaatataatagtggtctttttttaaaggatacccacccattcccccaataatttaaattttatttttgttttaatattttataaatatttaatattaataattctactttttttatatatttttttaattataattatttatattataaattataaatttatttaaaaaatatcatttattatttctatattttataatataattatatataattaatattatttaatttattatattaaataatattataaattaaattataattattaaaaaaattaattttatacattatattttatttatatatttaaatataatttattattttactattacataatatattttaattaaataattttattaattatcattattttatttataatatcattaataactttttaattatatataatatttatataatattaatatatctctaatatatatatataaatcttttaattatatctttaattaatttttactaatataatataatttttataa

SEQ ID NO: 6360 - DNA, 158 bp, Gossypium hirsutum
  Clone ID: uC-gsronu33B028g12b1
tcttctcgtccgtccacgcgtccggcttttttacaggaagcttaggcacttgaaatatgtggacaatttccatcaatacgatctaagcttcaagcgtcactgtaaggatgggaagctaccaaattatgtggtgtttgatcccagatatattttttata

SEQ ID NO: 6361 - DNA, 346 bp, Gossypium hirsutum
  Clone ID: uC-gsronu33B028h01b1
tagcttcttcgttttcctccgcggctccatttctcgttccctcaatatcaaagtaaaaatgaaggtggtcgccgcttacttgctcgccgtactcggaggaaacgcttccccttccgccgatgacttgaaggttattctcggatcagttggagctgaggctgatgatgataggatagagttgttattatccgaagttaagggcaaagatattactgagctaattgctagtggaagggagaagttagcttccgttccttccggtggtggtgctgttgcggttgccgctcctgcaactggtggcggaggcggcgatgctgcacctgcagctgaggcccagaaagaagag

SEQ ID NO: 6362 - DNA, 208 bp, Gossypium hirsutum
  Clone ID: uC-gsronu33B028h03b1
atctttcgtgcgcttgggaatcatggttcaaatgtgactgaggaagaactagagacacacacgatatcagcttggaaggagggaaaggtgtatcttggcagacagattgatggcaatgctaggtcatatcctagatgtcttgttcaagctggaccatatgattctttgaagaacatgatgctttaagtttctgtttactaagacaatg

SEQ ID NO: 6363 - DNA, 74 bp, Gossypium hirsutum
  Clone ID: uC-gsronu33B028h05b1
gcgacgtgaccggctaatagcgataacgaacgagggtttattttattaactagctacacggaggtccccccaaa

SEQ ID NO: 6364 - DNA, 95 bp, Gossypium hirsutum
  Clone ID: uC-gsronu33B028h06b1
ggcacatggtaagagaagaggaaaggcagatataggtttgtattaatctataaaaacctctgattccacttaaaaatcctattattttttttttt

SEQ ID NO: 6365 - DNA, 297 bp, Gossypium hirsutum
  unsure (1)..(297): unsure at all n locations
  Clone ID: uC-gsronu33B028h07b1
agtccgaactttgctgctcactttgtncttcatcaaaccccagagacctagctttgcctcctttttaatttcttggattttggtgaactttatgaatccaagatcagagtaaaggattcgagttttaaccccagaattaagtacatctgctctttttgatctttgggttgaaattgtctacacaaagagggtgatttagaaatggatgctgatccatgactctttttttttttaactgttagagttattattttgctcttcagtcacgatctgatattgtttatggggtttgaagaa

SEQ ID NO: 6366 - DNA, 172 bp, Gossypium hirsutum
  Clone ID: uC-gsronu33B028h08b1
ttcattcgtccgactatctgttaaaaaagacgtggtgttaatgacaactagagagtctatatccctccttggggacacctgatggtgcatgttgcacgttaaccgtttataattgacttaaaaaagcaggagtccaacgatcttgtcgggcatttcgggagctaagagatcc

SEQ ID NO: 6367 - DNA, 167 bp, Gossypium hirsutum
  Clone ID: uC-gsronu33B028h09b1
gatgcgcggcaatatttcaagtattttatcttgcgcttttagttccttattctcattatcttcccttggttgcttggtattgaattgtactttttgatgatctttatgtgcttgtgcaggaccttgtttagcttttgaagcttgtttgtttttggttttcgggttaa

SEQ ID NO: 6368 - DNA, 65 bp, Gossypium hirsutum
  unsure (1)..(65): unsure at all n locations
  Clone ID: uC-gsronu33B028h11b1
actcctaggacacatgtaatgttacttgtttggaaggtatgttatcgnncaataccccctattcc

SEQ ID NO: 6369 - DNA, 71 bp, Gossypium hirsutum
  Clone ID: uC-gsronu33B028h12b1
gtctttttcttttaaaaaaagaaaaaaaaaaaaaatgaataaaataaaaaaaaaggacgaaaaaaacaaag

SEQ ID NO: 6370 - DNA, 99 bp, Gossypium hirsutum
  Clone ID: uC-gsronu33B029a02b1
ccctcgctatcggccacgcgaccgattgctttcattttcttttttaccatagcttttattctcactctagtatacaccctagagattactacttgttta

SEQ ID NO: 6371 - DNA, 364 bp, Gossypium hirsutum
  Clone ID: uC-gsronu33B029a06b1
cggaacttccttgtcggacccacccgtccgcgtagtttttggggtggaacccgttgttggttgtttacaaggtgttgaacttgaagaagcttcggttcagagggttgaaacattgacgagtggtgaattcacggaaactgttcgagtgaatgccacagtgaagatcttagaagagtttttgcgtcagaaagatgatggggtggttgaaattttgtcttctaaaagcgtggaggccaacaatgataaaggatccaatcccaagactacaatgaatgctgatatggggaggagtttgaagccaaagcaatggttgaattcccctatagtgaaagctaattatggagataatgacatgaactttggg

SEQ ID NO: 6372 - DNA, 917 bp, Gossypium hirsutum
  Clone ID: uC-gsronu33B029a08b1
ttgcctacgcgtccgcccacgcgtccggtttttcctttttctttattttgaagtgtcaaaccccacaattgttgaggtaaacattgtgaagaaaaatggaaaaacagatgatttttgcatgtgcaatgatattttgtcttgctcattgtttcagttgttggccaattctattccagatctgtttaggtatgatcttttgttgaaaagttttctcacatttatcttatttttctaaatatctatttattaattaattttttttattcaatttttttattttttttttatcttatttttttttttttttaattctttatatttttatttatttttttaatctatttatatttttatttatattatattatttctattttttttatcttctatttatctttctttttattttttttatattaatttatatttaactttctatttttatattatatttttcttttctttttatttctccttttttattattttatttcatctatttttatatatctattctattcaatttatatattttcttttcttacttaatttaatttttttctattttattattatttattttattttttcttttattttcttttttttaaattattatttttttattatttcctttatattattttttaattttttttttatatcttttaattttaataattaatatttttcttaattttctttttcaataattaattttttattattatatttatatttttctacatttttttattttcttatctattcctttattcatttttttttaattctataaatttataactctatttttatttatttacttatatattttttattttttattctcttattctaatattataatcttttttttattatcttaattgtttttattctaatattaaattatt

SEQ ID NO: 6373 - DNA, 272 bp, Gossypium hirsutum
  Clone ID: uC-gsronu33B029a10b1
gcgcccacgcgtccgcccacgcgtacggtagcgatcgccataactgatgctcaaagcatttgcagcatgccagcttcaggtttgatggcatgcaaaccagcagtgacccctcccaaccctccgccgcccacgtcaacttgctgctccgccctctcccacgctgacatgcgttgcctttgctcatataagaactccaagctgttgccttcccttggtattgacccaaaccttgccatgaaattgcctagcttgtgcaagctttcttcatctgc

SEQ ID NO: 6374 - DNA, 144 bp, Gossypium hirsutum
  Clone ID: uC-gsronu33B029a12b1
tgtgcagcccgatgttggtcgcatccaaggtgaaaaagttgagcaggccctcggatcagagggttgaaacattgacgagtgtgtgaaattaccggaaactgttcgagtgaatgcccacagcgaagatcttagaagaagtttttg

SEQ ID NO: 6375 - DNA, 240 bp, Gossypium hirsutum
  Clone ID: uC-gsronu33B029b08b1
ttcggtttgtctattgaattctttccctcactttctcgaaaaaaaaaatgtcttcaggttgcaattgcggatctaactgcagctgcggtgacaactgctcatgcagcaggaaccttaaccttggatattcggagaagacaaccagtactcagaccatcattttctgtgttgttccagtgtagattaacttttaggaaccatagacaagttttatattatttacttaaagtatctctttct

SEQ ID NO: 6376 - DNA, 523 bp, Gossypium hirsutum
  Clone ID: uC-gsronu33B029c02b1
cccacgcgtccgcccacgcgtccggttttctctgtttgccatttgccttaatcatcttcctctttctttaaaacttcttcctatttaatttctgactaaacttgcgctgaattccatggctactgcagaggttgtaacagctcaaactgcaatccatgaggagaaacctgaagaagtggtcaaggttgaagaaattgcaacagaagaggtagtggctgttgctcctgcaacagaacctgttgctgaagaaccaaaggaagcagtgcctgaagcagcatccgaagaaccccaggctccagaaactgaagccacagttgaaactgaatcaaaggaggtggttgaagagcccaggctgtgactgaggaccagaagttgagaaaaaagaagaagagactcctgaggaaacagtagcagagccagttgcggaggagtccaaggagactactgagccaaccgttgaagaaaccaaagaaagcacagagtctacagaagcagcagtagctgcagcagcagaagaagaagt

SEQ ID NO: 6377 - DNA, 174 bp, Gossypium hirsutum
  Clone ID: uC-gsronu33B029c04b1
ccctcgctaccgcccacgcgtccgaaaaaaaaggggaggaataacaataaaacaccctacccacgcacccccaattaacgagtgtgcgctgccccgcctgcccctgtccatctgctcccttctggctcctctgccggcctcttttaggggggggcccgctattgggggtcccgg

SEQ ID NO: 6378 - DNA, 427 bp, Gossypium hirsutum
  Clone ID: uC-gsronu33B029c05b1
ccctcgctatcgcccacgcgtccgctcagggatctgcgcttagaggtttgttttcatctctccctttccttttctatttattcttcattctttatatcttttccttccttttttatctctttcctctttctaccttttattcctctcttcccctattttttcctcttctttttctcttttcatactttcttttcttcccttttctttttttctcttctatttctttttttcttttctattttttttttaccttcctatccttccttactttctttcttttttcttctatctttcctttctttttctcttctatttttttcttcttctctctttctttacctctttacctctatattttctcttattcttatttattatcttatttccttttattcttcttttcttttttatatcctactatctcttc

SEQ ID NO: 6379 - DNA, 144 bp, Gossypium hirsutum
  Clone ID: uC-gsronu33B029c07b1
tcgggttaagttgggatgttgtctaatgtctagaatatttaatgtctgtcatttagactcttttatggtgctgtttttatagacactggtttagtagcaaactttagacttcatttattatcaattttcattatttacttatat

SEQ ID NO: 6380 - DNA, 89 bp, Gossypium hirsutum
  Clone ID: uC-gsronu33B029c09b1
atcgcctacgcgtccgcccacgcgtccgctgaaaatgctcgagtctataacgaaaaagtccttgttgtggcgaagaattctgccattaa

SEQ ID NO: 6381 - DNA, 916 bp, Gossypium hirsutum
  Clone ID: uC-gsronu33B029c10b1
cgtatttacagaaacaacagatgaagaaatataaattaatttataaaaaataatttaaaaaatatataataatatgggttgtcattttagtggtttaatgttttttttttttttttttttaagtggttttttttttgtggggtctcttttttttttttttgtttgtggttgtttttattttttttttggggggggccctttttttttcctccctttttttttcccgccttttgtcccttttttttcttttttttgtccccccttttttccttttctgggctgctcttttttccctgttttggttgtttatcctcttgtcgtcccccctttttttcttctttttgcttccttcttttttgtgggttttttctttctctctttgtctcctcttttttctttttttttttttttcctctctttttttttcttttccttccctctctttttgtctttttttccgttttgttgtttgttttttctctcttttctcttttttttttcttctttttctcttcttctctttttcttttttttttcttttttttcttccttttcttttctttttttcttttttttcttcttttttctttttctcttctttttttctttttcttttctcctttctttttttttttttctctctcttcctttctttttctttctcctttttcttctcctttctctttttctttcttttttctttttttttttcttttccttcttttttcgttccttctctttttctctctttttttttcttctctcttttttctttcttttcccttttctttttttcctcttcttttccttcttccctcttccctcctcttttcttttctttctttttctcttttctctttctttcttccttcttttctttttttctctctttctcctctttttgtctttttctttc

SEQ ID NO: 6382 - DNA, 692 bp, Gossypium hirsutum
  Clone ID: uC-gsronu33B029c12b1
tgcataaagtgaacctgttgaaggctttaattttagtactactacgttgttaacaagatatctacaggcaagttctgatattccagcttagccactcacttttctaccttggatttaactgtcttgttgcttgtctaccttttattcaatcttttcttgttattcatctttctccttttgcttatcatctttcttttcttatattcttcttaacatttatttcttttttatattttattccttattatctttaattttttttctaatttcttacttaatatcatcttatctcttctttttatatcttctttcttttatatttttatcattccatcatctcatatcttttttctctactttttttttctttttttaatatttttctcttcacttataacttctaattactatcttccttttttctttaatactcttccttactctctctctctcattctctccttcttaatcttcttttatattttatccattcctcatctctttttttatctaatccttattctattatatcattttcatacttttctcattattcatttcatttttcatttatttctcttactttatttcattcttcattcatttaatatctttcttattatatacttttaatattatcttttatcattttttaaaattcatttttttattaactcatctttcttctatct

SEQ ID NO: 6383 - DNA, 291 bp, Gossypium hirsutum
  Clone ID: uC-gsronu33B029d01b1
cccacgcgtccgcccacgcgtccgctggttttgctttcactgttaacggatgggtgcaatcttatgggtctcgctgcgtcaagccaccaatcatctacggtgatgttagccgtcccaaaccaatgactgttttctggtcatctactgcccatagcatgactaaacgcccaatgaagggaatgcttactggccctgtctaccattcctaactggtcctttgtcagaaatgacctaccgatattctaaacttgctaccagattgtctaggccatcttggttacaagtattata

SEQ ID NO: 6384 - DNA, 110 bp, Gossypium hirsutum
  Clone ID: uC-gsronu33B029d02b1
cttacgttttcgacgagtcgtacgtacagttttttagttttttaatataattaaacatatctatccctaccaaataataatatataaatataatatatataaaaatatta

SEQ ID NO: 6385 - DNA, 259 bp, Gossypium hirsutum
  Clone ID: uC-gsronu33B029d04b1
ggtatatctcttgcttcttttcctcaaggctgtttctactccacagcagtaggaggattaagacgctatgagaatcctaagaacaagatcactgcatttgccttttgtccaagagtactactttcccttctctatcctattctcccttcattttttatatactttatcactttcttttactcatctattaattttccatcttcttcttcttattacttttacttctttttcacttcttcaattttttttttttttttct

SEQ ID NO: 6386 - DNA, 365 bp, Gossypium hirsutum
  Clone ID: uC-gsronu33B029d07b1
tcgattgaaagagctcatctcagacttcagcagtgaacacagttcaaaatgctaggattcccaaccgaagctgatacggggtaaagctactagaatcagagctatttgcttatttttcaaaagctggagaactgcatacatatttaatgatgcgttcttcatatctgtgcctttagaagattctttgttattactctttatttttgtttctttatattgctaccttttcttttctttctcttttatttcttatttcatttttaattttctcttttttttattttttatcctcttttcatattctcttttctctctttttttaccaattttttttataatcatcactttttattatttttttcttt

SEQ ID NO: 6387 - DNA, 103 bp, Gossypium hirsutum
  Clone ID: uC-gsronu33B029d10b1
tcggttactcgtaaaccggggccaattcctgggatcaacactaaaattacctctttcctagatcctgatggctggaaaactgttctggttgacattgaggact

SEQ ID NO: 6388 - DNA, 83 bp, Gossypium hirsutum
  Clone ID: uC-gsronu33B029d12b1
atcgcttacgcgtccggttccaaggcatcaaatatctggatttgagacagccttgacaagtggttcagatccattgataccca

SEQ ID NO: 6389 - DNA, 953 bp, Gossypium hirsutum
  Clone ID: uC-gsronu33B029e05b1
acggtgtcttgccgataatgcgcagaggtctgtcggggataatcgaacggtggagaggagtaatattttttttttactatttttattaataaaatatttttaggattttaaaaagattataggagttgttaactttttctgcaacggcgatttatccttttacagaagacaaattttatacttattgatgttttgaaaaaataatttataaaaaaatgtttttataaaaaatttaaaaatattgatcgttttaaaatttaagacttaaaaaatcagctgtttttttaatacgagaatatttacactttttatttttaaaggtatccacgggtttttctgattttgaacaaattttttgtatgttaataatttttctgtatttaaattttttaaaaaaaaattgtttttattttaaaattctaaaaactttagaatttcaatataggaaggaaaattttttgtgatgaaaaactttaaaacatttttaatgtaaaaaaaaaggtagtttttttgaaaattggaaaaatgtaaacccttattttttgaagaatactaacttattttttttaatttggccttggttgaaaataagcaaataaaagttagttttttcaatgaatttaatgtttgcttttttttggagataaattttattggtggttaaaattaaaaggtttattaattttataaaaattttgggaaataaaaaaattttataaaaattctttttataaaattatatttgttaaaaatatttatatataataaaaaattatgtaattaatatctaatatattttattttaaattatatttatttattattaaatatttttttttttattttctttatcttttattatttatataattattatttatattttttatttattttaactttttatatattttttttatctttttctatatattatcatttatttatatata

SEQ ID NO: 6390 - DNA, 706 bp, Gossypium hirsutum
  Clone ID: uC-gsronu33B029e06b1
attaactgtgaagccgatgttgatggtgacggccagatcaactacgactaattcgttaaagtcatgctgtaaaagtaaggtttatttttatatatattttacttaagtaattataatttatatttttgttatactattttttatttatttttatttttttttattatatttcttatattctatttattatgtttcatttatattattatatttattatttatttatatttatatatttttacatgattatattttttaattctattttttatattttattttatttatttttttttctatgttaataacattttaaatctttatatatatatattttaatttataattatttgttaatgtaatatgatttatctaataatattattatttctctttaattataatcatatttatttatttttatattaatatttattttattaattctcatattctattcttctatctacttagtcatttatattctattttcaattcaatattatattttaaatatatatcgtattttattataatatttttattttataattttcatttctctcgatccatatttatattataaattatcattattattatagatttttttattgaatatattttttaattatatattttatatttattatatattattttaatatctaataatacatctttaacttttaatacaaatattaat

SEQ ID NO: 6391 - DNA, 173 bp, Gossypium hirsutum
  Clone ID: uC-gsronu33B029e08b1
atcgcctacgtgtacggacaactcggagttctttactagtaccttcggcacaacaaacatgccccatagacactctgaagctaggtgcatgtgtggacagttttttctattatattatacttattcttgctttttttttatttttatacttttctattcctattttttttttt

SEQ ID NO: 6392 - DNA, 867 bp, Gossypium hirsutum
  Clone ID: uC-gsronu33B029f03b1
cctacgcgtccgcgacagtgtagatcttgagaaaggtcatgctgagtcacaggttcaggacgacgggtttcaagctgaggttgagacattagggaagattaggcacaagaatattgttaagttatggtgtttttgtacttcttcgttattgtatgcttttgttgtattatattattcttaattttttttttatttttttgttattttctcttatactattattctttctatttttcttattttctttttttattttctttatatatattttttttttttttttttcttttttttttttatttcattttcattttttatatatattttatcctcttattcttcttctttattttatatttctttatttatttattttcttttttaattttttctttttatatttttattatttcttatttcatttcttactctcttttatttttttattttcttctttattatttttttattatttttttattttttaattttatttatttcttatttttaaaatatttttatttttttctatttctttttttctaatctatatctatttttttctttttttttatatttctattttattttctttttattctttttttatttatttctcttattttcttcttttttttattctttttattttttttttctttttttttttctttatattcatttttataaatttatttattattttttattatttttttttttttatatttttctattttttatttctttatttattactttctttatttaatatttcattctctaatttttataatttattattttttatatttttattctttattattttctttttctgttttattatttttttatatttttctt

SEQ ID NO: 6393 - DNA, 217 bp, Gossypium hirsutum
  Clone ID: uC-gsronu33B029f07b1
tcgaaggtcttgttatgaacttctacaaggattcttgtcctcaggctgaagacattatcaaggagcaagttaagctactgtacaagcgacacaaaaacactgctttttcttggctgagaaacattttccatgactgtgctgttcagtcatgtgatgcttcactgctgctggactccacaagaaggagcttgtctgataaggtgacagacaggatctt

SEQ ID NO: 6394 - DNA, 199 bp, Gossypium hirsutum
  Clone ID: uC-gsronu33B029f10b1
tcgcccacgcgtccgcccacgcgtccgcatccctccagaccagcagcgtctgatcttcgccggaaaacagcttgaggacggccggaccttggccgattacaacatccaaaaggagtcaactctccacctcgtcctccgtttgcgcggtgggatgcaaatcttcgtgaaaaccttgaccggcaagacaatcactctcgag

SEQ ID NO: 6395 - DNA, 218 bp, Gossypium hirsutum
  Clone ID: uC-gsronu33B029f11b1
ttgctcagcggtcggacgcttacaggggtgaatatgaagaaatttttatgtggagaaaccattgcaattgtatatattgatgcaagattctgtttgataaattcaaaatgtaacactaaattaccttatggacattaacttttgttgtcattttacaaattttatatattttttccaatggtttgaatattattttctaattttcaacaattgtttaa

SEQ ID NO: 6396 - DNA, 265 bp, Gossypium hirsutum
  Clone ID: uC-gsronu33B029g01b1
atgtagtctaacaccaaaatgtcagctcttcttttgctttgcatgcttttcatttcttcagtgacaccaattcttgggtgtggtttatgtgggaaagcaccacacaatgtatctttgtctatgggaatgtttttttatgttatattactatttattttctagtgaaatattcattcatgttgctactttttttttcttttatttataattaatttatctttactaatttatattcaatttttcatattttctttttatttttata

SEQ ID NO: 6397 - DNA, 588 bp, Gossypium hirsutum
  unsure (1)..(588): unsure at all n locations
  Clone ID: uC-gsronu33B029g05b1
cccacgcgtccgcggacgcgtgggtccttttagcattttctctcaaaactcaacctcccaaatcctctgtacctttttttttcttccaatccagacagcacccaattccatggccacctcttccccacgtgaggataatgtctacatggcgaagctcgccgagcaagccgagcgctacgaggagatggtgaagttcatggagaccgtcgtctccgccgtcccctcctccgacgagctctccgtcgaggaaaggaacctcctctctgtcgcatacaagaacgtcatcggcgcccgacgcgcctctggnaggatcgtttcctccatcgagcagaaggaggaaggacgcggcaacgccgaccacgtctccgtcatccgtgagtacagggccaagatcgaggctgagttgtccgagatttgcgccggaatcttgaagctcttcgacgagaagctcgttccggcagccaagaccgnggattccaaggtcttttatctgaaaatgaagggagattaccataggtacttggcttgagtcaagactggcgatgacaggaaagccgctgccgagaatacgcttacgcgtataaatct

SEQ ID NO: 6398 - DNA, 255 bp, Gossypium hirsutum
  Clone ID: uC-gsronu33B029g06b1
cataaattcaactgataatttcgaaagaggttttcgattacgctgatcgaagaattaaagggataagtaaacaagattggtagaatggctttagttgctgtaggatctgtaacattgtactccatttcccctctgttttgtctacttttttttcttttctgcttttgctttttatttctttctattttatttgttattcttattactcttttttgttttttttttttctttctttctttttatctttttttattt

SEQ ID NO: 6399 - DNA, 980 bp, Gossypium hirsutum
  Clone ID: uC-gsronu33B029g07b1
tcgtatatagtgtcatacaggttaaagatgaatttatgcatacagaaggtgcggacgttatttaatttttgtatttattttttttatatatttattaactttttttttttttattttattttatatttttaatttattttttttttaatataattttatatttttatatattatttttaatttatcttttttttttatttatttttttttttattatttatttattattttatttattttttattttttatttttttattttattaattttattttatttatttatatattttaatatatatttaatatattttatttttttttttcttattttctttatttttttatttttttatattattttttttttatatttatattatttttatttttatttatttttattttttttttttatttatttttatcttttatttataattatttagtatctttatatttttatttttttttatttatttttttttttatattactaattttgttaatatttaaataatttttattttttatttatatgtatttttatttgtttataattttatatttatttattttttattattttttttatattacatttattatatttacaatatttattatttataactatttaattatttttctatctttttaatatacttttttatctaattttatttttacttttctaattttttattaatctatcgattatttatcttttatttattttttattaattttatatatttatctatatcctattttttaatttttttattcatttctattattttttataatatttttatatttattattatttattattttattttataattacttattatttttttattaataatatttcattttattctttttatttttaatttcttattatttttataatttaataatatatatatttattttaattaaatattttctttattttaattttctttata

SEQ ID NO: 6400 - DNA, 810 bp, Gossypium hirsutum
  unsure (1)..(810): unsure at all n locations
  Clone ID: uC-gsronu33B029g09b1
aaaaaaaaaaaaaaaataataataaaaaaaaaataaaaaaaaaaaaaaaaaaaaaaaaaaaaaaaaaattaaataaaaaaataaaaaataaaanataataaaaaaaaaataaataaaaaaatatataaaaaaaaaaaaaaatatataaaataaatataaaaataatataataaaaaataatattaatataaataaataataaaaatatatataaataaataaaattaaataataaaataaaataataaataaaataaaaaaaaaaaataaaaaaaatataaataattaaaaatataaaaaaaaataaaaaattaaaaataaataaataaatttaataattaaaaaaaataataaaatataaaaataaaataatattataaaaatattaatataataaaaaaataaaataaataaaataaataaaataaaatatataaatataaataaaataaaaaaataataaaaaatataaaaaaaaataaaaataaaatattaaataaaataatatatataaaaataataaataaataaaaaaaaaaantaaaaaaaataaataaatatatataaataatataaaaaaaataaataatataaaataaaaataataaaaataatattatataataaatataaatattaaaaataataattaaattatattaaaataaaatanaataaatataaattaaataaaantaaaaataaaaaaataaaataaaaaataataaaataaaattatttcatataaaaattaataaatatattataatatataaaaaaaaaactaaacaaataaataaaatataaaaa

SEQ ID NO: 6401 - DNA, 76 bp, Gossypium hirsutum
  Clone ID: uC-gsronu33B029h03b1
gctgctgcgcgtgcacggtacccggatcgcagtttcggcccaggcgtacgcctacgcgtacggttctagatcgcga

SEQ ID NO: 6402 - DNA, 344 bp, Gossypium hirsutum
  Clone ID: uC-gsronu33B029h04b1
atcaccctgagagtgaactaaagcctggaattgaccttctaggtcccgttgatgagatattctttgatatctatgaccgatatgaaccagtcaacgaaccttctcttgacaattgtttcatatcaacaagttatgatgctacaacacattttgaatcaactgtcagtgatgtacttaacatgtataccatgataactggaaaggttcttgacctcagtgtggatttgagtgctgctagtgctgcggaagaataattaccctgaagcatggtatttgccaatgtttgtgcttgtttaagcttcttaaacagtgttgaatgttgcttgagggattttatgtctatt

SEQ ID NO: 6403 - DNA, 344 bp, Gossypium hirsutum
  Clone ID: uC-gsronu33B029h05b1
ccctcgcgtccggtagggttcatggatccaaaattgttgccattgatgttgatgaatgtgacgatatatcatcctcagatgatgatgatgatgatgaactgttttaaatttgaattccttgtaatattaatttgtaaatatcgatactataatatgtatccaattttgagtccttatcatattaaaattgccaagttttgttgttatttctacctcaattctttccttccctattatcttctctttctaatttctttatttctttttctttcttatttcctcattttatttttatatttttctttttcctcaatttcttttatctcttttttctatatttcttt

SEQ ID NO: 6404 - DNA, 107 bp, Gossypium hirsutum
  Clone ID: uC-gsronu33B029h06b1
cccacgcgtccggtcttgagacctatcctggtgttaaacgcatcaccattaagcctcaaaccgataggtgggtcttccctgaaaccaaaaccggcataattgtgttt

SEQ ID NO: 6405 - DNA, 486 bp, Gossypium hirsutum
  Clone ID: uC-gsronu33B031a07b1
ttgatttcaaggccggtggctattatcaccgctctacatccatcccatgcacaagctgcggtcatttgcgctaagcgtcatggttttcaactaaggattcgaagtggcggacatgattacgagggactttcgtatatttccgacgtcccgtttgttatcctcgatatgttcaaccttaagtctatagatatcgacatgaaaaccgagacggcatgggttcaagccggagctactaccggcgaactttattatagtatagcccagaaaagcgatgtccatggattcccatctggtgtatgtaccactctaggcattggtggacacttcagtggaggtggttggggatttttaatgagaaaatacgggctttccattgataatgtcattgatgcacaattgatcgacgctaatggtcgaatccttgaccgtaaatcaatgggggaagacgtgttttgggctatcagaggccggggaactactagcttc

SEQ ID NO: 6406 - DNA, 337 bp, Gossypium hirsutum
  Clone ID: uC-gsronu33B031a10b1
cccactcgttctcgcacacgagccacaaaccaaacgggggggttaaaaaaaaaaaggggggcctaaacatcaaccacccactaaccccaacacaaccaaataaccactggagcgacacacccccagctaagaagacagcgcaaccaccaaaccaagcacctcaggtgcggctgccccacaaggcacacaggaaaacccccaacaaagcccaccaacccaaaccgttcaatctcaaccccccccccaaaaccaccaaactaagcccccaacccaaacccaccaacccaaatccctgccaacttaataaccccgaaccaagatcaacccaccacaaccc

SEQ ID NO: 6407 - DNA, 515 bp, Gossypium hirsutum
  Clone ID: uC-gsronu33B031b01b1
cgaaaacagttcatcgccccatggccatgggagattccgtccctactcctcgcatatcagttcatcaagcttttggcggcggcttagttgctgatgtgctgttatggagaaaatggtgtgggggagttgtgatgctagcctcagcaaccacgttttggtgcctctttgaattagctggttatagtatcttgtctttcgtggccaacgtatttaaactcctggttgttattctatcttacagggccaaatttgcttcactgctcaacagacctgtgccgcccctagtacttgtgtggttgtttgattgggcagctggtactgaacttacttatgggacaagtgtgtgctattatggcattggcgtgggtgcatgacattacccctggcagaaatttggaaccttttttgaagggtggtgttgccttgtggtttgtttctttattggtagtttctttggcttcctcactgtggtctatttggggtttttcttagctatcagttcccgtgtttttgat

SEQ ID NO: 6408 - DNA, 533 bp, Gossypium hirsutum
  Clone ID: uC-gsronu33B031b04b1
gtcagtaattcgcgagccacgcaagaaatcccgcatttgggtcggtactttccctactccagaaatggcagctcgggcacacgacgtggccgctttaagtatcaaaggcaactcagccattctcaacttccctgaactcgccaactctttacctcgacccgtgtcattagcaccccgcgacgtccaagctgcggcagccaaagctgcccaaatgggaaacttggactccccatcaccatccactacatcatcatcttccacttcaacattgtcatcatcgtcatccctatcctctctggtttctcacttggacttatcttcagcgtcagacgaattaaccgagatagtggagctaccaagtctagggacaagttacgagtcggtggagttggggagtgagtttatattcgcaaactcgatggacggatggttttaccctccaccatggcttgaaagcatggaagactgtgagtacgtttgtaatcagttagtagtacccgagagcgttttacaaacggcttcaaacaagggtt

SEQ ID NO: 6409 - DNA, 579 bp, Gossypium hirsutum
  Clone ID: uC-gsronu33B031b05b1
ctggtttttgctgtaaattcacttgaagttgaaaatgtggtcatcattggtcatagctgctgtggtggcattcgtgccctcatgagtatgcaagataaagcggaatcaagtagctttatccggagttgggttactgtcggaaagaatgcaaaactaagtacaaaggctgctgcttcaaacctcagttttgaccagcaatgcacgcactgcgagaaggaatcaatcaacacttcactgttgaacctgcttacttatccatggatagaagaaaaggtgaacaaagggatgctttctctgcacggtggctactatgactttgtcaactgtactttcgagaaatggacattggattacaagggaagcatcatgaatggaaaaaccagagttgtagtgaaggaccgattattttggtgctaaccttctcggtccatcttatcttttttatctggtgcttccgcatcgctgttccgttcacagtttacttgatcgtaagtgctaagtgtcaatgcagtctaaaatgtttattcttgggatatcaggaataactacttaggtgaataatatgttgcttctgatctg

SEQ ID NO: 6410 - DNA, 335 bp, Gossypium hirsutum
  Clone ID: uC-gsronu33B031c02b1
agattatgctgagcctgtgcattggggtattgctgatgtgaatacactgatatagaaatatttatcagattgatacaaattgtatgggagacaatactttttaggccattggataacgagaaatgggtccttatttcatgtgagagatttgaaattttcttttcttttaatttctttggtggtttgtgagcaaaagagcaataagtgatgaatcccacttgcatggggtcattttctttattcttttttatttatttctgcttgccaattattagactgtaatgtatagaatagattacattgcatcttggttgagttgtttactttattttttg

SEQ ID NO: 6411 - DNA, 345 bp, Gossypium hirsutum
  Clone ID: uC-gsronu33B031c04b1
cccattcgttcgaacaaaaaaaaaaaaacataaaaaaaggggaatttttaaaaaaaacataaccaataaacccacaaaagaaaaaaaaaatgggggggccgcttcagggggaccatgcttacttggcgcccgcatgatacgtaataagttcctttttcggggcccataaattgaattctctggccgaggttttccaacgttccggacggggaaacccttggcgttacccgagttaggcgcctggggactcatccccctttccccggtaggtcgttttctcgaataggcctggacggatcggcctaccctacggttgcccatttaggttgaacccttggggtccct

SEQ ID NO: 6412 - DNA, 312 bp, Gossypium hirsutum
  Clone ID: uC-gsronu33B031d01b1
cagggaccgggccggaacgcccgggccgacccacgcgcccgttcatacccaccccaaaaaaaacccaaaagggggggccaagaaaaacccaagggggcgcaaccacacccccaaccgggccacaaaacccaaacagcacacaaaaggcccaacccccccaaaaaacagagccacacaccatgccccccccaaccgcggcccaccaccggaacacctgaagacaacacccaaacaggaggtccacccccaaccacgaaagcacccagcagagcacccacacagcagacaacacacacacaccaccccccccca

SEQ ID NO: 6413 - DNA, 484 bp, Gossypium hirsutum
  Clone ID: uC-gsronu33B031d04b1
aagcttctttctgcaactttggagccatttcatctctgcttcgtcctcctaaaatttcccgtcatcgtttcgtgatcagagctgaagtggaaccgtcagagaaatctgtggaaatcatgaggaaattctcagaacaatatgcacgtcgctcaggaacctatttctgtatggataagggagttacttctgttgtaatcaagggattggcggagcataaagattcgttgggtgcgccactttgcccttgtaggcattatgatgacaaagctgccgaagtcaatcagggattttggaattgtccatgcgttcctatgagagagaggaaagaatgtcactgcatgctctttctcacttcggataacgactttgctggccaagatcagaccataccattggaagaaatcaaggaaacaacagcatacatgtaacacttgacggtttcaaaatttgttttttaaacagtcataactttgttttttggccc

SEQ ID NO: 6414 - DNA, 248 bp, Gossypium hirsutum
  Clone ID: uC-gsronu33B031d05b1
gccgttcgtccgaagaaggttttggcaaatctagtgatggcaggaacatacaggttgttgatgactccaataatctcaaggctcccaaagggcttggcacctttacagaacaatcaaactgctatgatgtacaaacagggagcaacggggattggggccattacttttattatgggggtcctggtaaaaaccccaattgtccttaagagcaagagggaaaagcacctttttttttttggcgttgcgtt

SEQ ID NO: 6415 - DNA, 214 bp, Gossypium hirsutum
  Clone ID: uC-gsronu33B031d07b1
tttatgtgtacggcaaaaaatgcgtccatggggggggttttattaaagcttaggggtgcagataaaaaggaaggaagggaactgaatcttgcaggcagaatgaaagcttttatatagagagaatgggaggtcgaaacaggccccttcagtcagagcatagaagtggaaaaacttatgaagatacctaatatggtaggggcggaagcataaaaca

SEQ ID NO: 6416 - DNA, 108 bp, Gossypium hirsutum
  Clone ID: uC-gsronu33B031d09b1
ttcatttgtccgcccacgcgtccgtccacgcgggggggctatttatacacaacgcgttctgtaacattcaatcggagatggaccaaatatattatttaagataatttt

SEQ ID NO: 6417 - DNA, 273 bp, Gossypium hirsutum
  Clone ID: uC-gsronu33B031d10b1
gttgtattcggggtaagaaagcaaaggtgaacttccctgatgagatgccacgcacctctccaaaacgtgtgattaagacaaatgatgagaaaccacttcccatgtcaaatttgagccctgttgaaccaaatatcaaccagaatttcaattgcttgaacaaaccagagcaggtcttttatgataccatgggtttcgttgaagagaaggcaccaatggatccatttgcttatgtggacactgttcctgctgctgttgatgttggatttgtaattc

SEQ ID NO: 6418 - DNA, 480 bp, Gossypium hirsutum
  Clone ID: uC-gsronu33B031d12b1
gtggtttaaacatattaagttctacatcgaagatgataagttatgcagtgtcgaagacgatgataatgatgttgggtcatgttcagaccaatcatcaatgtctgagtcagaaacagagttggaaacgaggaaacgagttggcacattgccaaggccagctagtttaaacgcgttcgaccttatttctttctccccagggttcaacctatccgggttgttcgaggaaggagaagaaggctcccggttcgtttcaggggcaccggtttcgacaatcatatcgaaattggaggagatagccaaggttgttagctttacagtgaggaaaaaggattgtagagtgagcttggagggttctagagaaggagctaaaggtccattatcgattgctgctgagatattcgaattaaccccttcattagtcgttgtggaagtgaagaagaaaggaggtgaacgaggagagtatgaggattttttgtaaca

SEQ ID NO: 6419 - DNA, 424 bp, Gossypium hirsutum
  Clone ID: uC-gsronu33B031e01b1
cccactcgttcgaaagaacttatagatgaaaaacatcctcagcttttcaaggaattcgatttcatggacttcttcctttatgccatttctgacccagcaaagcacatcgacagcggtgaactgctccacgcctatgcttctctttcaccaccgggttccaattaaatgcataccgatatcaacaagtaaaagcccaattttagtattaaattaatgttacaaataataaatggagtcctatacttgggatttccattcttgctatggcttaccatgttgccgccaatgattgcttgcctatgggctttacttacatgcaattggcatatggcagggagagagtttagagaaggttcaagcaggaattggggggggggggacatttttcatgggcaatctgtctctgtaatgggcggtttctggg

SEQ ID NO: 6420 - DNA, 491 bp, Gossypium hirsutum
  Clone ID: uC-gsronu33B031e02b1
cccattcgttcgcccacgcgtccgtaggaagctctctcctaactcatgagcaagcactgttgcaggctagtattatactggttttgtccttaaaccggtgaagttgaccagatgctgaatattatttttaaatgtgatgtagttgttagaatcggcgtttttgtggtggttactcttagctaagttcgcatgttgaaatcaattagtttctattttagttgaataaggacgtgatagtattaaggtggatgaggccttggtactggggcatggaaatgacccaccaatgatagcttgcctattggctaaactaacatgcaattggcatatggcagggagagagtttaacagaaggttcaagcaggaattggggggggggggaccatttttaaggcaatctgttctctgtatgggtggtttctggttcccacttccaatcggtcgcttaaatttaagggttctgcttgattgttttattagaaaggcatttg

SEQ ID NO: 6421 - DNA, 279 bp, Gossypium hirsutum
  Clone ID: uC-gsronu33B031e04b1
cccactcgttcgaaaaagtttaaataccctctgaaagaggggagaggagaggccctcctggctctggcctccgtaggccacgcgccggtcatcaatcctacacgcgccgtcgtacacgatggtctgagggtctaaaaccttcggcattccacagcaatcgagcgagggaatctctagcctctgattactgcgccgatcacggatcctagaatcacggcactgatgaggctactggaacggcatgccttgcagggctctagacccttgagatggctcgaa

SEQ ID NO: 6422 - DNA, 492 bp, Gossypium hirsutum
  Clone ID: uC-gsronu33B031e07b1
gtagtagtaaaagcagaagccgaagccgaagccgccccagtggaagcacccaaagaggaagctgcaaaggaagaagaggaaccagctgaagctcaagctgagaagactactaccgagtaaaataagcttgtaagatggggagtcaatggaagcttgtgtagtgcgcttactgttagctaagtttgcatgttgaaatcaattagtttctattctagttgaataaggacgtgatagtattaaggtggatgaggcttgggactggggcatggaaatgacccaccaatgatagcttgcctattggctaaactaacatgcaattggcatatggcagggagagagtttagagaaggttcaagcaggaattgggggggggggacatttttcatggtcaatctgttctctgtaatgggtggatcctgggtcccaactcccagcaggtcgcttaatttagtgtttctgttgtatgttttattagagaggcagtttgctgtt

SEQ ID NO: 6423 - DNA, 596 bp, Gossypium hirsutum
  unsure (1)..(596): unsure at all n locations
  Clone ID: uC-gsronu33B031e09b1
ttttatctttcatttaaaaaaaacccagagaaaatgaccaagtgttacccaactgtgagcgaggaataccagaagtcagttgaaaaggctaagaggaagctcagaggtctcatcgctgagaagaactgtgctccactcatgctccgtctagcgtggcactcagctggaacttttgatgttaagaccaagacaggaggtccattcggaaccatgaagcatcctgctgagctcgcacatgctgctaacaacggccttgatatcgccgtcagacttctcgagccgatcaaggagcagttccctaacctcacctacgctgacttctatcagctcgctggtgtcgtcgccgttgagattactggtggacctgaaattcccttccatcccggaagagaggacaagcctcacccaccacctgagggccgtcttcctgatgctaccaagggttctgatcacttgaggcaggtgtttagtgctcaaatgggtctcagtgaccaggacattgttgctctttctggtggccacactctnggaaggtgccacanggagaggtcccggtttgagggaccatggactaccaaccctttcatttttgacaa

SEQ ID NO: 6424 - DNA, 471 bp, Gossypium hirsutum
  unsure (1)..(471): unsure at all n locations
  Clone ID: uC-gsronu33B031e10b1
tatcttcattgctgatcatcccgttgagcttgaatcccctaagcctgatcaactctcccctgaaacccccgctgatcacattttcaggtctaaattgcctgatattcctatctcaaaccacctccctctccacacttactgctttgaaaatctcccctctctctccgataaaccatgtttgatctccggctcttctgggaaaatctattccttcagcgaaactcatttgattgcgcaaaagacagccgctggtctatccaacttaggcattcaaaagggagatgccatcatgattctcctccacaactgtgccgaattcgtcttcgccttcatgggagcttccatgatagnagccgtttctaccaccgccaacccgttttacacctccaaagaaatcttcaagcaattcatagctgctcgagccaaactcatcatcactcaatcccaatacgttgacaagcttaaagacac

SEQ ID NO: 6425 - DNA, 269 bp, Gossypium hirsutum
  Clone ID: uC-gsronu33B031g02b1
attgttggaccttcaatttttcgtaggagagagcatgcatgatgatggatgcttggtgtttgcttactacaaggatggtgctgttgacccaacatttttgtactttgcatatgcattgaaggaggtcaagtgctgaggtttgaagcaaagaaaaaaaaagtggttgctgaagaatttagtcctttttattattgcttttgtctcttgttttcagtactctgctaaagacataatttatttgtggatcttgacacttaatatgattactt

SEQ ID NO: 6426 - DNA, 393 bp, Gossypium hirsutum
  Clone ID: uC-gsronu33B031g10b1
tggactcgtgggcaaaaaccaagaaaaaaaaaataagaacatgccagcccaggatgacgaggagcagggccaggtattcgttgatgaatccgacataatccacgaagttgatgtcgacgaagaagatcttcctgatgctgacgatgaggatgatactgaaaatattaaggatacagatgattccattcacatattcactggccatacgggtgaactttatgcagttgcctgtagcccaacagatccagtgttagtggctactgggggtgtagatgataaggggttcctttggatgattggccatgcttgattgggcttttgagctccgaggccataccgatttactttttagttttgccttttgtcgtgttggactatttcttgcattttgga

SEQ ID NO: 6427 - DNA, 492 bp, Gossypium hirsutum
  Clone ID: uC-gsronu33B031g11b1
ttaacataaaaatcagagaatcaggaaaaagaaagaggaaaggaagaaaatggggaaatcaactcctgtgaaacaagcggcggtggttttgggagcgctagctttcgggtggatggctatagagatggcgtttaaacctttactggacaaggctcgctccgccatggacaactccgaccctgatcgggagcccgacgacatcgactccgctcgcaaggacgactccgactccgactccgatcggaagcctatctcttatgctgatgccgtcgccaagaacatagcgggtgcaagttaggggcgagattcttgtgtttggtccagtccaagtaatcatgaaagtagggttcctttttatgataaatggaattatggtgttatcttattttagatttcttgctgctgcttttctaggttagccttaagaattaatgttgagagaagagttaattggtgctatttttctgtttctacattatatgataattagat

SEQ ID NO: 6428 - DNA, 358 bp, Gossypium hirsutum
  Clone ID: uC-gsronu33B031g12b1
gtcctttcctttccttttcccctcttacatgctccttggtacccaaggtttcagccatggcgacaatgctgagatctctgctaactttcacactcttcacgcttcttttctcctacgtttctgcaacaacaattacactctacaacaagtgccctcacccagtgtggccaggtatccaacccagcgctgggaagccacttttagctcgcggtggctttaaacttcgacccaacaaggcctactccatgcgtctccctcccctctggtccggtcgtttctggggccgtcacggctgctccttcgacgcatccggacgcggtcgttgcgctactggtgactgcggcggatccctcttctg

SEQ ID NO: 6429 - DNA, 466 bp, Gossypium hirsutum
  Clone ID: uC-gsronu33B031h05b1
ctcttttaacctaaaaaaccaattaatgggtgcaagaataaggtttgtggctcttgctttagcgatattgatgatggtgagttactgcttggctgcaaaggttataaaagtggatatgctgaagcacgaaaacaccgcggtcaatggcggccggcggctgctccatgacgacagcaatgccaaaagtggatacgcaaaagagagcagtgtgaacaaccaccattacattcctaggaacgactttaacaactaccctggtggcagtgaagatggaaatgggtaaattaatgagattagcaataatatggggactaaaccggtaactagataataattgcatgatgttgctgcgtgtttaatgagtttttaagacatatatatgtgattgtgatctaattagtttctgtacggcagtacgtatataaaaaaaaatatacatggtttggtgaaaggggagttaagattt

SEQ ID NO: 6430 - DNA, 200 bp, Gossypium hirsutum
  Clone ID: uC-gsronu33B031h07b1
tttggtctgtggttcctgcaattgagatgcggatgagagttggatctatggcgcctggatttggatcctgggagttaagagtaggtataggatatgtaatgggaaggggactatgcaagacgaggattgggcatttaatggactgcaataattttaatttagacggaaaacaagattgagaatggacggctcttggcacg

SEQ ID NO: 6431 - DNA, 572 bp, Gossypium hirsutum
  Clone ID: uC-gsronu33B031h08b1
atccatcgcactccgtctcacttttcttttatccgttgtgcttatagcagcaacaggtaactaccacctcatcaacatgtcgtctcaccacctctctgagttggactccaccaccgattccgtcgcgtcctctccacgctccgagcaccatgctcctcatgatgcccgtgtacggttcatgtgcagtttcggcggaaagatccttccacgtccacatgataatcagctccgttatgccggtggtgatacccgcatcgttgccgtccatcgttccacctccttcgcagccatcctcaccaagctctctaaactctcaggaattgccaacgtgagtgttaagtatcagcttccgaacgaggatcttgacgcgttgatttcagtgatgaccgatgaggatctcgagaacatgatggaagaatatgatcggctagcacagaatcataacccctcgttgcggatttttcttttctccaaaggcgatgactctcgaaccagtagcatcagctcacttttggacggttcggttaatcgtgagcactggttcttagacgctctaacagggagccaatgca

SEQ ID NO: 6432 - DNA, 298 bp, Gossypium hirsutum
  Clone ID: uC-gsronu33B031h09b1
catataaaataggtttgataattgttaaagacggggcatatttgagggattgcgggctggttaccctcccaacgaagggttctgacttacccacttagacagtcaggaacctcggaagcaaagtgcgcattacacgctccgagcaccatgctcctcatgatggcccgtgttcggttcatgtgctgtttcagcggaaagatcccttcacgtgcacatgataattcagctccgttatgccgggggggatacccgcatcgttgccgttcattgtttcacctccttcgcagccattcttacc

SEQ ID NO: 6433 - DNA, 118 bp, Gossypium hirsutum
  Clone ID: uC-gsronu33B031h11b1
tttgttttaattttacttctagtgtttcaaagaaaaggaaaaataaaaaaaaaaaaagaaaaaaaaaaaaaaaaaaaaaaaaaaaaaaaaaaaaaaagaaaaaaaaaaaaaaaaaaca

SEQ ID NO: 6434 - DNA, 547 bp, Gossypium hirsutum
  Clone ID: uC-gsronu33B032a03b1
cccacgtgtactggactgctgtcacgtattgaggcattgctacgtgatccaaatcctaattaccgtgcaaattatggagccgttgggatgtgcagtgagaacaagcgctaatactatgtgagagtgcctgtgatagtcgctcctagtgagagtgatggttgatgttttatgttgcagtgccatattcagagcgaatcgtggctatgttaccagagcttgtgatactggcacacatggctgtactgctgatggatagctcaacgctggggtggagttatatggagcgtcgaaggtagtgcaatgtgctgactaaataacaatgtacgaccgatagagacgcaaactaccaggtcggtattatgttgtgtgtggtaagaagaagaacgctgatacttggactggatatatcatttagtacgtcaagcgtatagaaacccgaagacccgtgcagagcgaacttgagtctcacgttgagagctacttggtgatgatgtgtgtgaactcgtagtttatttttgctaagttattaaaactatagtgctatata

SEQ ID NO: 6435 - DNA, 353 bp, Gossypium hirsutum
  Clone ID: uC-gsronu33B032a11b1
gcctatttctagtgagaagccttccgttgagctcgtgaaggtcaccgaggacatgaaatcattcaaggcatacaacaagctccgtgttgaacgtgcgaacgaacgtcatattggtgctaggttgaagaaagctgccgaggccgcgaaggaagacaagaagtaaggctacccttttggggacagcgctttgttatttggcttgctaaaaagaccttaaattctgttttcattttgtcaagtgaactgagacagctttagaaaactttggcattatgacagtactcgtttttgatgagcattttattaaatgatgaagtcccctgcacacacgaagtgttaatttgattaaaagg

SEQ ID NO: 6436 - DNA, 562 bp, Gossypium hirsutum
  Clone ID: uC-gsronu33B032b01b1
ggaaaaccctccaactccaatcgtcatcaatgaatcatatcccaaaccatttcatcaatttcccctgccaaatctcatccttccaccctcctatataacccacataactaagttaacctgagggagacgagaaagttgtaagatataagagcaaaatggaagctgttgtagcatcgaaaccagtgattaaagttgctgccatttgtgggtctttaaggaaagcctcttacaacagaggcttaattcgaaccgctttggagcttaccaaggagtccattgctgggattcaaatggaatacatagacatttcaccacttccaatgctggatacagatctggaagttgatggcaagtttccccctgcggttgaggctttcaggcagaagattttggaggctgatagcatccttattgcttcccctgaatacaactattctcttactgcgcctctgaagaatgcacttgactgggcttcaagaccaccaaatgtatgggcagataaagcggctgccatcgtaagcgccggaggagggcttggtggtgcgcgatcacattatcatct

SEQ ID NO: 6437 - DNA, 540 bp, Gossypium hirsutum
  unsure (1)..(540): unsure at all n locations
  Clone ID: uC-gsronu33B032b03b1
aaattttgctaaaacaaagaagatgatgacagatcaacaccactatcttaaaaggccaagtttacatcggccaattcttcttctgatgttgatggtgatgatcccatggagcacatgccattttgctttagacccaccggagaagagaaacagcctcggcttctttcactgcaacggctcgtccgctgaatgctccggcggtaaggttgaggacgacatgttattggagttcttggtggagtcggaaacaagaagaatgctgcagcaaggaggcaatcggccttcgactaacacccttaagcctaatattgcagcttgtggtcgtgacaagtacggctacttatgcactccgccgagcaacaaagatgttaaaagatctgaaaactgtggaggggataacttcaatcgtgcctgccaccaattatccaaatgagcagttaaggttgtcatattcacccgaacaccncccccgtnggggtccttttcatccactccttccttttattcttcattttatcctatgctagttcaggaaaatct

SEQ ID NO: 6438 - DNA, 370 bp, Gossypium hirsutum
  Clone ID: uC-gsronu33B032b05b1
cccacacgtccggtctttttgtgattcgaacagcatctaatgaatcaatttcttgctttgttgtttattaaaaaaaaaaaaaaaaaacaaactaaaaaaaaaacaaaacttaatcccttcaaagaacactagacagacactgctacaaataaacaaggacttttgcgagccggggaagccaagatcacagtgagatggcgatcgaaccaaagtttcccagccggaaccgactaaactcataagaccatcaagggccagctacgctatgcacccatcagccaaacactccgcgcatggcgaaacaccgaggaccatcttaacaacaacaatacatgccatttcaagatcgcaaaaaaccctacaccaacca

SEQ ID NO: 6439 - DNA, 442 bp, Gossypium hirsutum
  Clone ID: uC-gsronu33B032b08b1
cccacgcgtccgtagcaatgccacctcttccattagtggtccaaccatttctatgccagaggctctaagagcaactagtatttctgcagcgcagcccacagagcagtcactgcctggtgcgagtgttgctacaggacctgcacttccgcaacatctagccatgcaccctttttcccaacctacacttccattgggacactttgccaacatgattagttatcctttcttacctcagagttacacctatatgccatcagctttccagcaaacatttactggtaataataactatcctcagtccctggcagcaatgctcccccaatacaagaacagtgtttctgtaagtagcttgcctcaatctgctgcaattccatctgctatgggttctgggagctctaccaacatcctggaggacttcctctgaatccacctactgcacctg

SEQ ID NO: 6440 - DNA, 391 bp, Gossypium hirsutum
  Clone ID: uC-gsronu33B032b10b1
ctcataactcctcaaaagtcttcttcaatggcagctcgagttcttgttttggcttcaattcttattttctcttgttttgcagagacatgctatggggtgatctctttctcatcccttcaaagaacacttgttgttactgcttctcatagacaaggacttttgaaagccggggaagacaagatcacagtgagatggggattgaaccagagtttcccggccgggaccgactcgtcttataagaccatcaaggtccagctttgctatgcacccatcagccaagtcgaccgtgcatggcggaaaaccgaggaccatcttaacaaagacatgacatgccagttcaagatcgtcaagaaaccctacaccaacgtcaacgaaaccctttgatggacca

SEQ ID NO: 6441 - DNA, 455 bp, Gossypium hirsutum
  Clone ID: uC-gsronu33B032b11b1
cccactcttccggtcatgtttcatatccaaaaaacagacaataaattttatatcatgaaaaagatatcatgattgatgaaatgaatttacttaaatatcacttgaacttaatctggtgcaactcttgaagacatacgattatatagaacacaaaagagatcacgggacattaagccagactgtcccccaattaatccttaccaatgaaccttccccagttagactactttaaagacacggtggctttagttgtccgaaacctgtccattcgccttccatcacactttacattattcctcacattatactcaatataataaacaataaaaaaattacttatttttatacattaaatcagagagtaaattagttatttctactcaaaatttcacacatttatacaagtaaaaattgatgtagctaataaaataccaataacatgtcatgtatcctgt

SEQ ID NO: 6442 - DNA, 344 bp, Gossypium hirsutum
  Clone ID: uC-gsronu33B032b12b1
caatttgtcttgaatacctttatttctggtttgctggttgacccactttttaatcttcacatcaacaacaacatgcctagtcgctgcgaaattctgtgtgaactcttgatcgcgattttgatccctcctttgggagtatgcttgaggcacgagggtcgcagcgtggagccctggatttgcgagctggcaacggctctggtatacaaagctgggattaaaggtgcgatgtaccgcatgtggcagaagttgctcgtcttgagtgctccccagactatgcttatggtgcctgtgggttttcctgcagggggattccagccaacctgggtttcgaattcgagattgaa

SEQ ID NO: 6443 - DNA, 89 bp, Gossypium hirsutum
  Clone ID: uC-gsronu33B032c06b1
aggggaagcgggacgcccgcaggggccggggcgcagaatcccgggggagacccacgcgcgcggactttttttttgagacacgtgttaaa

SEQ ID NO: 6444 - DNA, 375 bp, Gossypium hirsutum
  Clone ID: uC-gsronu33B032c07b1
gtttaatgcagcaatatggtctggcaaagtcagcaaatgaagtgatattggtcattgaagcttacaaggcccttcgtgaccgagcaccttatcctccaaaccatgtggttggccatctaattgggagctttgctttcattgtctttgataaatccacctccactttgtttgtggcttctgatcaatttggtaaggttcctctctattggggaatcaccgccgacggatatgtggcctttgctgataatgctgaattgctgaaaggtgcctgtggcaaatcttttgcttctttccctcaaggctgttttctactccacagcagttggaggattaagaagctatgagaatcctatgaacaagatcactgcattgcct

SEQ ID NO: 6445 - DNA, 388 bp, Gossypium hirsutum
  Clone ID: uC-gsronu33B032c08b1
cattcctcgcccaattccggagaagaaatggtatcttacaccctctgtggtctccttgatgggaggacttctgccgtttggcagcatatttattgaaatgtatttcgtcttcacatccttctggaattacaaggtttattatgtctatggatttatgctgctggtgttcctgattctcgtcattgtaactgtctgtgtgacaattgtggggacatatttcttgctgaacgctgagaactatcactggcagaggacatcatttttctctgctgcctcgacagcagtgtatgtgtatatgtactctgtatactactactatgtgataaccaagatgtcaggcttcttgcagaccagtttttacttcagatacactttgatgttttgtctt

SEQ ID NO: 6446 - DNA, 624 bp, Gossypium hirsutum
  unsure (1)..(624): unsure at all n locations
  Clone ID: uC-gsronu33B032c10b1
cccacgcgtccgcccacgcgtccgctttgtctctcttaagtcttaccataaaacagagcagagaaggtaaaacccaaagtttgaaaaccatcaaaaatggttcaaaggctcacttaccgtactcgccatagctacgctaccaaatccaatcaacaccgtgtcgttaagacccctggtgggaaattggtctatcagacaactaagaaaagagcaagtgggcctaagtgtcctgtcactggcaagagaattcagggtattcctcacttgagacctgctgaatacaaaaggtctagattgccaaggaaccgccggactgtgaatcgtgctatggtggtgttttgtcctgcagtgctgttagagagaggataattcgagccttcttggtggaagagcagaaaattgtaaagaaggttctgaagatccagaagtccaaggaaaagcaagcttcaaagagctaagaaattagatgtcgaatcatcatttcaattctgatatgtgatcagcaaggctttggaaagtgccaccaatgacttcagaagattagaggttctctttttctattggcaaatggacttcaatgttacaatgttngattacgacaaattagtcattttggatacgttt

SEQ ID NO: 6447 - DNA, 315 bp, Gossypium hirsutum
  Clone ID: uC-gsronu33B032c12b1
actatggggagcggtggcacgcgtgcgggccccggcgcggttttcggggggagccaccacgcgcgcgaactgtcctgtgttggctagttaagaatcaccgatggtaacgctctagatctagtcaatctgaagacttccatcggatagagccctcgatgtcctaaataatgttaagcttgagtggttgggatcagggcttttgtagtttgagattttcccatgctagtattaaagttaaggttctattttgtcctgcggctctggattctctttcctttttgttacctaaaaagatcatgtgtggatgattttgtt

SEQ ID NO: 6448 - DNA, 847 bp, Gossypium hirsutum
  Clone ID: uC-gsronu33B032d04b1
catcacttttacagtcaatctgatgaaagctcggaacatttctttgtacctgtttcatcatttaacttttatcatgggggaccagagaataaagttggctccataaggagtaagaaattattttcaactcaaaaagacaattccttgcttgatagtcgtgcaagcgatggtcgtattaggagtaactatgatgacgtatcacacatgttgaacaagttggattctcttaatgattatgatccagtaaacgtatttctgtcagctgctgcttctagtagttcagcttctgatgggcagaggtctttttttgacttggaagaagcacaggaatcaggtcttttctcctttttttctgatggacgcatccctcttattcgattcttacgaggatttgctcgctccacttttagatacagatactgacttaatggagcattgagactgggtttttgacgattttgttgttttgtttatatcctcttaattccttctgttatactgttatcattctcttcttatcttgttttcatcttttactactcttttataattttattattccttcttcattttcttatttttttctttttctctacttttctactttttttattttttattctttatatttatttcctttctaattcatattatcttatattgttttactttaactttctcctcatttttttttacttctttcttcctatctatattattatattttattcatccctttttactctctttcctaataatactctcttattcttcacattcttattttttttccactttcattcctattacatttttttttttattttccttttttctctttattctc

SEQ ID NO: 6449 - DNA, 101 bp, Gossypium hirsutum
  Clone ID: uC-gsronu33B032d11b1
taatgatctaaagttggcaacaagaaacttcagacctgagagtcttcttggtgaaggtggttctggatgcgtttccaagggatgcctagaagaccatggac

SEQ ID NO: 6450 - DNA, 486 bp, Gossypium hirsutum
  Clone ID: uC-gsronu33B032e04b1
tgaagttttcacaagcaaaaagataacagatgccaaacttgcaaaagattttcaagcagttttgaaagagtttcagaaggctcaacggcttgcagctgaaagagaaactttatattccccttttgttccccagtcagctcttcctgcaagctacacggcaggggagatggatgcaagttctgataaaagtgctgaacagcgagcccttcttgttgaaagaagacaagaggttgtgctgctggataatgagatttcatttaatgaggctatcattgacgaaagagaacaaggaattcaagaaattcagcagcatattgttgaggtgaacgagatcttcaaagatcttgctgtgctagttcatgagcagtgttacattattgttgacatcgggccctattttgaatattcctaggctgccactttacaggtatattctccttctttgaaagctgtcttgatccttttttccatttttttctggctttt

SEQ ID NO: 6451 - DNA, 122 bp, Gossypium hirsutum
  Clone ID: uC-gsronu33B032e05b1
cccactgtctttcggtcccagggaagctcagccatgccttccattgatgaactggggttgagccatggtcatggtaatgcaagcgtctatggtttacaaagtaatggtgatggaattttata

SEQ ID NO: 6452 - DNA, 400 bp, Gossypium hirsutum
  Clone ID: uC-gsronu33B032e09b1
atgttcttaaggtgcctacctagtaatttctggttatttttaactcttaacaatgattcaattttaattctgcaagataaattcctttagtttagggtggaatggaaggtccaggattcacagcatttttcttagggtctctttttttctcaagctggtatggatgccgcacctggtatcttgggaaagcattcttctggtctggattgtccaaagaggatgtcacccttttttatgggaaccacgggacgcctctttggtactaaattctttcaacaatatatatctatgggctgtgtaattttcttagaggaaggagggagaattttcacttttcaaggaaacatggaaaagtggtctcttaaaacaggtctgaaaggacattatcctcaagtttact

SEQ ID NO: 6453 - DNA, 332 bp, Gossypium hirsutum
  Clone ID: uC-gsronu33B032e10b1
cccactgtcgtccgatttggtcttggtttatatctctatcatgaaaaacaatagatacacacaaaagcatattggaaatatggactatgcttttagtcttactgttcaagcacattttaattacccaaatgcgcctaataattaaatgaaggttttaaaattagcctacattgaaattgttatttattattttagaaatgtgaggttaaattttactattagttcttgtacgttgcgaaagttgtgtattaaatatctatactttaaattttaaaatttaaaattttagtcctcaccattaaaatttcttaaaataaataattaaaaaatat

SEQ ID NO: 6454 - DNA, 918 bp, Gossypium hirsutum
  Clone ID: uC-gsronu33B032e11b1
tcgccctcttctttcgtccacgcgtccggaagaattcactatggaaaacttgtagctgaagtgaagttcagggacgaacggaaagactatgaaccggcaattcgtgctcaggatagatttactctgacatatttgttgacgtttacaaacgttgaagaagcggttaagaacagagtggcgaagaatgcgatgacatttgtccaggaagtgatgttcatctatgatgtgttcatgtgttttttctattattttatccacttatttttcctttaattataattatattttataattttttactttagttttacttctattttttaatatttttattttttcatttgttattgctattttttatttatttatctatttgtttctattcatttaatttttatatctttttaatttttatttagtattattaaatcttttttttttttgttcatatttttataatttttattatatatacttttatttatttctttgttttttttaattcttcttttttactattatttattgattttttcttgttttttcttcttaatttttttatttatttatatatctatttttttttttatgttaattatatcattttatttttattttattctctaattaatatatacttttcttatattttttttttattattatatattttttatatattatcttcttcttttatattcttttttttttttcataattttaattttgattttttatttaaatttttctaatttttttatatattattttctatttttttttcatttttctttatatttatttttatctacttttattttcttaatttttattttatacttatctatttttttattttacttatacttttatatatttattattttttaattatttctatattattcctattttttt

SEQ ID NO: 6455 - DNA, 641 bp, Gossypium hirsutum
  unsure (1)..(641): unsure at all n locations
  Clone ID: uC-gsronu33B032f01b1
cccactcgtccgcccacgcgtccggtctctcgggaaggaacttgcagatgaatgaagttcttggaaaaatagcatctacagcacaagagctggcgcattaccattctggagatgaggaaggcatctacttagcttattctgacttccatccgtacttggttggagattcatcctgcataatggagttaaatcagtggtttgctaagcaactagacacggttccttttcgattggttgctgaagagggtaaatcaaaatgctcctgggttagtcttgatgatgtctcaaacagcttagtaagagcagatctagaaaagtcccatcatcaacgtgtatctgaattgcagaggcttcgctccatattcggaacaagtgaaagacaatgggtagaagcccaggttgagaatgccaagcagcaagccattctcatggcgcttaaatctcaaatatcatcagatgaagctcatattcatcttgatcttcattcccttagaagaaagcacgctgaattggtgggagagggtttcatacctttatcacatagaagagaagtttttaactgagactatccagatctttgctgggagctggcgcannctccagacacatacatnttgcaggtngatatgatctaaggtatg

SEQ ID NO: 6456 - DNA, 95 bp, Gossypium hirsutum
  Clone ID: uC-gsronu33B032f02b1
cccacgctcgctgtttactcattagggcacgggaatggggatggcgatcgaatcaactgctgctcaaagcattagcaacatggccaggatcaggt

SEQ ID NO: 6457 - DNA, 64 bp, Gossypium hirsutum
  Clone ID: uC-gsronu33B032f05b1
ccaacatggatgtcagctccaaggaattttatggtgagggttattattaaagtgacatgcgttt

SEQ ID NO: 6458 - DNA, 302 bp, Gossypium hirsutum
  Clone ID: uC-gsronu33B032f07b1
ctgcgcgtttttcttgaaaaaaaaaggatcagagttgctttctgctcgcgatatatgcggggcttggtaaaataccatccaccgcacaagatctggcgcattacctttctggagattaggtaggcatcttacttagtcttatattgacttcctttctcactttgtttttagttttatctctgtatatcggagttaaatcagtggtctgttaagcaactagacacggctccttttcgattggttgctgaagagggtaaatcaaaatgctcctgggtttagtcttgatgacgttttcaatcagc

SEQ ID NO: 6459 - DNA, 345 bp, Gossypium hirsutum
  Clone ID: uC-gsronu33B032f08b1
gggtctctggcacttatattggcaatggtaatggttatggcgatcgctacaactgatgctcaaagcatttgcaacatgccagcttcaggtttgatggttttctttggtttttttctttatatttattttttttttcattcttttttttttttttctttcatattttttttatttttttttattttcttatttatattttatttattttaattaatttaattttttagtttcttatttatattttttttttaatttgtttattcatctaatctctttcttcttattttaattattttattgttttattattttattactttatatatttttcttctatctctatat

SEQ ID NO: 6460 - DNA, 609 bp, Gossypium hirsutum
  Clone ID: uC-gsronu33B032f11b1
cgccgaactttctttcctcgaaggatcttatcatatgatacgtgacgagcgatgcaagtcagcgaattggatagttgtgcatagagcgctaatggctataaaagatgtcgaaggaatgttctcttctttggatcctgagtactatgatatccttatgaagtatttgtatagaggattgtcaaccggagatcgtcccacatgtgatcagtgccttaggatccatgagaagctgacggagagagctggtttgggctgcatacttcgttcccttgcagatactgtgaatgcaatttgactccaataggcccttcactttggaaaatgttttcaagtgttgttgttcttaaatcattgaagtgctttagaagcttttatgttacagcttttcttccatgattcgtatttccagatcagagttgcggtcacatgggttatatggtctcctatctggcttttctacttggggtaattggaggtgtttaagtatagaatcttattaccacctttcaagtcctttccttttcctcctttttatcttaattgagaatcttgttacctatggttgtatgaaatttgcatgaaaagagagatcgatatgaagcaaagact

SEQ ID NO: 6461 - DNA, 603 bp, Gossypium hirsutum
  Clone ID: uC-gsronu33B032g03b1
gatccctgttccatggcacctcttcctggtcgcatgggcagtcggatggaaccaccacccccatcaggtcctgctgctacatttggtgcttcagcaactgcaaaaattagtgtggatgcttcccttgcaggagccatcatagggaaaggcggtgtgcattcgaaacagatatgtcgtcaaacaggagcaaagctatctattcgggagcatgagtcagatccatcacttaggaacatcgagcttgaaggatcgtttgagcaaattaaagaagcgagtgcaatggttagagaactaatcagcagcctaggtccggttccaggtcctgccaaaacacccggtgcgcatggtggtcaagggcatccaggaagcaactacaaaacgaagttgtgcgacaattttgcaaagggaagttgcacgttcggagaaagatgtcactttgcacatggtgcgcggagtgcggaagtcatagtgtgagggctgcattggtacagtgcattcaagtagctatagctggagatcatgtatgaatgttgtatcagatgagccctggtaacatgctagccgtgattgctgcatttactgttgagttttactataagctag

SEQ ID NO: 6462 - DNA, 99 bp, Gossypium hirsutum
  Clone ID: uC-gsronu33B032g06b1
cctggagtcttttcttgtgctgatatccttgttctgtctgctagagatggcatcgtttcgattaaaagccctatacacttctctcaaaagtgaatgaag

SEQ ID NO: 6463 - DNA, 407 bp, Gossypium hirsutum
  Clone ID: uC-gsronu33B032g07b1
cgacaccacagcgctgcgggcgtcttgtttcttctcggtaatgaatgcgcttggaatcgtagcgtttgcattccgtggccataactctaacttagagattcaggcaacaatgccatcgacgtttaaacatccgggctcatgtttcgatttggacttggagcccagggtaggtaattctttaattggaatgtggcttttccctgttgacattggaggtttttggggattaagtccctcaaccgccacagttgggttgtgaatatcgctttttaatttttaccatctcgatatttcaagtggtctttgtaagtttgtttttcattttaggctgtttatatatgattttataatttttccaatctttttttttccttttttttcatttttttggtcatcttttacctttt

SEQ ID NO: 6464 - DNA, 562 bp, Gossypium hirsutum
  Clone ID: uC-gsronu33B032g09b1
cgcagaaattgttgaaacaggatttacgacactactccggaccctactcacgtctctctccaaaccctaaccatcaaaacgtcgtcggtttacccgtctattacccccgccataacgatgactgccgttgccttcgtcactgtgtcggctatacctacgtgattgtacttttatcttgagtcctggtgttgatttaccggttcgatccaactctagaactggtccgtcttcaactgaaccacgtaggagtgaacacgttggccaaactcacactcgacctctgatgttctttgaccattagggtgcgcagcaggggctttgtttcattggacaatggtatgcgtagtgcagaggcttggctcgtggggggggcacagtgacagcaatgtgtagaaggccaggttgagaatgccaaggcagaagccattctcatggcgcttaaatcttagatatgattagatgaagctcatattcatcttgatcttcattcccttagaagaagcacgctgaattggtgggagaggtttatacctttatacaaagaaagaagttttactggact

SEQ ID NO: 6465 - DNA, 471 bp, Gossypium hirsutum
  Clone ID: uC-gsronu33B032g10b1
cccacgcgtccggcagaggagatatataagctgttacgtacagcatattgccagttcccattactgtcactggacttgtcaacttctcaggagttgtcaatggccggaaacagcgggcagaacaaagatgagggtagttccaaagatcaagagtcacataatccagatttgaacgaaatcaaattgtcaagttaaaatgaatagtgggtcgttgatcggaaggggaaaggcatagtatatgaaccgaattggatcatagaaacatccgtttaaggctctgttaatggtggcagtgggatatagggaatagtacacaaggtgactgtttttgcttcacaaaaactatacaaatttagttactttgccattttaattctcacactcaatgggggcaaagccctttgatatgtatacatacttcaacattgtatagtttaaaggaaagtgtttattcctgttgatgtgcaaaaa

SEQ ID NO: 6466 - DNA, 310 bp, Gossypium hirsutum
  Clone ID: uC-gsronu33B032g11b1
agttctcttaagaaaaaaaaaaaaaataaaaaagaaaagaaaagtatataaagacaagtaccattactgacactgggcttgggatcttttggggggtggcggctgtcgcgtttccagggtcccgtcccctgtcgtggggtgttccgggggtcctgtggggtgtgttccattttcctccgtgcttccttgtgtccgcctgtgccgtttggtgggtccccgatcgtgcggtcattggcctatttgttgcaccgttctgtttggtagaaccctgcgttttccgctctttttcccctttgcgcgctttcccctt

SEQ ID NO: 6467 - DNA, 359 bp, Gossypium hirsutum
  Clone ID: uC-gsronu33B032h07b1
agataggtgttcgggttaccggaaaactgcgagaacatggaccaactaccttcttgagacttaataatgaactagttaatggcagctaacgagttacaacacagattcgaagagcctattaacaagttgaagccactagctagaaagacgtgtgtcacaaggaccagaaacatgagggcaagcactaatgcctttacgatgctgactactttgtatttcattctccatataataagcttgtgcaaaaaagctttgctcgtttggtgttcaacgactttgtgaggaatgccagttttgttggtgacattgcttaaaaaaaagtggctccatattaacctttgatcggtgttgaaaagcta

SEQ ID NO: 6468 - DNA, 360 bp, Gossypium hirsutum
  unsure (1)..(360): unsure at all n locations
  Clone ID: uC-gsronu33B032h08b1
ngccctttctgtttttctcatggcctacaaaaaaggaggtgatttttataaaaaaataacaatataaaaactgaaaactgggcctgctttttggggggccctccttttggtccctcggtttttcaaccgaaggacatgcttttacagcaccattaataagcccacccacctagcttttaaccccgcctgaaatggtatcccggtccaggaggcccttggatcatgccccagaacggaggcggtggcccaccccttcccccccggtgaatggacaacgtttggggtatttgaccatagttccttttactggctgtggcatctgtcgaacggaaagtgaaaaatctccttcatggttttaag

SEQ ID NO: 6469 - DNA, 232 bp, Gossypium hirsutum
  Clone ID: uC-gsronu33B032h09b1
ctgtgtttgttttaccctctgaagacattcccgattgaactgttacatgcattttcaaggctgaaactaggataaaaagaaattttacgcagttctttcatttcgaggggtgagaaggctcatagattttgtttgtggaatgtggttttgggacaggtataccgggttgcatgagtagcttgtttggaagggatattatgggggcgtctttttaaaaaaaaaaaaaaattaa

SEQ ID NO: 6470 - DNA, 276 bp, Gossypium hirsutum
  Clone ID: uC-gsronu33B032h10b1
gcgttacagaattaaaggggtctgtttacaggactgggagaatggctctagcagcggttggatcgtcaacattgaaccccaatgcccctctgtttgataccgctgcttatcgccgagcggaggatatgtgacccgcatggtggaaactgattacgacaacaccatggcaccgtgactattggatcagccggaaccaggatgaagacggcttttacgacaacacaagggatgatatatcagatgtcagaagcattgatgacctgcttgcagatccct

SEQ ID NO: 6471 - DNA, 558 bp, Gossypium hirsutum
  Clone ID: uC-gsronu33B032h11b1
ctctcttctttcctcctagccaaaaaaaaaaaaaaaaagcctctttcctgtctctcgttctttttcctgttcaatcatgtcttgcttcattagcaaatatgctgatgagttggctaaaaacgctgcttacattggaacccctggaaagggtatccttgctgctgatgaatccactggcaccatcggcaagcgtctttcaagtattaatgtagagaatgttgaagacaacaggcgtgctctccgtgagctcctattcacaactcctggagctcttcagcacctagtggtgttattctctttgaggaaaccctttatcaaaaaaccgcttcgggcaagcccttcgttgatgttctgaagaaggttggtgtcctccctggcatcaaggttgccaagggtaccggctgagcttaatggaacccatggcgaaactttcaacagggtctagatggccttgccagcgatccagaagtactatgaagctggtgcccgctttgctaatggcgtgctgtccttagattagtgctaatgaaccaccgagcttgcatccagaaaatgcca

SEQ ID NO: 6472 - DNA, 578 bp, Gossypium hirsutum
  Clone ID: uC-gsronu33B032h12b1
cccactcttccggcttatgatacatatagaaatcaacaactgaatttctctggaaaagaagaagcctcaaatttcgagaggtttcttgctggtgctgctgctgggattactgctactctgctttgcttaccattggacaccataaggacagtaatggtagctgcaggcggcgaagcgctggatggtttgtttggaacttttcgtcacatggttcaaactgaagggttcttttctctctataagggactagtgcccacgattatcagtatggcaccttcaggtgcagtcttctatggcgttgatgatatgtcgaagtcagcctatcttcattcacctgaggggagaaaaagaactcaagacatgaagctaggtgttctggaactgactgcatttgagcaatcagaggtaggtcctattagaacattattatacggcgcatttgctggtgcatgtcgcgaggctgctacatatccattcgaagttgtgagaaggctacttcaaatgcatgtccgtgcgactaagttaagtgcattcgcgactcgtgtgaagatagttgaagcaggtggtggaatgcatgc

SEQ ID NO: 6473 - DNA, 458 bp, Gossypium hirsutum
  Clone ID: uC-gsronu33B036a01b1
gaatgcttggtggacatcggccatgcagatcatgtatttttcgctgacccagagacaagcctgcagaaagttcaccctaatttcatcgatgtttccaagaacaagttgagtactccagatgataaatgtgggagaccaagaccaggtcagccctattatccttgcgtcccagaccctaatgatagcaaaaaaggtgaacattgtaagggaatttacaaagacagcaatagaaatcgtggatgcaagtagaattatcttgcagattatggatttttttagttattgtttatgtaaactaaataaagatttttgctattagtttttgtagtttttttgaaaattatgaattttaattcgatgaaatttaatatttatatttttcaaaaaaaaaaaaacaaaaaaacaacaccacaaaactaataaatactttcatcacttatttcctttctcttaaacct

SEQ ID NO: 6474 - DNA, 444 bp, Gossypium hirsutum
  Clone ID: uC-gsronu33B036a07b1
tttttgtccaaccaacaaaagggaagttggtatggtttttggacaaaccagctgcatcgaaactggacaatcttcaattttcagagtagggttgaatttatttcttttgccaaagtgtatgtttgtatgtagtggaggtttttcaaaccccgtcgaccctcgtcctcgattagttcctacttcttttatccctttttattttcttaaaaaaaaaaaaaaaaaaaaaaaaaaaaaaaaaaaaaaaaaaaaaaaaaaaaaaaaataaaaaaaaaataaaaaataaaaaaaagaataaaaaaaaaaaaaaaaggggggggccgttttagaggaccaaagtttccttccccgggcttgcaacttaataatttttttttggggcccctaaaataaaattcacgggccgtcgtttaacaacgttgggactggaaaaaccttggtttaccc

SEQ ID NO: 6475 - DNA, 298 bp, Gossypium hirsutum
  Clone ID: uC-gsronu33B036a09b1
ttttggtttagctaaagagagtttgctagatgccattctcttcataaatgaatgctcgcaatcaaatgaccccgatctctcgttgaggcaaaataaggttcctgattatgcggaacgattagtcaagaagcagatgcgtgcagcttggttatttagagaggcagctatcaaactcgggggtgtgcactgtgagggtgatgcaggtgacatgtatggccaagataccgatgactccgagtgggaaacagctagtgaaagtgatataggaaatgaaggaagggatgaaatgggtgatgag

SEQ ID NO: 6476 - DNA, 327 bp, Gossypium hirsutum
  Clone ID: uC-gsronu33B036a10b1
tgtactggtggaattttaattaaggaaaactttgtgggtttagtgtgagatgggcatttgcatatccattgcatctacagagattcatgatcaagctgaagagcaacatcactttcatgaaaatgttcttgactcgaccgagaccaatccgtctattgtaactcagacacatggttctctttactcgaaacaaggaaccaaaggactcaaccaggatgctgccatccttgatcaggagtatgggatgaaaggctgagcatttcgtggtgttttccaggggcgtggcaactgtggttatttcttcagtaatttggtgaggaatcggct

SEQ ID NO: 6477 - DNA, 576 bp, Gossypium hirsutum
  Clone ID: uC-gsronu33B036a11b1
tccatgcgtccgctagatcgcgagcggctgccctttataaaacaacaacccgctcttttgaattttatatctttaaagcttatctttcttttttcaaacgaagctctgaacttattgtctctatttgaggagcaagttttgaggttgtggtctaaaaaacgaaaatggtgaagatctgttgcattggagctggttatgtaggtgggcctacaatggctgtgattgcacttaaatgcccatctattgaagtggctgatgtggatatctctgtgcctcgtattaatgcatggaatagtgaccagcttccaatctatgagcctggtcttgatgctgttgtgaagcagtgtcgtggaaagaaccttttcttcagcactgatgtagaaaaacatgtgcgtgaggctgatatagtcttagtttccgtcaacactccgaccaagactcgagggcttggagctggcaaggctgcagatcttacatattgcgaaagtgctgctcgaaagattgctgatgtatcaaaatctgataagattgcggtccgagaaacaacagtccctgtcaaaactgctgaggcaatcg

SEQ ID NO: 6478 - DNA, 568 bp, Gossypium hirsutum
  Clone ID: uC-gsronu33B036b02b1
cccatgtgtacggggtaatgtccatgatgcaatgtgttctgtttgtgagatggcagtcatatgggtgcaaagccaacttaaacagaaccagactcaggagcgtatacttgattacgtcaatgagctctgtgaccggatgcctagtccaatgggagaatcagttgttgattgtaacagcctatctgctatgcctagtgtcgccttcacaatgggtggaaagatacttgagcttacccctgagcagtacattctaaaagttggtgacggagagctagctcaatgcattagcggattcggtgctctcgatgtaccgactcctcgcggaccactctggatcttgggcgacgtgtttatgggtaagttccatacggctttcgactatggaaacatgcaaattggatttgcagaggctacataaagtaatcacttcaacagttacacccctttggtatgtataatatgccgtgctaagtattactcttataaaaataggagagtgggatttagtatgtaatgataatttgcatgtaaatatatcgttgcttgaggtggagcttttattaggaag

SEQ ID NO: 6479 - DNA, 625 bp, Gossypium hirsutum
  Clone ID: uC-gsronu33B036b03b1
cgattattaagtgatgggattgtacaaatcttgggtcatccaacatggcaaagcttacaatggtatcagtgaagaagagaaaaggttcgaaatctttaaggataacttgatgttcattgatgaacataactctaacaacaacactacatataagcttgggttgaacaagtttgcggatttaaccaaccaagagtaccgagccaagttcttgggcaccaggactgaccctaggcgtcgactcatgaagtccaagatccccagctcacgttacgctcaccgtgccggcgataacttgccggattcagtaaactggagagatcatggagctgttagtcgagtcaaggatcaaggatcttgtggaagttgttgggcattctcagcaattgcagcagtggaaggcataaacaaaatcgtgtccggtgaactaatctctctatcggaacaagaactagtcgattgtgacctatcctacgatgccggttgcaatggtggcctaatggactatgccttccaattcattatcgcaatggtggcattgacactgaaaggataatccttaccttggtttaaataccatgtgatccacaaaaaaaaacgctaagttggtagcattgagggtccagga

SEQ ID NO: 6480 - DNA, 553 bp, Gossypium hirsutum
  Clone ID: uC-gsronu33B036b05b1
cccacgcttccgcccacgcgtccgccagacccacttctatttcatccctttctcccagaaactcgacgaagttgatagtctctgcattgccatccccttatggagactcttctgcaatggggttatctagtagaactgctgggctacctatgaagatcaacaagaagggcttacttgaatccaatccaagctacgatgcaatacaagctaaaacggggaatccacctgtgatgccagcagtaatgactccaggggggcctttggacctttcaactgtgttattccgaaatcgtatcatcttcattgggcaaccagtcaattcacaggttgctcaaagagttatatcacagcttgtgactttggcaactgttgatgaaaatgcggatattctggtgtatttgaactgccctggcggaagcacctattcagtcttggcaatctacgattgcatgtcttggataaagccaaaggtgggcacagtttgtttcggagtagctgcaagccaaggagctcttcttcttgctggtggagagaagggaatgcgttatgcaat

SEQ ID NO: 6481 - DNA, 448 bp, Gossypium hirsutum
  unsure (1)..(448): unsure at all n locations
  Clone ID: uC-gsronu33B036b08b1
attacgaaggatctctatggtaacattgtgctcagtggtggttcaactatgttccctggtattgcagaccgtatgagcaaggagatcactgctcttgctccaagcagcatgaagatcaaggatgttgcacccccagagagaaagtacagtgtctggattggaggatctatcttggcatcactcagcaccttccagcagatgtggatttccaagggtgagtatgatgagtcggatccatccattgtccacaggaagtgcttctaaatttacaagtcatttaatggtgagttacattttctgtttagttggctttttcgagtcctgagtcaagtgaacttaaggtctggatgatgtgggaaatggattattgaagganggtttgaactttgatctggatgtaatattagccttgcattctgatgcgatttgtgatgcccggtggagtcac

SEQ ID NO: 6482 - DNA, 213 bp, Gossypium hirsutum
  Clone ID: uC-gsronu33B036b11b1
tcctacgcgtccggaaaaactttatgccagttgggcaaattctattctcaacttccagttgctgaaagaaatagtcattatgctgtgactgttgttgcatttatgtttctaagtgaacttttttcttgagcttttcatgctcaatacttagcaaagcatgcgcagtttatgtactttactcctttcaagtttctaagtaactttttttgtttc

SEQ ID NO: 6483 - DNA, 389 bp, Gossypium hirsutum
  Clone ID: uC-gsronu33B036b12b1
taatctaaaataaagtaaaataattgtatcatcttctttagattatttatccaccaaaattagggttattaaacttcatttttgatgttttaaggttcaaacaagtcccttacttgcaggatcaagatagaccacgtacggatttagattggggaaaagctaaatcctcagattagtcgatttcatttctatgcctagttgtcgaggtaagttcgtatgtacggattactatattcatgttattcacttttatattattatgtatttataatgttattgaataatgtatatccaaagcaatgttatgacggttattaagtcctgattgaaccttaggaattcgtaggatacaaaagacatgttattagggatttcatgttttgagtgct

SEQ ID NO: 6484 - DNA, 552 bp, Gossypium hirsutum
  unsure (1)..(552): unsure at all n locations
  Clone ID: uC-gsronu33B036c11b1
tccacgcgtccgcatcatcagaagctgtaaacacttcctccgagactggagatgtccaaaatgattatgtctatgacgagtcttcagggtactactacagtagcactttgggatattattatgacccatctactggattattttgctcagcagcaacagggcaatggtattcttttaatgagacaactggaacatatgatgaagttaaggaagttgcatcttagtataaatttgatcctgagttgctcttgcggtggaagatgtcgtacaggctatcgagtaagtccaatgtgtgaaactctcatcttttaagtatgttccatacgttaggctccttaccttttattgccttttgatgtctctaaccttaatagttacaatgctgttgtagttattatgagttcgaacttgaggcctagtctagctagttttcgaggtcattcttagaggttgcagcttctcgtgtacccgaaaacaatcatattttatcacttagggaactcctttgattagtntttgagttcttagactcatgggaaatttatctgagtg

SEQ ID NO: 6485 - DNA, 189 bp, Gossypium hirsutum
  Clone ID: uC-gsronu33B036c12b1
tccttcgcgtccgaaaaaaaaaaaaaaaaaaaaaaaaaaaaaaaaaaaaaaaaaaaaaaaaaaaaaaatgtagggtatatataaagagaaacccgggttccctcctctggcttcctcctttttcgctcttctttagtgtcacttattgcccattttttggcccccttttgcttgggttacccctggttt

SEQ ID NO: 6486 - DNA, 465 bp, Gossypium hirsutum
  Clone ID: uC-gsronu33B036d03b1
agcttcttttgtaaatggtggatcatcaccttcatttccatctcagagactcttggccttagctcagcagctgcgtcattacaagcctccaccttgttccttggacgaagaatctgttaccccagttgtccaaaacccagaaaagtttagacccaaaagagctgctgttttgatatgtctctttgaaggagatgctggggatttgcgtgtcatactgaccaaaaggtctttaacaatgtctactcaattccggggaagtttcattgccaggtgggaaagcagaggagggagacaaagatgatggtgatacagctactagagaagccaaagaagagattgggttggatccttcacttgtgaatgttgtaacctttcttgaaccatttttgtccaagcatctccttagagttgttcctgttattggcatacttaacgacaggaaggcatttcagcctaagcccgaat

SEQ ID NO: 6487 - DNA, 316 bp, Gossypium hirsutum
  Clone ID: uC-gsronu33B036d04b1
atttcattatcatcatcaacaacaacaactagggctaatgacacctcaagcacatcaaaaacgtttgagatttatgatcatgttgatacttcacttcatctctagtagggtaaagaaaagaggttgtaaatattgggtttcgtttttcgaacccaaattcgatgttatttcctacatcaactaattaagttccattttctctttttttgggggtttgtaattgagaatgtaaaattaatagaattatatcaaaatcactaattcacttcaaaaaaaaaaaaaaaaaaaaataaaaaaaaaaaaataaaaaaataaa

SEQ ID NO: 6488 - DNA, 551 bp, Gossypium hirsutum
  Clone ID: uC-gsronu33B036d07b1
tccacgcgtccgcttgggttgagtgtagagatgaggaaaatcatgggtgccaaagttcttttcttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgttctgtctgctggggaaggcatcgtttcgttgggaggcccttatattcctctcaaaactggaagaagagacggtagaaggagcagagccagatgttgtggaggagtatcttccggaccacaatgaga

SEQ ID NO: 6489 - DNA, 470 bp, Gossypium hirsutum
  Clone ID: uC-gsronu33B036e02b1
caaccagcaaaagatattgtacaaataaatttgcaatcgaatccagtgtcataaataatggcaaaaagaatcagtgactcgaaagacataaaagcatgccctttttaacacactgaaacaaataaacaagggtcaatattcaaagaaaattaaagaaaaaaaaaacttgaaaacgaactaaatgtgttgtctaaccctcacaaacagttgcatttagcgttgaaagagattaagactacacaaaggcactcaatacataggttctatagataacaaatcacatatacccgaaactacgggtttatcatcatcaagactgataaaagtcttatggcataactctggaaatcccgagtttgccgtttcgaaacctataaacatttcacttaagtaaagacatactgtaggaaggaaggaagcttcccggttgaaaatccttaaagaaccgtattcagttagcacggcttttg

SEQ ID NO: 6490 - DNA, 343 bp, Gossypium hirsutum
  unsure (1)..(343): unsure at all n locations
  Clone ID: uC-gsronu33B036e06b1
caattgttgtacggcactaatcctaactataacggttccaccacttcgaatacgcaggagagagagagtagcgacggcgttccccgttatctgggtccacggtggggccttgctctattcttggccgttggatttgggtctttatttttgtagattctttatttcgtgctctgttgattatgaataatttatagacatacttcttattttattttttttataaattttagtatttggtcctttttatgtgagatttatcactatgccgcaccatgtacattctcatttgttttatacatatacctactgatttgttgtagttnaaaaaaaaaaaaaaaaataa

SEQ ID NO: 6491 - DNA, 590 bp, Gossypium hirsutum
  unsure (1)..(590): unsure at all n locations
  Clone ID: uC-gsronu33B036e10b1
tcttgaagaaaggtctagggtggtataatgttggtaacaacaaatctaggttccgtggttatggaaaagagaatattgatggtttcaatgagctaaacaaaggacccagagtaaaagggtataagaataaggatggttctggaaatgcaactctagctgtcaaagatcagaaccttccattgatcaagagcaatgatgaggacattgtttctcttgttccagatacagagcagtacaatagagaagattttcccgagagttattcagatggtatgtttttcgtcattaaatcctatagtgaggatgatgtccacaaaagcatcaaatacaacgtatgggccagtacatctaatggcaacaagaaactcgatgctgcattccgggaggccaaggagaagtctgatggctgtcctgtatttctactgttttcggttaataccagtggacaatttgttggattagcagaaaatggtgggtccggttgattttaataaaactgtagagtattggcagcaagacaagtggactggntgcttccctgtgaagtgcacatcgtaaggatgtccaaatgcttattaggcacataacgc

SEQ ID NO: 6492 - DNA, 418 bp, Gossypium hirsutum
  Clone ID: uC-gsronu33B036f01b1
gacatcattggttactttccggtttcaccagtaccaggttgttgggagggctcttccaacggagaacgatgagcaccctaagatttacaggatgaagctttgggccaccaatgaggttcgggccaaatccaagttctggtacttcttgagaaagctgaagaaggttaagaagaccaatgggaaggccctggcattcatgggaattttggggagaacccttcccagatcaagaattttgggatctggcttcgttatcaaagccgtactggttatcacaacatgtacaaggaataccgtgacactactttgaatggagctgttgaacagatgtacaccgagatggcttctcgtcacagagtcaggttcccttgcatccagattattaagacggcgaccattccagctaagctttgcaagc

SEQ ID NO: 6493 - DNA, 605 bp, Gossypium hirsutum
  Clone ID: uC-gsronu33B036f06b1
cccacgcgtccgtgaaattgaagggtctgcctcgtggtagggggctgttgctacttgctgaaatgagctctgctggtaaccttgccacgggggactacacagctgctgccgtaaaaattgccgaacaacactccgattttgtcatcggtttcatctcagtcaaccccgcatcttggcccggtgcacctgtaaatccagcattcattcaggcaacccctggagttcaaatggtaaagggtggcgacgccctcggccagcaatacaacaccccgtattcagtcatctttgataggggtagcgacataataatcgttggtcggggaatcattaaggcagcgaacccagcggaggcagctcgtgagtaccgtcttcaaggatgggaagcatacatggctaaatgcacttaagagggtatcttatcttttaaatatgttacgtccctaataacataagggccaaattttgttgaatctatctatgattttgcatgaatggcttgttatatttgtattacttgttgagggagaactttgggaccccattactgtttcatccttgtgagggcaattcttttatgttatttaaataaattttgtcaaacaaaa

SEQ ID NO: 6494 - DNA, 108 bp, Gossypium hirsutum
  Clone ID: uC-gsronu33B036f07b1
catagacaaggacttttgaaagccggggaagactagatcacagtgagatggggattgaaccagagtttctcggatgttacggattaagcttatgagaaccattgaggt

SEQ ID NO: 6495 - DNA, 137 bp, Gossypium hirsutum
  Clone ID: uC-gsronu33B036f12b1
tattatacaaccaaaaaaaaaaaaaataaaagaagaaatttataataaaaaaatcataatcaaactcacctaaaacaaaatctagatggccgtctcccttgggggttcctctctttcgtcctcccggttccctccct

SEQ ID NO: 6496 - DNA, 616 bp, Gossypium hirsutum
  unsure (1)..(616): unsure at all n locations
  Clone ID: uC-gsronu33B036g04b1
gtttgttacccagatagatgctagtttttctcctcttcacagaaaatagcgacttcgaagatgatgagagcagtgatctatttgctccccttgactttcatcttcttcaccatagctgatggtaagcgcatccttccactgcttcagcctcagcctcttgaatccttcaaggtcaatgcaacccagaatgtggggagctgcacttacacagtatcaataaggacaagctgttcttcaactacctacacaagagatcagatcagtcttgcatttggcgatgcttatgggaatcaggtgtatgcaccaaggctggatgatccattctcgagaacatttgaaagcctgntcaactgatacatttcaaataaaggggtccttgcacataccagatttgctatctttacctttacaggagtggatatgatggttggaagccagagagcgggactgtgtacggatattatccccaagctgccacatttaattacaatgcctttattcctaatggggtttgggatggctttgatttcttgtatggaagggggttcgcatctgctgaaccatgtaccaaattggtggggggggggtaagtttgtgaatttttatttagggattt

SEQ ID NO: 6497 - DNA, 115 bp, Gossypium hirsutum
  Clone ID: uC-gsronu33B036g06b1
gacatgccctgtagcggagcattaagctcggctgatgaggagggttctcacggtgggggcgatgaacttgacagcgccatagagccagtttgtctacctatagagaatatctttt

SEQ ID NO: 6498 - DNA, 651 bp, Gossypium hirsutum
  Clone ID: uC-gsronu33B036g08b1
tttttaaacctgaatcatagaatgaatacgaatgaaaactgagaaaattagacacaaatatttacatggaaaaacccctctaaagaggataaaaaatacgaacaaagaaaacttaactaaaaatgacaaaaactgaaaaggagagtacaagatggagaaacaaataaaccctaaactcgaaatacaaagattccctaaaattcccacaaactcttaattttgttgttgttattctgaactatcttgggttgctaagaagcatatttatatgcttaatttcatgtacaaatatgactaaaacatccataaaataataagagtttgaactggaaaaatataatagatattagttgaatagttatgagatattagttggaataataatgcttctttacagatatgattattaagggaatatgtctattgaaagtattgttttataacgagacatgagaattctataaataggagtgatttttcattttgaaaacattcaaaaaatttcaaaagtcctttttattattccttcatcttctacttatgatagactatctataaggattacttttgaattctttttgaaatgattttttgtatactatgctagactagtgaatattttgttgggcaaacgcaaaatgaaccagcttt

SEQ ID NO: 6499 - DNA, 207 bp, Gossypium hirsutum
  Clone ID: uC-gsronu33B036g10b1
ttataaaaaaaaaaaaaaaaaaaaaaaaaaaaaaaaaataaaaaaaaaaaaaaaaaaaaaaaaaaaaaaaaaaaaaaaaaaaaaaaaaaaaaaaaaaaataataaaaaaaaaaaaaaagggggggtccgttttaaggaacccattctactataccagcgattgtgattttatacttattttatgggggaacaaaaatgaaatttgtt

SEQ ID NO: 6500 - DNA, 598 bp, Gossypium hirsutum
  Clone ID: uC-gsronu33B036h03b1
cacgagtctctccattcaaacgtaaaaaacggtgccgtatttacgcttgttggtgaaagtgcgagatggcgataggagctgagcacaagtcacagtccgatgttagagtttgggggtttttcaagctgccatttcggcaaaccgggaacgctaccggtacgacgtcgtcttcttccttgtcgtcgaatctatacgctgaaactcaacctcagaacgaaggatcgaaccgtcatgcctctgccaattcggtttctgccgttgcgaagtcgcttttgccgactcggcgtcgcctgaaacttgatcccgccaataaactctattttccatatgaacctggcaaacaggtgaggagcgcggtgaggataaaaaacactagcaagtcatatgcagctttcaagtttcaaacaacagcaccaaagagttgtttcatgcgccctccgggtgcgatccttgcccccggtgagggcatcatagcaacggtgttcaagtttgtagagccttcagagaacaatgaaaaaccaatggatcaaaagcgcaaagttaagttcaaaatatgagtctcacgtgaaagtccaatggactatgtatttgagctgtt

SEQ ID NO: 6501 - DNA, 361 bp, Gossypium hirsutum
  Clone ID: uC-gsronu33B036h05b1
cccatgcgtccgcccacgcgtccgagcgtttgtctcagatttttgaagatggcccgtaccaagcagacagcccgtaagtcgactggtgggaaggctccaaggaagcaacttgctaccaaggctgcccgtaaatctgccccaaccaccggtggtgtgaagaagcctcatcgctaccgtcctggaactgttgctcttcgtgaaattcgaaagtaccaaaagagtactgagcttcttatcaggaaattgcctttccagaggcttgttcgtgaaattgcccaggacttcaagactgatttgcgtttccagagccatgctgttctagctctccaggaagctgcagaggcattccttgggggtcttt

SEQ ID NO: 6502 - DNA, 803 bp, Gossypium hirsutum
  Clone ID: uC-gsronu33B036h07b1
tctatgcgtccgaaaaaaaaaaaaaaaaaaaaggaaaaaatataaaaaaaaaaatataaaaaaaaaaaaaaaaaaataaataataaataattttaaataatttaaaatggggggggtctttttttaggttccaagttttctttcttggttatgtaaggttatagtttttttttggtgtgacttaatttaaatttattggccttgtatttaaaccttcgtgattgggaaaacctaggggttatccaatttaatttgtttggtagaacattcctttttctccggtgggggtataatcaatggggtccttaacttatttgccttttcaaaaagtttgtgattcttgatatggtgattgggcctccctctttattggtcttttaatcacgtcgctttttgttggtaaatctccctgggtcctttttacttttcagtgcccttaggcccgttttttggttttttttcctttttttttttgccacgttggtgggtttttcccggtaagttttaaattgggggttattttttgggttcctgttttgtgtttttttggatctttgccccaaaaaatttggttgggggagtgttattttgggggcctctcctataaaggtttttcgccttggtattggatacatttttaatgggcttttttcaattggaacaggctactttttggtgtttttttgtttaagggttttccatttggttttgaaaaaatgtttaaaaaaaatacttattttaaaatttactttctttaagttttttggaaaggtggacctttttttttttatcaaaatgtttct

SEQ ID NO: 6503 - DNA, 506 bp, Gossypium hirsutum
  Clone ID: uC-gsronu33B036h08b1
ttcatgcgtccgctcacctcacctgtatcattcttactcattcactcctacacagtagaaaaaccctttaattttaagaaggatattttggttttatactgagaaatccaacttcttttgtatctttatctttttggtacttcaattatcaaaagagagaaaagcaagaacaaaaaaaaaaaaaacatacaactaagtgaaaaaccagacaagagagaaaacaagaaaaatgggtgttctggatcatgtttcagatctgtttgactgttctcacagttccaagcacaagaaacgtaagcagttgcagacggtggaaatcaaggtgaaaatggactgcgaaggatgcgaacggaaagtgaaaaaatcagtggaagggatgaaaggggtgacacaagtggacgtggagcggaaggccagcaagttgacggtcgtcggatttgtggacccgaagaaggttgtggcacgagtggcgcatcggacgggcaagaaggtggagctatggccct

SEQ ID NO: 6504 - DNA, 470 bp, Gossypium hirsutum
  Clone ID: uC-gsronu33B036h10b1
tttttagtgttcctcaacatagtccttcaaaatcctcataagaacaccctaccgaagccaaaactgaagccgaggcagaggccaatcagcaagattccgatactgtgggtgccgggaatcccggaatccttaatccaacattaaatgaaagggttgtcgaagaaccacctgtggctcccgccaatgcttatccatatcctgttgccatgaggctagtgagagagatccttgttgagggaccaagtaaccaaccactacgaaggtcggagataagggttcaacgatccgttgttgatgaccgtttatttacttgggctgacgtcggacttaccattgctattttggctcttttgttcaagaaatacttcaaatctaggggacatggtgctgtttttaaggatgggtcatagttttagcaacatcagttcatttgggaagaaagaattccatcatttatgtgtttaaatttt

SEQ ID NO: 6505 - DNA, 556 bp, Gossypium hirsutum
  Clone ID: uC-gsronu33B036h11b1
ttaattatagtaaaacagagacaatgaaaggagcattgatgttgagttggattctgatcatctgcctctcccaagtagcagttcggagccaatactactcagatacccgaccatatcatcccaagccacctaaggtcaccaatcttcacttctttatgcacgaacatacgggtgttacagcagtcgtgctaacccaagctaacatcacaagcaataattcatcagtgacatttgccaccctagttgctgttaatgatcctctcaggactggtcctgagcctgactcagaggtgattggaaatgttcagggtatttccctcttagccggatcaaatgcatcgagcacgcaggacataaaattgggaattaatccccgtaggtaaacggcggctttttaagcgttttttaagggggagacccaggcttgcggtggtccgaggaagaggacgattcatgatggcaaaagggactgcactatttaaccctattcttataaatgccaccaatgtcattatggaatttaacttactggagttcattactagggggcattaca

SEQ ID NO: 6506 - DNA, 475 bp, Gossypium hirsutum
  unsure (1)..(475): unsure at all n locations
  Clone ID: uC-gsronu33B037a01b1
ggttacggagtcggagtcactggcggcgatgatggagaaagaagagacgggagcaccagcagagcctactgcggcgggtactactactactactacaactagtgctcaagaagaggtggctgctgctgttgaagagaaaaaggttcctcaaaatctggcttctttcaaagaggaaagcaacaaggaagctgatctatccgattccgaaaggaaagctttggaagaactgaagcagcttgttagagaagcaatagactctaaccttttcaattcagaatccaaaagtgaagaaaacccagaaaaggaaaagaaacaagaatcaaaagaggtatccatttggnggtattcctctcttaaaagatgaaaggagcgatgttatcctttggaagttcttaagggcagggaatttcaagccaaagatgccttcgtatgatcaaaacacgatcccgtggaggaaagagtttgggatcgatga

SEQ ID NO: 6507 - DNA, 395 bp, Gossypium hirsutum
  Clone ID: uC-gsronu33B037a03b1
ccgcggacgttaccgccgggaccgacccggccgactggattaaatatgactacagcgagcgtggtggcgcgatgaccagctcgctggattatgatgaccgctagtgaaagatacgcataatgacacttatcgcagaacctgcgagagtcaccatggtgcggaggacggcgtcactcatgaaaggctctataacactgattatgaggtgctgagttggctagaagccagctagcagaatgccgatagctagctgactaatggaggccagaagctggtgttagatgagaggagggttggactgttgaggagagtaattatgaaaaggactggaaagacactgtgaaagaggaaatatgaggtgtttgcaaggtcatcaaggatgtcttaggtgacaa

SEQ ID NO: 6508 - DNA, 415 bp, Gossypium hirsutum
  Clone ID: uC-gsronu33B037a06b1
ttcatcgtcatggacctcctcttcctagagaaagttctgatctctcttttcttcaccatcatctttgctatctgagtctctaaactacgtggcaagcgctttaaactcccccctggcccccttcccatccctgatgtcggcaactggctccaagtcggcgatgacttgaaccaccgcaacctgacagacttagccaagaagttcggtgacatcttcttgctccggatgggacaccgtaacctcggggttgtctcttccccagagctggccaaggaggtttggccaccccaggaggtgagagtcgtttccagaaaggaatggcgggtttgatatcttcaccgggaaaggacaggacatggttttcaccgtgtacggtgagcactggcgcaagatgagaggatcatgaccgtccctt

SEQ ID NO: 6509 - DNA, 218 bp, Gossypium hirsutum
  Clone ID: uC-gsronu33B037a09b1
tatagtttttatatcactctaccaagagtggtggggaggtgtccagcttgaaggactgtgtgacccgtactaatgaggctcaaaatgacatctattacattacctggtgagaagaaaaaagttgtcgagacagtttctattcttgtgaagctccataataaaggttattgggtgcaccataaagttgatgccatggaagagtatgccggatggcattt

SEQ ID NO: 6510 - DNA, 432 bp, Gossypium hirsutum
  unsure (1)..(432): unsure at all n locations
  Clone ID: uC-gsronu33B037a10b1
tccacgcgtccgcccacgcgtccgcccacgcgtccgcccacgcgtccgcaaaaaagctttccccagagagtggaaaggaacaaaaaatcttctactcaaagaaaaggaaagagagaaagatcttccttagcgaaactatttgcaggaaaatcacatagaaaaacgatgagttattacaaccaacaacagccttcaagtggtgttcctcctcctcaagggtatccaccggaaggatattccaaggatgcttatccaccaccgggatatcctccacaaggatatcctcaaggttatcctcctcaaggatatcctcctccttacgcccctcaatatcctgctcagcctcctcctcagcaacagcaaagtactggtttcttagaaggctgtttggctgctctgtgcttgntgttgcctgctggatgcttgcttttg

SEQ ID NO: 6511 - DNA, 432 bp, Gossypium hirsutum
  Clone ID: uC-gsronu33B037a12b1
gttaaggttaatgttgatgggtcttctaatatgaatggacactatctgatggttggttgtgtggtgagagattctactgggaattggttggaaggcttcaggaaatatattggcagaggctctgctctaaagtctaaattacgggttattttaactggtcttgaagtggattcgctccaaactacattaagattattggtggaaggcggctacttgattcctatggaaaaaatatgggaaaattttgtgagtacttatttgatggcccttatacgacagattattgaagcttaaaagcaattatgaagaagttaaattttagtttgttccaaggaagggtaaaaggtggtagaattggctagctcaattaggctcaaatattgatgttgaactcactcttcttgagttccctaacttttctgacagagaact

SEQ ID NO: 6512 - DNA, 428 bp, Gossypium hirsutum
  unsure (1)..(428): unsure at all n locations
  Clone ID: uC-gsronu33B037b01b1
cccacgcgtccggaaatggtggccagtaagggtcttgaggctgttcaatctgagatcaatgacatggactgggaaagcaccttctttttgcgccacttgcctgaatctaacatgtctgaaattcctgatcttgaagaagattacagaaaggtgatgaaggaatttgcagtggagttggagaagcttgcagagcaacttttggaccttttgtgtgagaatctggggttggagcctggttacctgaaaaaagtgttttatgggtccaaagggccaacctttggtaccaaggtcagcaactatcctccatgccccaaacctgacttaatcaagggactcagggctcacactgatgcttggggaatcatcttacttttcaagatgacaagggtagcgggcttcagcttttaaggatggtcagnggattgatg

SEQ ID NO: 6513 - DNA, 379 bp, Gossypium hirsutum
  Clone ID: uC-gsronu33B037b10b1
ttcacgcgtccgcccacgcgtccgcggacgcgtgggttacggtatcgacaatatcgttaagcctaaagacgaaactgtatgtttaggaaataatatgaactattttggtccatttcaaagcacaaattatactgcgaaaaacagtaggagttattcaatgacgagaagcccttcacatgctcaagatcatataatggccgaaagaaaaagaagagaaaagctcaaccagcgtttcattgctctctcagcaattgttcctggccttaagaagatggataaagcttcagttcttggtgatgcaattaagtacgtgaaacaacttcaagaacggttgaaggtgctagaagagcaaaccaagaaaagaacagtggaatccgta

SEQ ID NO: 6514 - DNA, 482 bp, Gossypium hirsutum
  unsure (1)..(482): unsure at all n locations
  Clone ID: uC-gsronu33B037b11b1
ttaatctgctttgagagaagggttgcctcttcgaaattccgagcacgccttttacttgaaatgggctgtccactcctttaggatcactaactgtggtgtccaggacactactcagatccacacccacatgtgctactccaacttcaatgacattatccactctatcatcgacatggatgccgatgtgatcaccatcgagaactcacgttccgatgagaaactcctgtctgtcttccgcgaaggggtgaagtatggagccggaattggccctggtgtttatgatatccactctccaagaataccatcgaccgaagagatcgccgataggatcaacaagatgcttgcggtgctcgagaccaacatcttgtgggttaaccctgactgtggactcaagactcgcaagtatgcanaggtgaaaccggcactcaacacatgggtgctggcactaagatgcttcgacccaactgctagtgccagtgaaa

SEQ ID NO: 6515 - DNA, 325 bp, Gossypium hirsutum
  Clone ID: uC-gsronu33B037d02b1
ttattaacgaccatccgaactattatggtgtgtagttatttgtgccaagaatggagatcatgcagaatcgtgatggatcctcgtgttgcggagtatggcaaaacggatcacaaaggaaatttcattttgtccagagcaccagccatgcgtgttcggtcgaatgaaggggaagttaaagctagtgcataatagatcaatagatggttccaccctgccacggtttatcgagtcatgacaggtttaggtaactacgttttcggtctgccattgaagcaaatgtaaaaaataattgaaaaagagcattactaatgtatgtttttcgtta

SEQ ID NO: 6516 - DNA, 354 bp, Gossypium hirsutum
  Clone ID: uC-gsronu33B037d04b1
cccatgtgtccgcccacgcgtacgagaaagccgagtgtggccgaataaaatgtttgtttactcagtttcttttccaagagacgagtttgttaatgtgcatgtgagtaatggtgcaatggtactggtttgtaacgatcgatccattgcatttttcttttagcataagccaggttgacttctcttgatgttggtcatgggcttggtggatgtagggatggatgtaatatatgtatgtaaggtggccgttgactgtgtatgatgcatggatttcaatgatttaaaagttatcatgattcatgcggacgtgacacatagagtgaccgttagactagcaatcggactgggccgcccttt

SEQ ID NO: 6517 - DNA, 131 bp, Gossypium hirsutum
  Clone ID: uC-gsronu33B037d05b1
gctatatctgcctgcgaacattacgtatgtatggcttagatttatagaaaacggctctatctttgtttggccggtagccttcagacaaactatactgagcgtactctagagctgatcctggtggacaaaaa

SEQ ID NO: 6518 - DNA, 456 bp, Gossypium hirsutum
  Clone ID: uC-gsronu33B037d08b1
aaagaaaaattcagcatgatagtataatactggggaaaacccggttgaatgaccgtaaaacatgaatctcaacatgcaaacatgacccagggtacaaccaaacctcaacaaacactcgagaccattccaaccaataacacatctagttccatccgaggaatatgccagagactactctcaccatattcgccaaaagtacatggcatggaaaacaaacccaaccgccttttaagttgaggaagctgcctccccatctttcttctcggtatctgccttttctgtggcttctgtttcctttttctcctctccggctttatcctcggtcttcttttcatcaacgctcaacttctccagcagtccagcagcagcagatgcatctttattttcctcttttggtttttgggattcagcaacttcttggaacatttgcacctacgcgttcggaccccaacttac

SEQ ID NO: 6519 - DNA, 455 bp, Gossypium hirsutum
  unsure (1)..(455): unsure at all n locations
  Clone ID: uC-gsronu33B037d09b1
tattatctgagactctggttcttggtgtagcacccgagaaagcacactttgagggagctgagatggaattcggggctgagaacggctgcaagtgtggagacaactgcacctgcaacccttgcaattgtaaatgattagagaccaaagccaaagctccctggaagcagagacgcctttgtctttaagaaataatatgttttgttgtttatgtgtttttagaataaagtagccatggcttgtcgtaggttttgcctgttgccgccacggttacttggtgcttgccaatagatagagtgaagtactaatatttacttgtttttctgtccagtgtgagcatctctgctatctcaggatatattgngactattacataattaatgtaaggaagtgagtcagattcctnttgaaagaaataaaataatgaatccattatggttttacaatttttgcggtta

SEQ ID NO: 6520 - DNA, 562 bp, Gossypium hirsutum
  unsure (1)..(562): unsure at all n locations
  Clone ID: uC-gsronu33B037e03b1
ctcaaggggaggaattaaagaggttggagaaagagaagggaattataatgcgatttgtcataggacacagtgcaaccccgggtggtattttggatcgagggatcgaagctgaagaggagcaatacaaggattttctgcgcctgaatcacatagaaggttaccatgaattatcatcgaaaacccaaatatacttttccacagccgtcgctaagtgggatgcagacttttatattaaagttgatgatgatgtacatgtaaatctgggtatggtgggttctacattggcccgtcacagatcaaaaccccgtgtttatattggttgcatgaaatctggacctgttctagcacagaaaggggtcaaataccatgagccagaatattggaaatttggtgaggagggaaacaaatacttcaggcatgcaaccggacaaatatatgcagtgtccaaagacttggcaacctacatctccgtcaatcggcacatacttcatagatatgcanacgaagacgtctctttagggtcttggtttattggtcttgatgtcgagcatatcgaccaacg

SEQ ID NO: 6521 - DNA, 452 bp, Gossypium hirsutum
  unsure (1)..(452): unsure at all n locations
  Clone ID: uC-gsronu33B037e04b1
accatatttcaaccctcgacagtctcaaaccctccaaagatgtcaacatgctcttcacccaactcgtcctcacatgcatgccacccacccatatcgatgtcaccaagctttgcaaaaaggttcaacagatgaggtcccaaattgaatcggctatgggggggaagccgagggactattagaaacccatttctacaccatcttagcatcctatgataacccacttcaccatctcaatattttccctaactacacanactaccttaaactcagccaactcgaattcaatatccttaccaaacactgctcaaatgtgcctaaacaagttgccttccttggctttgggccccttcccctcacttcgatccggttagcttcttttctaccttaaaaccccttgtttcacaactacgatatcgacccttcgctaattcgaaagctcttcgattagtctc

SEQ ID NO: 6522 - DNA, 527 bp, Gossypium hirsutum
  Clone ID: uC-gsronu33B037e07b1
cttatattcctgcaaattcccttcttttcccctccacccaagcctaaaaaatcatggcgacagctcaaatcagcaaaaagcgaaagttcgtcgctgatggagttttcttcgcggaactcaacgaggtattgaccagggaactggctgaggatggatactctggagtcgaagtcagagttactcctatgcgtacggagatcatcatcagagccacccgcacccaaaacgttctcggtgagaaaggtaggaggattagggagcttacctcagtggttcagaagcgattcaagttcccagaaaacagcgtcgagctttacgctgagaaggtcaacaacagaggtctttgcgctattgctcaggccgagtctcttcgctacaagctactcggaggtcttgccgttcgcagggcctgctatggtgtattgagattcatcatggagagtggtgccaagggatgcgaggttattgttagtggaaagctaagggcacagcgtgccaaatctatgaaattcaaggaatgatatatg

SEQ ID NO: 6523 - DNA, 489 bp, Gossypium hirsutum
  Clone ID: uC-gsronu33B037e09b1
ttcacgcgtccgctcaaacaatccctctcagtcaccaaagcaaaatgcgtgaaatccttcatattcaaggcggccaatgcggcaaccaaatcggcgccaagttctgggaagttatatgtgcggaacacggcatagatccaacggggcgttacaatggagatttggatcttcaactcgagaggatcaatgtttactacaatgaatccagttgtggtaggttcgttcctcgtgctgttcttatggatcttgagcctgggaccatggatagcattagatctggtccggttggtcagattttcagaccggacaacttcgtgtttggtcagtccggcgccggtaataactgggctaaagggcattatactgaaggtgctgagttgattgattctgtcttgatgttgtacgaaagaagctgaaattgcgattgtcttaaagatttcaggtttgtcattcatgggaggtggactggatctgaatgggacacttttg

SEQ ID NO: 6524 - DNA, 126 bp, Gossypium hirsutum
  Clone ID: uC-gsronu33B037e11b1
aacataaaaaaagataagcatttagttctaaaaagaaaacattgttcatgtagatgaaaaaagggttcaacaaaaatacaaaactaaaccataaaaattataaagataaatctcaaatcctttaac

SEQ ID NO: 6525 - DNA, 500 bp, Gossypium hirsutum
  Clone ID: uC-gsronu33B037f07b1
tcctcgcgtccggccggacaagaagtctgtctgtatcaccgagcccgaggtatagaaatcgtcgctatggtcatagccgcagtcgtagcccaagtcgaagtcgaacctctattcgcagccgtagcccaagtcgaagtcgaacccctattcgcagctgtagtccagttgattctccaagggctggaaggcgaaggtccccttcacagagcaggagccgatcagaatcaaggtcttcgttaaactctcagtctccaaagaaggtgagcaaagcgaagtcaaggtcatcatcaggaagtccagacggtggaaggggactggtctcttatgatgatggttcacctgattcacgaaggtggaatacagtgaaagttggttgaagaatgttgttaagagtttgatgagccccatcttctgttgatgcactgaactgcgcagttttacgaactgctcgactctgacttgtggtgctgccagaggatgtggtcagtaattacattaat

SEQ ID NO: 6526 - DNA, 620 bp, Gossypium hirsutum
  Clone ID: uC-gsronu33B037f10b1
tgtttggacccacgaaaggcactcggtttcgtccattgtcattgaacattccaaagcctttgtttcctttggctggacaacctatggttcatcaccccatttctgcttgtaaaaggattccaaatctagcacagatttatctagtcggtttctatgaagagcgtgaattcgctatgtatgtctcatcaatctctactgagttaagagttccagtcagatacttaagggaagacaaaccacatggttcagctggtgggctttacaacttcagagatctgatcatggaagataatccgtctcatatcttcttgctgaattgtgatgtttgctgcagttttccactcccagaaatgcttgaggctcacaaaagatatggtggtatgggaactatcctagtaatcaaggtttcagctgaatcagccagtgagtttggggagttggtagcagatcccatcaccaatgaactgttacattatacagagaaacctgaaactttcgtaagtgaccgaatcaactgtggtgtctatgtgtttacaccagatatttttactgctatccaaggtgtttcctctcaacggaaagacagagccaatctgagacgtctttccagctttgaagcc

SEQ ID NO: 6527 - DNA, 637 bp, Gossypium hirsutum
  Clone ID: uC-gsronu33B037f11b1
ttatttaaccacttcctctatcagagtgactgactcacttacttttgttgaacacttatcatcaaataatcacaactcccagattcataaattcacgtgaagaaaaatccactaaaacactcattaccgacgatggggaagaagcgggtaatggttccggccaaggaactggacttgttgaccgttaaatacgagaaagaaacaatccaagctcctcatttgacgggatcgatactgaagttgtttgtgaggataattgaaattccaattataggttctttgatcatatctttcatgaaaaaggagaataacatggttgagatgttgcagaacactgaaataccagaaaaacccatgtttaaacctgaatttcctcctcaagaagcagaaccttctgttgtcattgtggatgaagaagggaaacctactgatagagttgaatcagccgttaagtgtcttcctcattatgatcctgctagctgctggagtggggatacacttccatcgttacggtactggaagattcgtgactttgcttatgcttatcgatcaacacttgtgacaccttctaagatagcagaacaaatcatcacacttgttgagggtgtaaatatcatagggccccacaccatattga

SEQ ID NO: 6528 - DNA, 511 bp, Gossypium hirsutum
  Clone ID: uC-gsronu33B037f12b1
atcgtctgagaatgcggagtggaaaatacattgcacttcacttaagatatgagaaagacatgcttgcttttactggttgtacttctggtttgactgatgcagaatctgaagagctgagaataatgagggagaacacaaagcattggaaggttaaagatataaactctactgaacagaggataggtggcttttgtccactaacccccaaagaagtcgggatatttcttcaagctattggctatcctccatcaacattaatttatgttgcatctggtgaaatttatggtggcgatgctcgcctttcagagcttatgtctttttttccaaatctagttttcaaggaaaaactggcaacaaaggaagagttgaatgaatttgctaagcatgcatctcaaagtgctgcactagattacattgcttctttggaagcgatgtgtttgttccatcatattcaggtaacatggcacgagcagttgaggggcaccgcagattctaggccatcggagacatc

SEQ ID NO: 6529 - DNA, 388 bp, Gossypium hirsutum
  unsure (1)..(388): unsure at all n locations
  Clone ID: uC-gsronu33B037g05b1
gggaggctttggaattcaggagaaaagttttttacaatatcgttccctatttacaagcagagacagatattttgtatttggctgatagaagaagatttttgagagatgaagaagtgctgatgaaggatgttcctggatgggttgtaggagaaagcgtctacaaaactcgctggatgcctcctattcgtatggcaaacaaataagaaatcgaacgtttatgtgatctctattcaattaactttatatcaagattggttcttttctttttccttttgcaactttctcttgctttcaatattttccagcaaacccaatgtaattaatatatctccaatattatccttgaataagggtagtgtattcaaaatnnannanaananannaaaaa

SEQ ID NO: 6530 - DNA, 555 bp, Gossypium hirsutum
  Clone ID: uC-gsronu33B037g06b1
gtatggtagtgacctttggcccctctggtctgaccactgaagttaagtctgttgagatgcaccatgaagccctctctgaggctctccctggtgacaatgttggattcaatgtcaagaacgttgctgttaaggatctcaagcgtggtttcgttgcttcaaactctaaggatgatcctgcaaaggaggctgccagcttcacctctcaggtcatcatcatgaaccaccctgggcagattggaaacggatatgccccagtccttgactgccatacctcccacattgctgtgaaattttccgaattgctgaccaagatcgacaggcgatctggaaaggagcttgagaaggagcccaagttcttgaagaatggtgatgcagggatgataaagatggttcccaccaagctatggttgtggagactttctctgagtacccaccacttggacggtttgctgtcaggacatgcgtaggacttggctgttggtgtcatagaagcgtgagaagaagacccaacggtgctaggtcaccaatctgctgcagaagaatgagatgcattga

SEQ ID NO: 6531 - DNA, 492 bp, Gossypium hirsutum
  Clone ID: uC-gsronu33B037h01b1
aaaaaaaatataaaataaaaaaaaatgaaaaaaataaaaaaaaaaaaaaacaaaaaaactaaaaaaaaatataaaaaaaaaaaaagggggccccctttataggaaaaaccgggggcgcccctttttggggccccagttttcctttctctttgtttgccccttttttttttttttttggggcccccttaatccaatttcttggctcggattttctctcgcttccccctctttaaaaaccctttggcgtcccacccctttttctcccttttgggaatttccccttttttcccccttttttttttttttttttaaggccctccccctttttttttttttcaaaatggcccccccctttttttgtccttttttccccccccccttttttggtttttttttcccccgcggggggttttttttttttttccccttccccccccccccccctttccgcccttttttcccccccctttttttctgtgtttctcttttttt

SEQ ID NO: 6532 - DNA, 534 bp, Gossypium hirsutum
  Clone ID: uC-gsronu33B037h04b1
gcgattgctacgtcagacgccccgaccaagccgagcgcgtaatcggcacgctcctcggctccgtccttcctgatggcaccgttgatatccgtaactcctatgccgttcctcacaccgaatccgccgaacaggttgctttggatattgaataccatcataatatggtagtctcccaccaaaaagtgaatccaaaggaagtaattgttggatggtattctactggccttggagtcactggtggtagtgcattgatccatgatttttattctagggaagtcccaaaccctgttcatttgacagtggatactggatttaggaatggagagggcacgataaaggcctacgtttctgtcaatttagctcttggagaccgacagcttgctgctcaattccaagaaattcctcttgatctacgtatggttgaagctgagcgactcgggtttgacatccttgagacacaagcgttgacaactgccgaagatttggaagatgggagtcacaatgcaagactgttggcttaaagatgatgctaca

SEQ ID NO: 6533 - DNA, 426 bp, Gossypium hirsutum
  Clone ID: uC-gsronu33B037h05b1
cccacgcgtccgcaaggcttgaaattcaatagcaaaaaacaagagatttgggatccccaacgagattgtttgatcgagaaatggatggaaaacaaggtttccgagaagaaaattgcagggaaaaaacagggtctcaaagatttcaaaaggaaatcacatcatcatcatcatcatgtgagtttgattagctcaagttctagctcatcggattccagttccggtgggtttttttcatcatccgacactgaatctttgaatggttcaaagacaaaagctccatgttttgttgctccaccatcactaccaaagcctaaacctgtcaggaccagcgtgtcggcttctcctgagaaacttgatgaaaggtcgaaatcgagagccatgaaaatctatggaattttaaagcagggtgaaacaacccatttcacc

SEQ ID NO: 6534 - DNA, 503 bp, Gossypium hirsutum
  Clone ID: uC-gsronu33B037h06b1
aaaaaggcaaaggaagtagtggaagcagtggaccctgataagaatttggtcactttcagagtgatcgaaggagatctaatggaagagtataagagctttgtaatcacgattcaagtttcgcccaagagcgagggtagtggcagcgtactgcactggactttggaatacgagaagctgcacggagggattgcgcatcctgagactctgctgcaattcgttcaagatatctctaaagacattgacgcccacctcacccaagcaagctaaacagtatcacatgtcgctattgatgccgctacttgaagcactgctcatctatttaatgaataaagtgacttcctttctcatgtattttgatctgaatatgtatgtttagatcaatatgcagacaaggggagggagctatgaattttcttgcatggttgactttttaattctgtatgaattcaatgtatcctatgctcttatttgtgctctaagaatataagtaagcatgatttttt

SEQ ID NO: 6535 - DNA, 158 bp, Gossypium hirsutum
  Clone ID: uC-gsronu33B037h07b1
ttcatgcgtacgctttgaaactgtttgtttatggcttttgtgtaaaatgctttgaatgcttttgattatggggatttgatgtttgtgggtgtttttcatatgaaaaaaaaaaaaaaaaaaaaaaaaaaaaaaaaaaaataaaaaaaaaaaaaaagacg

SEQ ID NO: 6536 - DNA, 156 bp, Gossypium hirsutum
  Clone ID: uC-gsronu33B037h08b1
tattgttaagctggcacgcctgcgtgtaccggccgcggacttactgggtcgaccgcacccagtccgtattttcataataagcagattgtaatgaaaatggggtgggtgatcgactgaatgggaccattgttactgaaaagcggcgtcctggctgga

SEQ ID NO: 6537 - DNA, 431 bp, Gossypium hirsutum
  Clone ID: uC-gsronu33B038a04b1
cccactcttccggttttcttgtatgttatgtattaatgttttcttttactagcgagagtgcttatggcagtactcattggaatgcctattttatgtcttcttatttctcaatgagcaatatcctgatttcaacagaaaaaaagaaaaaaaaaaataaataaaaaaattaacgaagaaaggaaaaaaaataaaaaaacaaaaaaacaaaaacaataaaaaaaacacatcaaaagcaaaaaaaaaaaaaaaaaaaaatggggggggccgttttaggggtcccaattttcctcccctggcttcgcaagtaaaaatttttttattggggcccctaaattaaattccctgggccgggttttaacacccgcgtgaatgggaaaacccctggggtccccaatttaatagcctttgaaaaaaacccccttttccccagt

SEQ ID NO: 6538 - DNA, 394 bp, Gossypium hirsutum
  unsure (1)..(394): unsure at all n locations
  Clone ID: uC-gsronu33B038a09b1
tttttttttttttttaaatgaaatgcttacttgagatagaagataatagatggcgtatttacttacattccaaagtcaagaaaggggatggggtaaaagtaaaacatctttgtacaaaaggggtgaggttgcaaatgaaaaggccatgcttgaaaatctaaatgcaaaaatgagttttaaaagtcaaaagtctgtttgccaaattcaatagtattccaatttattgattcagaactggacgctgataaactcagaaattggagcacatttgagttcggtgctatgttgtcttttattcagatgtaaactcaaaagaaaataataaatatatctcggccgtaacagaattaatcgattgccttgttacgaaaaatattacaagaacttggcttnt

SEQ ID NO: 6539 - DNA, 428 bp, Gossypium hirsutum
  Clone ID: uC-gsronu33B038a12b1
gcaatttccagaaagtaaaaagaacagagcttggatatcctaagctaatgtcggacgaggagcaccatttcgagtccaaggccgacgccggcgcctccaaaacctatcctcagcaggccggtactatccgtaaaaacggctacatcgtcatcaaaggccgtccttgcaaggttgtcgaagtttccacttccaagactgggaagcacggacatgctaagtgtcactttgttgggatcgacatcttcactgctaagaagctggaagatatcgttccttcttcccacaattgtgatgtgccgcacgtcaaccgtactgattaccaattgatcgacatttctgaggatggatttgggagcttgctgactgagagcggagacactaaggatgatctgaggctcccaactgatgaaaacttgttgaaacagatc

SEQ ID NO: 6540 - DNA, 543 bp, Gossypium hirsutum
  Clone ID: uC-gsronu33B038b02b1
cgggtcgacccacacgcgcggaaattttcacctgctaaagcttccggccttgatgatgagaccggtgaacctttggtgcatcgaaaagatgatactgcatgagttctcaagctaaggcttgacgcattccacaagcaaacccaaccggtgagtgagtattattccgagaagggaatagtcgcatagcttcatgcggaaaagcctcataaagaggttacggacgaagttaagaaagtactttcatgacgaaaccctcattacggacgagattcgtataaggtgatttacacatgaacattggttcttttgcaaacagggaccccccaaaaaattgagaaatttcatggatttttactcgtgttttgagtacatattcggattcattgctatgtcattgcttttttggcccaaatatcagctgttgtttgttcaagtattggtgatgattatgatacttgaaataatgatatacttatagattgacaacttgtttgaaaataaaatgtattttactttataatggttttttgtaaataatttttt

SEQ ID NO: 6541 - DNA, 512 bp, Gossypium hirsutum
  Clone ID: uC-gsronu33B038b04b1
attttagacatttgctcattgtaaatagatttccaccgtttgcaagtcactcccattctaggtccaggtacaacccttaacgccaattgcttaaccactctagtgtcaataaaattaatgaatgctaccagagtccacaagcatactgatggcatgctcaccagttttcccattgcctctcatagtttgaaaaccaagtgaccccatcatggcctggagaaacaatattggctgctcattctcaactgctagagcatcaaggttgtctcaacagttcgagaatactttaggttcactcttctcgtccatagattctgctaacaactgaatgagttggggtttcatacacttgtgaccatacgagaatttcaagccacaccagtagcagagaccttttttccttcttcccccagtttctgtcagccttttgtttttgtagttggtatattggttataggtagggggacccttttcagtatttaagggtgtttggttttaggttcagttggatt

SEQ ID NO: 6542 - DNA, 79 bp, Gossypium hirsutum
  Clone ID: uC-gsronu33B038b10b1
gtttttattaaatctgccattggaggtcatgcatgtatgtttctgtgccataattaataaaagtgatcgaagtttatgt

SEQ ID NO: 6543 - DNA, 523 bp, Gossypium hirsutum
  Clone ID: uC-gsronu33B038c02b1
cgcccacgcgtccggataaattacttcccttcaaggtacgatcctgttcgtcatgcagagatgttccctatcccacctgctgtttgcactggaaggcgagagaagtgcatcattgagaaggagaacaacttcaaacagcccggagagagataccggtcctgggcagcagacaggcaagaacgattcatctgccgctgggttgatgccttgtctgatccacgtgtgactcatgaaattcgcagcatatggatctcatactggtctcaggctgataaatcagtgggtcagaagttagcatctcgcctcaatgtgagacccagcatttagacatggagttgcggaggatgagtaaaggactgaaatgtagaaaggccatcatctagttgtttcggaagcataaacttattgttgatccttttgatctgtgtgccataactgaaataaagtctcatatactataagttttacgcttatggtcctaattaataaatgccgtttatgtgtaactaactatttctttctt

SEQ ID NO: 6544 - DNA, 603 bp, Gossypium hirsutum
  Clone ID: uC-gsronu33B038c06b1
gaacttaagatttcagtctcaaatatggcaaccagcgccagagaaagtcggcgtaggaaaatcctcgaaagaggatctgatcgtttggcttttattacgggtcagctccaaaacctgcctactcctcctcactctcatgaacaactccacgccaaccctcctccgccgcaagatccacctactgatttttcgactcaacccgccgtttctcctgatgtcgacgatgaagcctccggtcctttgtcgctcaaacatcaccctgtttctgatgctgatcagggtcagaccagtgcttataatggtggaattgatgaaggatcagcatccagcggacgggatagaagcattgagccttcaaatggttctgcttttgatacaagtggtgaaccgaattcatttctggtttcatcaaatgatcgaagttcaccaatttccacgtcagggacagtacagggttcagaaacatctgctcggaaacataacttcttcacccctaaacaaataagttctgccattgatggatctgagaaagcacgccttttatgttcagtaattgtgggtgtttagttgattggtgcatttgggtttctctttcaggaaaca

SEQ ID NO: 6545 - DNA, 553 bp, Gossypium hirsutum
  Clone ID: uC-gsronu33B038c11b1
ctctctcgtccgcccacgcgtccggtttgtttgtatattctgatcggttcaatttcatgtgtcactcactttcctttcccatcttaaacatgctccctcctctgtaaatcctattagacgtcaatttcccctttcataaatctttgggttttcatggaggaaatcaattgggatacccttctgctcgaggttgacttacccgatttcgggaatatcttagataatgaaccggtaacggaacctcctcctcaaccttgttcaacccagaatcccgatgaagaaccggcggtgtcttcgtggatcggggcgatcgagaaggttttgatggaggatgataattttgatcctagggttgagactcaacctgtctccgatgatgatttcttggccgatttactggttgattcaccttctagtagcggcggcgatgtggctggcgtcgacggtgctgatttgcacaaacagagccagacccacaccgacctcgataaagacgatccccttattaagaaacagagaaagcagttgagaaacagagatgcaactgtgagat

SEQ ID NO: 6546 - DNA, 505 bp, Gossypium hirsutum
  Clone ID: uC-gsronu33B038c12b1
cgtccggaccaatcgtcaatatgctacattgattctgtcaagccaccctgcaccttccctactcattccgatgattgcccgttctcttataagcctcactgcagccaggatggacctgtctatgttatcatgatcgaaaatgataagatgtcggtgcaagagtttccggcaaactcaacaatgatggatttgctggaaagagctgggcggggtaactcgagatggtctccatatggttttccagtgaaggaagaattgaggccaaggctgaaccatgagccggtaagcgatgctacatgcaggctgaagatgggtgatgtggtggagctaacaccagccattccagacaagtctttgacagagtacagggaagagatacagcgcatgtataaccgaggtctttctgtttccagtactgggcctcctgctagtaacatggttgctttacgacgttgacgccttttcgtttttttttttatgctaaacccaaaaggggggcaaaaag

SEQ ID NO: 6547 - DNA, 601 bp, Gossypium hirsutum
  Clone ID: uC-gsronu33B038d06b1
caaggtatggtgctttgggtggtggagctaactctgtgaatcatggctacaccaagggagatgggcttggtgctgaaattgttggcacctttgtgcttgtttacactgtgttctcagccactgatgccaagcgcagtgccagagactctcacgtccctattctggcaccattgccaattgggttcgcagtgttcttggtgcacttagccaccatcccaatcacaggaaccggtattaacccagctcgtagtcttggtgcagccatcattttcaacaaggacaagggctgggatgaccattggattttctgggtgggtccattcataggagcagcactagcagcactctaccacgttgttgtgatcagagccattcctttcaagtcaaactgatcaaaatcaacggtccatatgatcatatgatctcaacaaaatgaaaaatttcacccatgcacccttttagtttgtgtatttcccaatttatccttttgtttttgcatgccctttgtgattttgtatatgtaagaatgtgtgtaatatatattatttacatcaatggtgggagagcctttgtgtccctttttacttgttttttttttagc

SEQ ID NO: 6548 - DNA, 266 bp, Gossypium hirsutum
  unsure (1)..(266): unsure at all n locations
  Clone ID: uC-gsronu33B038d07b1
atattggttgtttacttgtttcttttccaagagacaagtttgttaatgtgcagtgagtaatggtgcaatggtactagtttgatacgatcgacccattgcatttttttttagcataagccaggttgccttctcttgatgttggtcatgggcgtagtggatgtagggatggatgtaatgtatgtatgtaaggatggngttgactgtgtatgctgcatgaagttcatcgatttaagagttatgatgatttatacattaatttactttca

SEQ ID NO: 6549 - DNA, 446 bp, Gossypium hirsutum
  Clone ID: uC-gsronu33B038d08b1
ctttctcgtccgctgaaatcgagaagcctatgttggaactcgtctcggcggcccaaacgatcttgccagacagcgatggtgccattgacggtcaccttcgtgaagttggacttacatttcaccttctcaaggatgttcccggcctaatttcaaagaacattgaaaagagcctagctgaggcatttcaacctttgggcatttcggattggaactcgctcttttggatcgctcaccccggtggtccagccatattggatcaggttgaggcgaagctagcccttaaacccgaataactccgagccacgaggcacgtgctttcagaatatgggaacatgtcaagtgcttgtgtgctgttcatattggctgagatgaggaagaaatcaagggagatgggccttggaaccacgggttgagggcttgagtggggggtcctggttggttttcga

SEQ ID NO: 6550 - DNA, 597 bp, Gossypium hirsutum
  Clone ID: uC-gsronu33B038e08b1
ccctttcgtccgccctagaagcctaaggaaaagatgaggccgttgccgatggaattcgtgacggacccagacgaccaaggttcagccatggaagccgacgacgttgacacaccggagatcttcggcgaaggcgtcgtcgcttccgacgattttgatgactccgatatcgactaaaacaacaaacaagaatcgtttcaattgaatctgaactgcgctatggatgcttatctgtatgcaaatcctgtgaatcgtcacaggtcctcgggttcaactacataatacaaattcgacctctgaacttcatttttccttcaaaataaagcttcgatttgatctcttttagtgagacaaatggctgaaaatcttatgcatgctttacaatataacagctatggcggaggcactgctactttgaagcatgttgaagttccgatcccaactccaaataaagactggtcaagctatggcaagtgctctcaatgttgtacaaacatttcattcgtttggggattaatgcttttatgaaagctgctgaactgaacaggtgtgtgcttttttgtggttttttactacattttagtgataaactatgttact

SEQ ID NO: 6551 - DNA, 532 bp, Gossypium hirsutum
  Clone ID: uC-gsronu33B038e09b1
ttttctcgaaagagttggtctggggcagaagaaggttgatatgactattgtattcaaggacttcaagcgagatgtccttcggattgactcgattccctctacatcactagatggcatcaaagagtggcttaataccactgatctcaagtactatgagagcagactaaatttgaattggcgtcctatactgaaaactatcactgatgatccagaaaagttcattgaagatggtggatgggaatttttgaacatggaagtcagtgattccgagtctgagaactcagaagagtctgaccaagggtatgtgccttcagatgtgcagtctgaatcaggatcagaggatgaggatgatgatagtgaatcgttggttgaatctgaagatgatgacgaagaagactcagatgaagattcggaggaagatgaaggaaagacttgggaagagttggagagggaagcaagctatgcagatagagagaaaggagatgattccgatagcgaggaagaacggaagagaagaaagatgaaagctttc

SEQ ID NO: 6552 - DNA, 483 bp, Gossypium hirsutum
  unsure (1)..(483): unsure at all n locations
  Clone ID: uC-gsronu33B038e11b1
attgttctccatatttttgggaccagccccatgattttgttccagagaggtttcaggtacaaaaggagagtgaaggcattgaaggatgggctggttttgacccgtctcggagccccggagcattatatcctaatgagattatatctgattttgctttcttacccttcggcgggggaccgagaaagtgcgtgggagatcaatttgcactcatggagtcaactgtggcattagccatgttgttgcaaaagtttgatgtggaactaagaggatctcctgaatccgtggagctagttacaggagcaacaattcacaccaagaatggattgtggtgcaagctaaagaggaggtctaatggccattgatatttgttcttcacctttgtatctaaacttagagaaagtgtacaacgtatttttggacttactgaaaaggaaattaaatatatgggtttattctacntatcaacatttgattctttttttt

SEQ ID NO: 6553 - DNA, 390 bp, Gossypium hirsutum
  unsure (1)..(390): unsure at all n locations
  Clone ID: uC-gsronu33B038f03b1
aaatgatcatatgatctcaaaaaaatgaaaaatttgacccatgcaccctttcagtttgtgtatttcccatttgatccttttgtttttgtatatgtaagaatgtgtgtaatatatattatttacttcaatggggggagagcctttgtgtcctttttttacttgctttttttttttaagctaaaaaaaggagagggtgctgatggcaaatattggacccatttgtaatttgtatggctatgatttgtgaaaaaaaacatgtcattttcataataacaccgaccaatacctactttcaatggctttttgttgtaaattatggatttgacttggcaaatacaaaanaaaaaaaaaaatataaaaaaaatataattaaaaaaaaaaatataaaaa

SEQ ID NO: 6554 - DNA, 692 bp, Gossypium hirsutum
  unsure (1)..(692): unsure at all n locations
  Clone ID: uC-gsronu33B038f05b1
aaatataattaaaaaaaaaaaaaaaaaaaaaaaaaaagaaaaatataaaaaaaaaataaataaatataaacaataaaaaatatcaatttttcatacgggggcccttatttttggggccggcctttcttgggctcccaggcncccgtctcctttttgccttgtctaatttttttttattgggcccgcctgttttttttctctggctggctgttttacccctttggctggggatccccttggctttccccccctttcccctttttgcttccctttccttttttccccctttgcctttttgggttatcgcccccccccgttgccttttcctattggtttttcgtcctttctttttttgggtcctttccctttggccgtttttttgccccccctctttttgtttttttccctttctttccccctttccttcgcctttttttttttccctcttttctttttttttcccctttccttttttcccccttattctttttttccccggtcttccttttaggggtggtcttccttttggttctccttttgtctctttccttttttttcccaaaaactctttttttgtggttgttccttttggccctttcccctttttcgtgtttaccctttcctctttttccccttttttttagtggttctttctcctccttccccccttcccttttttgctttttttgctt

SEQ ID NO: 6555 - DNA, 459 bp, Gossypium hirsutum
  Clone ID: uC-gsronu33B038f09b1
gcctttcgtctcctctccataaatctctctctcaacgcagagcgaataggcggagacttccaagaatctatcgcatcagctaatcacgctccaaagaatggatcaggttcaacacccatctgtcatgcagaaggtagcaggccagctccttcgttctagccattctcaagattttcaaggttataatgggtctttcaggagtcctgctctataccaaaggcgtgctgcatatggcaattactccaatgctgcactgcagtatcctgtccgggcttgtggagacctgtctatggttccatcaacagcttcagctatttgcgttcaagcccctgctgagaaaggatttgccagctttgccattgatttcctcatgggtggagtttctgctgctgtatcaaaaacaggtgctgcaccaaatgagcgtgttaagcttttgattcagaaccaagatgaaatgat

SEQ ID NO: 6556 - DNA, 533 bp, Gossypium hirsutum
  Clone ID: uC-gsronu33B038f10b1
tttttatcgcgagcggcccggacgcgtgggccgacattacgttgacccttccaaaaaaaaaaagaaagtaaagaaaagaaagtgagagagaaaatgcgagaaagcgaggaaactgagaaagtgaagaagatgaagaaacgagaaaaaatgaagcacatttttaagaagctgcacataggaagcagaaaaaaaccttcaagaaacttttgatcttttgtattgatttcgtgtctgtgtgcgtaaccttacaagaatgaagcaatcggccctttatattgccgaatattacaaaaatggttttttcctcttttttttctattatttcttcccttttttatatctgctggcctattgttgttgttgttttgctgtgttgttttcgtcttctttgcaggtacggtggccagctggtgtatggagccgtacggtgacgtggcgcggaggctcgatgcatgctgaaggtaggagcggtggctgagtttagggttttggtctttagggtttgctgttaatttctctgttttggctgcgag

SEQ ID NO: 6557 - DNA, 449 bp, Gossypium hirsutum
  unsure (1)..(449): unsure at all n locations
  Clone ID: uC-gsronu33B038f12b1
gtttattaggaaaaaaaaaaaaaagaagcagaagaggaaagaaaagattaaaaagctttgcaaaaatggtgcttcatcatctcgaatccgttcaaaagtgctctacgccacttcaaaacacgggcttcgagaggaactggatggtatccactatgagattcaggcaactgaccctacagaaatngatcttgaagtgctgaaggaccgtgctaactgagcgttgcattatttaactgttccattcaagaagttaccccctcgctttgctgactccaagttagtcttttgcttcatgtgcagaatcattttctgacaccaaaaaattggtcaatggtttaatcctttgaattaccaaaatctggtgaagttgatttgaagctctgggcttaacatttatctggttcccggtaattctgggatctttacttattatttcctttgaacaaaga

SEQ ID NO: 6558 - DNA, 567 bp, Gossypium hirsutum
  Clone ID: uC-gsronu33B038g04b1
ctttccttactttcttttctcttaatttactgaaagctttttttagttgaaatggagattcttccacagcgatcatcattatcctcaactctgaatcccaacgctccattgttcattccattagcatatcggatggtcaaggatttctctgatcaatggtgggctctcgtccaatcatccccttgcttccgcgactactggcttcaagaacgcttccacgatcccgaaaacgacgacgtttccgacgacgacgatgatcctctcttccccggcgacctcgatgacatatttgagcaatacgacgacgttttactcgacccaagaccggaggaaaaggaaaagaaattggtaccgtttgggacatcgaagtggcggaaggaccgagttgtgactgagtcaccgaggtttatcgaaaaagcacccaagattgtgaatgttaaagtgagtccaaggactattcaccaaccaaggtaaatcaactcgtactgagttgacatgggaggtctcattttaagctttttaacttcttttttcttattgatttggaatatattaggtacagagatc

SEQ ID NO: 6559 - DNA, 279 bp, Gossypium hirsutum
  Clone ID: uC-gsronu33B038g06b1
cccactcgtccgaaacattgtttttatcccttttttcctggactccttacaaatctggctaaagcaatgatgatgaagcatgagtcaagaatcagcttgaaaatgcaagatccggtctcattgaagtggttgttagagatttataatagtatttgtgattcaaattataacacattaataatattaattaatagtattaattagtgagatttatattgtattgggacaaggagttgatataagaattaatttagtaaagaattgttgctattatagatg

SEQ ID NO: 6560 - DNA, 559 bp, Gossypium hirsutum
  Clone ID: uC-gsronu33B038g08b1
cccattcgtccgcggacgcgtgggctgaatttaaacatattactaagtggaggaaaagaaagtaacaacgattcctttagtaacggcgagtgaagaaggatgaagtgcaaaattgaaatcataaatctctgagggtttatgaattgtagtttatatattttttttaaaaaaagtgaaggaagaaaacaatgaaataattttgattggaaaatcatttcatagaaggtgataaacctgtaattgtttcttctcttccacatcgttttaaaagaaagtattatagagccaagactatttcttcaaggagttctcaagggccattactctcctctctgagaacaatcctctcactggtagcaagggtgagatcaggaagcaatgcaatcttgcaaacaagcttcactaaaatgcctcgccaaagagaaagccgagagtggccgaataaaatggttgtttacttgtttcttttccaagagacaagtttgttaatgtgcagtgagtaatggtgcaatggtactagtttgatacaatcgacccattgcattttttttagcataag

SEQ ID NO: 6561 - DNA, 493 bp, Gossypium hirsutum
  Clone ID: uC-gsronu33B038g09b1
ctttttcgtccgcccacgcgtccggatccttactatgacttgtatatcaaggaggcgttgaatcggctgccccgtgagattgtcgatgctcgtaaccaacgccttaagcgtgcaatggatctctccatgaagcacgagtatctcccagaagatcttcagaaaatgcagacaccatttaggagctatcttcaagatatgcttgctcttgtgaagaaggagagagcagagcgagaagcattgggagctttgcctctgtatcagcgaaccattccttaagggttttcatgccgtatctcatagtcattgctgttgaaatttgcgttcgattatctgtatgtgcgtatggtatttcgatagcggcagtggactgaatttttacaattcctggtttggttggtttacacaggcatctgtgtcagtttttgaactgaatcactttttaggttaagtctgttgcagtgtccaaatataaacagactggaacggcatttac

SEQ ID NO: 6562 - DNA, 586 bp, Gossypium hirsutum
  Clone ID: uC-gsronu33B038g11b1
aaattataaaaagaagattagatttgatagaatttgaagatggggaatgctctgagattgttgtatagccattgctgcaagccaaccacagctggtgactcccaaggcaaggatggagtttcagctctttcccatgatctcttccaatttgatatcacctctcaggttcctgaagggctaagttatcacgtcgtttcatccaagaaagctcaggctaactggtatagaaagctattagatgcttggagagaagcaaaaccaccaccaaaaacacctgaggaagcttcaagccttgtcattcagacactgaagagacaccaaaaggcagatgttaagggattattagcgtactatggtcttcctcagcagtcttctgccagcgccacaacatcattgcctcaaggagttaagtttgaattgcagactttaccagtggacaccaaagcagtacctgatggagataccataacagtgtatgtaagtactacagatcccagggaatcattgaatgtaccttgagatgtccaatcggcagctgatcaaagatcgagagcccgtgctgccaagaactataccaaagctgatg

SEQ ID NO: 6563 - DNA, 557 bp, Gossypium hirsutum
  Clone ID: uC-gsronu33B038h02b1
cccacgcttccggttttcggtatcagaaaccctgaggaaatcccatgggctgaggctggagctgagtatgttgttgagtctactggtgtttttactgacaaggacaaggctgctgctcacttgaagggtggcgcgaagaaggttatcatttctgctcccagtaaggatgctcccatgtttgttgtgggtgtcaatgagaaggaatataagcctgaccttaacattgtctccaatgctagttgcaccaccaactgtcttgccccattggctaaggtgatcaacgataaatttggcattgttgagggtcttatgaccaccgtccattctattactgctacacaaaagactgttgatggtccttccatgaaggactggagaggtggtagagctgcttccttcaatatcattcctagcagcactggagctgccaaggctgtcggcaaagttttgccagcactgaatggcaagctgactggaatggctttccgtgttcccactgttgatgtctttgtggttgacctcactgtgagacttgagaagaaggcttcatattgatg

SEQ ID NO: 6564 - DNA, 464 bp, Gossypium hirsutum
  unsure (1)..(464): unsure at all n locations
  Clone ID: uC-gsronu33B038h07b1
gatcaggcgtggaaggaaggaatgacaaaggaggaagctgagcaactagtggtcaaggcagtgtcgctcgccattgctcgtgatggtgctagtggaggtgttgttcgcactgttgttatcaactccgacggagtgacaaggaacttctaccctggtgataaacttcaattgtggcacgacgaattggagccgcagcattcgttattggatatactgaacgctcctagtcctgaaccgatgaacatttaatcaatgggagtcagctgccttttcagtaatcaaatgggagtcacctgactttctagttttaggttgtattcagctgaagggcttgttcttactgcgtttattttctaaagctggaagttttatgtttagttgntgttaaaaacatattatctatttcattttctgtttgggtggggcttggagacgaacgggaattcagcttcatttgaatgggc

SEQ ID NO: 6565 - DNA, 559 bp, Gossypium hirsutum
  Clone ID: uC-gsronu33B038h11b1
gcattatggaggttcatgtgtgggactagtagagggatggccattcggagcctgagagtctccttgatcactgcctgcagatatggaagcttatgggtgtcgggttcggtaacctgcacgccgggtcctagtacggtgtcgatttcgttgcggagtttctgctggatctcgggatggttcacaagctcagcaatgccccattcaattgaccataaggttgtttcaatagcagcaacattgatattctcaacaatgtaaagaacattgtcttcattgatctctccctttcgttgagcatcaagaatgtgatcaatggcacatttcaaagcattgttgtcaattctttttgtggttgcaagcttcttcctctcctcaaggaattggtccctgaaaagctgcaatctgatttccttcacttccttgcataacttcaaataccctctcaagaatggcctcaaaatggggataaaaatcaccataggtgtactcaaagctttgtgggtatgacatccctgcagagagtaagatccttgtgaatgcatggtggttagccaataaa

SEQ ID NO: 6566 - DNA, 196 bp, Gossypium hirsutum
  Clone ID: uC-gsronu33B039a02b1
cccgagaccaaacgtttcggttatacggggccaatgatgctgaactaaagggccgccacgattcattcactaaggattccgacccagacccacacgtctccgcttacaataactaataaaaagcgaaaccaaagttccagtggcttatacccacattttccaataaattcgtcatcagactgtgtgtcggactcct

SEQ ID NO: 6567 - DNA, 656 bp, Gossypium hirsutum
  Clone ID: uC-gsronu33B039a07b1
cgttcatattctttttgcctgctgtcgtttactcttttagttcttttttctattcgtccttttctcattctcttttctatcttttctctctatttttctctcttctttcttttatacttttttttttctcttcttttttttttttttttcattttatttattcattttttttttttcattccttttctcttctttttctcttttcttttttcctttctttttcttcttatcctctctcttcttttgttactatcttttttctttattctttttctttttcttctcttttttttactttcctatctcattttctccttatactatatttttttctcccctttacttttttcttatttctctcttaccttatattttatatttttatctcacactttttatttatttcttcttttctttgtcatctctctcctttattttttcttctctcttctttctttaatcttctttttaactctatatctattttccatatttttcttttattctttcttttatatctatttttttcttttttctctttttatttcaatcccatattttcatcgtctcttatcttttctctttaaatattcttttctcttcaactttttctttcttactctcttattcatttttcactttttttcttttttttt

SEQ ID NO: 6568 - DNA, 200 bp, Gossypium hirsutum
  unsure (1)..(200): unsure at all n locations
  Clone ID: uC-gsronu33B039a08b1
gtcactaantatggctatataggacagatccagtacttacaaattagtagcggcggccacgctcgttccattttcttgtatgccattgttatcatgtaatgtttacttcgcatgttaatcctcttgttgttgaaccctgtttgttgcagttcactgtattttttttcaaaagttttaacacccctcttttataaatttta

SEQ ID NO: 6569 - DNA, 329 bp, Gossypium hirsutum
  Clone ID: uC-gsronu33B039a09b1
ctacgcgtacggttttaaatggatatttgtattgtcattggccttgcttcaagctgcttactaccgacgcttgaggtggttgtgacgtaaatattcctttgtgtgttattgaatcttgattttgaactctctttgtagtagattattttattttctttttatatgtttatcttattttaataatatatttaactttgaaattatttatttgattgtgctttatttttacatattcttattcttttttttatttttctttatatatttttattattaatttttttatttattttattatcttatccttttttttatatttttataatttt

SEQ ID NO: 6570 - DNA, 80 bp, Gossypium hirsutum
  Clone ID: uC-gsronu33B039a10b1
taataatttacttgagcacagtatcatctaaagtccctcctcaaaacccagtatataaagatgctttaataatgtcttcc

SEQ ID NO: 6571 - DNA, 147 bp, Gossypium hirsutum
  unsure (1)..(147): unsure at all n locations
  Clone ID: uC-gsronu33B039a11b1
nagatgacgcgtacgcaaacgcaaaagaaatagggtggtttttttaaaaaatatccgccggtgatcccctaaataaaattatttaatttcaatttaattatacttaattaatgcgtacttactaaatacttacaaatattatactta

SEQ ID NO: 6572 - DNA, 87 bp, Gossypium hirsutum
  unsure (1)..(87): unsure at all n locations
  Clone ID: uC-gsronu33B039a12b1
caaacaccaacaacaccaaacaaaaaaaaaaaaaccaggcgagaagaaaaaaaaaaaaaaataagggggagcgcgcngaaccaaccg

SEQ ID NO: 6573 - DNA, 408 bp, Gossypium hirsutum
  Clone ID: uC-gsronu33B039b03b1
ccttcgctctaaatcagtagttgagcaaacctctttcacaatgagcagatccggccagcctccagatctcaaaaattaagctgaatgcaaatcggttggttgttggtacacttcgcggatttgatcagtttatgaacctagtagttgccaacaccgttgaggtgattgtttatgtgtaatttgttatagtcatgtttgatttcttatctttatccttcttcttctcttttctatttttttttcttttttaatttatttcttctcttttatttttttttttatttttttatatattcattctccctgcttttcttttttcattttctctttttttttattctctcttcttcccttccttttttctcttgtttcctttgtatctctatttttatcttttccttatcattt

SEQ ID NO: 6574 - DNA, 908 bp, Gossypium hirsutum
  Clone ID: uC-gsronu33B039b07b1
ttgtacgcgtggggtttaagtgttaaagttttggattttattttttgtatgagtgggttttgtttttattatatattttttttttttttaatatatttattttttttatttttttttatatttttatttttttttttttttataggtttttataattttattataattttgttattttatatatgttatttattttttaaatttatttttttttttttatttatatgtttttttatatattatatttttatataatttttttttatattattattttattatttttatttttttttattttttaattttatttttatgtttaattaatttattttttattttttttatattatttattatttaatattttattatttatttttatatttattttatttttatttttatttttttttatttaatattttattataatattattatttattattttgtattttttttatgtattattttttttttttattttattaattttattttttttattttattaatttttagtttaattatttttttattattttatttaaattttttatatatttttttatatttttttttttatattattttatttatatttgtaataattttaatttttttaattatatatttatttattaattaattattatattttttttatattttattataaatttttattatttatttttattatttatataatttatattatttttattttatatatatatttatttatatgtttttttttatttttatagtttatttttttattataattatatataatatatttttttattttattatttatttataatttattattattatatatattttttattattatatttatattttattttaattttttattatttttaattatttta

SEQ ID NO: 6575 - DNA, 263 bp, Gossypium hirsutum
  unsure (1)..(263): unsure at all n locations
  Clone ID: uC-gsronu33B039b08b1
taataaaaggagcagcttgacctcccttttgtgaagaacccataatcttagagatggatatttgatagatttccctttgatctccttttctctttaaagaaaaattggttttcgatttcattttcaaatttatatattttggattagatttggttgnttttagggaaaaacaatggaaagggcaatgttaaccccagcaaggaagaggcttgatgagagactttcatgagactacagcatgatccatctgctggtattagtgt

SEQ ID NO: 6576 - DNA, 186 bp, Gossypium hirsutum
  Clone ID: uC-gsronu33B039b09b1
ttcttcgcgatctagaatagtcctgtggtttcgctggatttgacattggttgacagttttttttatggaatgatttacatgatatattattattgctttatattatttctctttttaattattattaattttcttactaaattttttattacatttctttatattataataatatatttattataa

SEQ ID NO: 6577 - DNA, 385 bp, Gossypium hirsutum
  unsure (1)..(385): unsure at all n locations
  Clone ID: uC-gsronu33B039b11b1
attcttatgcgtgggcggacgcgtgggggggatgagttgtttattttaaataaatgaaaaaaataatgttaaataagtttattattaatattatttaaaattatataagtaattttttaaataaaaatattaaatgttaattttaatttaattaatataataatatataatatataatatattattttatttatataatataaattatattattattatattatttaatttattataataattaatataaataatattataataattattaatattatattatttattaaatattaaattgtaatagtatttattttattttatatttaaattttttaataaatttttaataataaatatttaantatattttttaattaaaatt

SEQ ID NO: 6578 - DNA, 150 bp, Gossypium hirsutum
  Clone ID: uC-gsronu33B039b12b1
taattttagaacattgggttcataaaaaaagagattgatttaatttaaaaaaaacaaaaaaaaacatatcaaagacaagggttttttgatttatggggggcccccgtttgcgggcccgcgccttggtctcatttcctccgccttccttgt

SEQ ID NO: 6579 - DNA, 76 bp, Gossypium hirsutum
  Clone ID: uC-gsronu33B039c03b1
cctagcttgcgcgcacacgatcgaggacacgagggaagatattttatagataaacaccgtggctcgaagtggaata

SEQ ID NO: 6580 - DNA, 427 bp, Gossypium hirsutum
  Clone ID: uC-gsronu33B039c09b1
cctacgcgtccgcggacgcgtggggaagaatggttcgtattattgatgaattaggggcaaggtaactagaccgtatggtaacagtgatgttattcgtgctatgcacaatgctatcttacattattttataaaactacaactgagacttttgtttttgttattcaaattcaaaaaatgcatttttaaggttttttctattagagtattttttttatttttatattctttttattaaatcaattttataaatttattatatttttattttatttattttttaataaactaaataaaattaattatatttctttttatctatttttatattttgtttaaaattcttattacttttaattaatgttttatttaaaaatctttattttggtattttttttttcttatttatattaataatgttggttttttt

SEQ ID NO: 6581 - DNA, 941 bp, Gossypium hirsutum
  Clone ID: uC-gsronu33B039d01b1
cttactagtggacgctttggtgatttgcaccatatgatatctgaagcactgtctggagttacatgctgattgcggctacctggtgagctgaacttcgatctaggaaacttgccgcgaatctcatcccctttcctcgtcttcactttttcatggtgggttttgctccactcacttctaggggatctcaacagtaccgagctttaacagtacctgagctcacccagcaaatgtgggacgcaaagaacatgatgtgtgctgctgatcctcgttacggtcgttacttgactgcatctgctatgttctgtggttaaatgagcaccaaggaagtggtagagcaaatgttgtttggttctgacttgaaactttctattattttgttttgcttgtttctctccaatttttctcttcttccttttggataaatcttttttattcttcttgttaattttctctaccatttctcgtcttttttttttattcttttctttattcttttttattttctatttttctcttctttatccttttaacctactttattttatattttttattttcattattttctttttatattatttatcattttacttctttctttctttttctcctttttcaatcctttatttattttccttttctccttccctacttttttttatttcctcattcaattatatttttatattcttttccttaacttttaactcttagtttctttttttattatattccttcctcttccattctattttcttttcttttctctttcttctttacattctttattatattactatttgtcttatctcttttcttcttctatatcattcttacctctataattctctctcctacctctattatatcttttttccatttatatatcttttatatctaatcttttccttttctttaccccccccccccccccccccccc

SEQ ID NO: 6582 - DNA, 78 bp, Gossypium hirsutum
  Clone ID: uC-gsronu33B039d02b1
ccttctcgtccggcgactggctgctattgggcgaagtgcttttttaaaaaattcccccaaaaaccccattcatattaa

SEQ ID NO: 6583 - DNA, 650 bp, Gossypium hirsutum
  unsure (1)..(650): unsure at all n locations
  Clone ID: uC-gsronu33B039d06b1
acttcttccacttaaaagcaagttagctagctagggttttgtgagccagagagatgggttcaaaaagaacggcatcactagccctcttctttgcactcaacatcctcttcttttccctggtgagtgcttgtggttcctgcccttcccccaaccccaaacctaaacctaaaccaaagccaaaccccactccctccccatcttcttctggcaagtgccctagagatgctcttaaactcggtgtatgtgctgatttgctcggtggcttgctcaacgtcaccattggtacgcctcctgttcaaccctgctgctctctcatccaaggtcttgctgatcttgaagctgccgtttgcctttgcacggcaatcaaagctaatattttgggcatcaaccttaatgtcccactttccctcagcttgcttcttaatgtctgctcaaagaaagtaccctctggcttccaatgtcgctaaatcagntctctaaattctntctcttcttagtgctgcgtgggtttgaggttcttaaggtctaagttgcagtgatcaatgttttcttggtaactggttgtttaatttacgttngtggagtgtgtttcctttggatgatactgataaatgtacactatataaaagagtttatttctttggtttatg

SEQ ID NO: 6584 - DNA, 252 bp, Gossypium hirsutum
  Clone ID: uC-gsronu33B039d08b1
gatccgttttttaatcttttatctgtattgaattagattcatatacccgcattttcaatcgtttagttattgtttaattcctcacaattctccattttcctcagttttaagtgcagtagagctccatttaagaaagaaaaaaaaagttgaaatcttttttgagcaatggaaggatcagtttttactccatcattggaaggaatgaagcatattaattttccggaaggggaaatgctttctaagccttctttg

SEQ ID NO: 6585 - DNA, 315 bp, Gossypium hirsutum
  Clone ID: uC-gsronu33B039d10b1
ttcttctcttactttttatattactctcaattcccattaaaactttcaatctttcagccataattaagcttcttcccttcagaaaacatcgactgaagctgctccaagattaaagaagcttcaatttataatactctgccccttaaactagcaaagcctgatctgctgcataatcgtctaaagaaaaattgatggggataaataagtacctgtatgcgattactttttttaaaccctactgaggtataactttcaagctatgatcaatgttttttgatgctgttgtacattggccccatattattttcctgtatt

SEQ ID NO: 6586 - DNA, 302 bp, Gossypium hirsutum
  Clone ID: uC-gsronu33B039d11b1
aagcattatactcgtactaagaagaaactagttgtaggcagctattatatcgtttctcctttctcccttctcttaagagtagaatgattattggaaggttacgccaatggttaagtctactggtctgtgtgcttgctgttatactactcaaatctgaaggcgctagtgtagggattacttatctgcaggatgccgtagcgaaaggagctgtttgtttggatgggagttcaccagcttaccattttgacaagggctctggcgctggacttgataattggattgttcacatggagggtggtggt

SEQ ID NO: 6587 - DNA, 428 bp, Gossypium hirsutum
  Clone ID: uC-gsronu33B039e01b1
cgtacgcgtgggcggacgcgtggggtttgccgtagcctgcctgttcttccactacagatccacccattgcgacggcggaatgaagatccgtcaacgccgtatgcgactattttcgcatgtatgaaagtcgaggaggacgtgcgcaaagtgctgaacgtggggcgacgttgtggcgtcggcgaggttgtcgcgattgctgatttagttggtaggttgatgtgttttgtgttttaagctagtggtgtcatcgggccctgtgatcgggttcagatgggaccaggctttattggatgtaatagaattgaagatgggcagagctatgaattgggggaggcaatatttaccaggggaccatgtgagctcatttatttgaacaagtatgagatgataccttcgactggaaggtcctgagctgctggggcttgtat

SEQ ID NO: 6588 - DNA, 134 bp, Gossypium hirsutum
  Clone ID: uC-gsronu33B039e02b1
ccttcttttgcgaggattgacagactgagagctctttcttgattctatgggtgccccgtgttgacccacaaaaggatttcccaccatttctcctcttttttatatcattccttcttacttcttcctaatcttta

SEQ ID NO: 6589 - DNA, 254 bp, Gossypium hirsutum
  Clone ID: uC-gsronu33B039e04b1
cctactactgccgttttgcctctatgttcgaccaacagccacctcgcgagggcctcatctgaccccgttcgaccatgaacctgagggtctcgctcctagcctcagaatcttcgcctagactccgatttcaacgaagcaagcaaagactcgagggggccaaaactacgataagtccctctttctttattctttcttatatctacagcaaataaagatcgtgaaaagaaattacatagatcacataatcattattt

SEQ ID NO: 6590 - DNA, 308 bp, Gossypium hirsutum
  Clone ID: uC-gsronu33B039e08b1
tcctacgcgtccggcacctttaataacattacatttcgaagccttgtcgatgccattgccaatggaaaacagcttcttacacaccagtgccgggtctcgggcatgcttggccatagcaccggtccccaacaatgtgaacgccgccatgaatgtgatagccaatttgcagcagcagaatcataggattctctttgatgtcatcaattctcgcttgggaattgctcgtgaagcttgcaattagtttcttattggctttatttttttttgtttgttctttgtttgctttcttgttttttatgcgtaagctc

SEQ ID NO: 6591 - DNA, 767 bp, Gossypium hirsutum
  Clone ID: uC-gsronu33B039e09b1
aaccgaggaccatcttaacaaagacaagacatgccagttcaagatcgtcaagaaaccctacaccaacgtcaacgaaacccttgaatggaccatcgaacgagacgtgccgacggcgacgttctttatccgagcctacgctttggactccgacgaccacgaggtggcgtacggtcaaaacaccgacgccgagaagaaaaccaatctgtttgaaatccaagccatcaccggtcgtcatgtttcgctcgatatagtgtcggtttgtttatagtctctttctttcccttgttctctttctgtcctatttctcttatttcttttataatctttgatctttttttttatctattgttttttttttttttttatgttttctttcttctttctcctactgtcttttttctttttttttttttttttttttttctttttttcccttttctcacttttttttttttttttttttcttcttcttttcttctattttctatttatcttcttctttcttttctattctttacttttcttttttatttttctttttctctattttttttttttctctttacttatttttctattctttctttttcttctttctattcttctttttttatattttttctattttttttttacctctttttttttttcttctttcttaccttttgtctttttctctttcttcttttttcatttttcttttctcttcttcttactttctttttcttcttcattattttttttttttttttgtttttcattttttt

SEQ ID NO: 6592 - DNA, 186 bp, Gossypium hirsutum
  Clone ID: uC-gsronu33B039e10b1
tttaaggccaagattcaggacaaggagggcatcccacctgaccagcagaggttaatttttgctgggaaacagcttgaagatggcagaacccttgcagactataacattcaaaaggagtctaccctccatttggtgttgcgtcttcgtggtggtttgcaaatttttgtgaatactttcacaggaaag

SEQ ID NO: 6593 - DNA, 219 bp, Gossypium hirsutum
  Clone ID: uC-gsronu33B039e11b1
gttagtcactacctctacccaccgtcgtaccgttttcttttcttttctttttctcttaatattctgtctagaactctccattttctcttttgctgtctttggtttctctttatttttcgtctctaaatctctgcatcatcatcgatcatgtctcttttattcttcctactgctgttcttagccatgactcggcctttcaagcgctctttattgctttat

SEQ ID NO: 6594 - DNA, 1097 bp, Gossypium hirsutum
  Clone ID: uC-gsronu33B039f01b1
cgttcatgagggaagtcattctggaggagttcatttagagattatttgaacagaatgtgacataatgcatctaataatattagatattttataaatttaattaaatttaaattaatttttaattattttatatttttattttttgttattaatttatatttacttattttatatttattttttataattaaattattttttattttttatatattttatttataattttattcattctttttattaatttttatattttttttaataattatatattataattattaattttattttttattattattttttttattattttatattattatacttacaaatatatttattattatattcttactattatataaaataattcttatttatattatatataattatttatactttttaattctatattttatttttaacttttattatttattatttatattttcttttattattattattaattaatttaaatattattaatattattatttatttatatatctttttatctttatatattattttttctttattaattaatttatcttataatctttatataataatctttacctttatttatattaatatactcatattcataatcttttttattattattctatctattttatacttcataatttattttattatagtataaatatatattataattttactatgtattttataatatatcatttattcaattcatcatttatttatattatttattcatattttttattatattaaatattttttatacttttatataatatcttattatatatatatttatatttatatctttaagtattttatgtaatatattatattttacaatatacttttttaatattttctattttttctatttacattctatattatttctatttttaatattttgttatttatcacaaatttatcttttattaaatattcttaatttcttctcttatatctaattaatatatttttatttataatatttacctataattatatttatttcatttctatgtaataaactaaatattgatctaacaacatctttttagtaatataat

SEQ ID NO: 6595 - DNA, 429 bp, Gossypium hirsutum
  Clone ID: uC-gsronu33B039f04b1
cctacgcgtccgcagaaatttacgcccaacctctgtgtaatttgtctcacaattacaataaaccattatctgttttatttgtttttatatttataagaagagagtgagagtatctaatcattcccaaatgcctttaaattgcttaacccttggtttcagagtcccccattttctgccacaaaccaactacatagctttcactacctacgtaggaagctgttttcttgcgcataggacaataatcctaccctaacaatttttactttgttttttagtttcaagtttaaattttttctttttttttttttaattcattaattttcttcaataatgttaagttgtcttctgtttttttttttttatccactatttaattatttctcttttgtgtgaattttattttatattctttcttattttttttttttt

SEQ ID NO: 6596 - DNA, 82 bp, Gossypium hirsutum
  Clone ID: uC-gsronu33B039f05b1
aaatatcttactgttttctaatattgtgaatttctagtggatttgacgacgcttacccttaaccagaatctgctttgattta

SEQ ID NO: 6597 - DNA, 273 bp, Gossypium hirsutum
  Clone ID: uC-gsronu33B039f06b1
catcattttgcccatttcactgctctcccctagatcgtcttcaagagagagatctccttacagctaccgtacacattcacacacacattcactgaatgggtcgagtcatccgagctcaacgtaagggtgctggttccgtattcaaggcccacactcaccactctcaaggtttctgcttttttttttatgtctgacttatcttacctattttcttttcttttagcttttcctttcctacgtctctcctgttttttattatcttctcttctcttt

SEQ ID NO: 6598 - DNA, 383 bp, Gossypium hirsutum
  Clone ID: uC-gsronu33B039f07b1
tattttcctatcgaaatcatcaacgctgattccatgcaagtctatcaaggtcttgatgtcctcaccaataaagtccccctccgtgaacaaaatggagtgccacatcatcttttgggtactgttagctcagatgtggaattcacggctaacaagttcagggattctgctattcctattattagtgacatattatctcgcaaccatttgccagtcattgttggaggcaccaatttctatattcaggcagttgtgagttctgtccttcttgatgaattagtagaagatttttttgaaacctactcaagggaccattctggatatgagcataccaattcatatgcctgtcttccttggagacagtttcattttttgctttgattttt

SEQ ID NO: 6599 - DNA, 149 bp, Gossypium hirsutum
  Clone ID: uC-gsronu33B039f09b1
tttgtgaattgcagtcgctggtgaagggactcgaaaaatctttggagcaagctgatgattcagatgcacttctagctcaggtgcgttttttttatttaatttatttttcaattattctttttattattttttcatatatactttttttt

SEQ ID NO: 6600 - DNA, 168 bp, Gossypium hirsutum
  Clone ID: uC-gsronu33B039f11b1
taatactcggatcttctctgtctctccaaagatcttcgtttctgtcctccaacttcattcattttctgagtttgtttcagaaattttttttatttctatttctcaattttattattctttatacttttatttttttatatactttttctaatattttattttcaattt

SEQ ID NO: 6601 - DNA, 750 bp, Gossypium hirsutum
  Clone ID: uC-gsronu33B039g06b1
tgtacatggaatccagcctgatggccagatgccaagtgacaagactgtcggaggaggtgatgatgcttttaacacctttttcagtgaaactggtgctggaaagcacgtccctcgtgctgtctttgtggatcttgagcctactgttattgatgaagtgaggactgttacttaccgttagctttttcacctttagcatcttatcattttcatggttgatccttccttcaactttccccgtgtccactactcttttgccctaacagatcctattttttttttttttcctcttttatcttatttttgtttattttctccttccttcctcttattttattctttttttctttcatctccttttccttctttttttctctcctttctctttctcttttctattttcttattcttcttccttcactttttttcttcctattctttttcttttcttttctatttttccactctttctttcttattcttcttatctctttatttattctatttcttcttacttctctcttctttttttcttttcttttttacttttttttattttttctattttctcttcttttttcacttatttacttcaccttcttttcttcttccccttctctttctttcttacttttactttatcttccttcttttcatttctttccctttcttctcttttttttttttctctcttcctctcttttcctctcttcttttttttttttcttttcattttttttcctcctccttttc

SEQ ID NO: 6602 - DNA, 258 bp, Gossypium hirsutum
  Clone ID: uC-gsronu33B039g09b1
tgtggtgcacgttagaggattgtcggcgcatgatagcgagtgtcgataagaacgaagatggatttgtctgcttcgaggacttgtacagaatgatggagctgcagcgatgatcatatgattatgggtttttattcatttgtgcttcataaacatcgtgttaagcgatgtactcgattttgtgttaatcttaaattttttattttttatttttttttttttttttttttttgtatttctattttatatttttcatttttt

SEQ ID NO: 6603 - DNA, 1099 bp, Gossypium hirsutum
  unsure (1)..(1099): unsure at all n locations
  Clone ID: uC-gsronu33B039g11b1
tctccttttgtttgccggtgaagctgagtgtagcaatgtgggtggtaatggtatttaggantttatattttataatttattttattaatttttttttttatttatatttatttttattttttttttttatttttttaatttttttattttttttttttttatttttatattttttaataattttttatatattatatttttatattttatattttttttaatttattttaattattatttatttattttatttattttttttttttttatatattattattaattttttttttttttaattatttatttttattattattttttttttttattattatttatctaatatttttttttttttttatattttaattaatatttttttttatctatattatttaaataatattttattttatttatatttattttttatttttttatttttaattattctatttttttttttatttttcataaacttttatttcttttttattttattttatttttatctttatatatattctatttatattattatttattttatcatctatatatatatttatttatttatatcttatttaatcttcattatttttttattattttattacaatctttttttatatatctattaactatttatattttttatctttataaatatctttttttttttatactatttcttattattatatattatatattaataattatttttctattttaattattcatattattttttctctaattattaatataaattcttcatttttaattttttacaatattctatatttcattatattattattattataattatatatatatataaatattttttatttatacaaatttataatacttttatttttctttacttttctattatctcttaatnttattacaaagtttttttatttatttaattatatattttttttattataattttcttttatttattctaattctttttaatatattatattcttatttttattcttatattttttcttaccattactcttttattttttttacttacttcttattatttatattatttcatctttattttttt

SEQ ID NO: 6604 - DNA, 467 bp, Gossypium hirsutum
  unsure (1)..(467): unsure at all n locations
  Clone ID: uC-gsronu33B039h03b1
ccctcgcttccggcgaaatggaagagatgcatttgactcccgatctactcacatataacgtgctgattcacttgtatgcagagcacggagatgttcaaaatgcagtttttttgcatcgagagatgatagaccgtggaatttgccctgacaaattgacctacaatagcttgattttgggacagtttaaaaacggaaagttgttagaaataaaggatcttgttgatgatatgaaggccaagggattggttcctaaagctgatacatatacccttctgattaagggatattgtgaacacaaggatttcatcggggcatacttttggtatcgggaaatgtttgaaaaccatttcctttcacgtttcacgacttgtaaggaaactcgtgattgggccttaaagagcaggnaaagtcgcaagaggcgcagattatctgctcggagatgaaggctaaaggaatggacaactgga

SEQ ID NO: 6605 - DNA, 105 bp, Gossypium hirsutum
  Clone ID: uC-gsronu33B039h11b1
ctcacgcgtccggccggacaagaagtctgtctgtattacctagcccgaggtatagaaatcgtccctttggacatagacgtagattaaatctaagacaatttaata

SEQ ID NO: 6606 - DNA, 362 bp, Gossypium hirsutum
  Clone ID: uC-gsronu33B039h12b1
ataattataaaaagaaaaaagaaaaaaaaaaaaataagaatggaacaagaatatgcataaacggcatacatggaagatataaagggaataaaatgaacatgttccaagagttggtcgaagcactgccgttgtgtttatgaggaatcgtgtacttaagtttgtttagggggggggcccgcttgttgggttctcctgggttcccttagccgctttggggggccgctttttttcttttttgggggcgcccttaaaaaacttttggggggcggcgtgttttttctcccgtggtgggggggtttaaacctttgggtggggccccctattatttctctctggggggtcgatttctctttttttttggt

SEQ ID NO: 6607 - DNA, 206 bp, Gossypium hirsutum
  unsure (1)..(206): unsure at all n locations
  Clone ID: uC-gsronu33B040a03b1
cctctcgtccgacgtctccggtgctagcttacccctcggcaagaggatttcacatccccactcccgggctggatcatcgaatcacttaaagccgtaaaattcatcgatgcaaagcacttcaacgttccggccggacactccgcagtcgagctggttgccggntgagaaagtgccatcgtccatatcctcatgaccatccccaacat

SEQ ID NO: 6608 - DNA, 331 bp, Gossypium hirsutum
  Clone ID: uC-gsronu33B040a09b1
gtttttgggtgttcacaagtttatggtgatatcttgtcctttgtcaccatcagaggagcttcacacaccgctccagcttcacagccaaagcgatcaatggcactgtttaaggcagctcttagcgggaaaccactgccagaagcttgagcgttcccatggatccatataccttttttatttcagcattatgtattctccaaactaagtgtcagtatccattgtactgccattggcaatctttaataattaaataatgaaagttttcatttgaaataaaaaaatgtgagaacctgaaaaagcaaatgaaaaagagccgtgtgccgcccaaaaa

SEQ ID NO: 6609 - DNA, 335 bp, Gossypium hirsutum
  Clone ID: uC-gsronu33B040b03b1
ggctcattggtgctggtactgatcattgtgaagggcaactcataagtgaccgagtaaatgttaaggagggtgaattaggagatttatctccagatattagaagtacagtagatgacacaggtgaccgttctggtatacatcccaggcggtctagttggggtagaaaaagtggtcgatgggaaatgtcacctgaagttcttgctttggcagcttgagagggggaaccaaaccgagtcggtggaggtagcaattgcaacaatttgataaccgaaagccggctgtcatgaccaatgttatgattttgaatgtacgatttggaaaagggaatgactttt

SEQ ID NO: 6610 - DNA, 460 bp, Gossypium hirsutum
  unsure (1)..(460): unsure at all n locations
  Clone ID: uC-gsronu33B040b04b1
gtttcttcgacaatgaaattgacatgctcggtctcgagaattatcctggtgtcaagcgcattaccatcaagcctcaaaccgataggtgggtcttccctgaaaccctcaccggcatcattgtgttggctgaaggacgtctcatgaacttgggttgtgcctcctgcccaccctaccttggcatggcatgctctttcaccaaccaaggtgatcgcccagctcgagctgtggaaggagaaggcacccggcaagtacgagaagaaggtgtacgttttgcctaagcaccttgatgagaaggtggctgctcttcaccttggaaagcttggggctaacctcaccaagctcaccaaggatcaggctgactacattagcgtcccattgagggtccttacagcctcctactacaggtactgaggagagaataccanagagagagagggacagagtttggactagaaaaagg

SEQ ID NO: 6611 - DNA, 480 bp, Gossypium hirsutum
  Clone ID: uC-gsronu33B040b05b1
cctgcatggctaccgtgtccggaattgaccgattcgatcccacgtcttccgccctctcgtccgcgtagctggtgaacatcctggaaagacatttgaaggtgaaagccaaaaggaatatcgtagatatgcctggaaacggtgacgttccattcactcatgcaaatatcagtttggcccaaagagaattcgggtacaagcccacaaccgatttgcaaaccgggttgaagaagtttgttagatggtatttatcttattatggttataacaaccgtaaaggtctacaataaaatttatttttggttttaaatgtaaggattttcttggtttcccgttagaatgaaatagaaggtaatgggaaaaaccggaggaaccgcaagttaaaaacaagagaaagatgaggattacgtattctttttttgggggagcagtgaaaaaaacacctaagcccggtatttctttgcagttctttttatttttttc

SEQ ID NO: 6612 - DNA, 110 bp, Gossypium hirsutum
  Clone ID: uC-gsronu33B040b06b1
aggcaccgtgtccggaatcgaccttttcgacccactcttccgaactggcctctgtaatgatttattttcaaggatgtttgcctgcaaggcctatgaccataattacccct

SEQ ID NO: 6613 - DNA, 465 bp, Gossypium hirsutum
  Clone ID: uC-gsronu33B040b11b1
caggcaccagttccggaatcgacctacgcgtccggtgttaaagaactactatattacttcagtagctggggcaaatatcgggagttccttggttgttatgtcgaaagggactccttacacccagcaatcctacaaggtgagcgaatcttttccgttcaagtggataaataagaagtggaaagaaggcttttatgtaacatcgatgacaactgctgggactcgctggggtgtggtaatgtcaaggaacgctggattctctgatcaggttgtggagctcgacttcttatatccaagtgaaggaatacaccggcgatggagtagcggttacagaataacatcaatggctgcaactgtggatcaagctgccttcatacttagcatttcaaaacgaaaaacaacagatgatacttatgaaacgctccgtacaactgccttccccagcacccatgtaaaggaaaaatgggc

SEQ ID NO: 6614 - DNA, 128 bp, Gossypium hirsutum
  Clone ID: uC-gsronu33B040b12b1
gaatgaagcagttatttgggatattgagatgcgaggcgaggtttacagtccaagaactgagcactatatcagatagaatcgcgacggatggtgattgttggggctcgaaacccattgaaccaaagggt

SEQ ID NO: 6615 - DNA, 118 bp, Gossypium hirsutum
  Clone ID: uC-gsronu33B040c03b1
ttttccggcctcggactcattcgtaggacaactaatggacaatgagcacgaaaagcagtacaagttctccgatgttgaaccagtggaaaatgaagctttagatcacaaagaagagatg

SEQ ID NO: 6616 - DNA, 670 bp, Gossypium hirsutum
  Clone ID: uC-gsronu33B040c05b1
ccctctcgtccggtcagcggcggagatgagccaagtggaggagacgatgagttacgtttacaagaacccaaatgcgcctatagaagatcgaatcaaagaccttgtttctcggatgaccctgcaagaaaaggtcggtcaaatgacccaaatcgagctctgtgttgctactcttgacgatgtcagaaacctctccatcgggagtatggtcagcggtggagggaaagagcctttagagaaagcaatggcatccgattgggccgaaacgattgacaggttttagcaggcagcattttgtttcaggcttggaataccgcttgcctttgggatcgatgcggtttcatggaacaaccggttttattgttccatttttttccttacaattttgttcttgaatcacaagttttgatattttgtttaatgtatagtgtttcagtttcttttgtttatgactttttgctttacttaaattttgtttctagtctataaagctaaatttttttttcttattatttttaaaattatctttttctctttttttctttttttatattttttttattttttaatttattaatatttttttttatttcttttttttatcttctttttttttattattttttttatattctcttttttttcttatatttttatgttttttcttttttcc

SEQ ID NO: 6617 - DNA, 302 bp, Gossypium hirsutum
  Clone ID: uC-gsronu33B040c06b1
atctgaatcatgggtgttgtgagttatgattttgaggtaacctccccaattgctccagccaggcttttcaaggcttttgttcttgaggctgccaagatttggcccacggctgcccctcatgcagtcaagagtgttgagctcgaaggtgatgctagtcctggaagtattgtaaagatcacctttgttgaaggccttccataccaatatatgaagcaccagattggaggacatgacgaaaacaatttttcatacagttacagtatgattgaaggtgggcctttaggggacaagcctgagaaaat

SEQ ID NO: 6618 - DNA, 433 bp, Gossypium hirsutum
  Clone ID: uC-gsronu33B040c09b1
ctgtctcgtgggtttaaaatgaagaaaccttccatggctttttaaagcttcggcacttacatagcaaaattcacatcaagaatgaataacatggaattggatcggtggaaaacgaaagttgtcgagtaatcgatcgtgtccgccgatatccgagatcttgaggtgcatacaaacacgggatcgtcagttaagtccatcacactattggatacttatcggattttaagctgaaattatctcgatactatggcatgtatagactagttggaaattgttactttggagagtatatttgattaaaagccatgtgaatatggcttaatatgcttgctctactcgaatttggattggattaaaggccatgcacattttggtgttggctcgacattataagcgtgtgtggtttattcgaactaggtatgaacttaatata

SEQ ID NO: 6619 - DNA, 474 bp, Gossypium hirsutum
  Clone ID: uC-gsronu33B040d01b1
cttttcgtccttccacgcgtccgggaagatatagaaatttcttctgataatggaaatgctgaaattggtgacgaccgacagcaattacgaccatctagttcaaaagtgcctgtaattgaaagctttgaatttgtatcacccaatttagataccgagacactcgtcacacatcaaaagcgtgacaaacaaagagcaaacaaggcacaacctctgaaggttgtttcatcagaaaagtcatcacttcaaccaagtaccagtgcaaagaatatgaatgtgaaccaagagagaaaaactgtagctgtaaaaatatctgaggaaggcgcaaagtcaaccaagcgacccttgctcccagtactgggtaccgagaaacgtaggagactacactggacagctgagaggaagatatgttgaagagttggtccataagttctatcgcaggtaaacaaaacatcccctgaggaaaattttgagcat

SEQ ID NO: 6620 - DNA, 78 bp, Gossypium hirsutum
  Clone ID: uC-gsronu33B040d04b1
taccggcgtatctgacttaaatggtatagctgtcatcaaattttaagtcatgcatctgacccgcataacgtggtggat

SEQ ID NO: 6621 - DNA, 287 bp, Gossypium hirsutum
  Clone ID: uC-gsronu33B040d08b1
ccctcgcgtccgtgtactttcactgaaccaacaaacctccccgtttctctttctctttctcctcccttaaaacatctctcactcagctctagattgagtgagaccttgccttagtggactttgtccacgcccgacactcgtacagattcccttgtatttcaccctttctcgtaaaagcaggtcagcctctcctcagctttctacacatattcaaaagtgtatgtgtatataaaaaaattaaatgcacataattattagtttatgtgatctcccgctcctttctggag

SEQ ID NO: 6622 - DNA, 261 bp, Gossypium hirsutum
  Clone ID: uC-gsronu33B040d09b1
ccctctcgtccgcccacgcgtccgacttaatatatgctgtatgatgcatgatactgatgtagtttcaagtatgtgagttgaagatgatgcatcattgtgtaagcatgccaggttatattttgttttagaatgtgatatattctcatgccgtgctcaaatgggttgctgcctgctaatggagctacaaatacatccttaggaaagtgagattggggaagatatttcctgcaaggcccaaatgggaaaatgctgtaatcttga

SEQ ID NO: 6623 - DNA, 60 bp, Gossypium hirsutum
  Clone ID: uC-gsronu33B040d11b1
cgatagatcaagtcacttggtgtcaaaatggttatgtccggttttttgcttcaacgagaa

SEQ ID NO: 6624 - DNA, 70 bp, Gossypium hirsutum
  unsure (1)..(70): unsure at all n locations
  Clone ID: uC-gsronu33B040e01b1
gcttaagcacgtgtgttctaggtgaaaggttcgagttttggnacnccaaccacaattcccacaaaaccaa

SEQ ID NO: 6625 - DNA, 411 bp, Gossypium hirsutum
  unsure (1)..(411): unsure at all n locations
  Clone ID: uC-gsronu33B040e02b1
attctccatcattacgatggtccaaaattccgccttgaactcaacatccctgaggcactttccctgttggatatatttgctgatcaacaagatacttgtatttcttaagcaacaagatgcttgagcaaaactaaaacactaggcatatcgatacaaatacagatacacacagagataatgaagagaagagtttgaagaataagtagagaaaaatagaaattatatttgtgaaagtacctttgttagatgtaaaactgtttttttcacaggctttgctgngattgtttttcttttcttttctttcttttttactgtttggcttatacataaataatacctgaaactaagtgataaacatcgacttattttgtgatgttacttaatataagccgagatatttgttaattttaa

SEQ ID NO: 6626 - DNA, 367 bp, Gossypium hirsutum
  Clone ID: uC-gsronu33B040e09b1
ccctcgcgtccgaaaaaaaaccctaatggatcttcatttcatcaccattttagctctcattatcttccttatcaccccaaacggcgtatatggtgcttcgttcacattcatcaaccggtgtgattacactgtatggcctggtatattagcaaatgcaggtactcctagtctgggaaccaccggattcgagctcccagaagactcttttcgttcattccaagctccgacgggttgatccggtcgtttttggagtcgaacggatatgtaaattcgaccgatccggctccggaacttgtctcaccgtcgattgcgaatgcggctcaagcaagaatgcaacggacttctgtgctgctccgggcgctgactc

SEQ ID NO: 6627 - DNA, 435 bp, Gossypium hirsutum
  Clone ID: uC-gsronu33B040f04b1
tctccggagtaagggtgtctggcactattgagccgcttacaagacgcattggttccgggcagggtttgcatggtgatcaatctagatacagatctgatgacgtgccgtcatccaaggatgtgcatcctgattctgaaaaggttcgctcctcctcaagatacgatagttctttaatgagtcctgtttaaacattaagccttctgtactactttgttttacttaattattattggtctttcttattatttttatgctttaatttattcttttaatatcatattttatttttctctatttattaattattatttttttattttttatttcttttttatattattttttttttatttatttttactatttattcttcttttttcttcctttcttttatatttttatcttttttatattacttttatatcataacttttt

SEQ ID NO: 6628 - DNA, 56 bp, Gossypium hirsutum
  Clone ID: uC-gsronu33B040f09b1
gctttgcttatcaacgcgagcacgcgacgtcaccactctccaatagtgacatctaa

SEQ ID NO: 6629 - DNA, 64 bp, Gossypium hirsutum
  Clone ID: uC-gsronu33B040f11b1
atttttcccgcctggtaatcgagcggaactatacgcgaaggactttttgatttaaacaccaaca

SEQ ID NO: 6630 - DNA, 537 bp, Gossypium hirsutum
  Clone ID: uC-gsronu33B040f12b1
cgctaacacccttccctgaaagccgtggtgttcgtccacagaaattccctgcagctggagcagcgccttatgttcccatcagacaattaaggacaccttgctgtggcattgctccaccagtgacaataagaactgcagtgcctgttttctctgcacctccgcgtccagcaccatctgcagtatctcctcagccaccgacatcagcggttcctactcatcccgctcaaccagcacaatctgttcttcctcctcatcaactgccagcgacactcccctctcaagtgctgcgagctcctccagtacgaattgcccaagcagtcaccattaggcaggtggttcctgtatttgctgctccaccggtacgggaagaagataaacaattccgttcctctcagaaatgaagatatcacaaccgctactgctgctcccccgcctaaccattcacctactcaagcagaggaagcagcatgcacaatattgaagaacctgcaagaatctgagacgatccaagagttagaacaactcaaatctgatggc

SEQ ID NO: 6631 - DNA, 353 bp, Gossypium hirsutum
  Clone ID: uC-gsronu33B040g03b1
agatattgatgctagctctgttgtgtatttcattaggggcactcaagaaattatggggctaaatctgctgtcagctgacaaatttccccaattattccaatggtctgaagatttcgcaaattgcagcattgttaaggaaagtttacctccaagagacaaactacttccctttgtcaaaggtctcattgccaaatatcagcaagataatgctaaggcctaagccctcccaatgaacgcctgtcacaatgattgtcgcatgcaatttgccttttttgtatttgctgcttttgtgtgtaatgagctacttgctcttaattttcgagtgaaaaaattaatatactctttgtacccct

SEQ ID NO: 6632 - DNA, 355 bp, Gossypium hirsutum
  Clone ID: uC-gsronu33B040g07b1
gcgtcgtcaagatgcagatcttcgtcaaaaccctaacggggaaaaccataacccttgaggtcgagtcttctgacaccatcgacaatgtcaaagccaagatccaagacaaggaaggcatccctcccgatcaacaacgccttatcttcgccgggaagcagcttgaagacggccgcaccttagccgactacaatatccagaaggaatccactcttcacctcgtcctccgcctccgaggtggtgccaagaagaggaagaagaagacctacaccaagcccaagaagatcaagcacaagaagaagaaggtcaagctcgccgtgctccagttttacaaggtggacgagtcgggtaaggtcca

SEQ ID NO: 6633 - DNA, 189 bp, Gossypium hirsutum
  unsure (1)..(189): unsure at all n locations
  Clone ID: uC-gsronu33B040g09b1
cgacccacgctcnccggactaataacaagaatcctgctgattacagacctgtcataactcatcaggctctactggcgattctagatagtccagtcaataaagctgggagattgcaagctgagtatgttagaactgggaaaggtgtactttttgaagttaaacctcatgttagaaattgcggtccatata

SEQ ID NO: 6634 - DNA, 313 bp, Gossypium hirsutum
  Clone ID: uC-gsronu33B040h01b1
cccttgcgtccttccacgcgtccgtcgaaactgaactgtgactcattcattccaaagctgaggaataggtgcaggaatcttgggatgacaatggacaaccccatcttatatgaaccggctcgaatgcaaatattttctgatgggaatgcacttcttcaactgcttgaaaatgttacttgtcgagtacatgaacttggtagaggaaatttacaatttctactttgtgtaatggtcggggaaggatgatggctacaaatgtcttaagtggatctctgagacaaaaattggtggtggggactcagtgttgcttgtc

SEQ ID NO: 6635 - DNA, 486 bp, Gossypium hirsutum
  Clone ID: uC-gsronu33B040h02b1
gaggcgccagttccgggttcgaccttcgcgtccgcgttttcgttctcccacgcgtgcgattataacaacttgcactttttatactcaaactccattccgttcctgaatatccatccgggttctgcatttcttgtcttctgctttccttctcataatttcaccatgtctgtcattggagaggctgctttgtctgtgtttctggagctgtaggggggcaagttgctcgactctgcactcaactttgttgctgatcataagtaactccacccgcagctcaagcagtggaagtccatattgcccgatgtccaagcaatgttggatgatgcagaggagaagcagatcaagaacgaaagcgtgaagaaacggttggaggatctacaggacttggcttacgatgtggatgacatcttggatgagttcgcttatgaagagttacgcaacaagctcaagaaattgcaagttcatgccagcactagcaaggcattg

SEQ ID NO: 6636 - DNA, 363 bp, Gossypium hirsutum
  Clone ID: uC-gsronu33B040h04b1
cagaaaccccacgacggtttacgatttcaatgtacaagccgacaagcacgcgagccccattaaaaatccagttacggaaggtcaaaatcttcttcagccgaaaacccaacagcaacaggacgagttcttccagggacaaggcctttcctttatcaaagaggccaacatacccgctaataaccagattttaccacaaggggaagctcacatcgaccagatgcagaccccgaattccccattccggaccacccacaacaacaacaacaacgggctcaaactgatggtcggctctccaatcgattagtcataattcgaatacaaagaagaaccccaagccggagggaaaggccgccatgccaaaac

SEQ ID NO: 6637 - DNA, 285 bp, Gossypium hirsutum
  unsure (1)..(285): unsure at all n locations
  Clone ID: uC-gsronu33B040h06b1
ggatgatgttgaagctttgctcttgcaatgtgactttccaatttcaggcatcggttcaatgccgattccccgcttcacccggtcctttcgcatttcggcggcggagcccggtctctgtctcttgttccccgctgagtagactcaagttgacgccggttcaagccgtgctgtcaagccagcaaaaagaagttgccaaggttggtaaatctgggtcggggagtttggccgacctgctccgcttgggtagcttggcggaagatgngttgtcttataacgaaaagtata

SEQ ID NO: 6638 - DNA, 473 bp, Gossypium hirsutum
  Clone ID: uC-gsronu33B041a03b1
taatctactacggccataacgcaaagaacgcaacatcagccattgtaggttcaccacaatgggggaacaagaccattttaacaggaaaaaaccatttcggagacctggtcgtgttcgacgaccccattaccttagacaacaacttgcattcgaaaccagtgggtcgagcccaagggttttatatctacgacaagaaagacatattcacagcttggttgggtttctccttcgttttcaattctacccaaaataaaggaagtataaacttcgccggtgctgatccgttgatgaaccagacgagggatttatcatgcgattggtggaacagggtgatttcttaatggctcgaggagcggctatgttgatgactgatgcctttgagggggaagtatattttcgtcttcgaactgatattaatttgtatgaatgtcgggaaaccattgaaattttaattttcgatttgaaactttttt

SEQ ID NO: 6639 - DNA, 107 bp, Gossypium hirsutum
  Clone ID: uC-gsronu33B041a04b1
ctttttctcttctgaaaccctaaaccgccgccgccgtccgtctatcgccgactaaaatggctttcgagggagtagttctaatttttttacaaatcttatcctaaatt

SEQ ID NO: 6640 - DNA, 454 bp, Gossypium hirsutum
  Clone ID: uC-gsronu33B041a10b1
aatcatgccttggaatgatgcaaaggcatgagtctcccttttggcattggcgcattgcttttcaactatttcatatcaatccttctttgattctgctaccaccatttaggtcatgcatgtgcctggaaaatagcctttcgttgcgataaggtgggctcggttgggtttcagccccatgacatctggtttctgctaacatggaaagcacctgttttgtgtctttaaggcccaaatatttgtttattgcattcacagcgaaggaagggaaccacttctatatttctcctatgatacagagagacactactgggttgactactgaaaacaaggaactgaaactacggctacaggctatggagcaacaagcgcagcttagggatgcctttggatgaaaaatcgaaggaagaagtgcaacggcttatgaaacaagctggtcaaggggtctgcattgaat

SEQ ID NO: 6641 - DNA, 97 bp, Gossypium hirsutum
  Clone ID: uC-gsronu33B041a12b1
atatatgctggaacatctttgtcatcaaattttgaagatttagaacctcctgctccctgccccacacgtcctatctcctcctccattccctcccctt

SEQ ID NO: 6642 - DNA, 100 bp, Gossypium hirsutum
  Clone ID: uC-gsronu33B041b01b1
cggtctcttgtggtgaaaatgccaaaaccttctctgggggggttaagttgacgatcttgcatcacccacctaattttaagaatgatgaataccggaattg

SEQ ID NO: 6643 - DNA, 258 bp, Gossypium hirsutum
  Clone ID: uC-gsronu33B041b03b1
acccgaacttgttctgtctttcaaaaccagcaaccggacgaccccaatgcataaaacccacagtttttccctacccaaacccgaaaacactcccctctataaaacacactccaatccacattagacactcaaaaattccatcttcaatttctcaaggttgtttttcttttatcaactgttccaatccaaactcacagattcaatggccgaggatgacgttgcatctaaggaacgcccacccctgtagatcatccatgc

SEQ ID NO: 6644 - DNA, 184 bp, Gossypium hirsutum
  Clone ID: uC-gsronu33B041b09b1
ttcctctcgtccgcccacgcgtccgatttcttctgtgggttgtgtaagaattaataacctaaaaattattaataatgtttttgattagttatgcatgtgatttcttttcttgttaatgttatattgtaagaaaagattctgtgcatgtatatttaatttaatgatcggttttgatgaattttat

SEQ ID NO: 6645 - DNA, 327 bp, Gossypium hirsutum
  Clone ID: uC-gsronu33B041c02b1
atttttattggtctccgaggtgactcagttgttcttatggggaagaatactatgatgaaaaggtcggttaggatgcatgctgagaagaccgggaaccaagcttttcttaaccttatccccttgcttcagggtaatgtgggtttgatctttactaagggtgacttgaaggaagtaatgtgagttttatcatcgagtttctatctcatttacattatcaactaaaccttttaatggccgtctcatgatttaactcctatctactactatgatccttttttttcccccaaatattttttttagctatttcgtgccatttccattattttc

SEQ ID NO: 6646 - DNA, 345 bp, Gossypium hirsutum
  Clone ID: uC-gsronu33B041c03b1
ccctcgcgtccgatccactgctgttttctttccctaaagaaatcccattgtttttatttagagattccttgtacaacttttcttgtttctcaaagaaggtccaagttgagtcagagaggatgttggagatgtgcacaaggccgttagagatgtgctttggaggaggtggaggtggaggcgatgagctcttatggcatatggatttgaagccctacgtttctggggactattccatagcagctgttcaagccaattcctctttggaagactcaggtctgggtgtttactttcccttccgtcacttacgttctgtctctacgtccggccatggttggacctgaggct

SEQ ID NO: 6647 - DNA, 792 bp, Gossypium hirsutum
  Clone ID: uC-gsronu33B041c04b1
ttgtgtgtttgcactttctttgttttccttccctcttttcttctcatagaaaaaaaggaaccatttcattctctggtttttcttgattttctgtttggctttctttcatttttttttttttttgataaacttattatatttgcaatcggtttttgagttatctggataatggcatgtcttttctttcctttcttttttgattccatctacttctatttcttatctcttattctatactttacttatctctcttatttttatttaatttttctcctttctttattttttcttttttctaatctatttttttctttttcttttcttttttttatttctccctctcttatatttttttctccatttttcttcctttttatttttctatatttttttttatattttttctcttcctatatatatcttcttttttttttctattatttttatcttacatttttttttcaccttctttatcttttttttattacttattctttctttttctatctttttacattcttatctttctcactcttttattctttattcttataatttctacctttttcttatattttttttatcctctttctctgtatgaattctctttttatttcttttttcctttttacttcttcattatatttccctatatttctttttctttcttttacttactcactctttatcctttttcttttactttttttcatctaatttttcccattttatcctctttctttcctttctctaccttcttctctttatattctctctcttttttatctattt

SEQ ID NO: 6648 - DNA, 65 bp, Gossypium hirsutum
  Clone ID: uC-gsronu33B041c07b1
ttcctcgcgtccgttttattcaattcgacgggataaagaaattttgaccatggattctgcaaaca

SEQ ID NO: 6649 - DNA, 93 bp, Gossypium hirsutum
  Clone ID: uC-gsronu33B041c08b1
tctttttttctactctgaacaaccaaggcaatttggctcctatttatcccaaatcagatcttaaggtctctccctataattacttgttctcct

SEQ ID NO: 6650 - DNA, 156 bp, Gossypium hirsutum
  Clone ID: uC-gsronu33B041c09b1
tggtttcgtgggataaaaaaaataaaaaataaaaaataaatataaaaaaaaaaaaaaaaaaaaataaaaaaaaatatttaaataaaataaaatttatatacttattctcttttatatttttttttttctctttttttctctatttttatcttctta

SEQ ID NO: 6651 - DNA, 428 bp, Gossypium hirsutum
  Clone ID: uC-gsronu33B041c11b1
tttcatgcgtccgcccacgcgtccgagcaggtcgtcaccttcagcaactgcctccgatgccaacattgcctacaaccacactcccaccatttcccattctatcccctaatctcccacagccatccataccatctttcccaaggcccggtgcactttctccatttcctaccatgcctgggttgcccacattgccaagtgtaccaagggccacactgtctcctctgccaagcatacccttattccccacaatccaacctacaattccctctattcctttcctttctccaccaccttctccttttaccccttaaaaatcccttttggcttatgggacccagtccagagtcgggacatgctacctagtgttctcatttcattcagggttgaaagtgttagttacagactctagtttttaatcagcatatatt

SEQ ID NO: 6652 - DNA, 381 bp, Gossypium hirsutum
  Clone ID: uC-gsronu33B041d03b1
ccctcgcttccggactgactaagatttcaactgtctctcactctcctgttttgctgcctttaccaagagagaatgaaaccaaaatttctgtttctcttccttgtattatgcagtctcactatagacaacgttttagcaacctcacttggaactcatggcaaaattcccgacaatgaaacaatataccgagtctccaagcaacggtgttggggttgtattggagagtcactagagttcctattcactcacaatttggtgagggcaaccaaatgggagccactcttgttttgggattcccagcttgagaaatatgcccgatggtgggcacttcaaaggaaagcagactgcatgctaccgcattcgtttccagagggtgatttc

SEQ ID NO: 6653 - DNA, 304 bp, Gossypium hirsutum
  Clone ID: uC-gsronu33B041d05b1
ccctcgcttccgcccgtctccacaggcatggctaccaagcagccaaatactggcctctttgtaggactgaacaagggccatgttgtaaccaagaaggagttggcaccacgcccctctaatcggaaaggaaaaacgagcaaaagagtccatttcgtgaggaacttgatcagggaagctgctggttttgcaccgtatgagaagaggatcaccgagcttttgaaggtcggtaaggacaagcgagctctcaaggtagctaaaagaaagttgggaactcacaaaagggcaaagaagaagcgtgaagaga

SEQ ID NO: 6654 - DNA, 94 bp, Gossypium hirsutum
  Clone ID: uC-gsronu33B041d08b1
tcctctgcgtccgaataacaaaaataaaaataggagatattatataaaaaaaaaaagataattaactctaaacaattaatggctttccactccc

SEQ ID NO: 6655 - DNA, 416 bp, Gossypium hirsutum
  Clone ID: uC-gsronu33B041d09b1
cgctttaccatcaagcctcaaaccgataggtgggtcttccctgaaaccaacaccggcatcattgtgttggctgaaggacgtctcatgaacttgggttgtgctactggccaccctagctttgtcatgtcatgctctttcaccaaccaggtgatcgcccagctcgagctgtggaaggagaaggcaaccggcaagtacgagaagaaggtgtacgttttgcctaagcaccttgatgagaaggtggctgctcttcaccttggaaagcttggggctaacctcaccaagctcaccaaggatcaggctgactacattagcgtccccattgagggtccttacaagcctcctcactacagggactgaggagagaataccagagagagagagggagagagttgcaccttaataaggatccatacaac

SEQ ID NO: 6656 - DNA, 95 bp, Gossypium hirsutum
  Clone ID: uC-gsronu33B041d12b1
tttctgttaaaattcctgaaccgggacgcggcggctgacggctacgttagggagtccggagacgtcttctgttgccttgttatgagttatctttt

SEQ ID NO: 6657 - DNA, 526 bp, Gossypium hirsutum
  Clone ID: uC-gsronu33B041e03b1
gctctatcccttaacctttcatatgtttctcgtatctcttcatctcattcccaaacccttggaacttccttatcagtttcaaattcatccttttcactctcagcagcttcttctccttcaatcccctatgtgtactgtggcagaggggataagaaaacagagagagggaagcggttcaatcactcttttggcaatgcaaggcctagggacaagaagaaggggagagggccaccaagggtgccagttccaccatcaccaccgagaaaagataagtttgatgatgatgagaagataaaaattgaaattgatgaatccctttttactagttaatgcttaatttctttaatttttctattggaatggcttaaattgagacaacttgctgtgtatgctgcaatttgctgttgttaacattactcttttaatttgagttattcttctctgctgatgagtttttttggggctcattttatggcaactaaagaaatgtagatatgtgtattgagaagcaagattggagcaatgg

SEQ ID NO: 6658 - DNA, 549 bp, Gossypium hirsutum
  unsure (1)..(549): unsure at all n locations
  Clone ID: uC-gsronu33B041e05b1
tgtttccttgaaccccataagagaaaaaaaacctagacatcctaaaacatacatttgcatatattattgttgtctttgtcattgtttttccaagaaagcacaatgaatgtagacgaggaggtggagagactcaaggaagaaattcaaagactaggccagatccaatcagatggttcttacaaggtcacatttggggtgctatttaatgatgatcgctgtgcaaacatctttgaagcactagttgggacactaagagcagcaaagaaacgaaaagttgttgcatatgatggtgaactactactgcaaggagttcatgacaatgtggaaatcattctcaaagctacaacaccagcagcagcagctcagagtagcaactaatgcagntctaaataaataattgcaattatagttctgcagcaaaagcttgatgatattctatgtaatttttcaatgcttatcatgtttgaaagcttgcttcagcataagtgcataacagtatttttggatactctattatgaaattttccagagtgtactacacccagattt

SEQ ID NO: 6659 - DNA, 775 bp, Gossypium hirsutum
  Clone ID: uC-gsronu33B041e08b1
cttactaaaaattaaaaaaaaataagtaatatttaatttaaatataaataataaaaaaccttatagggcggccgcttttgtggtcccttgctttcttccccttttcttggcgccccttttctgttttcttgggtccccttccttcagttccctggccgtggttttccatcggggtgcctggttttcccttggcgggcccccttttttcccccttgcgccgggttcccccttggcttgctttcctcttttccccttggcctcttccccttttttccctttcttctgttttctccgccttggttctcgttggttccccttttccctacttttggcttactctcttgttttttggttcccccccgctttttattgggaccccctgggttggttttccggtctctctctcttcttatccttcccccttttttctctccctttttctccctgcttttgggttttttggggtttctttttttcctccttatttattttgtccttcgttatgacttttcccttttctcttgttttttcctttttctctgggtgggcattatcccctttctttccttttattttttccctccctctttccttctcttcttctctcttttttttttctttcctttccctttttttttctttcttttccctccttttttctcctctctccccctctttcttctctttttccttccttcttcttttattttcttttccttttctttctttttttttctttcttcttttctttttttatcttcccccctctcttctt

SEQ ID NO: 6660 - DNA, 653 bp, Gossypium hirsutum
  Clone ID: uC-gsronu33B041e11b1
tttataaagtttaccctgaaaacaaggtgccgtccttggaacataatggcaaagtcattggggagagtcttgatttgattaaatatgttgatagcaacttcgaagggccgtctcttctacctgatgatgctgtcaaaaaggagtactttaagacgttgttatctcacatggactaatttccagggatggtgcatgcctcattttaaaggagccttatttaaggatgctgttgctttcttttgatcttttgtaaactgctcttgcctatttattgtttgtcctttttctttattcatcttgttatctctgttttgatattgcttttttcccttattctctgattcctgatattttttctttttctattttttttttctctatttttttctttatcttatttttttttttactttatctttttatttagtcttttttattttttttttaccattcttacccttttttctttattattttcatttttttttctttactccacatcctatttttttttttttctgtttttattcctcctcttcttatttctctttaattcctttttctatttatctttctcttcttttatcaacttttctttctcttattatttttatttcttccttttttatttttttcctttcctcttctttttt

SEQ ID NO: 6661 - DNA, 525 bp, Gossypium hirsutum
  Clone ID: uC-gsronu33B041e12b1
gtgttggaaaagcagagtgagtgaagaagatggagaccaaacccacagagattgggagttcaaagatgtttggagggtacaacaaaagatacaagcatttcagtcccaccctcggctgttccatgactttccatatctacttccctccttcttcttctccttcccacaagttccctatactttactggctctctgggcttacttgcactgatgagaatttcataatcaagtcaggagcacaacgtgctgcttctgctgagggtgttgctctaattgctcctgatacatctccaagaggcctgaatgtggaaggagaggctgacagctgggattttggtgtaggtgctggattttatcttaatgctacacaacagatgtggaagaactggcgtatgtacgattatgttgtgaaagaactgccaaaacttctgagtgaaaattttcctcaacttgatacatcaaaagcatctatttttggtcattctatgggtggacatggtgctctcacaatttatctgaaaacct

SEQ ID NO: 6662 - DNA, 589 bp, Gossypium hirsutum
  Clone ID: uC-gsronu33B041f03b1
gcagcatctcttttatactctttgtaatttacttcaaaaaaatgccactctctaaaccagacaagaacaacgtcgtcatcgacatcaacgacgagagcagcaacaattgtggtgaagataaccaagatgagcaagacaagttagatgccatcactagccatctttacattaagccaagccattcgaagcaaacattggataaagatatggttttgagaaggattcgtcaccgtaaacgtatgaataatttcaggtccgcatttcaatctttcattggctcttcttcttcttcatcatcatcgacgaaaatgaccaagaatggcaaaggttctagcaatgaactaaagtgggtcgatgatgcttttgcagctctttgattggaatatatttttttttggatagctgctgatgttttagtgcactgtttaagcactcgtgtacgttgggtagaatatgggcctttaatacccaatatgatatggggtttaaaagcaaagaatatttcactttttaagccttttaatgctacgatacatattagattctaacttatatgggcatttgatacacatttacactattgtgtgga

SEQ ID NO: 6663 - DNA, 559 bp, Gossypium hirsutum
  Clone ID: uC-gsronu33B041f04b1
atcttttctcttttccccattcagaaaaatccaatatacccaccaatgaatatgcaagagcagtataaatccttgatcagcaacccataaggtttctattctgtttttgtttctcatcaatcaatcaaccatgacaggcaatgccaagcccaagatgcacactgccaaggaaatcgcagccaagatcgatgccgccactaccaaccgaggcggtggcaaggctggattagctgaccgttctggggtggagaagggtggacatgccatgttcgaatgtcctcactgcataacatctgctccagatttgaagactatgcagattcatcatgatgccaagcatcccatgcttgcttttgaagaatcaaagcttgtgaatttttattctacttatggtgccgattcttccatgcctcgtcccggagttaggggttagttaaaaaagtgatattaataaattaatttagccgtttttcttatgatttggtgctttgcggttgtttttgaatcggggtttggtttcttacctatagttctagcaggtttgggtaaaaaagatgat

SEQ ID NO: 6664 - DNA, 533 bp, Gossypium hirsutum
  Clone ID: uC-gsronu33B041f07b1
tttctttcgtccgcccacgcgtccggcattttagaggagctgacttgtcattgccggcgaccaactatttgatcccggtagatagcagcgggactttttgctttgctttcgcgggtacaatgaacgggttgtccatcattggaaatatccagcaacaaggtttccgggttgcatatgatttagcgggttctcgtgtcgggttttctccccgtggatgcgcctaaaaatggtggtgcttttaattcttatattaagggacaaagctttatccctatctctattttattttccttggatatttttgggtgagggttagaaaggaagaaacataatgttttcatagataagaatgcaagggaaagttggtgatcacgaaaggcgggttgctggttagaggtagagaatggcgttcggggggttttcagtttttcacgtgttgtccgttgtacttttaaacaaaagaatgggctggtcaaaaaggattatattctaattttaactaataaaaatatattataattgattaaggatct

SEQ ID NO: 6665 - DNA, 560 bp, Gossypium hirsutum
  Clone ID: uC-gsronu33B041f09b1
tcactataggttaagctgctacgcctgccggtacccggaccgtacttcctcgacccacccacgcgtccttattcactgtcactgatgaagaaaaacggtccaagttcttgagatggaggattcagtccctggaaaagagcatccgaaaactcgacttcaatcctactggtatcaataccatggttcaagtgaacgacctgaagaattcacctggacctggtaaaaaggaactcagacaagctaccaaccaagcccttaacttgcttcaagataactatcccgaatttgtggccaaacaagtgttcatcaacgttccatggtggtacttggctttcaataggatgatcagtcctttcctgactcagagaaccaagagcatgttcgtatttgcaagtccagccaaatctgctgagaccctcttcaaatatattgctccggagcaagtaccagttcaatatgtttggactgagcatagagggtgaacaggaatttagcgtggccgaaaaagctcattgtttcaattatcccagcttaaatccttgtgttgaatcccctataac

SEQ ID NO: 6666 - DNA, 524 bp, Gossypium hirsutum
  Clone ID: uC-gsronu33B041f11b1
tttcttgctttgttctcttatcaattactgtcccctctcttgtttctcttcatttcatttgtttaagaatgtcttttatggcggctgctaaggtttttgcgtgtcctttcgtccttgttgccctcttcagcatggttgcttctgatcctgatcttctccaagatctctgcgtagctaataaagctgctgggataaaggttaatggatttccatgcaaggacgaagccaatgttaccgaagctgattttttctatagcggattagccaatccaggagtcatcaacaactcggttggatcagtggcaacaggagccaatgtcgagaaaatctcagggctcaacaccctcggcgtctcgcttgctcggatcgactatgcaccaggtggccttaaccctcctcacactcacccacgagccaccgagatcatcttcgttctcgacggtgaattaagacgtggggttcatcactacatcaaacatgttgatctccatatcggtcaagaaaggcgacattttcgtgttccc

SEQ ID NO: 6667 - DNA, 403 bp, Gossypium hirsutum
  Clone ID: uC-gsronu33B041g01b1
tttttctcttctagtttccttttaatttcaacaatggaatctacagataaaccggcggcggtagcggcgacgacaaccacaccaccatcaacgacggttgctgctagcatatgcccttttaattattcagctgtagatgttggtcttagggtggtattgtttgctgcagctgtaattgctgtggtggttatggctactagcaagcaaactgaaatggttcctgctccaggcttgcctacttcagctagggttccttatttggccgagttcactgatttacctgcctttgtatacgttatggtagcactgtcaacatcaggcttatacaggattattactgctcttgatcatcctttgctcggctgcattcctttttattcaaaaccttttggcttgtctttgc

SEQ ID NO: 6668 - DNA, 504 bp, Gossypium hirsutum
  Clone ID: uC-gsronu33B041g06b1
gggtttatcttccattttctttgcgttttgttgaaatgaatggtgaaataaaagtttattctccgctcaacaaaatattcgatctcttacgccttttaacggaactacatggcgacccaatctgtgaaagtgggaaacgcttccttgggtgcatgtgatagagatctcaaggagtccttttgcttctccggtgaaattgcatatgctgaaatgaatggggactatgagcaatctcaagttgcatatattactttcaaggactcaaagggggcagagactggtgctcttctttcgggggcaacatttgttgatcagtctgttaccatagaattagctcctgattacatgccacgcggctgtgcaacacttgcatcagagaacaaaggctctgccaatgctgaatctgctgtccagaaagcacaagatgtgggtgagtgacatgcttgccaaggatttattcttggcaaagatgcattgaacaaagcaagacctttgatgagaagc

SEQ ID NO: 6669 - DNA, 448 bp, Gossypium hirsutum
  unsure (1)..(448): unsure at all n locations
  Clone ID: uC-gsronu33B041g08b1
tccctctcgtccggaagaggatactgaggaaaggcgcagtgaggaagctgggagatgatttcgagagagtggctaaggataaggatagcggcgttgcgagtggaggaaagaggggttttagtgatgggatcggcattgacgtgatgaagattgtggaagaggttaatgttgagtcagaggagataaagaagaagaaaaagaggattgtaaagggtttgaagaagggtacagatgaggtgcagagtggaacagggacaacgacaagggcctcccctagactggccaaacgagggtgctaggtctttgtaggatggatgtaggatttttaatgctgggtattggtcgaaatttacagtgaatacagcttaatgatgcttttgttcgtacttaaaaaaaaaaaaaaaaaaaanctttattttttttctcttttttttttccttcctattaa

SEQ ID NO: 6670 - DNA, 195 bp, Gossypium hirsutum
  Clone ID: uC-gsronu33B041h02b1
ctgaattcccgacccaacccacccgtgtgtaatatgaatggcaatgcgtattctcatccgaatgtcactgttctacatagcattctcacgtactgttcaccgtgccttttctgtgatgaaataaatgatgccatggtgatcgtttcgaccagttagagcatggatatgataccaagtaagcagtttaatttcgta

SEQ ID NO: 6671 - DNA, 309 bp, Gossypium hirsutum
  Clone ID: uC-gsronu33B041h07b1
tgtcttttcgtccggcttgtgctgctctaaatggaattataatgggtgataaaactctcaccattaggcgagcaaaccagggtgctacccagcctaaacctgagcaagagagtgtactccagcacgcacaacagcagattgctttgcagaggcttattttgcaaccacaaggggtgcctacgaaagttgtttgcttgactcaagcacttaatgtggatgatctcagggatggtgaggagcatgttgaccttgtttgttgtcattgtggcaatgcgtgtttttaatttttgtttattttgctaaattttt

SEQ ID NO: 6672 - DNA, 350 bp, Gossypium hirsutum
  Clone ID: uC-gsronu33B041h08b1
tttattaagatggtcaatgcatattctcatccgaaaatgttggtgtccaagtcattgactctgtcaacattaccttgggttctgaagatgaattaaagcatgcagttgccatggttcgaccagttagcgtggcatttgaagttgtcccaagtttcaatttttacaaaagcggggtttacttccagtgacaaatgtggcaacacttcctcggatgtagaaccacgctgttcttgcatgtggatatggacattagatcaagtttctggtattggctcattaaaaactcagttctaatcgatctgcagcactcagttctatgttcatgttgtatatgggcattttaaggatgc

SEQ ID NO: 6673 - DNA, 310 bp, Gossypium hirsutum
  Clone ID: uC-gsronu33B041h10b1
gagaagtggtgggaagggtttagatttataagaaatttttacacacacaaagactatatggattttgaagctaataggcttttgtcaaatttttattataatgattaaatcacattattatagaattcatttaaaaaaaaaaaaaaaaaaaaaaaaaaaaaaaaaaaaaaaaaaaaaaaaaaaaaaaaaaaaaaaaaaaaataaaaattaataacactaaaaatgctataaattaaaatatctataaattaaaataaattcattttaatttaatatcgtttaataacttttttaattttttttggggggg

SEQ ID NO: 6674 - DNA, 185 bp, Gossypium hirsutum
  Clone ID: uC-gsronu33B042a02b1
gcctttgtcctaaatgtttttgattcttttgtgaattaccttatatctatagcagtgtcaggtctataaaatattcattgttatggtaatgtttcattgttgaatttatatatatgcacatttcatacttttgtcaatattattcttatgttgaaccgtactattgttttcttcatctgcatatt

SEQ ID NO: 6675 - DNA, 214 bp, Gossypium hirsutum
  Clone ID: uC-gsronu33B042a03b1
gaattatcttgtactattactgaaactgagcctcagaagtttgctcttccagtggattccgaacataaggcgactgagtttcatttgttctcggcggctgcaccgtatatgctaagcgtttcaccttctcctggttctcatttctttttttgctcctgttcccacttatgcttgtttcactcttccttctttttcctctttttctttttatttc

SEQ ID NO: 6676 - DNA, 486 bp, Gossypium hirsutum
  Clone ID: uC-gsronu33B042a04b1
atctggaacgtgagttacaggcgatcaaatacctctcggctgcaggatttggtgccaagttgcttggtgtatttggaaatgggatggtacaatcttttatatatgcacgtaccttaactccagcagatatgagaaagccaaagctggtttctgaaatcgcgaagcaacttcgaagattccatcaagtggaaattccaggttctaaagaacctcagctatgggttgacatcttcaagttctttgagaaagcatctactctccagtttgaagatactgataaacaaaggacatatgagttaatttcgttcaaggaagtgcataaggaagttaaagagctgaaggaactgacaacccttctcaattcttcagtggtgtttgcttacaatgatttgctttctgggaatttgatgcataatgatgaacaagaaaagctctacttgatagactttgagtatgggtcttacaatttcagaggcttttacattt

SEQ ID NO: 6677 - DNA, 541 bp, Gossypium hirsutum
  Clone ID: uC-gsronu33B042a06b1
atttacactgtttctacttcaagtgtatgcatccattgacattgtccatttgtttaagctggcttaactataagctgtccacttgtatgagtgatcattctgctgttgattttgagcttcaattttgttaaagatgatatgttttttgatttagttttattttttttactttattattttctgtctttatttatttttttactatttttttaaatttttatagttttattttcttgttctttttttttattttatattttttttcttcattattttattattttttattatttttttttcatttatttgatatatacttcttttattttttatacattttttctactagtcttatctgtctattatttgatcttttttatatattcttttttttttttttttattatcttatctattttttttttttgtctttttatttttttttatcttatttcctattaattttatttttttttttttatgttatctatatctattttgctatttttattttattatatattttttcttttttctattt

SEQ ID NO: 6678 - DNA, 687 bp, Gossypium hirsutum
  Clone ID: uC-gsronu33B042a08b1
tgtttctcaagaaccctaggagaccctcactttattacgtcaatttgattggaattagggttggaagaaggattgttgatatcccaccaagtgccattgctttcaatccttccactggtgctggcaccattattgattctggtactgtcttcacccggctagttgaaccagcctatgtagctgtccgtgacgcattccgtagactagtatgggtggcgaacgtgacatctctggttgggtttcgaccacatgtttcttggtccctatcaatgcttcctccctttcatttttttttttgttcctgtaactctacttcgcccctagtgaacccttctgctccttagccctatatgttttttctctgttttctttatttcctgttccctatttcttattatactctaatttttcttctttcttctcacttttttttttttttcttcttctcattttattcttttttttttcctttcatctattttctctccttttttatatctcttccttctatattttcttttattattctccattttatttcttcctttatttttttatttttatatctcctttctctctctttttttctcttttaatctttcctactatatttctttttttttctcattttctcttttctcttttttttttccctattcttttctccctattttattatccttctct

SEQ ID NO: 6679 - DNA, 82 bp, Gossypium hirsutum
  Clone ID: uC-gsronu33B042a09b1
ttcccagtgttcgatcccatcgcgtctcttcctcttcgtccgcaaatgctgtacctatggtatagggatagtgaatgattta

SEQ ID NO: 6680 - DNA, 834 bp, Gossypium hirsutum
  Clone ID: uC-gsronu33B042a10b1
taactttatgtgccaaggaggtgacttcaccgccggaaacggtaccggaggtgaatccatctacggatcaaagttcgctgacgagaacttcatcaagaagcacactggtcccggtattctcttaatggctaacgctggaccgggaactaacggatctcagttcttcatttgcacggctaagactgagtggctcgacggaaagcacgttgtgttttggacaagttgttgaaggcatggatgtggtgtaagccattgtgatagtttttttttgcattttttgtatctttatgccctgcttttttttttttttctttctttcatattcttttttctttttaattttgttttccttttttattattctttttgctatttttatatccctatttatattctattttttatttttatattattttttatttatttgctttctttattctttttatctcattgtaatttttttttactctatttcttttatttatttttttccttcttttttctctattaattcgtttttttttttttatctttccattttttctttaattattccttttttatctttttttatttcttctatctttttttttatcttatatgttttattatttgattttttttactctttttatattttttttttttttttttattttcttttccattttatcttttatttattttttttttactctttttcttttttatttttactttctgttttttttctcgttttttttttctatgttttttttattttttttctatttcttactttatttattatctatctattctaacaatcttatttttttcttaatatttttt

SEQ ID NO: 6681 - DNA, 99 bp, Gossypium hirsutum
  Clone ID: uC-gsronu33B042b03b1
cgagtgctcatctctctgcttcaaagctcctgtccaggtagaattctcttcttcctttgcgttgtgttctttgttgttcaatcgccatgacttcaaagc

SEQ ID NO: 6682 - DNA, 81 bp, Gossypium hirsutum
  Clone ID: uC-gsronu33B042b05b1
ccctctcttttcgcccacgcatccgactagttctagatcgtgtgcattcaaactagagtatccaacctatcgcacatacat

SEQ ID NO: 6683 - DNA, 76 bp, Gossypium hirsutum
  Clone ID: uC-gsronu33B042b06b1
gcgttattggggtattgttttttcgcatttgttacgacaacttttatatgaaatggatgatcttcgtttctagatt

SEQ ID NO: 6684 - DNA, 108 bp, Gossypium hirsutum
  Clone ID: uC-gsronu33B042b08b1
tgtttactccagctttcgcgtaatttcatttatgtctcttacctttactttaccttaaggcatagataaccaaaaccctcaccttttgacactctactatttaataat

SEQ ID NO: 6685 - DNA, 293 bp, Gossypium hirsutum
  Clone ID: uC-gsronu33B042b09b1
ttgtggcttttcttttgggtttctatttaagtctttaggatatctttactcctataattttgtttgggtttattttcactttaggtctctcttctgtttattctttattctcttttcttttttcttttttctcatttatgatttttttatttttttttacttttctttcttgttttttttttctttattatttttatctttttattttttatcattttatttattcattttatttttttttttcttctttatttttttttttttttctttctttctgttttcttttcttttta

SEQ ID NO: 6686 - DNA, 91 bp, Gossypium hirsutum
  Clone ID: uC-gsronu33B042b11b1
ttgacatcagttactttaataaggggtctttacttaatgctaaatttacctatatggctcaaaaaggtttaagtagatctaagaacccatt

SEQ ID NO: 6687 - DNA, 667 bp, Gossypium hirsutum
  unsure (1)..(667): unsure at all n locations
  Clone ID: uC-gsronu33B042c06b1
caatctcatagaacaagcgatagagtatgtgaagcaagcggtacaagatgattatgcaggtatactacagtatagcccattctttatacattttctttacttaagtattttttgacttatttatttatttatttagttatcactaattatttatttggtttattataatttaatttttttataattttttaattttacttttttttttttttttaattattctttatcataattcttttttatttttatttttataatatatattctattttttcttattactttttatttataattcatttatttattcttatactattatttcctttattctatattatattatatattttattctttttcatataatatattttatcgttattcttttttcttatttctatattntattttattctatctataatctattttattttatatatattttatttcatatttaatatataattttttattattattttctattttattcttatatataatacattttctcttatttttttctttattatattatttatttctctatttctatataactatattctattacacatattatttttattcttcatttagtaattatttatatactaaattattatttatttattattatatattttaacattattttttt

SEQ ID NO: 6688 - DNA, 541 bp, Gossypium hirsutum
  Clone ID: uC-gsronu33B042c09b1
gacttcaccacttgattatatgtgtcattttttttcaaattcactttatttatttttttttttatcactatttttacctttaatttctttataaatcttttttttttttttttatttttttttatacttattttttgtgttttttgtttttttttttattattatctttttatatttaatttttttattatttttttactattatatttattttttttcttactaatttttttatttatattattttattattatattatctatttataatattttttacatctattttaatatacgattttttactttattatttcattcttattttttttaaaataattttattttatctttacttatccttttttatttttcatatcttccatctttttctcttttttttctttttttacatttttttattcttattattatatattattatattttttttttctctattttatttttatatatttattttatatctttttatcatttttttatttttcattatattttataattataatattttatt

SEQ ID NO: 6689 - DNA, 278 bp, Gossypium hirsutum
  Clone ID: uC-gsronu33B042c11b1
ttgtttgcttctttacaatcctgtattgctcaccaaatctttgaaaaatcaattgaaatccctcggaaatattcaatttattatagtcgcctataggcaacacttgtagttttttacagtttatttgaatgaatacccataagtctttttttatttatccctctggttcttttgtctgtttttcatatgaaagtttgtttgttttttttttattcatcttttttatttttttttattttttgttttttattctttcctttttttttttctctttttta

SEQ ID NO: 6690 - DNA, 676 bp, Gossypium hirsutum
  Clone ID: uC-gsronu33B042d01b1
cttttcattatgagcaacggatacagtatttgcaatgactaaatattataatttaatttttaattataaaatattataaaatatttattatataaattattatttattattataaattttttaaattataatctatatattttttttattatattatttaattataaatataattaaaattaaattttatataataaatagttaataaataatataaaaaattatttttttatatatataaaaaaattaataattattttaattataaaattaaattattttatttaaaatatattatttatttttattatttaaaataattataattaaaattttttaaataataataaaatttttattaaattaaatattttttatataatattataattcataaaattttaaattatatattatattattattattatatataatatatattaaaataatatttatttaaatatattctatttttattatttatctatataaatattataatttattatttattatttaattatatatatataatcacttttatactatttttaaattatatattataatcataaaaattatatattatttttataaatatatattaattcaaaattttatacaattataatatatataaatcaatatcttttttaaaatttaaatattattt

SEQ ID NO: 6691 - DNA, 543 bp, Gossypium hirsutum
  Clone ID: uC-gsronu33B042d06b1
ggatggcgcaatttgtgcaaaaaggttcaagaggcttgtgagaaattcggttgttttgaggtggtttatgatacgatatcgacgaaagtccgagaagagagttttgtgttgataaaagaattgtttgaggttccgttggaaaggaaacattttaacactattctcatgcctttattatttctgttttgaactttgctatcaattttttttttttttttttttctttattttctatattatattctttttattttattttttatttattcattcatatcatttttttttttatatttttctctacatttttttatcacttttttattttttttttttttattcttttattttttttacttctttcatcttactttttttcttactttcattttatttatttttccttctatttattttatttattttctctattatttttttaattttttatatttttaattttattattgtttaatattttctaatttgatttattaactttcttaatatttttttatattatcttttcatatttttatctta

SEQ ID NO: 6692 - DNA, 210 bp, Gossypium hirsutum
  Clone ID: uC-gsronu33B042d08b1
gattgaatggagaggaaagatgttatgtcaaagaatgtgtctatttacaagtctcaggcttttgccttggaacagcatgcatttgctaacttcaaggattttgttaatttgtttaattttttcttaattctatattttttctttttcttttttgttctcctttacttttctattatcttcctaatttgttataatctttattattttttt

SEQ ID NO: 6693 - DNA, 89 bp, Gossypium hirsutum
  Clone ID: uC-gsronu33B042d09b1
tgcctctcaaaacaagcagattttctcggggttttgtagtttacatggcaaataatcaagctcatcttaattgtgttttcttttaaatc

SEQ ID NO: 6694 - DNA, 154 bp, Gossypium hirsutum
  Clone ID: uC-gsronu33B042e01b1
gtcttttttagttgaaactgttctcagaaacagactacatcccaaccccatcgttcgatatactacaggaccggctaatgttacccttaacaggactcggtgtattaccaacttcatcttgcacctttcgcccgtgtcatctgttaggctatcg

SEQ ID NO: 6695 - DNA, 734 bp, Gossypium hirsutum
  Clone ID: uC-gsronu33B042e07b1
cgtgagtttcgactgttctcagatctaaacgacaacgtttccagatccacaatggcttctacattcagcggcgatgaaacggctccgttcttcggctttctcggcgccgccgccgctcttgtcttctcttgtatgggagctgcatatgggaccgctaagagcggtgtcggtgtggcatctatgggtgtgatgaggcctgaattggtgttgaatatcgattgctcctgttgttttgtttgtgttcttgtttattttctgtttgttatttctcttctctctttatgctccttgctctatcctctttttcatttctttgttctttttttttttttcttttcttattttttgcttctttttcttcttcttttcgttctttttttttttttttttttccttcttttttttctcctcttttatctttttctattttcgtctttttctttttattttttactatccctttttttttctgtttttctttctatttattctttttttgctcttctattttttttttttttttttcttttctgttctcttgttttttttccttcttttttttttattttttcttcttatctttttccctttattttttttttctttttcttctttttttttctctctttcttgttttaatttctctctcttttttctttttcattttttttcttttgtatttaattttcttgttagttattttctcatttctctttcttttttttcattttttc

SEQ ID NO: 6696 - DNA, 779 bp, Gossypium hirsutum
  Clone ID: uC-gsronu33B042e08b1
ttcctcgcgtccgcccacgcgtccgcccacgcgtccggaggaaccaaatattttgaagtacataaagattgcagctagcttgcctgagaaaactgtacgtgatgttgcactgaggtgtaggtggatgcaaataaaggtactttttggaaattggcagagaaagcgtagaaaacctgaggaacataatgcgggaaagaaggtaaacaacaggaaggataagctggtggaatcatcttctaagatgactatgccttcatctctgccaccaaccatggctgcatatcctctcatgatgcgtcatctggatcagaatggaagaacgccttctgaaggaatatgtggtacaactatgcatcttttgaagcaaaatgctcaaacttttagtcaaatcacatccaatctttctcaatacaagttacaggataacattgacctcttttgttacgcaaggaacaatattaccgccatgctaaatgacatgagagagatgccaggattaatgagccatatgccaccattgcctgtatctgttatgagggattagcaatggcctcttggctggagcaacaatgtctgcccgtaatgagttgcagtccgggttgctggccaaaagtggatcgagacccacctaagcaaaattgttcaatatgaatctgcgtttattattaatggggttaaggaaagcttttaaaaaaaaaaaaaaaaaaaaaagggggcgtttaagtccaagtattcggtgatgaactatatttttttggacctaattattttggcgtttt

SEQ ID NO: 6697 - DNA, 592 bp, Gossypium hirsutum
  Clone ID: uC-gsronu33B042e09b1
tatttgcttttgaaatacaatccggttcataagaaagtcccggttcttcttcacaacggaaaaccaattgtagagtctcttgttatacttgaatacattgaggaaacttggaagcataatccctatttgccacaagatccttatgacaaagctaccgctcgattctggatcaagttcatcgacgaaaagtgctttcctaccctttggctagctgcatggagcgccgagaatgagcgagaaaaagtgacgaatgaagcttgcgagtatctgaaaacgcttgaaagtgcgcttaatggaaagaaacttttttttgggagtatactcttggtcatggtttattattgttgatagctatcctatttctttcatttcatataactttatttttttctttacttcctttattttttttaggtttttaatttttttttacatatctattatattattttatttctcttattatttttatatttaatttataatattttcttatctttttttatattttaatctataatcttatatttcattttaaccttattattttctacattgtaaaatgtccacttctagtcttttaatatatttt

SEQ ID NO: 6698 - DNA, 343 bp, Gossypium hirsutum
  unsure (1)..(343): unsure at all n locations
  Clone ID: uC-gsronu33B042e10b1
tcccacgcgtccggtaaatcttactgaaagaatcgatttcaataaaaaaaaaaaaaaaaaaaaaaaaaaaaaaaaaaaaaaaaaaaaaaaaaaaaaaaaaaaaaaaaaaaaaagggnggtcaatataaaaaaaaaaaaaaaaaaggcgcttaaaatgagaggccccatctttaaaaacgagccaccgaaataaaattaattgcacaattgaatcacacaaatataaactgaaaaaaccatgtttttacccaacttaatggaaaaaaacatgattccactaacccaagttgccgtaaaaaaaaaaaggcctgaaccaaacaggttttaaaaaaaaatggacatc

SEQ ID NO: 6699 - DNA, 852 bp, Gossypium hirsutum
  Clone ID: uC-gsronu33B042e12b1
taattttttagatttgtcattacttagtaatagtgtaactaaaaaacatgacatgaacttgaatttaataaaataatttaaacaatattaataattagatttaaattttaaaatctaaaataaaaaagactaaatttaaaagaaataaaaatacaaaaactaaattctaattttataaaaaaatacaacaacttaaaataaaatttaaccaaaacaaaagccaaaaactccaaaatctaccataaaaaagcaaccccccatccccttattcctttcaaaagcattggggacttggaagtgcaaagcttgctcacatttctcaagagctgtttttagtgtttataaaaaaaatcctcccctccccttcttgttctactttcctctctaatcccttaaaaaactcattgctttttttcttattaacacccatattatttgccccatctaatcttatctttttctttctggatatggtttacatttgttttttttttcagttttttttttctttttttttttttttttatatttatattttattatttttaatttgggggtctgttttggttttttagttagctcttttctttttattatattatttattgttactataataatttctttcgttttttttttttttatttaaattcttgtacttctttattctttcttatttttttttattttatttttttatattttttatatttttttattttgttcttgttttttttttttattcttttatttattattttttttttatttattttattttctctattattcttttttttttatatttattattttttattatttttctttttttcattattttttttgttt

SEQ ID NO: 6700 - DNA, 461 bp, Gossypium hirsutum
  Clone ID: uC-gsronu33B042f05b1
cccacgcgtccggtcggtgtctttggagacatgtacataaagaaaagaatcttagagaacaaaagataagaatatccaatgatttagtcaattttgtaggagacagaaatgtaagaactgtcgttttcttttcctcttttgaagtaagtttatgacaaaagtcctttaggatacctctacgcaacatcaaatgaatcatttagtttatcatgtgagattgggcatataaatctatgttttgttgaaaaaaaaaaaaaaaaaaaaaaaaaaaaaaaaaaaaaaaaaaaaaaaaaaaaaaaaaaaaaaaaaaaaaaaaaaaaaataatataatcttcctttttaaaaaaattaattttgggggggccgttttaaggatcccaatttttttctcgcttttttccaaaacaattttttttatttgggtccccaaatttatttttgtggcggttttttacaacttt

SEQ ID NO: 6701 - DNA, 517 bp, Gossypium hirsutum
  Clone ID: uC-gsronu33B042g03b1
tccacgcgtccgcccacgcgtccgtagcttacagcttccattgtttttcagtagtgaagagctaaaaaagaagggaaatcaatggaggggaaagaagaagatgttagattgggagccaacaagttcccagagaggcaacctattgggacagcagctcagtcccaagatgataaggattacactgagccaccaccagcacccttgtttgagcctagtgagttgacctcatggtctttttaccgagccggaatcgctgagttcgttgctactttccttttcttgtatatctcggtattgactgtgatgggagttgttaaggacaaaaccaagtgtacaactgttgggattcaagggattgcttgggcttttggtggtatgatctttgcacttgtttactgcactgctggtatctcaggtggtcatatcaatccagcggtgacatttgggctgttcttgggtaggaaattgtcgttgacaagggcaataacacatggtgatgcaatgcttgggagccata

SEQ ID NO: 6702 - DNA, 416 bp, Gossypium hirsutum
  Clone ID: uC-gsronu33B042g04b1
atattccttcatacagccgaggatatcagcgtcaagctggaagtggatttgttatgaacccagtgggtgatgctgtcatagacataagagtatatttatgttttttttatagattatccttttttaatttgctgatgaggttataagtattggtttttataattttttatatatttgttttatttttgttgttttatctttttccacttttatatttatctctttatttcatattttctaattttatgatttatattcatttttttatttatttactttttatttatttatattaatattttaattctctatattttttttttactttctctatttaatttattcctatttaattttgtatcctcttattttaatgtttttttatatttcttcttattaatctcattgtctttatc

SEQ ID NO: 6703 - DNA, 321 bp, Gossypium hirsutum
  Clone ID: uC-gsronu33B042h04b1
aaatttattatcaagcatagatggaaaacatgggagttctagtcatggtggttgtttactctttatcgttattatcttttttcttttcattaactactccttttattctttctctttttcttttttctctttacttttttttttctatttttcttattttatccccttttttttattccttaatcatttttttcctcttttctttttttttatttattctttttcttttcttttttctcttcattctattatatttatttttcattcttttccacctcttttttcattatctttattatttcttttactctattttttttt

SEQ ID NO: 6704 - DNA, 579 bp, Gossypium hirsutum
  Clone ID: uC-gsronu33B042h06b1
cggtcgcgtggggaaaaatagttcttaatacattttcttttcttctttttaaggtttcctctcaaaaagttttttccttgtttcttccctactttccaacggtcaaagtttttgacatcgtgggaatatttatattggagaaaaaatatccattgtatactaaaatatcacctgaaaccctatgacaaatcttagtttgagcaatgaaaatggaagaaatcttaatctactctttgctttcggttcttatactatgggtggccaccaagttaatcacctcaactcacaaaaatcacccaccaagtcctctggctcttccgattctgggtcatctccatctcctcaaagaacccctccatcgaacactcttcaccctctcccaaaaacacggccccatcttctccctcaagcttggctctcgtttctggtcgtcgttcatcaccctttaccgtccaagaatgtttcaccgagaatgacattcgtttagccaaccgccctcgcttcatcatgggcaagttcgtcggctataactacaccactctaggtctggctccctacggcgatcatttgcgcaaccta

SEQ ID NO: 6705 - DNA, 873 bp, Gossypium hirsutum
  Clone ID: uC-gsronu33B042h07b1
tccctctcgtccgataattgcgagggaatcgccttcaaaaatgagtgactgccagccgttgtcaatacctattttgactgctgtccagcatgctatggcttcagcagcaaaaggtgacgaaacaccatcgcgaatatttgagtaagataaaaggaccttttttttcgtatcttgaaccacaatgcctgaagctgaccgtttctgttcttttttcttttgcttccttccttattttttcttgtttttctttcttttttatctttcaattatgtttcttctccttatttttcctttactttttttcatcttttttttttcttcttcttttcatttctctattttcatattcttattctatctttattgttttatttcattattctttcatctcttatttttctttcttactattttttttcttatttattttcttcttctttatttttttcttcgttttttttaactttatttcctttttatacctttttttcatttttttttttttctttatacatcctctatatactattcctataactttttacttcttttataatttctttttatttttctcacctatttctctttattttttatatattttctacttctcttatattctcttttcctttaattttacttctcttcatttctatcttttttatttttattttctcttctctaattttatattctctatttattttctctctattatctttttttttttccttacattcttttattttctttattcttttctatcttttccttaatttttctttcattttttttatatcatttcatcatttactctatttctatttatctactttatttattttttctcatttttctcacccatttttttta

SEQ ID NO: 6706 - DNA, 422 bp, Gossypium hirsutum
  Clone ID: uC-gsronu33B042h09b1
ttcttttatcccttttatcctgctcctttgccaaattggtctcacctttcatactaggcaaagcgccaaatcgggaacccgatctacgtagtgtgttactctctataatcataagaacctttttaacgagaatttgcgttcaatttctcgtttgtgaaaggatacttgttatctacttttttattttttattattttttttcattttgtctctaatcatattaatatttatttttttaaactttttgtttttttttttatttttttttatttcttttctttgtttttctatttcttacatttttatcactttctgcaaaattttttttaatatctatctctgttttctaactatattatttttttattttttttagtatttaatactttctctctttcccttttatttttattttttctatt

SEQ ID NO: 6707 - DNA, 74 bp, Gossypium hirsutum
  Clone ID: uC-gsronu33B044a03b1
cccatttcgtactctgcagaactccaaggtacagttggagggtggtgtcccagtccattcacagattacaaatt

SEQ ID NO: 6708 - DNA, 288 bp, Gossypium hirsutum
  Clone ID: uC-gsronu33B044a07b1
ttgatattggagaaacttgcacgcaagggacccaagccagaggagaaaccggatgctggttcagggggtgctgcgaccgatggtagcactacctctacatcgggaacatctgctgagaaagtatcaaccgataagtaccgaaactacggggttctcgctggtgttgcaacccttggtgctgctgtgggatggtatctcaactctaaagacaagaagcaagaggcctgaaatgggggttaatgcgattggattctctaggtggaacatggcttgaatggtttaccccca

SEQ ID NO: 6709 - DNA, 331 bp, Gossypium hirsutum
  Clone ID: uC-gsronu33B044a08b1
tttattcgtggggcttaagataggcggtaagttgcatacaattcaaaataaataaagggattgcataaagctttttattctttttattaataatttttcgtattaaaattcatatcaacctgtaattttttaatagtctgtaattaattctattttaactattgtacttttattcctaaagaattattttatttatttataatttattacattattagttattttttttatattaaattttcaattcattttttatttattctgtaatttttttcatttaactatataattttacttattcatatttatttcttttatatattctatttta

SEQ ID NO: 6710 - DNA, 342 bp, Gossypium hirsutum
  Clone ID: uC-gsronu33B044b02b1
cggacgcgtgggcttaacacaacttaccaactcaaaaaccccaagttttcactttcaaaaaacttcccacattcaccatgtctggcacgtgcggcaactgtgactgcgctgaccgcagccaatgcacgaagaagggaaacagcaacaccatgatcgttgagactgagaagagctacatcaacaatgttgagatggatgctccagctgagaacgatggcaagtgcaattgcggtactggctgcagctgcacagactgtacctgtggccactaagccaacataacaatggtcatgcttcagatcatggcatatatggggatctaaataatgaatttaaggttga

SEQ ID NO: 6711 - DNA, 376 bp, Gossypium hirsutum
  Clone ID: uC-gsronu33B044b03b1
gaaaatcatatatggataagattaagactatgatgcgcgctgttcaatacagtaaatatggcggaggagtcgccgatctcaagcaagttgaagttccggttcccagtccaaaaaaggatgaagttttgatcaaagtagagacagttagtattaacccaattgactggaaactacaggacggggtagcattggccatttttaccattgaaattttacctacattactggtcccttttttttttttgaattaacattttcttttatgttattctattatcactttttttatttttttctttatatctttcgtctttttctatttaatcaactaaactttcctttttttctcattcccttttatttattttatttcttt

SEQ ID NO: 6712 - DNA, 255 bp, Gossypium hirsutum
  Clone ID: uC-gsronu33B044b04b1
cccactctgtccgcttgtgcttgctagtgatggattatgggatgtagtgcctaatgaggaagcctgtttcctttgttcaagagaaaaaaaaactgttaacccttctaaaaccgctaaatttacttgcctttaattttacgcatatttcctactatattacatgcattgcctaaaatatctaacttttgacattggtatattcatttcgcattccttttcccctacatatatttctatatttttattttaacttac

SEQ ID NO: 6713 - DNA, 150 bp, Gossypium hirsutum
  Clone ID: uC-gsronu33B044b08b1
tttcatcgtacgggctgcggctgctgctgataacggggctcatcataatgtacatggagctcataaagttgcacatggaggatactatggtaatggtaacttgttaaattccaaaatcttatatatctaagaatgttcatattatttata

SEQ ID NO: 6714 - DNA, 273 bp, Gossypium hirsutum
  Clone ID: uC-gsronu33B044b11b1
ttcatgatacctaccatctcttgcattaacctaattacaaggataccatagagagaactaggttattcattatttctttacattcggaagaggttttttatttattttttttatttataattatatatttatctttttatttagtattattattattcattttcttttaattttttttttttttattttattatttttttttttttatttatattattttttttttaatacttatatttttttttttttttttttattatatattttttattt

SEQ ID NO: 6715 - DNA, 692 bp, Gossypium hirsutum
  Clone ID: uC-gsronu33B044c03b1
atttttcttttaaaaatcatcttattttatcattttcttttggtttagctgtccaactaagttagttagggctaaattaccactttagtcttacctcaattaaccttcaagctatttaatcaactaaatgcaataactaccaagttttgcaccttttacaatttagttttttttcattaattaactatctaaattttaatattttcgaaccaaattttgatatgaccttagtgactcataaatattctttttagaatatttatgagtcaacatgacagaaatttgtggtcccaaaaccactgatccgtcaccactaaaaatcgggctgttacaactctcccccttaggacatttcatccttgaaatggttacctaaaaatagattcagatactgtaggtttattgattctttagtctcccaggtagcttcttttgaaccatgatgatgccacaagacttttattaacgggactcgtttatttcacagttctttgacttcccaagctaaaattttattgggttcctcaaatccgtaaatctggtgaggctaatctataagcaaaatacatgccaagatcagatctgaccctttaactttgaactggaatcatttagtttttttgagtcaatggcaggttttattaacccggctgtattttacatttttacggcataattggatatattttttt

SEQ ID NO: 6716 - DNA, 256 bp, Gossypium hirsutum
  Clone ID: uC-gsronu33B044c05b1
gttaatcctggtcaatacaaggctatcaatgatgagggtatgccccaccatcagagacctttcatgaagggcaagctagtcatccagttccatgttattttcccagaatctggggtattttcaccctgagcattgccggaagattgagagtgttttgcccatgaggcctagtaagcatttgacagacatggagcttgatgactgtgaggagactactttgctatgatgtcagtgcttgaagagggtatagtttttt

SEQ ID NO: 6717 - DNA, 177 bp, Gossypium hirsutum
  unsure (1)..(177): unsure at all n locations
  Clone ID: uC-gsronu33B044c10b1
aanattctttatcaaaagttcttgataaagtaaagggatatatttttaaatatattaataatatcaaaatacaaaatatattataatataaaaaaaaaaaaaaaatttaaataaatataatatatattttaaatttttttataaatataaaaaaaaaaataatataaattaaaatta

SEQ ID NO: 6718 - DNA, 484 bp, Gossypium hirsutum
  Clone ID: uC-gsronu33B044c11b1
agaatctatgcatcaaggttgtcagccactcagcttagtatatgtatcaagacgatgaatccaacacatacttgcggagggtctgctgtgacagttgggcatcaaagctgggtagccggtattatcaaggagaagttgaaaatttttccagattacaaacctaaggacatgtgagatgacattgaacaagaatatggaatacaactgaactactgccaggcttggcgtgggaaagaaattgtccaggagcagcttttaggggtcatattagggtgtctatttgattgtttccttttttttggttgctaaggattttcgttatcccttcccttgcatcacttttttcatattttcttcttagtgcgatttttatatttctactctctttattttttttgttaatacttcctttttttatctttttttctactattgatgtatcctctttattatttttaattgttcattcttcttcgttttttta

SEQ ID NO: 6719 - DNA, 324 bp, Gossypium hirsutum
  Clone ID: uC-gsronu33B044d02b1
agcgtatctctttcatttgcccgcactagcagcagcagcgccacactttttacagtgctgatcaaccatggcggagcagaccgagaaggcatttataaagcatcctaaagtgttttttttgcatccatgaaatttggttattgcttctgactaattcttgttaggtctttcttttattatatatttttctttttcatttctttatcttaataattttttcttctaatattatctattatttttttttaataataacttttcttttttatattttttttcttatttaattctacattattttctttttctctaattattatatct

SEQ ID NO: 6720 - DNA, 257 bp, Gossypium hirsutum
  Clone ID: uC-gsronu33B044d04b1
attgtgttagaaccagcaagcccaaactgcgattacaaacttctgtgggggaaaacatggcgggagcagctgaaccacaaaaacgccagagcgggagaccgttcccaccatcggcgagaggtccgcctcctcctccttgccctcgctttgaacctgttgatcgcgaaaagacttgtcctctattgcttcgtgttctcactaagattggtggttatccttctaaagaagattttgtttgttgaggtatggatcccatg

SEQ ID NO: 6721 - DNA, 770 bp, Gossypium hirsutum
  Clone ID: uC-gsronu33B044d05b1
aaaatctactcctttgtaatatttctagaggaaatattaatttggtagtgtccgaggacgtaagctaaattggccgaacctcgttaaaactctggtattttatttcttatttgtttgcttttatttaatagctttatgttggttatatttatttagttattattgctataaatatctaagtgtgttttgtctaattgtagtcttctcatcagttccatttttattctttcttcttttcttttaaaatttttattatatttttttgttattatttctttttaactttctttttcatttctttatttctttcatctttctgtttgttctttttttatctttttattttttttctctttttttttcattatctttttctctttatttcacatttttattttattcttttttctttctatctttttttcctacattcttctttctttattttacttagttttcttctttcaattcttctcttctcctacttttcatttattttttattcttttctcattattttatactcatttttccatttttttctttctttttactactctattcttttttttttatttttcatttcttaatccttttaatttttcttctattttatatttatctttttttttcttctttttcctgctttcatatattcattctttccttttctcttctcttatttcttaattatcttcttattatttttttatctctcttctttcatttttttccttctcttttcttttattatctctttttttatttta

SEQ ID NO: 6722 - DNA, 645 bp, Gossypium hirsutum
  Clone ID: uC-gsronu33B044d09b1
ttgatactaccattaaccagtcttatgaatgcccggcttgtgtgcaagaaatggagacacttgaccacaactcctcggtttttacagatgagacgagaaggttcatgtcaaaaaccatggttgtttctctttggtgctgttaaggatggctattgctctggggagatacatgcactggacgtgtctcaagatcaatggcacaggatctgtgctgatatactcagaggtaggttcatgttcttagttgccagcatgcaggatgttttttatattgtttggcatgttagtttcttctttttaccaaatttttaatgtttttattatctttttatattttatattttacttctgtttgtttatatttttttttattttttttattttattcgtcttatttttttcttcttccttaactttctaatttatttctttttgttattcattttctcaattttttatttcatattttattcattttaatttttttttttgcactttttttttttctcttttatatattaatttttttttcatcccttattattattttaacttcatttaatttatctttttctcttatttccttttttgttctttcacttttaattcctttcttttctttttttattctccaccttctttttt

SEQ ID NO: 6723 - DNA, 289 bp, Gossypium hirsutum
  Clone ID: uC-gsronu33B044d11b1
tgagtcattgagtgatggctcacttagttaaaagattgaatataacacaacagaacagaatatgttttccgtagtctgatgtgacattaattttaccatacttattttacattaatattttattttattttacttcaattacgaatatttatatattatcgttacttcatataaaattattacttatttattaaatatatttatttctatataatatataatttaatttattactttttaatttaatttctaatttaaatatttttcacttattacttcttttaaaatt

SEQ ID NO: 6724 - DNA, 543 bp, Gossypium hirsutum
  Clone ID: uC-gsronu33B044e01b1
ggaattcatgcttttggaatctaaatcgctgtcctttttatcatttagagaaccttactagtcctaaaccccaaagtaaaaggagaatcaataatagttcgaagttggacaggctgaccactattaagtcaatttctgtagggtcagttgcttttacttatggaatggttgttaaaacaaataagagaaagtaaaaaaaaaaaaaaaagtggggagcaggatattattcctggtctttggctttgcctggtaagatgaaagaaaaatggaaatatggaaaattgaaggtgtagtaaagtagaaagataaaagaatatatttgttctttctattggggtgcttggtagggaaaaaaaataaatttaatactcttactttcattttcttatattttaaaattcattttttctttcttccttatctttttttctttttctttttcatttttattctatttccttattacttttgggggggggccttttaaagagacaaatttttttccccggggttgggcgtttatatttttttttggggccccca

SEQ ID NO: 6725 - DNA, 396 bp, Gossypium hirsutum
  Clone ID: uC-gsronu33B044e02b1
atcattatgatttccataaatccattttttcacgtagtcgctttaaatacgttccagaatcaaaacaacgtcgattcaagttcagatggaatcaacggcgaagccagcgggtggtagaaagggaggagtgaagaagaaggcagtctctaagtcggttaaagcggggctgcaattccccgtgggtcgtatagctcggttcctcaagaaaggtcgatatgcgcagcgttacggcggtggcgctcccgtttatcttgccgccgatcctgagtatcttgccgctgaggtttttgaactggcggggtaatgcggtacgtgacaccaaaaagaacaggatccacccgaggcacgtgctactagcagtgaagaacgacgaccagtttgggtaagcttttttaa

SEQ ID NO: 6726 - DNA, 214 bp, Gossypium hirsutum
  Clone ID: uC-gsronu33B044e04b1
atgttattgaaggttatatcggaaggcaaattggctgttttgcttctatccggtggccaggggactcggcttggaagttcagatcccaagggatgttttcttattgaacttccttttgggaagttaccttttcaactgctagctgtgcggatgttgtgtgttcaaagaatactccgcacatgctataaatgagtccttcacctactttacactg

SEQ ID NO: 6727 - DNA, 369 bp, Gossypium hirsutum
  Clone ID: uC-gsronu33B044e06b1
actcactgtagggctggctcgcccgccggcaccggccgcgacttactggctcgaccgacgcacgcgtacggtgcttagacacttacagcaccctcgtcttgcctttatgtccaagagtgaggtatatcatcttgtcaatggttatgccgggcgaagacatgggcagccggctcacactgacagagaggccgctagtagatcatgatcatgggctgatcgattgagctcgtcgagcccgagatcctacggttcaaggccggagagccaatccttcttctcgtgccgacagcggtttgccggcgttgacatgaggatccgtgtcaaaggtggaggtcacacttctcagatctacgctatccgtcaaagcat

SEQ ID NO: 6728 - DNA, 417 bp, Gossypium hirsutum
  Clone ID: uC-gsronu33B044e09b1
ttcattctttctcattacacgtcgacaatacgttcgcaacaccgtagggaagcacgactaggatgcttacggcgaataactgccgacagagaagcttgaacgttgagtcttagtgaaagaaggacttggcttaagggaatctgaacggctcaaagtccgaccactactacatagctggtgacgcaaggtacactgctcaatgcagccataattgggtacaaacagtggaacgagacatgcgagaggcatactagctacacaggacatcaactactgtgagctgctgcttcccatctgatgatcttcttgccaagcaaacaaggaactgagaagagtccttgtttgcagagaatgtgacaggttggatgttgggattccatgaaaaaagcagcagcagggaaactacaggggtacata

SEQ ID NO: 6729 - DNA, 312 bp, Gossypium hirsutum
  unsure (1)..(312): unsure at all n locations
  Clone ID: uC-gsronu33B044e11b1
ttcattcgtccgagcaaccatcttttactgaagaaaacatcaaggagctaatttatagggaatcggtaaaattcaatccagacccaatgtattaaggcttatatgtattgtatttgtatatgactctgcaagtgtgtgcctagcggcattaccatttgtgacccatcattcccctttgtgattagaaacattaagaatagaatactcttaaactgaatgacagtttattcaaaanaaaaaatttttaaaaaaaaaaaaaataaaaatattatttctaaaaaaccctatcttatttttctttttcttatctct

SEQ ID NO: 6730 - DNA, 397 bp, Gossypium hirsutum
  Clone ID: uC-gsronu33B044e12b1
gtcgattgattcttcgaaaaccataaacgaaaccaaatatggcggagaaagcaatcgagtcggttcaatgctttggccggaagaagacggcggtagccgtaacacactgcaagagaggccgtggtttgatcaagatcaatggttgtcccattgagcttgtcgagcccgagatcctccgtttcaaggccgtcgagccaatccttctcctcggccgtcagcgttttgccggcgttgacatgaggatccgagtcaaaggtggaggtcacacttctcagatctacgctatccgtcaaagcatcgctaaagcccttgtcgctttttaccagaagtacgttgatgagcagagcaagaaggagattaaggatattttggtcgggtacgataggactttgctggt

SEQ ID NO: 6731 - DNA, 468 bp, Gossypium hirsutum
  Clone ID: uC-gsronu33B044f05b1
cccattcgtccgcccacgcgtccgatttttttctattttcagaaatacttcatacaacgcaatacacagaagaaaaaaaaaaggaaatggaaggtcttatcccttttgtttacagggctatagtccagtacaagaacggaaaagaagatcacgttttagcaacatggttcaacgagtcaccctcggcttcttacatgagactccccaccggagattctgatcgcttccaaatatccgatgatcgaatctttgaatcagataattatgggaagttttccacttcatcatcatcatcatcttccatggttgctccttctgctagtgctaagattattttatcaaccggagttcaatctcctgctgtctgtcgtttgactcctcgccgcgtcgttacatgaaaccatcgcatgcttattgggttaatctagggtctgggaatttcatgtatgtagaaaaaatatatgaatt

SEQ ID NO: 6732 - DNA, 280 bp, Gossypium hirsutum
  Clone ID: uC-gsronu33B044f07b1
taaataataacaaaaaaaataaaaaaaaaaaaaaaaaaaaggaataacaactgtataattaaaataaaacattgaaaaaaaaaaaaaaaaaaaaaaacacaaagtgattttataaaaaaaaaaaaaaaaaaggggggcccctttttaggaacccaagtttataaccccgtctatgcaaataaaaatttttttttaggggcccccaaaataaatttaagtggccggcgtttaacaattttgtaattggaaaacccttgggttacccaattttatctctctt

SEQ ID NO: 6733 - DNA, 435 bp, Gossypium hirsutum
  Clone ID: uC-gsronu33B044f11b1
ttcactcgtccgaatccccaccaccagttctagtccttcatggacattatggaggttgcgtgggcgaccttccaagttacgatgcttttacacttgggggcccctattcggtgagaggttataacatgggtgagttaggtgctgctcgaaacattcttgagctcggagctgagatccggatacccgtgaggaatacacacgtgtatgcatttgcagagcatggtaacgatcttggaagttcaaaggatgtaaaggggaatccaacagaagtctacaggcgaatgggacatggttcgtcatacggtgttggcgtcaagctaggactagtaagagctgagtatgctgttgaccataacaacggaactggtgcaggcttcttccgatttggagaaagatattaaaatgtgatttcgggtctaattctgtaaggtgggc

SEQ ID NO: 6734 - DNA, 363 bp, Gossypium hirsutum
  Clone ID: uC-gsronu33B044g01b1
tccttattttctttcaaagatggcaggaatcgcctttggtcgcttcgatgattccttcagtttggggtctgtcaaggcctaccttgctgagtttatctcaactttggtgtttgttttcgccggcgttggctctgccattgcttacaacaagttgacaactgatgcagccctagatcccgatgggctagtcgccattgctgtttgccacggatttgctctctttgttgcagtggctatcggtgccaacatctcaggtggccctgtcaaccctgcagtaacttttgggttagctcttggtggccaaatcaccatactcactggcctcttttactggattgcccaacttcttggatccattgttgc

SEQ ID NO: 6735 - DNA, 351 bp, Gossypium hirsutum
  Clone ID: uC-gsronu33B044g03b1
cccattcttccggatttttcagccataaaacccggaattgctccagacctgaaatttggtgcatctggcccttttacagatgtaccatggggaaccggctctggtactggatcacacgtgatgaacctcttgtcggtggattatggaaagaaatcaaagcttgggttcaccatctatccttcgcctcaggtcccaactgcagttggggaaccttacaatagtggtcagggcacatatctcccttcttgagcacaccagatgtgggtcgtactattggacaatgaagcaatttacgacatatgccggaagttcccttgatatcgagaggccaacttacaccaatttgaaacc

SEQ ID NO: 6736 - DNA, 350 bp, Gossypium hirsutum
  Clone ID: uC-gsronu33B044g04b1
cccattctttcgcatatctacaaaaatcagtcaacaaccaaatgataagcctgcaatgcgtttaaagatcttgttcaatctctacaatttgttggaaggcccagatagccggttctttgtgtacatgcaagccttaaatttagcactgaatgggaaagttattgatcatattgtaccatctttcaagaagatagatagtttcttgaaggagtggaatattggggtcaaggatcaaaggaacctctttcttaccattgcaaatgtactgaaagaaaacaaaagctcgggaaaggattctttcaaattcttgaccaagtatttggaaactttctctggtgaggactcatatg

SEQ ID NO: 6737 - DNA, 438 bp, Gossypium hirsutum
  Clone ID: uC-gsronu33B044g05b1
tttttgttgttttcatttccaatgacaataaacagattccactgtggcatcaaaaagctagccatagagcagatggtgtaattctctgggattaccatgtaatttgtgttcagaggaagaaagatggtggtactcatttagtatgggacttggattcaagtcttccatttccttgtcctttagctacctatgtgtcagaaactatccggccatcatttcagctcttttcggagtttcagaggtttttccgggtagtgcatgctcctttatttcttcgtcattttgcatctgatagaagacacatgaaagattctgaagggaactttactgctcaacctcctccatatgaacccatagttgctgaagatggaatctgtgcacaacttaaacgagtacatggagaaccgggctggtgatgtactaacagatctaccaccg

SEQ ID NO: 6738 - DNA, 89 bp, Gossypium hirsutum
  Clone ID: uC-gsronu33B044g06b1
gttgggttaagtttaataatttgagcccgttatttaggccactcatgttatgaaagaaatggccatagaacaattattatatatcatat

SEQ ID NO: 6739 - DNA, 224 bp, Gossypium hirsutum
  Clone ID: uC-gsronu33B044g07b1
gtgttttgaagagcaccggacgtcgcgtggtgtccggtgcgcccccatagggctttgaaaatacgtaggacctattgcgcgtcggacactgtcgtactcataaccgtataaggtcttcaaggtgaacaggctatggtcaatggaacaatgtatgcaagggaagttggagaaacggatccggaacctagggataaggattggctatgagggctggagcacggggg

SEQ ID NO: 6740 - DNA, 436 bp, Gossypium hirsutum
  Clone ID: uC-gsronu33B044h04b1
aaattgtttaatgactcaaataacgacttttttttgtatcgaggcttctggtgttactcgtttttcattgaaggagtgatgtcggctcaacaaaatttccaatctcaaccttccgatatcgtcatatgcagtgcaccgaaaactggaacaacatggttaaagtccctcacttttgccattgtcacaagaatcaccttcgatgattccactaaccctttacttgccaatctatcacatgattgtgtaccacttttagaggttgatttagcccaatcttccatcaatcgagaccctaaaaatcctttgttagccacacatgtcccttactcatttttaccaagatcaataattgattccagttgtaaaattgtttacattttgcgggacccttaggattcattcgtttcgttttacccacttcatttgctaggccctt

SEQ ID NO: 6741 - DNA, 172 bp, Gossypium hirsutum
  Clone ID: uC-gsronu33B044h06b1
aaaactcgctggtttctattgttggtcttggtagttggaaaaaaaaaatgtattgttttccccaatctcgaggtcattccattcttgatggaaattaacaggttaagtcggttttctttaatctttaaatataaagataccagatttctttggattctttacaacaatacaa

SEQ ID NO: 6742 - DNA, 54 bp, Gossypium hirsutum
  Clone ID: uC-gsronu33B044h07b1
tcgtacgtacttgcgttagtaacggtacacactcttttactgcatacgtgattt

SEQ ID NO: 6743 - DNA, 109 bp, Gossypium hirsutum
  Clone ID: uC-gsronu33B044h09b1
taatgaggaacgtattgcacatccagagaagtataccgattaagggaagtcaactcctcctgagtttgaggaccctaagctttatcattatgcgattatttttgataaa

SEQ ID NO: 6744 - DNA, 87 bp, Gossypium hirsutum
  Clone ID: uC-gsronu33B044h10b1
ttcatgcgtccgcccacgcgtccgggagctccacagggctattaagatgtgcgagcgagctttagttcagcagattccaattgttta

SEQ ID NO: 6745 - DNA, 96 bp, Gossypium hirsutum
  Clone ID: uC-gsronu33B044h11b1
taatacttctccttcgcatctccaagacttacctggtttcactcgtagtgattacagaaggtaccatgcgttatataacgccagatagtttatgtt

SEQ ID NO: 6746 - DNA, 156 bp, Gossypium hirsutum
  Clone ID: uC-gsronu33B044h12b1
tagctaaggagaatctctctaagctggaggagagatctaaattgaaacctgggattcccaagaaggatgggaagattgactacactcaagactcctttgcccgtcaagcttttttgacagcattttggtcaacttgcagtttgtaatcttttgctt

SEQ ID NO: 6747 - DNA, 144 bp, Gossypium hirsutum
  unsure (1)..(144): unsure at all n locations
  Clone ID: uC-gsronu33B046a06b1
cccattcgttcgtcgatatacataaatctagcacaagagttactaaacgaagagaattgaaggagaatcaactatatgaattttattgaatatagatcttccactatcatctaaaaaaaaaaaaaaaaaaaaaaaaaaaannaa

SEQ ID NO: 6748 - DNA, 117 bp, Gossypium hirsutum
  Clone ID: uC-gsronu33B046a07b1
tcgcccatgcgtgcgaaacagctttgtgtttccgataaacccttttgtgcctattcttggccttcatcaagatttgatgagagcacgtccactgatgatgcacatattgatgaaatt

SEQ ID NO: 6749 - DNA, 226 bp, Gossypium hirsutum
  Clone ID: uC-gsronu33B046a12b1
actaaattgtagaaatacataaaatctagcacaagagttactaaacgaagaagaattgaagggggcggcccgatatgaggctccttgtttagagaccccagccttccatcccctagctttcaaatagagacccctaatttaaagtaactgggcgtcgtctcactagcggttccatgctaacgccctcgtggatacaaacctatagcttctctaatgaatccccttt

SEQ ID NO: 6750 - DNA, 144 bp, Gossypium hirsutum
  Clone ID: uC-gsronu33B046b05b1
cccttgcgttcgcctcaatgtcaccaccagcaatggtgcattcacgctctccatggcactctcccgtgccttacctctttggtggcctagcagcgatgctgggccctcactgcttatgctctcttgatttaagcttgttcttac

SEQ ID NO: 6751 - DNA, 375 bp, Gossypium hirsutum
  Clone ID: uC-gsronu33B046b08b1
tttgttgtcaggaagctctccacaaagcttctatcgaaaatgccaaagcaaattcatgagatcaaggacttccttctcactgccagaaagaaaggtgcatgctctgtaaaaatcaagaagagcagagacgttgtaaagttcaaagttcgctgttcaaagtacttgtatacactttgtgtgtctgatgctgagaaggctgataagttgaagcagtctctccctccaggtttgagtgtccaggacctgtgaaaatagggccgctttgaattcatcatccaattactaggtgatgaaagctagattttgactttggttttatcatatttcaagcctttcaaacttaaaatttacttgaaaggagggcgaggtactttt

SEQ ID NO: 6752 - DNA, 100 bp, Gossypium hirsutum
  Clone ID: uC-gsronu33B046b10b1
actggattagaatctgttcagaaaaaagacggcgtcttggttatgtagaatgatcacaacacccaaaaacccccgagagacagccagataacttctttaa

SEQ ID NO: 6753 - DNA, 303 bp, Gossypium hirsutum
  Clone ID: uC-gsronu33B046c01b1
gccttgcgttcgaccacgcgtccgaccacgcgtacgagctcggatactgaggcttgggcgtggcgtcgatgttgaggcgctggcatcgtacggaggcattgtccggttgcggcgcaagcattaggctagggttttttgcctgctttaaattttgggccacttgggcctaattgatttgggctcgggtttgtttgtaaatgggctgatggactgttaaaggctggactattataatgttttttattgcaaataattttgatttatgcttgtacgggcctgggcttaattggcccattacaattt

SEQ ID NO: 6754 - DNA, 179 bp, Gossypium hirsutum
  Clone ID: uC-gsronu33B046c10b1
tttaaattattaaaaaaaaaaaaaaaaaaaaaaaaaaataaaaaataaaaaaaaaaaaaaaaaaaaaaaagaaaaaacaataatagggggcggccgttttgggggtcccaggttttcttccccttgcttgccacgtcttcccttttttttggggccccccattttcatttcccttggcc

SEQ ID NO: 6755 - DNA, 343 bp, Gossypium hirsutum
  Clone ID: uC-gsronu33B046d03b1
tgtccgagcccacagcgtaccgcattttagatgcatatgttggtgatgaggctcaatctaaaagaggtattttgacattgaaatacccaattgagcacggtattgtgaacaattgggatgatatggaaaagatttggcatcatacattttacaacgagcttcgtgttgccccagaagagcacccggttttacttaccgaagctccccttaacccgaaagctaaccgtgagaagatgactcaaatcatgtttgagacctttaattcacctgctatgtatgttgccatccaggctgtgctctctctgtatgctagtggtcgcacaaccggtattgtgtttggaat

SEQ ID NO: 6756 - DNA, 226 bp, Gossypium hirsutum
  Clone ID: uC-gsronu33B046d04b1
atgtcagcccttcccatcattctcttgcccccgattccaggtatagaccctctactatgctaaaatctagaattttatccctgcactttaattcggtataatttaaccccctttacttttaataatgacgtaagtagcttcgaattaataacaccattaatgggtgctattaacgtagtgacatacaactttttcaaataattgtaattaagctttctattgacat

SEQ ID NO: 6757 - DNA, 100 bp, Gossypium hirsutum
  unsure (1)..(100): unsure at all n locations
  Clone ID: uC-gsronu33B046d06b1
cttttcttgttatttcatccncgctggaaactctggttcgcgtagtaatccattaaattctcctcgaacgatgtcacggcaagaaggctaagggttggca

SEQ ID NO: 6758 - DNA, 402 bp, Gossypium hirsutum
  Clone ID: uC-gsronu33B046d07b1
tcggctcctttgggtcaaaacacggttctcctcagaggtccaaagaattcccgtgaggcagttaaacactttggtcctgctcccggtgttcctcacagccacaccaagccatatgtgcgctcgaagggaaggaagtatgagagggctagaggaagaaggaacagcaagggatttagagtttaatattacttcactacttgattttgaggcctgtttgttatttagggtttctctttcagtttgttcacttgcctatgtttgcatttttattattgattgtttaattacttgtttgaagactatcctttttaagcgtttttaacgttatattttaccttaactcttgtatctttctttttgttatcaatttttttattctttttttttctgtctctctccttt

SEQ ID NO: 6759 - DNA, 315 bp, Gossypium hirsutum
  Clone ID: uC-gsronu33B046d09b1
ataggtgaagctggtagcgcctgcacggtaccggactcggaagtgttccggctcagacccacgcgtatctgattcatgtggatggagatgaggctctatattaatgaggaattttgaccttgaactacccaattgggcacgcgattgatgacaattgtagatgagcttgtagctgactagctgtgagccattatacaacctggctgtgcttgcctacctgctagtaaactcctgcaaatataaaaccaacttgaagctgataaataaaatcttacaggctaaaaacacatgcatttgtgtaaaaaaaataacccg

SEQ ID NO: 6760 - DNA, 359 bp, Gossypium hirsutum
  Clone ID: uC-gsronu33B046d10b1
tgctcatgcgtccggaaaactgttctttatgattaacatgtagttaatggtgggaagattatattacaacattttattaaatattttaatataaaaaaatatttttaatattatattaattattttcattataaataaattttaatttatataattataattattatattataaaaattacttattaattatataattttatattttttaaattttaataataatactttaatttttctatatattttttattttaataattaattacatttataaatattttttataacatatattaataattaatttatatttttatatattcattaatattttattttatatatattttaaatatt

SEQ ID NO: 6761 - DNA, 288 bp, Gossypium hirsutum
  Clone ID: uC-gsronu33B046e02b1
ccctcgcgttcgccgggacaacaatttgttgggtaaattcgagctctctggcattccaccagcacccagaggcgttccccaaattacagtttgcttcgacattgatgctaatggtatcttgaatgtctctgctgaggacaagactactggccagaagaacaagattacgatcacaaacgacaagggtcggttgtctaaggaagaaatcgagaagatggttcaagaagcggagaagtacaagtccgaggatgaggagcacaagaagaaggttgaagccaagaacgcatt

SEQ ID NO: 6762 - DNA, 699 bp, Gossypium hirsutum
  Clone ID: uC-gsronu33B046e04b1
ctgtaatcttatatatatacacttgatccatacaagaagtttatcgttgaacaattagacgagctattgaagtttgttgaatgttttgttcctttattttatgttctatctttctttttttattttcaatttctatttctctctctttctattttatttctttttttttctctctatatatttcctttttttttctatgtttttttcttttatcatttattcttttttttttttcttctttattttttttacttatttttttttctctttttattttcttactttttttttttttattctctttttatttttccttattctttctttctttttttattttttccttatttcttttatcttccttttctttctttttatttttttttttttcctatttcttgtttcatttttttattattttcttcttttttctatctaatttcttttcttttttttttttcttataatatttttcatttaccctcattttttttattaatttttctctcttattatctattctttatcttttttttttctcatttctactttttattctttattttattctgactctatttattcttatttatttattcttctttccttcattctattttcttttatcatttttttttctttatatctcaatctttttttttatcattatttcattctttctatcatatctttatttat

SEQ ID NO: 6763 - DNA, 719 bp, Gossypium hirsutum
  Clone ID: uC-gsronu33B046e06b1
cggtttcgtgtgctggtcgtaagatcattattgacacctatggtggctggggagcccatggtggtggtgctttctctggaaaggaccctaccaaggtggacaggagtggtgcttacattgttaggcaggctgccaagagcattgtggctaatgggcttgcccgaaggtgcatcgtgcaggtctcttatgctattggtgtgcctgagcccttgtctgtctttgtagacagctatggaactggaaagattcctgacaaagaaatcctccaaattgtgaaggagaacttcgacttcaggcccggtatgatcaccatcaacctggatctcaagaggggtggcaatggccgggttttgaagacagctgtctacggacactttggaagggacgacccggactttacctgggaaggttgtgaagccccttaagtgggaaaagccttaagtttaaaattcaacttttggctgttctcgagtgtctctaatcttatacataagatgccccctcaataattttcaatttctttttctaattcgaccttttcaccttaaatgggtcctctgcaaagctgtttccaaaaagtataaaaatttgttatttgatgccctgaagaacaatttcctttatattgttaaaggaattttgttccttttcaaaagaaaaaataatttttgctatatatttttttttttctctacttattctttctttactataaaagg

SEQ ID NO: 6764 - DNA, 58 bp, Gossypium hirsutum
  Clone ID: uC-gsronu33B046e08b1
tcgttctataaaagctggttcagattctgggccatgggtttctttataatattgattt

SEQ ID NO: 6765 - DNA, 301 bp, Gossypium hirsutum
  Clone ID: uC-gsronu33B046e09b1
tctcactgataaggctcattgcagttacgccgttaacagttacttccaaagaaaaggccaagctcaaggcacttgtgattttttctgcactgctaccgttaccaccacatcacctacaaccacacccttattcacaatactcttgtccgtgaacctaattaatatgattaaaacatgcttatctccttttgtttctacccacttacctgaatattgggtggagttgtctattacttttcgtttctcctatatataatttattaatttttttttctttaaattattcttttttttatcttta

SEQ ID NO: 6766 - DNA, 142 bp, Gossypium hirsutum
  Clone ID: uC-gsronu33B046e10b1
ttgcctgcgtccggccgttccttaacatcattcctagcagcactggtgctgccaaggctgttgaaaggattttactgtctttatggcaaactgactgtaattgtttttctatgttttatatttgatttatacatttttttta

SEQ ID NO: 6767 - DNA, 242 bp, Gossypium hirsutum
  Clone ID: uC-gsronu33B046f04b1
cccacgcgttcggaaagtacagtgtctggattggaggatctatcttggcatcactcagcaccttccagcagatgtggatttccaagggtgagtatgatgaatccggtccatccattgtccacaggaagtgcttctaagttttgtaattgcttttgatggtgatctacattttgcatttagttggctttttttgtgtgcggtgtcaagtgaactccaaagtctggtttatgtggggggagttg

SEQ ID NO: 6768 - DNA, 87 bp, Gossypium hirsutum
  Clone ID: uC-gsronu33B046f06b1
tctttcattcttacatcaatttttttctatatattctcttaaatttaaatttattatttttatttatttctattttatttattatta

SEQ ID NO: 6769 - DNA, 493 bp, Gossypium hirsutum
  Clone ID: uC-gsronu33B046f10b1
tttgattatagtgaagcttttgaagacctggtcaagcgcttttggattaagggttgtttgggcgttgaagctcaaaggtataccatatgaagcaattgatgaagatctgtccaacaagagcgctttgcttcttcagtataaccctgtccacaagaaaatcccagttcttgttcacaatgggaaccccatctctgaatcccttgtgattcttgaatatattgatgagacatggaagcaaaatcccatattgccccaagatcctctacacagagccagggaacggttctgggccaaatttaatgatgaaaagctactaccatcagcatggggtgctttcaccaaagaagggaaagaccgagaggaagctatggctgcaaccatggagaacctgaaattcgtagaaaaagagctgaaaggaaagaaattcttcaatggagagaagataggcctggtagatcttgttttcggttggcttgctaacttgatctctatt

SEQ ID NO: 6770 - DNA, 392 bp, Gossypium hirsutum
  unsure (1)..(392): unsure at all n locations
  Clone ID: uC-gsronu33B046g01b1
cttgttttttttgacttgcgctatcaacttgtcagtcaagactgtttttcttttatatgttgggaaatgtgggaattcagtatgttcaactgaaattaggagggatgttgtatggtagctatatttcacttgctagcaatttaccattggatttgttacataatggtgttttagttaaatgagaaatccattggggaaccctttatttgtaatttgtagagcttgggtgcctagctgcaaggggctaagttttgttggaattcatatattgtcttcaccctgagtaccatccgacttcaaaataaaaaaaaaaaaaaaaaaactcccncttttttctcttttctccttccttctctttttatacattcttttcccccctcttcttctttaat

SEQ ID NO: 6771 - DNA, 454 bp, Gossypium hirsutum
  unsure (1)..(454): unsure at all n locations
  Clone ID: uC-gsronu33B046g05b1
ccctcgctttcgattttcctaccgaaatttctgtgtcagacaaacaagtccacgagctactcagtcacacactctctctttctagatacagtgaattttcttttttcgcttctcttcatctattgatccctcgattccttagtgtttcttacgatgccgtctcgccgtagaaccctcttgaaggtcatcatcctcggcgatagcggggtaggcaagacgtctnnnnncaatcaatatgtgaataagaagtttagcaatcagtataaggcaacgatcggggccgatttcttgacaaaggaactgcagtttgaggannnggcttttcaccttacagatctgggatactnnccgccaggaacgattccaaagcctaggtgttgctttttaccgtggcgctgattggtgggtctttgtatacgatgtcaactcaatgaaattatttgaaaaccttaac

SEQ ID NO: 6772 - DNA, 436 bp, Gossypium hirsutum
  Clone ID: uC-gsronu33B046g08b1
tggcttgcatgagccatcacattcgtgagagaactgatgcactagatgctgctggaaacactacagctgccattggaaagggatttgccattgggtcagcagcattggtgtcattggctctatttggtgcctttgtgagccttgcagctatctctactgttgatgtcttgaccccgaaggttttcattggtttaatagttggtgccatgcttccctactggttctctgctatgaccatgaaaagcgtggggagtgcagttttaaagatggttgaggaggttcgcaagccggttaacaccattcctggtctaattggaggttgtccaaagctcttatatgctcctttggcaaaattctaattgatgcctttttaggggtaagtttcttttggggcccctttgtatatatatcccccttattttttggacactttttt

SEQ ID NO: 6773 - DNA, 108 bp, Gossypium hirsutum
  Clone ID: uC-gsronu33B046g09b1
ttgccctcgcgtacgcccacgcgtccgaccacgcgtgaggaaagtttgaaacacttcatgtattggaccaacataaagattacatagtattacataaatacatccatt

SEQ ID NO: 6774 - DNA, 318 bp, Gossypium hirsutum
  Clone ID: uC-gsronu33B046h02b1
cttttgtgtttgctattgaattctttccttcactttctcgagaaaaaaaaatgtcttcaggttgcaattgcggatctagctgcagctgcggcgacagctgctcatgcagcaggaaccttaaccttggatactcggagaagacaaccagcacctcagaccatcatctccggagttgcgccagtgaagatgacctttgagggaccagagatgaacactactgaatcaggacatggatgcaagtgtggatcaaactgctcttgtgatccatgcaactgttgaaaagctttgtgaaagccctagattattgaaaaaaagaaa

SEQ ID NO: 6775 - DNA, 537 bp, Gossypium hirsutum
  Clone ID: uC-gsronu33B046h06b1
gatcttctttcttttgagagggaatcatgaatgtgcttctattaatcggatttatggattttatgatgaatgcaaacgaaggttcaatgtgagactttggaaaacctttactgattgttttaactgtcttccagtggctgctctaatagatgacaaaatattgtgcatgcatggtggcctttctcctgatctaacaaatttggatcaaattaggagtataacccgaccaactgatgttcccgattctggtttgctttgtgatttactttggtcagatcctggtagggatatcaaaggctggggcatgaatgatcgaggagtctcattcacctatggcccagatagagtctctgacttcttaatgaaaaatgacatggacctttgtttgccgtgcccatcaggttgttgaagatggatatgaattttttcgctgacagacagcttgttactatatttcctgctcccaactattgtggtgaatttgacaatgctggcgcatgatgagtgtcgagaaagcctaatggttcattccaaatt

SEQ ID NO: 6776 - DNA, 52 bp, Gossypium hirsutum
  Clone ID: uC-gsronu33B046h07b1
tctgtattgttcaacctccttgtatcgcaccagagatagagaaagtaaattg

SEQ ID NO: 6777 - DNA, 347 bp, Gossypium hirsutum
  Clone ID: uC-gsronu33B047a01b1
cccatgcgttcgaatttctctaaaaaatctcgtaaatcccatactttaaatccaattcgccatgtgtggaggtgcgattatctccgatttcattccgcctgcgcggtcgcgactggtgacggcgaattatttgtggccggatctgaaaaaatcctgctctaaaaagtggtcgggtagaaagcactcgaagaagccggcggtcggctttgaagatgacttcgaggctgattttcaggcgtttaaggatgaggattctgatgttgatgacttccattatgttgctgttcattttctctctctttattactatctcatctctttttctctcctttcccttctccatgagt

SEQ ID NO: 6778 - DNA, 403 bp, Gossypium hirsutum
  Clone ID: uC-gsronu33B047a02b1
aaaccactctcacattaaatattgttagtgaaacaatggcgtcttcagctctgataagtaagcttgaggcagatgtagagattaaggcttctcctaagcagttccatgaaatgtttgcccacaaaccgcaccatgtgcaccatacttgttatgacaagattcaaggatgcgatttacatgaaggtgaatggggaaagtcggtaccattgtccattggagttatgtgcatgatggaaaggctaaaaaggcaaaggaagtagtggaagcagtagaccctgataagaatttggtcactttcagagtgatcgaaggagatctaatggaagagtataagagctttgtaatcacgattcaagtttcgcccaagagcgagggtagtggcagcgtagtgcactggactttg

SEQ ID NO: 6779 - DNA, 259 bp, Gossypium hirsutum
  Clone ID: uC-gsronu33B047a05b1
ccctgctttgcgtccacacgtgcgaacctatatgaggaagatgcagtcataaaccaaagtgcagactcgatcgaaagaatataggcaaacttcaataaaggaaggaacccaccataccaacaacggtgtgatttttgtcggaaaacagttcgaagatggccggaccttggccgattacaacattcagaaggagtccacccttcatctcgtactccgtctacgtggtggcatgcagatctttagtaaaaccctgaccggc

SEQ ID NO: 6780 - DNA, 344 bp, Gossypium hirsutum
  Clone ID: uC-gsronu33B047a06b1
cccattcttctcgcaaaatcctagacaatttctggaggtgacaccatgttgcagcactaattgggtcccacctcttgtcactttacccttgctaatatttgttgtccttaaacttactgtgcaaggtttcttccttttgccccctgtttaatcaatacatcatgtaccgtcctttttagattcgatttaagattcacagttgcatgattttgcggccttaatatagcgtattggttggttgatgaacctgataaaaggagatggtaccgagagttttttgttcttttggtttcctgtcaacagagagatgaggaaatcttatgatgaattcgatctactccaac

SEQ ID NO: 6781 - DNA, 421 bp, Gossypium hirsutum
  Clone ID: uC-gsronu33B047a07b1
tcaatcgtcttttcttttaatatttgttcaaagctttcgattacaaatccctcgcgaaagatgcagatctttgtgaaaactcttactggtaagaccatcaccctcgaggtggaaagctccgacacaattgataatgtcaaggccaagatccaagacaaggaagggatcccccctgaccaacagaggcttatcttcgctgggaaacagcttgaggatggccgtacccttgctgactacaacatccaaaaggagtccaccctccatcttgtccttcgtctcaggggtggcatgcagatcttcgtgaaaaccctcactggcaagacaatcacctttgaggttgaaagctccgacacaattgataatgtcaaggctaagatccaggataaggaaagggatccctcctgatcaacagaagcttatc

SEQ ID NO: 6782 - DNA, 383 bp, Gossypium hirsutum
  Clone ID: uC-gsronu33B047a08b1
tctcctctcgtccgcccacgcgtccgctgtgattggggtcatagcgatgtgtcggatggagatgatgatgaaaatctggagaagtctgcagctggatctagagtcaagtctaagaggagcattgcaggattagcaaagtgcacagcaaatgaagatggaattaatattgcagacttgattggttacagaataaaagtgtggtggcccatggataagaagttttatgaaggtaccatcaagtcttatgaccctataaaaaggaagcatgttgcattatacgatgtggagaggggggaagtactccgtttggaaagagagcgctgggagcttgttaatgcgggccgcaagtctataaagaaggcaaagtcaccaaaaggcaccaa

SEQ ID NO: 6783 - DNA, 275 bp, Gossypium hirsutum
  unsure (1)..(275): unsure at all n locations
  Clone ID: uC-gsronu33B047a10b1
tccgtctcgtccacacgtacgctgaccggcaagaccatttcttttgaagtcgagagttccgacacgatcgacaacgttaaggctaaaaccctcgacataggaagggatcccaccagaccaacatcgtcttatcttngccttttattcgctcgaagatggccggaccttgtctcgttatcatatttttatagggcgtttaccctccatttagccctgcttacaatcgcgtgctatcaacatcttattttttttcctgaccggcaagaccataactt

SEQ ID NO: 6784 - DNA, 551 bp, Gossypium hirsutum
  Clone ID: uC-gsronu33B047a11b1
tcggtgaagctcttcataaaggatggatccatttagattggccaattcgacaccaaatagcacttggggtcgcacaaggcttggcttaccttcaccatgatctgttgacacctattattcacagagacatcaagtcaaccaacatcctattggacgccaattatgaacccaaagttgcagatttcggaatagccaaggttttacaagccagaggaggcaaagattcaatcattaccgtcatagcaggcacctatggctatttagccccagaatatgcgtattcaagcaaagcaacgaccaagagtgatgtgtatagttttggagtggtgtcttttggttttccctttttttattataccttcttcctttttcaatttcaaatatctttaatctctttactttttttattcttatttcctttttcttcctatgtttatccttcttccaattctattcatttttgttcattctccttcttttttttttattttttatctctttttttttttttttaatccaattttttttcttcctctcaatctctcttttct

SEQ ID NO: 6785 - DNA, 548 bp, Gossypium hirsutum
  unsure (1)..(548): unsure at all n locations
  Clone ID: uC-gsronu33B047b01b1
catttctaataattataaaaaaattgcttttaccatttttcttcatgggcttagattgaaatctccaggttttttttttaatatccgtttcaaattttggggatttgctatcaattttatgtagtagaaggaaattggagcctttctaatacttaaaataatagatatcccttccatcggcttagattgaaaatctccaatttttcctttgatttttagctttatttatttttcaacaaaactaggtnttcggtttcaaattttgggggattttgctatcaatttatgcagtagaggaagctagggcctttctgaaaaaaatataattttacctttcttgggtttagattgaaatcttttttttttttcctttgatttttagctccacgcttttttccccttttaaataattgatctattggaggtgggagggtttcaatttggtaaatccattgaattttgagggcctgggctataaatactgaatttgactctattcccagggaagagtagcttaaataagccccttgtgggatgggtattattga

SEQ ID NO: 6786 - DNA, 478 bp, Gossypium hirsutum
  Clone ID: uC-gsronu33B047b02b1
catctatagaagcgaaatggctggttccagggttgctcatgctaccttgaaaggaccaagtgttgttaaggagatagttatcggaataacacttggcctttgtgctggtgggctttggaagatgcatcactggaatgagcagaggaaagtgagagcattctacgacatgctcgagaaaggtgaaatcagtgtcattgcagaagaataaatgttcttttagtcttgtgaaagtgtggacagcttcagctgtgtttcgttatatgcattctcttcatttggctcttagatagaagatgagcaaaacacaatttggagcttctaagaataatgtcatcattttgggatcttgatttcatatttgcatagcaaatccaagcgatttttcaatctagtgcctttgttggtttccatttgacattgttgtttgatttggagatgtttgaaagctctttatatttctactcaattggtatttgtc

SEQ ID NO: 6787 - DNA, 428 bp, Gossypium hirsutum
  Clone ID: uC-gsronu33B047b04b1
aatcttttatgcccattcctacatggctcaacttccctccctcttctgtcaaaacccaactcttctccccctcaccaaccccttcgatccccggcttttctccctccaatcagggcaatgaaatccatgcaaggccaggtcgtttgtgccacaaatgacaagacagtggcagtggaagtggtgcgtttagccccgcatcccaagtacaagaggcgtgttaggaagaagaagaagtttcaggctcacgacccagataaccaattcaaagttggcgattatgtgcagcttgagaagagccggcctattagcaagaccaagactttctttgcggtggctgtaccaaggaggaatgggaagcaggagaaggaggaggcaggggagcttgggattccattggagtctaaacagactcaagagcagccgcaagc

SEQ ID NO: 6788 - DNA, 255 bp, Gossypium hirsutum
  Clone ID: uC-gsronu33B047b06b1
tgttgtatcgtttctgagggaacccttgatcttgatgaggtttttctttggttgaggtttctcaacacaaccatgctaaagactgttgtcttttctctcttttttaaataatttctatagtatttatctttttggaggacccaccctggtggtgatgatgtcttgctgtcttccacagggatatgtgcatctgatgattttgaagatgttggccatagtattagtgctcgagcaatgatggatgagttttatgtg

SEQ ID NO: 6789 - DNA, 432 bp, Gossypium hirsutum
  unsure (1)..(432): unsure at all n locations
  Clone ID: uC-gsronu33B047b08b1
ttttggcatggagcttctttgcacacaagataatccagagtacaagtatacaatagccatgatgggctatgggcctgaagaaaaaaatgctgtgcttgagttaacatacaactacggggtcaccaactacgagaaaggaaatgactatgctcagattgcaatcggcacagatgatgttttcaacactgcagaggctgttagactttttggtggaatagtcacccaggaacctggacctttacctggtattaacatcaagatcactgcatgcttagatcctgatggttggaagacggtttttgttgataatattgatttcctcaaggaaatggagtggagttttaggtaattatttctcacacttnttctttttgaaatccaactccgagctgaaaggatttgcggcagaaattaaatccggcttgagcacac

SEQ ID NO: 6790 - DNA, 341 bp, Gossypium hirsutum
  Clone ID: uC-gsronu33B047b11b1
aaggggaaactgtattgtgttgacaccttgaacattatcactaacccactacatatgcgcagtcctcatgtcttcccacaactaccttctgcattaagaaggtacgatggagtgttacttatcggagctccaaaagcttgccacaaaacttattggtttcatgggaaaagcactgaaaattaaagaaaaggagatgatggagctgtttgatgatgggtcgcaagcggcgaatatggcataatatacttcatgcccacatccagtagtggtgatgggtcttattccacactctgatatgaccctttctactattctacactaactaaaaggtgtggatggtc

SEQ ID NO: 6791 - DNA, 498 bp, Gossypium hirsutum
  Clone ID: uC-gsronu33B047b12b1
agcgcaccggtttgtctcgcgtccgaaaaatgggtggagaaagaaaggtctacactttggctgaggtttctcaacacaaccatgctaaagactgttggcttgtcattgagggcaaggtatttgatgtgactaaattcttggaggaccaccctggtggtgatgatgtcttgctgtcttccacagggaaggatgcaactgatgattttgaagatgttggtcatagtagcagtgctcgagcaatgatggatgagttttatgtgggtgacatcgatacatcgaccattccctctaagaggaagtacactcctccaaagcagcctcactatgaacaagacaagacctcagaatttgtcataaagcttctccaattccttgttcctttgctaattttgagattggccttcggtattcgcttctataccaaaacaccaatttcatcttaagcattgagactccaagagattaattgagcaatcttcacattagaatatgctagtt

SEQ ID NO: 6792 - DNA, 169 bp, Gossypium hirsutum
  Clone ID: uC-gsronu33B047c01b1
atctttacataaattctaccggtacaactcgtgatgatggtgaaacggttggaatggagacagagggttttgccatctatgatgcacttatgcaattaccaaatgagatacatacggtcgctgttggggctgcaataagtcaagcttggtttttactttcaacaagaac

SEQ ID NO: 6793 - DNA, 257 bp, Gossypium hirsutum
  Clone ID: uC-gsronu33B047c02b1
cttgaaatgaagaggggtagcattagcactcaaattaagtgttttttatgacttgttgctgccctgccagcccggccactgtattttttttgtttttttttcctgtcgagatagtatatctgcttcttataatcaggaccatctgacatctgttattttccgtgaatactgaatcatgcttttgttgttttgttatgtttgtgttaataatacataacaaaagtttaatataaaaagggaagaagaataataataat

SEQ ID NO: 6794 - DNA, 173 bp, Gossypium hirsutum
  Clone ID: uC-gsronu33B047c07b1
ttcctcgcgtccgcccacgcgtccggttagttgctcatcgtggcattttcactatgataaaaatatacatctcccatatttgatcaattttatcgtttctcctttgatttccgcttaaccagtgggaattagttaaaaaaaaaaagaaaaaaacataaaaaaaaaaacaaaaa

SEQ ID NO: 6795 - DNA, 56 bp, Gossypium hirsutum
  Clone ID: uC-gsronu33B047d01b1
aaattaaaaaaaaaaaaaaaaaaaaaaaaaaaaaaaaaaaaaaaaaaaaaaaaaaa

SEQ ID NO: 6796 - DNA, 300 bp, Gossypium hirsutum
  Clone ID: uC-gsronu33B047d05b1
gcggcctctgttgggaagaggaacaaggggtcttattggactgtttttaattgaaggaagctaccccattaaccacccggaggagtagagagggggtctggtatatttgtatatagttcgttttatcccatatctagttttggtgcgtctcacataggtagtttctatacattcttaaaccctacatccaagaagaagaaactcctctatcgcttgaagaccatgcccgcatttgtttagacccaaacactttaaagattcacttttgctattttgcttgccttttaaaaaaaagagaac

SEQ ID NO: 6797 - DNA, 130 bp, Gossypium hirsutum
  Clone ID: uC-gsronu33B047d07b1
taactctcatagaaaaaaaaaaaaaaaaaaaaaaggaaaatataaaaaaaaaaaaacaaaaagggccgccccttttaaagaaccaaggttaactacccctggatgccaaggtataatttttttttagggg

SEQ ID NO: 6798 - DNA, 108 bp, Gossypium hirsutum
  Clone ID: uC-gsronu33B047d09b1
tagtcggagcacgacccctctttttggacccaaggcttttttttttctgtttgccccattttccctcctatattatatttttaaaatttttaaattttcttatttttt

SEQ ID NO: 6799 - DNA, 476 bp, Gossypium hirsutum
  Clone ID: uC-gsronu33B047e01b1
gcggccgtgacttcttcagaaactatctttccctcaaaaatggttactttcaggtttcaccagtaccaagtagttggaagggctcacccaacagagagcgatgagcatcccaagatctataggatgaagctctgggccaccaatgaggttcgggccaaatccaagttctggtacttcttgaggaagctgaagaaggttaagaagagcaatggtcaggtccttgccatcaatgagatatttgagaagaaccctaccaagattaagaattatggtatatggctccgctaccaaagccgtaccggttatcataacatgtacaaggaataccgtgacactactctaaacggagctgttgaacagatgtacactgagatggcttctcgccacagagtccggttcccatgtatccagattatcaagactgcaactatcccagccaagctatgcaagagagatagcaccaagcaatttcacaa

SEQ ID NO: 6800 - DNA, 421 bp, Gossypium hirsutum
  Clone ID: uC-gsronu33B047e02b1
ccctctcgttcgcccactcgtccgcccacgcgtccggattcttgctatttgccttttcacttcgttgtcctccatcatttcttccgaaaccaactcagatttctcaaacagctttcattttcgattgttttcatgattggctttcaaccatttgaatctttcttaatcgaggtagtttgctttttcaagttaaataatgccccgcgaagcatataatcaaaacattatctcgctaaccttttctctctttagcttttgatcgactacacattacatggtcggggcttttcttgttcgagttcagctcagctttgttaagatgctgctaattggtgcacttggtagcccgtaatttgttttttgaaggaacccgtaatttgttttttttaaggaaatgagctactggcttttgggtggaaaa

SEQ ID NO: 6801 - DNA, 541 bp, Gossypium hirsutum
  unsure (1)..(541): unsure at all n locations
  Clone ID: uC-gsronu33B047e03b1
gccaattgccgatcacacttttgtctgaaaccagcaacaatggtggaccaactcaccgacgaacaaatcgctgagttcaaagaagcttttagcctcttcgacaaggatggtgatggctgcatcactacaaaagagctgggaacggtgatgagatctcttggacaaaatccaactgaagctgaactgcagggtatgatcaatgaggtcgatgctgatcaaaacggcaccatcgacttcgccgagttcttgaatttgatcgcacggaaaatgaaggataccgattccgaggaggaacttaaggaagctttcaaagttttcgataaggatcagaacggctttatttctgcagccgagctccggcacgtgatgacgaatctcgnggaaattttgaccgagagggaagtcgatgaaatgattcatgaagcagataccgacggtgacgggcaagtgaactatgagaggttgtaggatgatggtggccaagtgatgacactgcttatttgntatcttatgttaagcagcatgagcactgtttctaata

SEQ ID NO: 6802 - DNA, 312 bp, Gossypium hirsutum
  Clone ID: uC-gsronu33B047e07b1
cactcacctcagctatcgaaatcctcttcttgctgtacactctcccaacgttcaacccctcgtcttccctttgccttctcacccttgcctgcctcatggagtcgaacaaatgcaagatctccccatttcctctcttccccacattggtaacgcctcgagaaaactctaccacccttggggtcaatggatgcgagcccaacaatcaccatccgtcgcgacactatcggaaatagtgctcagaacccggacaggaaacagaaccttggattatagtatcccaaacatatgcttagcgcctttcatagcaggtgc

SEQ ID NO: 6803 - DNA, 565 bp, Gossypium hirsutum
  Clone ID: uC-gsronu33B047e08b1
tcctcgcgtccgctgtatctccggatgacctgattgctcttgcacagcaatatagctctgaattgctacaaggagagcttgagaggactcgcatcaatacagcatgttttgtggaatcactccccatggaatctgctccagactcggtaaaagctgcatatgcatcttttagaggtccaatggactctcccagcaaaaattacagaggcacacaagcaacgggatcccctagtttcactcagcgtaggcgcagataaattagagccaccccagcagcagccatattcttcgtaaaaagtaaaaatttcttcattttgattttgattttggttctcatttgcattgttgtgcttcacttgttgacgatacatatgattttgtaagacatgctttttttttgtgttaggtttaatttcactcatctttctacttctctatttgggtgtgccatactttttcctttttatttctttccctgttttttttatatacttactctattttttttactttcttttttctcaatcttattccctcttttatttttaataaatttctctaatac

SEQ ID NO: 6804 - DNA, 441 bp, Gossypium hirsutum
  Clone ID: uC-gsronu33B047e09b1
ttcttggtccagcaggcaaggaatgaagcagctgcgtttcgtttcagatatggctatgagatgcctgtggatgtatagaccaaatgtacttccatcaaaaaatattagtatctctctctattctcataatagtattctttcatatttctttttacgtcttttataacactttttttaggtaaaaacccttgggttacccaacctaaattgctttgaaaaaaacccccttttgccaagtggggtaaaaaccaaaaaggcccgaccgaatggcctttccaaaaatttgccaaccctaattgggaatgggaccccccctttaaccggcccataaacccgctggtgtttgttttttaacccccaaagtgacccgttaaatttggcaagggccttatggccggttcttttggtttttttcctttcttttttggcaaggttggcggg

SEQ ID NO: 6805 - DNA, 559 bp, Gossypium hirsutum
  Clone ID: uC-gsronu33B047f01b1
tctgttaagatctgcaagaattacttcattgtcatctgcattgacttctgcagagagattagttgaggcatattttcgaagaaatgtggtgggaagaaatcaggagcagccaccaccggttaacgatagagattccttgtcgagcaatgctgcagtaataaacacggagagtcaattagatgctgcggtcgaaatagactctgcgatatcagtctcaacttcatcttctagtagaagaaacaatgtttcaagggttttggatgtggatggcatcaaccctcgatcggttaggagaagactgaactaggagctagaaagagtttttatcatatctcaatgtcatgaaattgcccagcattgcgcttgtattgcttttttctgttttacaaagaatttagttaatcataaagctttcaaatatgttatgctcacattatgacaatgaaattgtcaatcatcctttataatgatccggcaattaacgaagggattgtgaagttagaaatttaattcgacgttatgcaaggttgggttattcttttgagcttttagatccgat

SEQ ID NO: 6806 - DNA, 563 bp, Gossypium hirsutum
  Clone ID: uC-gsronu33B047f02b1
gtgttgtgctcttttggtcttgactccattatttgaatacataccacagtgtgctttggctgctatagtaatctctgctgttataaccctggtggattatgaagaggcaatattcttatggcgtgtagataagaaagattttcttctttggaccattacaactactacaacattgtttctcggaatcgagattggtgtccttgttggggtaggcgtctcacttgccttcgtcattcacgaatcagcgaatccgcatattgctgtcttggggcgtcttcctggcaccactgtttataggaacattcagcagtatccagaagcatatacttacaatggaattgtgattgttcgtatcgatgctcctatctactttgcgaacataagttacatcaaagacaggctacgagaaacgaagttgtgggtaataaatcgaccaaacgtggaccagagttgaacgaatttattttgtaatttggagttggcacctgttacatacatagacgcgagtgctgttcaagctctgaaagacttgcaccaggaatacacatcacgggacatccaga

SEQ ID NO: 6807 - DNA, 483 bp, Gossypium hirsutum
  Clone ID: uC-gsronu33B047f09b1
tccacgcgtgcgcggacgcgtgggaaaaaacatggccaaagttctgttgttcattgctctatgtgtgcttccagctttggttagtgctacacgcattctgaataaccaattggtggttgaaggctatgtgtactgtgatacttgccgtgctggttttgaaacccctaagactagaaggctagctgatgccatggttaagctggtatgctccgacaggaagaccggcggagttgttttcgagaaggagggatataccgacaaaaccggaaaataccagattcgtgtatccgaggatcacttggatcagatctggattgcagttcttgtgaagagcccccagctgggatgtgccacattgtcccccggtcgtgaacgtgcccgtgttatcttgaccaactccaatggcatttcatccaccacccgttatgccaatagcatgggcttcatggttgacaaggctgaagttggctgtgctgagatgat

SEQ ID NO: 6808 - DNA, 146 bp, Gossypium hirsutum
  Clone ID: uC-gsronu33B047f10b1
tattaacctcttttttcttgggcaatgattttcattgtaccaaataaaaggggtgtatgctagagatgattattacttatttgtgttgtaaccaagtgttgtgatgtatatcagtctacctatatatgaatttggaacttggtatt

SEQ ID NO: 6809 - DNA, 871 bp, Gossypium hirsutum
  Clone ID: uC-gsronu33B047f11b1
ataagatccagatgtttgaaactgtaagttcacatgcgtgacagaacatttcacttgagttatatgttactcggacttggtttaagcatatactcgagatcggtctgttttaattcttcttatgtttgatttttgaacttggttttttaatatttatttatttttttttttttattttatattattttttggttttcctttttatttgtttctttttttctttctctttttttctaattcatattttttatattttgtttttttttattttattcactttccgttattattactttctgttttatttttatataattctttctttaccctttttattcatttttttttttcattacctctttttctatgttgttttttatttcttatattgtctgttcttatcgcctctttcctatttttcgttttttttttattttttcatttttctcttttctttttttccttttttttttttctcgttttctttttcttgtttttttttctattatttctatttttatttgtttattttttttttttctctatctcttttttttctttttattattctttacgtttattttcattattttttctcttatctttttatttgtattttcttttatttcttttcgttctctttctattgttttttgcacctattaatttttttctgatttttcttttttttcttatcattcttatatttagtttacttcctttctatttttattttctttattattttctgttcctattagtatatattctcttccttttttttattatttatattcttccttttctttctctttattattttttatatttcttttttttttttttttttttttcttcttttatttctttt

SEQ ID NO: 6810 - DNA, 628 bp, Gossypium hirsutum
  unsure (1)..(628): unsure at all n locations
  Clone ID: uC-gsronu33B047g03b1
actactatgggtggttggccgcccgcctgccggaccggaacgtactgggtcggacccacgccgtgcggccttcttcttgaaatgggctgtccactccttcagaatcaccaactgcggtgtccaggacactacccagatccacactcatatgtgctactccaacttcaatgacatcatccactcaattatcgacatggatgctgatgtgataaccatcgagaactcacgttcagatgaaaagctcctttcagtattccgtgaaggagtgaagtatggtgctggaatcggccctggtgtgtatgacatccactctcccagaataccatcaaccgaagagattgctgaccgaattaacaagatgcttgctgtgcttgagaccaacatcttgtgggttaacccagactgtggtctcaagactcgcaagtatgccgaggtgaagccagccctgaacaacatggttgcagcggccaagctgctccgcacccaacttgcgagtgccaagtgagaggcatatctgaggtcggacatcatcctttaattcgagatggtccagaggaaatntgtcttaaatcatttgaataactgtgtgttgaagtaatttgtaggcgtatcatatgcccctctttta

SEQ ID NO: 6811 - DNA, 318 bp, Gossypium hirsutum
  Clone ID: uC-gsronu33B047g04b1
cgctcgctcgggctgacgcgtgggtgcctttatcctccattcgactgcgattgcgacggagtagaaggaagatcggccaccaggtaagctcgttctcctttcccttttctatttccttcacttttctcttgttcgtataaaaaaacaaaagaaaacagtaaagaaacgcacagtaaaaaaatggtgaacccttctcaaatctgatttcttttcctttttgattgattatttttttgtaattcaatatgctagaaaaaaaagatcctcgaaacatttcataaatgtggtctttatatcccctaaaattcattgcatttt

SEQ ID NO: 6812 - DNA, 260 bp, Gossypium hirsutum
  Clone ID: uC-gsronu33B047g07b1
cccattcgtccgctcacgtacttaaatagagaccaccttgtctcctacgagatcaagcgtgctctagccatgattcttgccacattctatactataacggtagctctcgtacgtaaatcccctgtgagtagctgcaccagcaagggacaggcaccggataggtgccccacctctaataccaagtgcatcgcagccccattaggccctcattccggaatcgtatgcgatatggaacaacctttgagccctagatttgcgag

SEQ ID NO: 6813 - DNA, 60 bp, Gossypium hirsutum
  Clone ID: uC-gsronu33B047g08b1
cctcttagttttctgatacaagactctgtataacgggtaaacctgctattttgactgatc

SEQ ID NO: 6814 - DNA, 84 bp, Gossypium hirsutum
  Clone ID: uC-gsronu33B047g11b1
ttctattcaacgacggatgtaatagaaaaaattttccctcagacaattttaccctgtgtttcttcacccctcgactgtcaattc

SEQ ID NO: 6815 - DNA, 165 bp, Gossypium hirsutum
  Clone ID: uC-gsronu33B047g12b1
ttctctcgtgcgagtaatgggaggggatagaggggtgcacactttggatgagggttctgaacacaacctagctaaagactgttgaatagacattgcggacaaggtttttaaagtgactaatctcttggtggaccaaccaggtggtgttgatgtcttgttttcttc

SEQ ID NO: 6816 - DNA, 163 bp, Gossypium hirsutum
  unsure (1)..(163): unsure at all n locations
  Clone ID: uC-gsronu33B047h06b1
agtccagnacttcacttatggaataactgaaactcgactctnacagccagggggctttcacttcatattgccccccgcactcccccctctcctttatctttcctactcttaacataccgtcaactcgctacatcccagtttttctattgatttcccccccatc

SEQ ID NO: 6817 - DNA, 61 bp, Gossypium hirsutum
  Clone ID: uC-gsronu33B047h08b1
tgacatggcttagttttagagaccatcactgcaaaggtactttaaagcttgacaactacaa

SEQ ID NO: 6818 - DNA, 61 bp, Gossypium hirsutum
  Clone ID: uC-gsronu33B047h10b1
agtccttcctctcgtacgctacagaagaccaaaaaagaaatgaactgtttaagaatccccc

SEQ ID NO: 6819 - DNA, 432 bp, Gossypium hirsutum
  Clone ID: uC-gsronu33B048a01b1
gtttaaacggttttagaaaccatcaactttttccttccctccaattctctcttgctataataaaccagtcttcttcttcttccactttccttttcttcttttgcctctctccaaacaaacaacaagaatatatatattatatatatatcaaaaaagagatttctcactcactctctttcgctgttctgaagagaaaatcactagtgttacagttaaggttcaggtgagcgtcaaattttctcaatttcaatgaaatctactttctgatgttttttattcgatatcattttttttagatttttttgctgttattcctaaaagcttttccaagcttcgttcggaaatgcaaaacgacaattttgcaaccgtctatggcgacctcgcagccaagcaatcgaaagatcaccagaggacggagttttctcttcttca

SEQ ID NO: 6820 - DNA, 306 bp, Gossypium hirsutum
  Clone ID: uC-gsronu33B048a12b1
ctaccttaacacaacttaccaactcaaaaaccccaagttttcactttcaaaaaacttcccacattcaccatgtctggcacgtgcggcaactgtgactgcgctgaccgcagccaatgcacgaagaagggaaacagcaacaccatgatcgttgagactgagaagagctacatcaacaatgttgagatggatgctccagctgagaacgatggcaagtgcaattgcggtactggctgcagctgcacagactgcacctgtggccactaagccaacatacaatggtcatgcttcagaacatggcatattaag

SEQ ID NO: 6821 - DNA, 596 bp, Gossypium hirsutum
  Clone ID: uC-gsronu33B048b01b1
cccacgcgtccgattataccattcactgtattattggaaactgtcttcctcaaaaagcaattcagtcaaaagataaagctatccctcttccttttgcttggtggaggtggcattgcctccattactgatctccaactcaattttgttgggacaatcctttctctccttgccattgcaaccacctgtgttggccaaattctgacaaacaccatacaaaagaggctcaatgtgtcttcaacccagcttctgtaccaatcagctccatttcaagcagctattctttttgtgtcaggccctttggtagatcagttcctcaccaatcaaaatgtgtttgcttacaaatattcccctatagtcctggcatttatcgtactctcctgaattatttctgtatctgccaactttagtacgtttctggttattggaaaaacattcccaagttcatatcaagtacttggtcacctcaagacttgcctggatctttgctttcgctatacactgctgcatgaccctttacagacagaacatcttggaattctggaagccattttgcatgggttatattcatatttgccccagagacaaaagaacagctg

SEQ ID NO: 6822 - DNA, 399 bp, Gossypium hirsutum
  Clone ID: uC-gsronu33B048b09b1
gacgtcatagatcttttatagtgttacctaaatttaatttactgtcctttgtttaacttactattatagttctattttatattcctctatttcattgagatttattatatttaattatgattattttcatattatatatttttatttactgcggttaatggtttattgtattcttataactttttttttttatggtaggtttagaatttttctctatatcatttttttttatattttttatttcttatcaatttttttaattacttttatatttttttcttgaaatattttatctttatttctttttacaatatattttttcttatttctttcttttatttattattatatatctacttaacttctcttttctaattgtattagatttctttttatatt

SEQ ID NO: 6823 - DNA, 197 bp, Gossypium hirsutum
  Clone ID: uC-gsronu33B048b10b1
tttcggcttctcttccacccacctcctttgtttcacctctttctttctttctcccctaaaccatcatgaatctcatctataggcttagtcctaagcgttcttttttcgatctaccattatcgatagattctctcgtctctcatgtttgacccctcctcctatagtttcgtcttctctcttctctctcttttcttcct

SEQ ID NO: 6824 - DNA, 76 bp, Gossypium hirsutum
  Clone ID: uC-gsronu33B048c02b1
aaataaaaaaattaaaaaaaaaaaaaaaaaaaaaaaaaaaaaaaaaaaaaaaaaaaaagataaaaaaaaaaaaaaa

SEQ ID NO: 6825 - DNA, 324 bp, Gossypium hirsutum
  Clone ID: uC-gsronu33B048c03b1
tttttttttcgcatataaactgaaccagaatatgctcattcaacaacaagaggattaacatacaaagaaaacattacatgataacaatggcatacaagaaaatggaacgagctggccgccgctcttatttgtaagtactgatctatctatatagccatagaagtggctcagttcttcggatggctaggtgatgggagcttctccaatggagggtgtcctggatagtgaccagaaggtggtttttttggatgttcataaactggtggcttgggttctggtttctctttctttggaggttcgtggattggtggctttggtggtatt

SEQ ID NO: 6826 - DNA, 125 bp, Gossypium hirsutum
  Clone ID: uC-gsronu33B048c10b1
taatagaaagtgcatcccctttcttttttgttcctcacctccctaaacctcttttaccatattggggttctcagcttttcactttagtttatctgaacaatgcaagtctgctgtgatcttgaagt

SEQ ID NO: 6827 - DNA, 118 bp, Gossypium hirsutum
  Clone ID: uC-gsronu33B048c11b1
tggtacttaattaacctttgggatttgaaacacattgtttatgtaacgccccgaattttgttcctagaagatttatggaattattgtatttaatttatttaatattttacttttttta

SEQ ID NO: 6828 - DNA, 393 bp, Gossypium hirsutum
  Clone ID: uC-gsronu33B048d02b1
caaatgcatactgattgggtacgggatgttgcttgggcacccaatttggggctaccaaaatcgaccattgcaagcgcttcccaggatgggaaagtaattatatggacagtggccaaggaaggggatcagtgggaaggtaaagtattgcatgatttcggtacccctgtgtggagggtgtcgtggtcattgactggaaacatattggctgtggctgatgggaacaacaatgtgactttgtggaaagaagttgtagatggtgaatggtttcaggagactgttgttcgagccataattttttaacttttttctatcgaaatattacgcttctctttattactttgttcttttgttatttcgtttattcacttttattttcctatatttcttattttt

SEQ ID NO: 6829 - DNA, 353 bp, Gossypium hirsutum
  Clone ID: uC-gsronu33B048d05b1
atcgtaaggagagccattctaatcatgcaccagagaggtgaagttgaatatcaacgagaaaggcatattatcgttcgtaaagtataaatcttgcggttgtaatgtttggaaccgaaattatcagggcagcagttttattgcaagatgaagttccaaattccaattgtagtggtggtcttgatcaggaatgaccgggctaacaaaaagttgtgtaatgttatgttgtacgtctctgcaacttgttttgatcttacattttaatggattcagtggatggattgtctcgagactgaaaaaaaaaaaaataaaaaaaaaaaaataaaaataaaaaaaaaaaaaataatataataaaa

SEQ ID NO: 6830 - DNA, 549 bp, Gossypium hirsutum
  Clone ID: uC-gsronu33B048d07b1
gaatccctgtttcaagcaagattgaacgatgaaaacctattaatctgtgtactgtaggaatgttgctagcgattgtatcagtcagaccgggctgttttgtattattgtatgttattttttatttttttatgtgtatctattactcttttttttatttctttttgtatttttttcttattttattttatttttctttacctctttcttcattctttattttatattattctctctaattttacttttattattattttcttttttttatctctccttattttctcattttatttatatttttttcttttcaattttttttacaattattatttatatgtttacttttatttttatttaattgtatattttttttctttttatttctttacatatttttatcttttttttatttttactcttttttatctattctatatattatttatatattttttattattctatttttttcttttatcatttatatctttatattttaacatttctttctattattatattctacttttctttttttgtctttttttt

SEQ ID NO: 6831 - DNA, 341 bp, Gossypium hirsutum
  Clone ID: uC-gsronu33B048d11b1
aatgcgaaccctctcttctctagaaaccaccgtcgagccatggctctaatcacccgaaccaccgccaatcgcctccctcacctcctctccctacagcgtgccctcgctattcacaccaccgtcccttctctctcctcttctgccaccccaaccacatacgctcgcccttctccgccgtccacctccggcactccctccagtctgtctaagcctgctgagtacgtgatctccaaggtcgatgaccttttgaactgggcccgtcgtgggtccttacggtccactccttctcttcctctcccatagccccccttcttaccatacacttttttcctttttttctc

SEQ ID NO: 6832 - DNA, 214 bp, Gossypium hirsutum
  Clone ID: uC-gsronu33B048d12b1
tcgccctcgcgtccgcaaatttcaagagcaaaccaaaaaaaggctgcaaattcagcttttcaatatctgcttttgatcaatcgaaatggcttcacaagttttctcaaatgcctttcttcatcacccctttcttccaataaggatgaaatccgtcccaaagccgattttcagcctagcatttggggagatttcttcctcaattgttctttccatg

SEQ ID NO: 6833 - DNA, 911 bp, Gossypium hirsutum
  Clone ID: uC-gsronu33B048e04b1
gtgtgagcattctggtccaatcaatattggaaacccaggtgaatttaccatggtcgagcttgctgagactgttaaggatgttattaatccctattttatatattatattatttttataatatttttttagtttttttctatcttattttatttatttttttttttttttttttttattttttattctttttattttatttttttaatatatcttttttttaatttatattccttattatatttttctttatttatatctattttttatttttctctattttataatgtttttattatttatttcttaatttttttttattttttacatttacttttattattctttttattctttaaaatttttttaattatttattaatttttatatttctttttttttttatttattctcaattattcttttttttataatttttaaatttatttcctattttataattttttactttatattctttttattttcttcttcttattattttatttttattatattattattctttatccatatttaatctttctattacttcattattttttattttttttcttattttattttaatcttttaattttatatatttttataatttattaatttttaaatttatttcttttttaacatatttatatttttttattttttctttattttattttattctctctaatatttactctatattttttattttttataatcttattattaatattcttttattttctatttatttaatttatatttattatttttatttattatttatttttatttcatttatattatctttatatatttttataattttttcattttctttttactttatatctctattattaatatttttatttttattcttcacttattctttctttttatt

SEQ ID NO: 6834 - DNA, 330 bp, Gossypium hirsutum
  Clone ID: uC-gsronu33B048e08b1
agataattctctcccttttaaagcttcctcatctttcatcttcccccaccccctaaattcccaaatattgaatcttgtttttctaaatatggaagacctgagcttcattgtgggtgttataggcaatgtcatctcagttctggtttttctttctccagttggaacgttttggaggatagtgaagaatggatcaacggaggattttgagagtcttccttacgtttgcacattgttgagttcaagcttgtggacttactatggaatcacaaagcctggggcttaccttgttgccactgtgaatggcttcggcatcctggctgaagcctgtct

SEQ ID NO: 6835 - DNA, 123 bp, Gossypium hirsutum
  Clone ID: uC-gsronu33B048e10b1
tcgccctctcgtccgggcggaattacccgctgagtttaagcataaaaaaacaacaaattctatccattaaacataattatattactcttctatctatcttttttactcctccatctatcattt

SEQ ID NO: 6836 - DNA, 551 bp, Gossypium hirsutum
  Clone ID: uC-gsronu33B048e11b1
tcggcgttattacccgctgagtttaagcatatcaataagcggaggaaaagaaacttaccaggattcccctagtaacggcgagcgaaccgggaaaagcccagcttgagaatcggtcgccatcggcgtccgaattgtagtctgtagtttttttattattcatttcaccttattctactattatcttatatgttttttaccttttatttttatttcttactttctttttatcatttcttttcttccttactgtttttttctatttatttttttctctcttttaatattattttttttctacctttattcattctcttttatttttctcttaatatatttttttcttttttttatattttttcttcttaatttccttattttctttttatcttttatttatttctattctttttcttttctttatatatcctctttttatttattccctttcctttcataatttattttcttctttttctttactttttattctttttttttttttcttttttacttctcttttttcttctcttattcttctttttctttttttc

SEQ ID NO: 6837 - DNA, 386 bp, Gossypium hirsutum
  unsure (1)..(386): unsure at all n locations
  Clone ID: uC-gsronu33B048e12b1
cagagcctccttcaccaacctccgctctgttcagcccgtgatcttttgatctttctccatggctaccatttccaagctcgctaaccccaacccagtcgcttctctttcattatctttcaaacccagatcttcttcatcgcttaaatgcttcgttgggttccctaccaggcctgctttcagctctaagctggtttcatcttctagcttgtcctcgataaacacccaccctttcaggggctccttggttgtcaggtgttctcttgctgatggaaacggagnttcagtgaagacgactactttgcatgatctgtatgaaaaagaagggccgagtccatggtatgacaacctttgcaggccagtgaccgatttgctgccactgattgcaa

SEQ ID NO: 6838 - DNA, 154 bp, Gossypium hirsutum
  Clone ID: uC-gsronu33B048f04b1
ctatacgaattatttcctcaaaaaactatatttgaatcattggaagagaatggatatagcttcgccatttactatcaatattctcctctctttcattatcctcccaattatcctctctctactttctacttttttttcttcttatctttcattt

SEQ ID NO: 6839 - DNA, 761 bp, Gossypium hirsutum
  Clone ID: uC-gsronu33B048f05b1
tgctgctctcatggacatgtaccagagcatgggagatgctcttgcccaacattatggaggttcctctttttttatccatatattattcttcttttccttataattttattcacttttttacatttttttttattttatttcttcatctttttttttttatctatttctattttctactctttattctctttttctttattatctttcattttttttttattctttattcttttttatcttttcttctctttttatttatattcttattttttaaatttttaatttctctttatttcttttatatttctttatcctttctatatattttttaactcctatttctcttattttctaatttctttttatttcttatatttttatatttatttatattttcattcttctttttatcttttttatttttacattattacttttttttcctattatttaattatttttttcttactttctttttacatatttttttctattattctttatctttatttcatttattcattatataattttatctccttctctctattatatcttttattatattcctctattatttaattatttttttatatttttcttaattatttatttcatttcaccatttttcatcttactactccttatcaattaattttctattctactctacattaactttcttttctaattctcttttctctttatatcttatttctttttcattattattttttattatattcttttatatttttatt

SEQ ID NO: 6840 - DNA, 179 bp, Gossypium hirsutum
  unsure (1)..(179): unsure at all n locations
  Clone ID: uC-gsronu33B048f07b1
tcgccctcgcgtccgcaaagtccgaatgcagctccagggtgaaagccatgttcccaatccggctgttcaagcactccgccctgctttagcctttcagacaaccactactaccacctnctctgttatccacatgcctcctccgccggcgcgtgttggacctgtgttcaccctttttcaat

SEQ ID NO: 6841 - DNA, 203 bp, Gossypium hirsutum
  unsure (1)..(203): unsure at all n locations
  Clone ID: uC-gsronu33B048f09b1
tcggcctaatacggctatatagaaatatagaaagcaagaaaatagtctcctttttttttctcttnttctgcaaattcttttctacaacaccctaagaatatccacgtcttacttagaaaatctatgtgtacagcatcttctatccctttatccatggattacactgagcctcaccctgcttccttttttgagcctagtgagtt

SEQ ID NO: 6842 - DNA, 225 bp, Gossypium hirsutum
  Clone ID: uC-gsronu33B048f10b1
cccacgcgtccgcggacgcgtgggtcagcagcaactttttccttttggcagttaagtgaaacgatgccatactactcgaggggtggcgaagatgacgttgacgagttctacgaattcgatccgacgccttacggtggtggatacaatctttgaactaacttatggtcgtactatggaacctttcgatgagacttgctatcttttcgatacaccctccgatggtta

SEQ ID NO: 6843 - DNA, 353 bp, Gossypium hirsutum
  Clone ID: uC-gsronu33B048g02b1
acccacacagccagctaataggaccagaggcaaggcaactcacgatgaacgtcatatacaggccagttcttgataagggatttatgatgcttatggatggacaccgtattgaggaccttcagaggatgtactcactgttttcaagggtcaattctcttgaaccactcaggcaggccgtgagttcatatattcggagaactgggcagggcattgtcatggatgaagagaaagacaaggacatggtgccttcattgttagaatttaaggcttcacttgactcaatatgggaagaaagcttttcgaagaatgagggattttgcacccacattagggatgcatttgagcatttaatt

SEQ ID NO: 6844 - DNA, 449 bp, Gossypium hirsutum
  unsure (1)..(449): unsure at all n locations
  Clone ID: uC-gsronu33B048g03b1
gacgcgcatcgacccacgcgtaacggtcaacgactgggcatgaactaaaacaagacctctaatttaaggtgctgaatattataaccaagattatcgtgaacactgaaaatattatattcgaaagagtgtttatcttgttagaaaatgtggtcaaatcatcaaaatcaatactgggtggtaaactttaattaaaaaaatcaaagttggtggaaatattcaataaaattcaaattttagtggcaaaattcaatcacattaagttaattgacaaatttacgtatattctcatagtataatgacaaatgtaaattaaaataaagtataatgctattgtgggtgctctctaaagaggtaaacaagatgaatagtcatgaaatgtgctccattctcatgaatgggngatcaaacttccgaccataagataaaggagtgaaattattttggatttt

SEQ ID NO: 6845 - DNA, 97 bp, Gossypium hirsutum
  Clone ID: uC-gsronu33B048g05b1
tagtgttgcgctaataaccctacaacatggaaatatatttaagatgcagcgcaagaggaaatcacgtaaaggtggatctcatttcacgcttttcttt

SEQ ID NO: 6846 - DNA, 270 bp, Gossypium hirsutum
  Clone ID: uC-gsronu33B048h04b1
gcaatgatatcgttcacgcactcaaggccgacctgacgcagacttacactgatcacgcggtgagccctgacgggcgtttaaaaacagtctcggactagacatccgctctcaacagatccaaaaacgtacctcatggctacttcaccaggctaacagctgatgaagctgctacactaactgaacacacccgcaatcttttctgcttgaccgtgggggatagaactactgcacacaactagaacaccagagagacccgggggaggaaggagc

SEQ ID NO: 6847 - DNA, 488 bp, Gossypium hirsutum
  Clone ID: uC-gsronu33B048h05b1
gaataaacgaatagctcatcgttgatggataacttattgggccttcttcggattcggattaaacggggcgttaacctcgccgttcgtgatgttttaagcatctatccttacgtttgttgttattttttatttttgttttttttttgggggaggggggggggggggggggggggccctttttttttatttatctttttttttttttttatttttggggggtgtgttatatctattctttttttcttttacttttttatcttttttatttttttttcttttttttttttttttttttttttatgtctatttttgtttgtgagttgtgtttctttttcttctttttttttattattaattattatttattttttttttctaattgtatattttatataatatatctttttattattattttttatatatttatttattttctcatttcttctttttattcattttttattttttttttttatttttatttt

SEQ ID NO: 6848 - DNA, 152 bp, Gossypium hirsutum
  unsure (1)..(152): unsure at all n locations
  Clone ID: uC-gsronu33B048h06b1
ccaatcctgatacggggaggtagngataataaataacattacttatttctatgagcctgttaatttgaaaatgatttctttctaatttttatttcatatttacaatttttttaactactttatcatttatttaattttttagaatatctttt

SEQ ID NO: 6849 - DNA, 374 bp, Gossypium hirsutum
  Clone ID: uC-gsronu33B049b01b1
aaaatatctgctcctcttagtttccctttttgtcccttgtttatttgatactcccccctcatggctgccgctgatgtcgagttccggtgcttcgtcggagggctcgcatgggccaccgacgaccgggcccttgaagaagccttcagtgcgtttggtgaaatcgtcgaatcgaagatcattaatgatcgcgagactggaagatcccgaggctttggattcgttactttccgcgacgagaaagctatgagggacgcgatcgaaggaatgaacggtcaaaatcttgatggaaggaacataactgtcaacgaagcccaatcgcgcataagtggaggcggtggcggaggatttggaggaggaaacggtgtttacagccg

SEQ ID NO: 6850 - DNA, 461 bp, Gossypium hirsutum
  Clone ID: uC-gsronu33B049b02b1
cccactcgtccgttccagtcaatcgccgagaaaaaaaaatgcagcaccagaggctgaagcaacagcaacaagccttgatgcaacaagctcttcttcaacagcagtctctctatcatcccggcatcttagctcctcctcagatagagccaattcccagtggaaatctgcctcctggttttgttccaagcacttgccgcagtgtgtatgtgggaaatatccatacacaagtgactgaaccactacttcaagaggtttttgcaagtactggccctgttgaaggttgcaagcttgtcagaaaggaaaagtcatcgtatggattcgtccactactttgatcgcagatcagctgctcttgctatattgtctctaaatggaaggcatttgtttggacagcctattaaggtcaattgggcatatgctagtggtcagagagaggataccataagtcactttacatttttt

SEQ ID NO: 6851 - DNA, 315 bp, Gossypium hirsutum
  Clone ID: uC-gsronu33B049b03b1
ccttttcttcctctttcacgtcagaaactcccaagacctatacgattaaggggtgttgtcagttatagctttgactgcaccagtcgaggccaccttaccagtcttgaatggcatggatccttcaaagcatgcatggcatgttgtaaccgataaactcaatcatggagcagtgaacatgtggcttctgatacatccccctggagaggccaccattcctgttgaaaatgttgacgaatccaagtggcttaaatgatcctattggcctgttttacggccgcgtaagactgcttcactgaaggtgttttactttgaggc

SEQ ID NO: 6852 - DNA, 170 bp, Gossypium hirsutum
  Clone ID: uC-gsronu33B049b06b1
cccattctccctacaaatcctcgtctcaccaatttttgtttaaagcctagtaaaatggcgtccacatttagcggtgatgaaactgctcctttcttcggcttcctcggagccgctgctgccctcgttttctcctgtatgggtgctgcgtacgggacggcgaagagcggtgt

SEQ ID NO: 6853 - DNA, 151 bp, Gossypium hirsutum
  Clone ID: uC-gsronu33B049b08b1
tcgctttacgcgcgaccgtaagcttttcgtcatcacatcaccatgagagccaagtggaagaagaagcgtatgagaagattgaagagaaagcgccgaaagatgaggcagagatccaagtagacagtgaaatctgtgggttctgtttaagcta

SEQ ID NO: 6854 - DNA, 433 bp, Gossypium hirsutum
  Clone ID: uC-gsronu33B049c01b1
ggatgaacgaacactcaagttcgaaggtgtttgtgccgcatctttgccaactaccatgggagttgttgctgggcttctagtccaaaatacgctaaagttcttgttgggatttggacacgtttctccctacttggggtacagttctcttaaagacttcttcccaacaatgacaatgaagccaaatccccaatgttcaaatgctgcctgtctggagcggcagacagagtacattcttgcaaagccagccagggatgctgcagcgaaagccaagatggaggctgaagctgctgccgctactgcagcaggagatatgccactccatgttgataatgagtggaacataagcgttgtcgatgattatgagccggccaagagttcatgtggaacaagttcagatgcgcgtccagaaggtctcactcgtgagctcccaagt

SEQ ID NO: 6855 - DNA, 510 bp, Gossypium hirsutum
  Clone ID: uC-gsronu33B049c07b1
atctgatttggcgatggcggagcagcaacaactagagccatggaccgacctcagtggcaacgtggtgatggtgacgggggcatcttctggtttaggtcgtgacttttgtcttgacttgagtaaagctggctgtcgtatcgtggctgccgcgcgccgcgtcgatcgccttaaatccatctgtgatgaaatcaatcacctcagctttcctttttccggaacccagccttagtggccctcgaagctttcgctgtcgagtctcgacattatgtgctgacggattcaccattacgtagctttgtaaagttggcttgtgattccttttggaggaatcgttcttttattaaatattatcgctgccctttatgtggatttttaatgtctcttttgtttttttcttaattaggatttgactcttatatttttctacactcacttattttgtcatttttttttttacttctcattacttatttctttttactttttttttttttttttatatttttattt

SEQ ID NO: 6856 - DNA, 679 bp, Gossypium hirsutum
  Clone ID: uC-gsronu33B049c09b1
tcgcccattcgtccgcccacgcgtccggaaccctcgtcactcggcggcagaagcagagagcctcaacatctacactttatcctcaaaccatgactttcaagcgtaggaatggtggccgcaacaaacatggccgtggccacgtgaagttcatccgctgctctaactgtggcaaatgctgccctaaggataagtcgatcaaaaggtttcttgtgaggaacattgtggagcaagctgctgttagggatgtccaggaagcttgcgtctatgacacctacactctgcctaagctttatgtgaagatgcaacactgcgtttcatgtgctatccactcccactttgtgaggtttcctccttgcctcgacaggatgaaccctggttcctatttaactccttattagtttcccgtattaatttccctcacatttttattttttctatacgtcttctttttcgtttttacttcccctttactatcttttatataccctaattcatctcaataatttcctctatatttttatccatctacaatttctctttataaattcttttctcttttttttttttttactttctattatttattttaatttatattttttcagttattcctcattatttgctccttctcaaatttcttccctttattatttttttatcatttattctctttctcttt

SEQ ID NO: 6857 - DNA, 273 bp, Gossypium hirsutum
  Clone ID: uC-gsronu33B049c11b1
tcgccctcgcgtccggggttgtgctgctgccttgaagcaagccggtgctcgtgtcattgttactgagattgatcccatctgtgcccttcaggctctgatggaaggacttgaggttttgaccctagaagatggtgtctccgaggctgatatctttgtcaccacacccggttacatggacataatcatggttgatcacatgaggatgatgaagaacatttgttattgtttgcatcattgttcactttgacattgaaattctattgcttatgtttt

SEQ ID NO: 6858 - DNA, 528 bp, Gossypium hirsutum
  Clone ID: uC-gsronu33B049d01b1
ccctttcgtcctcacaagctcaacatatactttccttcgacccacaatctttgaaagctttcgctcagacccaaacccaaccccttttcttcaactcttctacttctgctgctgttttctctgttccacttcactctaggggctccatacacaaaacccaccacaccgactacaaagcccttgtcctatcccgactagagcgtgactccgcccgtgtcgactctctctctaccaagctcctactcgctctcaatggagtcaagaaatcccagctccgcccactccctacccagatccaagctgaggcactttctacccccattatttccggaacaagccaagggagtggagagtacttttcccgggtcggagtcggtaaaccggctaaacaattctacatggttcttgatactggaagtgatatcaactggattcagtgtgagccctgtaacgaatgttaccaacaatccgaccccatatttaacccatccgggtccttcacttacagcccggttacttgcgaatcaa

SEQ ID NO: 6859 - DNA, 543 bp, Gossypium hirsutum
  Clone ID: uC-gsronu33B049d03b1
ctgttcttgtgtacaggcgacgtgacggaactaagtggattgttgcctggagcaacccacaagctgagaacagcaaggtctatactgatatccagagacaacctgttcactgggggcaaatcaaaaccaaccttgagaaaagaggaaaaccaaaatttaaagttacaaagtttggttacaatgcatctattgaaattgatcccgtgagtcgttcacccacaatgaaggcatcatttgagttagaggcataactgccttatcgtcttcatcaagctggggtggtaattaaggctatcaaaattaaataatagtgtgatgcttgctgctgcattacctggactactattatagtaaaaagatttgatagccagtagaaccattagaaagtgtgtaggccttcacaatcatgtcagtgccatgtatatgtacatggttgactatttgttgaaatatattggaagaattaatctaaatgtccttttctttttatacatatcttaccaaattttcactatatttttctgtctattttttggctcctat

SEQ ID NO: 6860 - DNA, 103 bp, Gossypium hirsutum
  unsure (1)..(103): unsure at all n locations
  Clone ID: uC-gsronu33B049d04b1
aacatggaataacataactaaaaaaaatttaaattttttctaagtcactcccacattttgttcgacacattgtgcanctnanaaaaaaaaaaaaaaaaaaaca

SEQ ID NO: 6861 - DNA, 78 bp, Gossypium hirsutum
  Clone ID: uC-gsronu33B049d05b1
ctctggtggtatcttatgttagaccggttcgctcgatccgtctgtgagtcgtgaaaagggagcgacacaacgaacaac

SEQ ID NO: 6862 - DNA, 89 bp, Gossypium hirsutum
  Clone ID: uC-gsronu33B049d08b1
tcgcccactcgttcgaacaaagacacgaaaggtaccaagggaacggtacttgtacatgggttatgggagtctaagagacggagagagcc

SEQ ID NO: 6863 - DNA, 208 bp, Gossypium hirsutum
  Clone ID: uC-gsronu33B049d10b1
tcgctctacgatgtaacccccataatttggccataacgtctaggctgagtatgggatgttacagttatgtgaccacatattgatccaattgcatcaatgattttaacctgacataatggtatacattgttttaatcatatactgctaataaatttccgatttttatttctttatatctaatatttatttcatttctcttttttttttt

SEQ ID NO: 6864 - DNA, 495 bp, Gossypium hirsutum
  Clone ID: uC-gsronu33B049e02b1
gttgtgaattatttggcagtgcataggcaaggtttacgtgtaaacgtggagaaattgtggtcccttcttaactccagttggcttaaaagtttgggggaaatctttgaatctctagcaaaagtagctaaaagcttataccccaagtggaaatttggtatccctgcaacagagtatgttgaaggcactgctacacttgcaagctcattgtattatcaggctctaggtgtgcctacaggcccacatggtgctttccgtgactaccaagttgacgcaatcacgttggagatttcacctaaattttcattggacaaagtctggcgcaatgacattcttctaagaggcggccggttgattgaaggagttatacgatcagtaaataacctcctgagaagtttcaccaatcatttttcttgtacctcttaacatctcctagaagtttgtggcagtgggggtttacatgattgcgtttgcacttctcatagcgccacttccaat

SEQ ID NO: 6865 - DNA, 254 bp, Gossypium hirsutum
  Clone ID: uC-gsronu33B049e05b1
ccctctcctcttaatggggactcattcatacattatcaaatcttacaaacacttgggtcaaagctctccttaatatgaggcatggccacacagaagctaaagtccatattttagtatcaaagctgaaagatgctgaagcgtagtcatccgtccacgatcaagtttcaaagactctaggatccgaacttgcttacatgatcaaatctcgaggataagtgcttaaagaaacattttttaacctcagcattaatgtg

SEQ ID NO: 6866 - DNA, 517 bp, Gossypium hirsutum
  unsure (1)..(517): unsure at all n locations
  Clone ID: uC-gsronu33B049e09b1
tcgtgataatagaggcagcagtggcttgacgttcccctttgctcccttcttccagaagccaaaagtttgagttaagaacaatggcttatgctacaatgaagccgaccaaacctggtttggaggagtcccaggagcagattcacaagatcaggatcactctctcctccaagaatgtgaaaaaccttgagaaagtttgtgctgatttggttcgtggtgccaaggataagagactgagggttaaggggccagtgagaatgcccaccaaggttcttcacatcacaacgaggaagtctccctgtggtgaaggaacaaacacatgggatagatttgagctccgtgttccaagcgagttaattgatcttttcagctcccctgatgtggtcaagcagatcacctctatcaccattgaacctggtgttgagggnggaagttaccatcgcagattcttaaatatgcctcacttatgctttttggcaaccactagttttagtcaattagaagacttccatctgatata

SEQ ID NO: 6867 - DNA, 272 bp, Gossypium hirsutum
  Clone ID: uC-gsronu33B049e12b1
tcgcccattcgtccgcggacgcgtgggttagaatttaggaaccgggttgtatctgtggggaacactaacaatggccctctgcaggctccagtgtcagatgcagcaggagctgcaccgataatttcaagcaatggagctggtccttccatcagtttacatgctagtgggagtatagaggagttagagcctgcggttcttactgcaatgacatcaatccctggtgcacctgtggtccatatgatgccgctaccaagatcgaactttcacgtact

SEQ ID NO: 6868 - DNA, 405 bp, Gossypium hirsutum
  Clone ID: uC-gsronu33B049f02b1
gctttaccttctctaattttctcgggaaccaaacaggggaaatttgggttcttgttctgaaaattcaatgactttcaatgatgataacaatgatgatgagggaggagaagtggtgtcggagctgaaattacgagttgagggtgatgatgatgttaatgagaaaagggtaagtttgagacagagattattagaagaatgtgaagcggaagagaataattctttaagtttgagacagagattattagaagaatgtgaagcggaagagaataattctttgttaaaagagccaggtttttcttctcaatcgagaaggtctatttggtactggatcaagttgggaattttacttacctttctagggatgctggctgctgttcttctcaaatgggttggcccttttttcat

SEQ ID NO: 6869 - DNA, 412 bp, Gossypium hirsutum
  Clone ID: uC-gsronu33B049f03b1
tactatgggaacgccggccgctccggtccgaatttccgggttggcccaaggctccggccatttgttcttcccaccgttccgcccacccttccgaaaaatcctaccaatccaatcaccaccggaaaccatggccactccttcccacgcgaagaaaatgtctacatggccaaactcgccgagcaagccgagcgctacgaggagatggtcaagttcatggagaacgtcgtctccgccgtccccgctcccgacgaactctccgtcgaggaacgcaaccttctctctgtcgcctacaagaacgtcatcggcgcccgccgtgcttcctggaggatcgtctcctccatcgagcagaaggaggaaggccgtggcaacgccgaccacgtcgccgtcatccgtgactacagggcccagatcg

SEQ ID NO: 6870 - DNA, 456 bp, Gossypium hirsutum
  unsure (1)..(456): unsure at all n locations
  Clone ID: uC-gsronu33B049f09b1
tcgcccacgcgtccgtctccctgtgagaaaatggcatcctaccaaatcttagctttcgcagctttgttcttgatcttgttacccgtagccgtcaatggagatttaggtgacttatctcctgctctatctcctttctatgataggttgtgtgatgatgttgattgtggaaagggaacatgcaaagcggacataagctaccctttgaactacatctgtgagtgtgatgctggttggaaaagaactcaagacgacagtgatgatgatgatgatcataagtttctgccatgcgttattcccaactgcactcttgactactcttgtcaaccagctcctcctccagtacctcagcgaggaagttcctcgcaattcatctttattttgatccttgctattgggcatactgtggaggagggaacctgcaacanaactgcaacatacaggtacgtatgcgaatgc

SEQ ID NO: 6871 - DNA, 337 bp, Gossypium hirsutum
  Clone ID: uC-gsronu33B049g02b1
gtatcctggtatcaactgctcaaagcatgactgaacgcccaatgaagggaatgcttactgaccctgttaccattcttaactggacctttgtcagaaatgatcagcccagatttcagacttgctaccagattgccttggccatcaaggatgaagtggaggaccttgagaaggccggtataaacgttctcccaattgacttaaacctgctttttagagaagggtctcctcctcttaaagacccagcactcctcatactttacaattctcatgtccaccctctttttcgatcatctccctttcttatctcaccaactacatctacacttctcctatccct

SEQ ID NO: 6872 - DNA, 82 bp, Gossypium hirsutum
  Clone ID: uC-gsronu33B049g04b1
ctcctcagtcgttccctgccaggcttatcaaggcctttactgatgaagctcctaaagtttggcccacggctgcacctaatgt

SEQ ID NO: 6873 - DNA, 448 bp, Gossypium hirsutum
  Clone ID: uC-gsronu33B049g07b1
tctttcagtgcgaagagcagcaggcatggttctcaagacggagctttgccgatttagtggtgccaatatataccctgggaaaggcatcagattagctcgtggtgattcccaggtcttactcttttccaattcaaaatgcaagaggtacttccacaaccgcctgaagccatcaaaacttacatggacggccatgtacaggaagcaacacaggaaggacattgcccaagaagctgtgaacaagaggagacgtactgcaaagaagccatactccagatccatagtgggtgccaccttagaggttatccagaagaagaggagtgagaaacctgaagttcgtgatgctgccagggaagctgctcttcgagaaatcaaggaaaggatcgagatgactacggatgaagagcaggcacagcaggcagaagtagcagcgaatcaacaggagacacat

SEQ ID NO: 6874 - DNA, 200 bp, Gossypium hirsutum
  Clone ID: uC-gsronu33B049g08b1
tcgtttttctcttattcgattaaattccagaactcgaagcgaagagacaaagatcgccatggcacctcctgcaaaagcaataactagccccgtgcctgatgcgtggtattcaaccttagtcgtatttatgttttccatatggtatttgtgctctccgttttctttcttattcactcatcatttacttgtactctcttttt

SEQ ID NO: 6875 - DNA, 103 bp, Gossypium hirsutum
  Clone ID: uC-gsronu33B049g09b1
tcggattaataaaggatgaattgcattgaggaagtatattcactaacctttacaccttcatttacaaaatgagaaacaatagatctacattgataaatagata

SEQ ID NO: 6876 - DNA, 536 bp, Gossypium hirsutum
  Clone ID: uC-gsronu33B049g11b1
gtggtattgtttgctgcagctgtaattgctgtggtggttatggctactagcaagcaaacagaaatggttcctgttccaggcttgcctacttcagttagggttcctttttcggccgagttcactgattcacctgcctttgtatactttatggcagcattatcaacaacaggcttatacagcatcatcactgctctcgcatcaattttgctcggccgcaagccttcttataccaacaccatcttgctcgcctttgcattaatggatgtggtatttgtgggaatcgttgcctcagccaccggttccgccggtagcgtcgcatacatcggattaagaggcaacagccacgtccggtgggacaaaatctgcaacgtttacgacgagttctgtcgacatattggaacggcaatcgcattctcgttatttgcggccatcttgcttggtgttcctcaccatgttctccaccttcgccctttacaaaaagaatccgtgataatttttagagacacagttcttaattactctcatgtctgaatttg

SEQ ID NO: 6877 - DNA, 240 bp, Gossypium hirsutum
  Clone ID: uC-gsronu33B049g12b1
tcgcccatgcgtccgcccacgcgtccgggagagcgccgtttctcattttcccttctatgccgtttcagatcctagcctccgcccgttcgactcctattcgcagaggagaagaaggcgccatcggctcacccgcgaaggtacggatgtgcgcgggcgtgcgtacggcgtggtccctggtgtgagatctgcaccgttcttgcatagatttctcttccggcgtttgtcttcttatactcacca

SEQ ID NO: 6878 - DNA, 743 bp, Gossypium hirsutum
  Clone ID: uC-gsronu33B049h01b1
cccatgcgtccggacacgatgtggaccgagctgatccagtagagcctgggctcaccatgtacaaggaaaagcgtcaggtcaggcgtctgattgaaaagctggagatcccttacacctacatttgttgtaattccattgcttcttggccctaccacaacaataggcatccttccgaggtcattccacccttggatcattttgaaatctatggagatggcagcgttaaagcttacttttttgtaggctctcatattggaaaattcatcattatctcttgttgtttacaattttgatcttgatctagttttttcttatttttgtctcttttctttgttcttttacttttttactcaatcttctcctttttctttttctctcatatcatcttttttttcttatttattatcatttccctctctttttatttatcattctattttttctccctttattcccaatattctcctttctttcttactattctctatatttttttcctaatctattttttactttttgttttattattaccttttctttctctcatttttcatctttttttatttactcttctatatctattcttcttatttttctttattttttacatctcttttattctttttcacccaattcctcttcttttattttctacctctcttttttctattcttatttattattcttatctattatttctattctcatttttctacttactttctatatacttttcaattttt

SEQ ID NO: 6879 - DNA, 454 bp, Gossypium hirsutum
  unsure (1)..(454): unsure at all n locations
  Clone ID: uC-gsronu33B049h03b1
aatttagtcatttcctgcacttggntctgcgccttcgaggagggatgcagatattcgttaagaccttgactggtaaaaccataacactggaggtcgagagctcggacaccattgacaatgttaaagcgaagattcaggacaaggagggaattcctccagaccagcagaggttgatttttgctggaaagcagcttgaggatggtaggacactcgcggactataacatccaaaaggagtccaccctgcacttggttttgcgacttcgaggagggatgcagatatttgttaagaccttgactggttaaaccatcaccctggaggtcgagagctcggacaccattgacaatgttaaagcgaaaattcaagacaaggaggggattcctccagaccagcagaggttgatttttgcccgaaagcagcttgaggatgggaggacacttgcggactataacat

SEQ ID NO: 6880 - DNA, 665 bp, Gossypium hirsutum
  Clone ID: uC-gsronu33B049h04b1
cccatgcgtcctttcattctctctctaaaaactctcattctctcgctctctctctctctctctctctctctctctctctctttcttcacaagaaaagtttttctttcgtgaattcatgtcggaggaaaagggccggccattgccaaaatctggtgaatgggatgtcaacgatcctgcatctgctgagggattcactgcgatcttcaataaggcaagggacgagaagaaaacaggtggcaaacctgagtcaccggcaaagtctgattctaatgttaagcctggagctgatcctggcaaaacccaacctaaaaaatggttttgctgcgctcaagccccgcctgcggaatcttgaccatgctccactcgtttaagacataacagcttccacagtatatttgaagccccacccatatattcctaacaagaaagggcccgcaaggcttgtccagcccttttcgcatcctcccctgggcgcccaatcccttccccgtgttacgcagccgccctaccccccccctctttcttttcttttctcctccttttctcactccccctttacccctctttctactccccttccttttcctctatcttcctcttctttctttcccctctcctccttattcccccttctccacctcatctcatcaccccttcttcttctc

SEQ ID NO: 6881 - DNA, 187 bp, Gossypium hirsutum
  Clone ID: uC-gsronu33B049h06b1
cggatgcgtggtcggacgcgtgggcggacgcgtgggaaaaaattaaaaatatagaattcatatacaatgcggctgcttcctttagtggtgtcctgttccttggctcatgtttgtcgtgttttttctctttctcttgtgtgctcttcatttttctgttttggtcgggtctttttcctttcttttggtt

SEQ ID NO: 6882 - DNA, 458 bp, Gossypium hirsutum
  Clone ID: uC-gsronu33B049h08b1
tcggtgttttgttggccggtgccagagatgacgagatagaaaggttgaggaggtacggcagagctgtgggtgtattgtatgaagtggtgaatgatgttttgctgtcaaaattgacagaaaaagaaggaaccgaggggcaggaaaagaaaggtaaaggttatgtgagcttgtatgggatcgagaagtcaatggagattatagaagagcttcgaagcaaggctaagaacgaattggatggctttgaaaagtatggtgactgtgtggtgccactctatagcttcatagattatgctattaatagaggtttcaatgttagtgacttgagtcaatgatgtgcttttttttcatgttggtgaatttacattgacgattgctagttattgacccggttaacatcagtgtgtttctagaaattttctaaaatacatcatatgcagaggtacaagaatagccatgtc

SEQ ID NO: 6883 - DNA, 135 bp, Gossypium hirsutum
  Clone ID: uC-gsronu33B049h10b1
tcgtggatcttaaacgtgccaagttgaagggcaattcaagtgctgatgctgctaatgcacccatcgagaaggctgctgatgcctgatgtctgcttatatgcccgattgttaaaaagtctgaacggctttgcttac

SEQ ID NO: 6884 - DNA, 471 bp, Gossypium hirsutum
  Clone ID: uC-gsronu33B050a03b1
tatggctactgcagaggttgtatcagctcagactgcaatccatgaggagaaacctgaagaagtggtcaaggttggagaaattgcaacagaagaggtaccggctgttgctcctgcagcagaacctgttgctgaagaaccaaaggaagcagtgcctgaagcagcatccggagaaccccaggctccagaaactgaagccacagttgaaactgaatcaaaggaggtggttaaagagcccaaggctgtgactgaggagccagaagttgagaaaaaagaagaagagactcctaaggaaacggtagcagagccagttgccgaggagtccaaggagtccaaggagacttctgagccaacagttgaagaaaccaaagaaagcacagagtctacagaagcagcagcagcagcagcagcagcagcagcagaaagtaaagcagaagccgaagccgcccccatggaagcacccaaagaggaagc

SEQ ID NO: 6885 - DNA, 532 bp, Gossypium hirsutum
  Clone ID: uC-gsronu33B050a04b1
ttcacgcgtccgctcataaatctactaagaagcctaaacagcctgaagaaaccctaaatgatttcctatctcatcaccctcacaacactttctccatgagctttggcaacgctgctgttttggcttatgtccgccatgaacgtgctgcttcagttcatcagaggttgttttgtgggtttgatgacatatactgccttttcttagggagcttgaacaatctatttatgctgaatagacagtatggtctttccaaagggagcaatgaggcgatgtttgtgattgaagcatataggacactaagggataggggtccataccctgctgatcaggttgttaaggatcttgaaggaagctttgcctttgtgatctatgacagcaagactggaaccgtgtttgctgactggggtctgatggtggagtgaagctgtattgggggattgcagctgatggctctgtggtcatttctgatgatttagatgtcattaaagaagggtgtgccaaatcctttgctcctttcccaactggattcatg

SEQ ID NO: 6886 - DNA, 536 bp, Gossypium hirsutum
  unsure (1)..(536): unsure at all n locations
  Clone ID: uC-gsronu33B050a05b1
tttcacgcgtccgcccacgcgtccggggccaaattggctgttacactggtaagacttaaacaattccaaggtgctgttgatgcagcacgaaaagcaaacagtgcaaagacatggaaggaggtttgctttgcttgtgttgatgcagaagaattccgattggcacagatatgtggtcttaacatcatcatacaggtggacgacttggaagaagttagcgaatactatcagaacagaggatgcttcaatgagttgatctctcttatggagagtggtttaggactggaacgtgcacatatggggatctttactgaactgggagttttgtatgccagataccgacccgagaagcttatggagcacattaaattgttctctactcgtctcaacattcccaagctgataagagcttgtgatgaacagcagcactggaaggaacttacctatttatacattcaatacgacgagttngacaatgctgcaactaccgtgatgaaccactctcccgaatcatgggatcatatgcagtttaaagacat

SEQ ID NO: 6887 - DNA, 508 bp, Gossypium hirsutum
  Clone ID: uC-gsronu33B050a07b1
ttcttattctcttgttattctcaattcttacacttgaacagcaaaagaaatcactttcactttcagttcagttctactgaggtttccatctctgaggacatggagagtcagagaggtcctcttcttagctgggtttacttctgtcaaggaaagacaatggaagagcttaggtattctcttttctatacgactatggagctggaacagacaaggatggcagttcaggaagagctaagaaagagagatgatcaattaattcaactcaaggagttgctaagcaaggcaataagagagagggatgaagcacaggagaaatgccaaagactttttcttgagaaactcctgcttcatcaactgcagcagcaacaacaaaaacagcaagtttctcctctctctggagtttctggcgttgaggatgaacgcataaaaggaatagactccaacaatggcttctcatcatctgactgtgagggaagcatcgtttcatcccctgttcttgacccaactc

SEQ ID NO: 6888 - DNA, 508 bp, Gossypium hirsutum
  unsure (1)..(508): unsure at all n locations
  Clone ID: uC-gsronu33B050b02b1
ttgagtttaagcatatcaataagcggaggaaaagaaacttaccaggattcccctagtaacggcgagcgaaccgggaaaagcccagcttgagaatcggtcgccatcggcgtccgaattgtagtctggagaagcgtcctcagcgacggaccgggcccaagtcccctggaaaggggcgccggagagggtgagagccccgtcgtgcccggaccctgtcgcaccaagaggcgctgtctacgagtcgggttgtttgggaatgcagccctaatcgggcggtaaattccgtccaaggctaaatacgggcgagagaccgatagcgaacaagtaccgcgagggaaagatgaaaaggactttgaaaagagagtcaaagagtgcttgaaattgtcgggagggaagcggatgggggccggcgatgcgccccggtcggatgtggaacggcgagagccggtccgccgatcggctcgnggcgtggaccgacgcgggtcgtggcggcggcccaagcccgggcctt

SEQ ID NO: 6889 - DNA, 489 bp, Gossypium hirsutum
  Clone ID: uC-gsronu33B050b05b1
cactctcccttcagatatcttcattttcatcttcttcctctttctttctgttctttgttttcttcaaaaactgccctttcattttgcttagttcttgttaaaaagaaaatgtgtgggattttagctgttttgggctgttctgatgattctcaggcaaaaagggttcgagtgctggaactttcccgtaggctgaagcaccgtggtcctgactggagtggcctctaccaacatggagactgttatttggcccatcaacgccttgccatcattgatcctgcttccggtgaccaacctctctttaatgaagacaagtctattgttgtcactgtcaatggagagatttacaaccatgaagaactaaggaagaagttggcccaccacaagttcaggactggcagtgactgtgatgttattgcccatctgtatgaggagtatggtgaagactttgtggacatgttggatggaatcttctcatttgtgctgctggat

SEQ ID NO: 6890 - DNA, 505 bp, Gossypium hirsutum
  Clone ID: uC-gsronu33B050c02b1
aaagaatccacccttttcttatctcttgttgattcatcaagcaaaatgttgactgatacagacaaggagttcttatctctaactgctactgttacagcggggtatcagttatttttctttttaatcgcggctgttttccagtttgataaactgactgattttgcaggaagcacgaatttcgtgataatcgctttattgactctggttaaaaaaggatcatggcatttacgacaggtagtcctgacggcgatgatagtaatatggagcacacgattggcactatatctcttttttagaattttgcgatggggggaggataagcgttatgataggatgcgccataatgtggggaacttagcagttttctttatatttcagggtctttgggtgtggactgtgactttacctgtaacagtggttaatgcaagtgacaaagatccatccattcaggccgaagacatcatagggtggattatgtggtttttgggtaccattgttgaaattt

SEQ ID NO: 6891 - DNA, 506 bp, Gossypium hirsutum
  Clone ID: uC-gsronu33B050c03b1
attgaccttgctcgaaccctagctgatcgagatggattttcaaacatcaagtttctggttgatgatattcttgagacaaagttggatagacagtttcaacttgtcatggataaggggactctcgatgccattggcttgcatcctgatgggcctatcaaaaggattatgtattgggattcagtttcaaagttgttggcccccggtggaatattagtgattacatcttgcaaccatacaaaagatgaattggtccaagaggtggaaaatttcaatcaaaggaacattgcaatatcccaggagccaagtgcaacgaaggaccaagagacacacagagatcatcccccgtttcgatatctgaatcatgttcggacttatcctacattcatgtttggtggatctgtgggatcaacgtgttgccactgttgcgtttctaaggaactaaattcaaagcttcggtcttttgtcatgaacggacttcacttttttggattgtcgtggttgaaaat

SEQ ID NO: 6892 - DNA, 237 bp, Gossypium hirsutum
  Clone ID: uC-gsronu33B050c05b1
ttcaattgtacgagatgatttccttagatagggagtgggtggatataactacttttttagggcaatagccattgctatatgctgaagatacgacgtttacaccgtggggagcggtgctgccttgggatgtacaggattgtgagaattcaggatgatcgatttggatgatgctggtcaatatcgttgaagaagggcgcctcttagagactggagatgtacaagacctgataagaatgg

SEQ ID NO: 6893 - DNA, 179 bp, Gossypium hirsutum
  Clone ID: uC-gsronu33B050c06b1
ttcacttgtacgacttggtttcctcagatacggacggagtcgatataactacttttttagtgcagtagccattgctatatgctgaagaaacgacgacgacactctatggagcgggaatgccttgggatgaacagcgatgtgccaacttcaggatgttccattgatagatgcttgtcaat

SEQ ID NO: 6894 - DNA, 236 bp, Gossypium hirsutum
  Clone ID: uC-gsronu33B050c07b1
tttaagcgtacgacatgatgtctgtggttatggaggaaggcgatataactactgtctttgggcaatagccattgcaataggctgaagaaatgacgactacaccgtgtggagctgtacatgcctagggttgaacaggcttgtggaaaattgaggaggttccatgggcagatgcttgtcaatatcgtcaagaagagggcctcttagagtctggagatgatcaaagctgataagaaacg

SEQ ID NO: 6895 - DNA, 500 bp, Gossypium hirsutum
  Clone ID: uC-gsronu33B050c09b1
gtcaatacgtcggcactgaagtcctttccctcgatgctttccttcattctcttggctcttctggctcacgcctcaccaatccaatgtaaacacccacatccaaaaataaacataatcatcttagccgggcaaagcaacatggccggtcgtggaggagtgttcaacgacaccataaccgagacactaacttgggacggcatagttccgcctgaatgccagccaaacccttcgatcctcaggctaaccgcaaacctaacatgggttgaagcccatgaaccactccatgcagacattgattacaacaagacaaaaggggctggacctggaatgccatttgccaacactgtgttgaacaaggaccctaactttggggtgatagggttggtgccttgtgccatcggagggacaaatataagccaatggcagaaaggagagtttttgtatgagcaattggtgaaaaggtctcaatttgcaatgcaaagtagagtgtatagagctat

SEQ ID NO: 6896 - DNA, 456 bp, Gossypium hirsutum
  Clone ID: uC-gsronu33B050c12b1
tccacgcgtccgaaaaaaaaaaaaaaaaaaaaaaaaaataaaaaaaaaaaaaaaggtaagaaaatataaaaagaaacagaattacgaacacgtgcatgcaacatcatagctcttttatagtgaaacctaaataaagggggggggcctttttggggcaccattttttcttccgggtactttggagttattaatttttttttggtggcaccaaatttaattttttggggctgttttttaaaccgtggggtctggaaaaacctgggttttccccattttatcggcttgggaaaaattccctttttcgccgtgtggggtaatattaaaggggcccgccctggtggtttttcccaaagtttccccttcttttttgggaattggtaacccccctttatttggctttttaagcggggtggtgggggggtttcccccctttttgccctttttttttgatgggcc

SEQ ID NO: 6897 - DNA, 464 bp, Gossypium hirsutum
  Clone ID: uC-gsronu33B050d02b1
gctctacttattcttttttctcttagatgagtacaaccatggcgaatcacaaaccgttccctaatttcttatctcttattctcctctctctcgtcgccatcgcctctgctgaagttttcttcgaagaacgcttcgaagatggatgggaaagtcgttgggtaaaatctgactggaagaaagatgagaacatggctggggaatggaattacacttctggaaaatggaatggagatcctaatgacaaaggtattcaaactagtgaagactacaggttttatgctatttcagctgagttcccagaagttaacaacaagggcaagactctagtcttccaattttctgtgaagcacgagcagaagcttgactgtggtggtggctacatgaagttgctcagtgataacattgaccagaagaaatttggtggcgacaccccgtacagcatcatgtttggacctgatatttgc

SEQ ID NO: 6898 - DNA, 236 bp, Gossypium hirsutum
  Clone ID: uC-gsronu33B050d07b1
ttcacgcgtacgacatgatttccacggatacggagttaggcgagataactcctttctttgggcagtagccattgaaatacgctgaagaaatgacgactacaccgtatggagcggtcatgcctatggatgaacatgcttgtggagacttcaggatgatccactggtagatgcttgtatatatagtacaagaagagtcccacttagtgaccggagatgtacaaacctgataagaatcg

SEQ ID NO: 6899 - DNA, 477 bp, Gossypium hirsutum
  Clone ID: uC-gsronu33B050d09b1
atttcctccacctccactcctctcctatcccattttatttctaaatatgtaactttttaattttaattttaattgcagaaaatatttagtactcacaaaattaactacatttaccgcaatttcagcatttcgtcgttaatcctattttcttgtccgatcccatcccatccacactcttcgctctctttcctttaatctgttttcattttctgtcatttgcaaattgaatttttggttcttgaattctaggtttagggttttgagagatggggcaacagacgttgatctacagctttgtggctcgtggcacggtgatcctcgctgagtataccgagttcaccggtaacttcacaagcattgccggtcaatgtctccagaagctccctacttccaacaacaaatttacctacaattgcgatggccacaccttcaattacctcgttgagaatggattcagtatgaatgtctttttttttt

SEQ ID NO: 6900 - DNA, 455 bp, Gossypium hirsutum
  Clone ID: uC-gsronu33B050d12b1
tatattccatggcaaagacgatgaagtaatcccgctcgaatgcagctttaatgttcaaaaaaaaatccctcgtgcccgagttaaggttgtcgaaaacaaagaccacattaccattgttgtcggcagacaaaaggtctttgccagagaactagaggagatttggaatagatcatcaagaagccattaaaagagtgccattttaattagtttggaatttataagaagaagaaaaaaaatcagtgaaatttgcgtaaagatgacatgagattggcaggctttttcgttctatgttaattgcttaagaccaatgtgagatggtttggtgtgtccatgttgtggaaattgcttaattaattgtaaccatatctatgatgaaacataatgtcctggtaaacacctacccatatatatatatttaaattgttataaataattaatatactcatgttcacact

SEQ ID NO: 6901 - DNA, 279 bp, Gossypium hirsutum
  Clone ID: uC-gsronu33B050e04b1
tccacgcgtccgaaattgccgcgccgtgaattcagcaactatcagatccaactcagatgctgctctcggcagctcaatataatatttgctgaactgaaggctaagaaaaatgggcagaagagaagctattttcctactcaaaatcaaaacgaataatatattgtaactctttaatgcctacaataaaaccctacgacgtttgttgatttacaaaaactatgctctgtaactttttgtgtttattacttagaaggtaatataaaataagcttaagagttg

SEQ ID NO: 6902 - DNA, 514 bp, Gossypium hirsutum
  Clone ID: uC-gsronu33B050e05b1
gttatttgagccagagagatgggttcgaaaagaacagcatcactagccctcctctttgcactcaacatcctcttcttttccctggagagtgcttgtggttactgcccttcccccaaccccaaacctaaacctaaacctaaaccaaagccaaaccctactccctccccatcttcttctggcaagtgccctagagatgctcttaaactcggtgtatgtgctgatttgctccgaggcttgctcaacgtcaccattggtacccctcctgttcaaccctgctgctctctcatccaaggtcttgctgatcttgaagctgccgcttgccttcgcacggcaatcaaagcaaatattttgggcatcaaccttaatgtcccactttccctcagtttgcttcttaatgtctgctcaaagaaagtaccctctggcttccaatgtcgctaaatcagctctctgaattctttctcttttagtgctgcgtggctttgatgttcttaaggtccagtttgaagtgatcaat

SEQ ID NO: 6903 - DNA, 333 bp, Gossypium hirsutum
  Clone ID: uC-gsronu33B050e06b1
ttcacttgtacgacatgatttcctcagacacggagggaggtgatataactactttcttagggcagtagccattgaaatatgctgaagaaatgacagttacaccgaatggagctgtacatgcctaggaatgaacatgattttgcaaagttcaggagattcaattgacagatgcttgtatatataatacaagaagatccgctcatagagactggagatgtacagccctgataagaaacggcttatatagaatatacaggacgtgcaccttccttgctattctaaccagacgagcgatgatctatagggatgtagctgaagatgacttactcatga

SEQ ID NO: 6904 - DNA, 251 bp, Gossypium hirsutum
  Clone ID: uC-gsronu33B050e07b1
ttcacgcgtacgacatgatttccgcggacacggaggtaggcgagataactactttcttagggcagtagccattgcaatatgctgaagaaatgacgactacactgtatggagctgtcatgccttgggatgaacatgcttttgccaactttcaggatgtttcattggatagatgcttttatatatcgtacaaggagagtcccacatagataccggagatgatcaagcctgataagaaacggcctacatatgat

SEQ ID NO: 6905 - DNA, 377 bp, Gossypium hirsutum
  Clone ID: uC-gsronu33B050e08b1
tccaaatgtccgacataatctccacggtcaccgacgtcggcgacataaatccattctttgggccgtggccgttccaatacagtgaagaaatgataccgacaggttatggagcggtaatgctctcgcatgaacatcgatttgcacactaacaggaggatcatccgatagatagtcatatatatcatacaagaggctccgcacctggatacgcggagttgtcaagccatttgaagaaacggattcaaatgggatacaggtcgggcactttcttgcatgctccaacaagaagagcgtgtgctccatatggatttagctgccgatgaattactcatcaaggtcgtgcaaatcgaagttgaacaggaaactttagctatgct

SEQ ID NO: 6906 - DNA, 71 bp, Gossypium hirsutum
  Clone ID: uC-gsronu33B050e09b1
tccacgcgtccgaaaaaaaaaaaagcagtaaagttaaaaagaaaaatacgaaggattactaaaaagaagat

SEQ ID NO: 6907 - DNA, 518 bp, Gossypium hirsutum
  unsure (1)..(518): unsure at all n locations
  Clone ID: uC-gsronu33B050e10b1
ttactttttccttcttcctttctttaaaaatgccaatcaacagagacccttctactcccccgcctatgatcggcaagatcggaccctacactgtcttcgttaccccaccttctactcctacccccactgaacctcctgtttttcagtctcctcagaaggcggtcgcgcctcctgcttctgctcctcctccggtccggccgccgcctcaacagtttgataagtcttttgttgcgtccgattctgatggctccattctgggttttttcaggaatgctatttttaaagtccaaaatgctcattcaagcttggatgaccatttagctcgctggtttggcttaaatcagtccaagtatcagtgggcactggacgattattacgagagcaagggattggaaaaggaaggtgtaaaagtgaaagaaatatcaagcaaaatgcanagtgtgtagcatgctttttgtgctggtaatgagatatttgaagtccctcttctcttcctctggttctggttccccctttac

SEQ ID NO: 6908 - DNA, 471 bp, Gossypium hirsutum
  Clone ID: uC-gsronu33B050f01b1
ggatgctggtgtggaagttgaccctcttggggaccttaatacagaagcagagagaaaattgggccagcttgttttggagaagtatgacactgaattttatattctgcatcgctatcctttggctgtgaggccattctacaccatgccttgctatgataatgccctttacagtaattcatttgatgtcttcatacgaggtgaggagataatttctggagctcagcgtgtccatgtaccagaatttttggcagaacgtgcacaggcatgtggaattgatgtcaatacaatctcaacctatgttgattctttcagatatggtgtaccaccacacggtgggtttggagtgggattggagcgtgtggtgatgctcttctgtgctctgggtaacattcgtaaaacttcactttaccctcgtgaccctcaaagaattgctccatgatcatgatagagcagaatttctgccaatgcaac

SEQ ID NO: 6909 - DNA, 516 bp, Gossypium hirsutum
  Clone ID: uC-gsronu33B050f05b1
attttattttggagatcatgtcgcaagattttcttcggcttgcggccttttccgccttgtttccattttcaaaaggctagttaataattaagctgaatccgcagcaatgctacgaagcaccacggtctccaccgtgagacccggcccaaaggccagtaagacgccccactctagcccttcagtggcggcggcggttttgccttcttctgttgacctttttctcatctcatcaagaacgaataggacgcttggactccacatgtttccatactcacttaacacatgccagcttgctttaagcttgtcgcttcccaatccaagtttctcttcaatacgtttaagaacagctgggccaccgggatgaactacgtaaaacaatttgttccaatcatcaacaccacatggacctaatgtttcgaataagcattgctcaatgttgttggcaattacattgggcaactttttagacaaataatacgccatacccatttcacgtatttttgctattatcacgtc

SEQ ID NO: 6910 - DNA, 518 bp, Gossypium hirsutum
  Clone ID: uC-gsronu33B050g05b1
tataattcaaccccaaacacaaaccaccattagacccatttttaaaccccaattcctcctttgttacagaagtagaacgaaaatgtcgcctttatccaaggtttttgcttcatggtgcaagaagcatgcagatggagatgatgatgacaatgattttgactatgctcccgcagcatgcatggaaggcaatggcgacgatgatgatggagactatgacgttgctccagcagcttctctcgagggtgatgatgatgacgatggcagctatgattatgctccagctgcatgattggagtgagtttatgagtgcccctaaccgtggggtttctaacccaaaactttttgcatttatgagtgcccccccccccccccgggtgcggctttaaagcaccttgtggttgtcgggtttataaggattattttaattaaatgatattcaaggagaacattggatcgtattctatgtcagctatcgttattattttagcaatctgtgacaaacgttaatatcatatacg

SEQ ID NO: 6911 - DNA, 312 bp, Gossypium hirsutum
  Clone ID: uC-gsronu33B050g10b1
tatttgggttcatgactcgatatctaaagaagctagtaacacacatgattgtggaagaaaggaatctgatctgatgtgaaaatggcttacctggttgtttgtgacgttctcgccaccaaaggattgatgtttgactggaaacgatttagaaggcaagcaagtttaatgcttccaaaatctcttgttatttataatagatcccaagtatgttatgctcgtacttccaccctacggctggaaatagttgcactgcagcagtgggttgaattgtatgtttatgtcaagataattcaagagcctcatttgaggatc

SEQ ID NO: 6912 - DNA, 346 bp, Gossypium hirsutum
  Clone ID: uC-gsronu33B050h01b1
ttcacgcgtccggccggcaaagatgccagcagagctcttgcaaagatgagcaagaacgaagaagatgtctgtcccaacattgacggcctctctgaaaaggagatggatgtccttaacgattgggtcaagaaatttgaagctaagtaccctgttgtcggccgcgttgtctcctgaaaatttgcacctttcctctatgttgggtgtaatttgtttcgtttttaagtgtctttagactctggttattacttatctatcaattgtgtttggtgttttgcttagctcagagcaatttctaggttaaataaatgggtgaaaattaataaattgagatacttatgggcttgcg

SEQ ID NO: 6913 - DNA, 534 bp, Gossypium hirsutum
  Clone ID: uC-gsronu33B050h05b1
cggacgcgtgggcggtctcgtgtgcagatttctctcccatttcttgaatttcatcgccttcttcttcttcttcttcttctttttatatctttctttccttcttgtttatatatagagagctgaaaccagttctgggtttgctttaaaccacaataaaaatggcttcttcactctcttttccatgccccaagatctcttcttttttgaaaacaaaccagcaaacccaagctcacaagggttctttgtctcttcctccaacttcaaatttcaactccaaatcttgcttgtcatttggatcttcaatccgcgtacctgcattttcagcatctcagtggcctaatgatgggaagcaaactacagtcttcgcaagccatacgcagcttaacgaggttgctgcagagaaatcatcaaattctgtagcggttgttgacatgaaacctaaagttgcattgcctgaggaagatgataaaagatccgcagagaaggctattccagatgctgcggcaatttcagaattcatggcacaagtttcag

SEQ ID NO: 6914 - DNA, 450 bp, Gossypium hirsutum
  Clone ID: uC-gsronu33B050h07b1
cagggtcgggccacgcccacgtttacgtttttttaggtcccaatctgcaattaaaccctttagtatatggtactatctatgccttcccttttctgtcttccctttatggctccaattttctcttcgtttcttgctttaactctcatttttccattaagcaatgctcaaggtccaccttcccctggattctccccaagctccagagtgagcactgtggcttttgataaagggtttcgaaacctatggggtcctcagcaccaaaaactagaccagggctcattaacagtctggctcgataaaagctcagggagtggtttcaagtcacttcgttcgtaccagtcaggttactttggtgctgcaatgaaactccaacctggttatacagcaggagtgattacatctttctatctttcaaacaatgaagaacaccccggaaatcatgacgaaatc

SEQ ID NO: 6915 - DNA, 392 bp, Gossypium hirsutum
  Clone ID: uC-gsronu33B050h08b1
ttcgggaatgctgaggtatcaatgggaagatgcggttagattttggaattcaaagaaaggagaggaccgtgagcgagttagaacagaaaataggcaaaaacaaaaattcacgcacacggcagggtcgagaagttttgcttctgtagctgaggccgaggaagtcaaatccggacaaaaagttggatgccttcagctttttgagattacgcataggaagaaagatgaatctcctatgacatccgaagctggagaaattatggagaaactaaaggagaagaaggcggaatatgaagtgattgcttcatctgatagttctgttaatcttgagaacattgataacaaaattatcactgaagttttgggtcttgaaaggtacggtcgggttcgattta

SEQ ID NO: 6916 - DNA, 507 bp, Gossypium hirsutum
  unsure (1)..(507): unsure at all n locations
  Clone ID: uC-gsronu33B050h10b1
tctcacgcgtccgcaagtatgatgtggtccaatgaaccgtcatttgaagctgaatggggcacacagatgaaccaagtccctccaaatggattctttaatatcaccacttgtacagctgctgctacatctacttggccactttccggaacaaccgaatcaaccatggacttgtcatattcggaccagtgcccgatagagctgcaaatgaatatgaacggtaaaacaaatatgctgagcatgccaatgtctcaaattgatgaaacagcagaaggtgtttggccatcccatcagcagtttgagcagtgtgacaataatggttggagtagtgctaatggctcttgggatccttacctctatgtttcctctgtgcttggttgagtattagccatttatagattcaatatttaatgcaattctttcattttccattttctttctaacttntactaatcattctttactttttgtgcccaaagaatccccattataagctgtaaattgattttt

SEQ ID NO: 6917 - DNA, 218 bp, Gossypium hirsutum
  Clone ID: uC-gsronu33B051g12b1
tttataatctagtccttaagtacaaattgagaatatttgggcttttggcagatccttgttgtttataccatttttgtaagataaagcttcattattacagtaataatttgatggatgaaagttacttttaaaaaaaaaaaataaaaaaaataaaaataataaatatttatatctttgggcgggcgtttttgaggattccaacttacttacgcccgcct

SEQ ID NO: 6918 - DNA, 328 bp, Gossypium hirsutum
  Clone ID: uC-gsronu33B055a08b1
gttatgcgtacgacatggcgacgatgtgaccgaggaaagaggagaggagaacctaggtagagtgcagagcaatgctgaacttaaattctaagcctctactatgtccatgcacttacttctgtaccgcaactgacgctgcctctgcatcattcgacaaagcgcctcgtcagcttcaaccgttggattaccaggcgaaaccgtacaacggaccggcggacgatcaaatacttgagaagcggaagaagatgatgggcccatttctgttatactactaccaaaagactttgaatattgttgaaggaaaaatgcaatatttgtatgatgaaaa

SEQ ID NO: 6919 - DNA, 355 bp, Gossypium hirsutum
  Clone ID: uC-gsronu33B055b02b1
cccactcgtcctcggacgcgtggggggcttttcattatagataaagagggaattatccagcactccaccatcaacaatgttgctattggacggagcgttgatgaaacaatgaggactctccaggccttgcagtatgtgcaggaaaatccagatgaagtatgcccagctgggtggaaacccggagagaaatccatgaaacctgaccctaagctcagcaaggattactttgcagcaatttgaggtatagcctagaaagcagaaggtatgtgttgcgtccattaggattgactaaaatgagtttttgtttttaatgaatcttttttgtttaaaagaattgcttatcctggatggtata

SEQ ID NO: 6920 - DNA, 161 bp, Gossypium hirsutum
  unsure (1)..(161): unsure at all n locations
  Clone ID: uC-gsronu33B055b04b1
cccacgcgtccgcccacgcgtccgcaaatcttcatgaggatttggttcttaattatgtgtaatgtgggcttttctgctatgtcagaatgtattatgatatttaagaaagtttgttttcaattgnaacaaanantacataaaaaacaacaataacaacaaaa

SEQ ID NO: 6921 - DNA, 360 bp, Gossypium hirsutum
  Clone ID: uC-gsronu33B055b06b1
cggacttcgtggtctttggccctttcctctgtccttggaaacgaaggttatggcttctccctcgttcttttttgctacctttctgttgcttctctctacggttcacccaaaggtgattgctgtggagcaactttcagacgtcaagcttaactctcggatccttcaggattcaattgtaaaacaagtaaataaaaaccccaaggctggatgggaagctgcactgaatcctagattttctaattacaccattggtgagtttaagcaccttcttggagtaaaaccaacacctaagaaagaacttttgggcgttcctattttaactcatgacaaatctttgaagttgccaacttcttttgatgc

SEQ ID NO: 6922 - DNA, 334 bp, Gossypium hirsutum
  Clone ID: uC-gsronu33B055b08b1
cccactcgtccgccatgaataaactgttaatggaggagaacgataggttacaaaaacaagtttcccaacttgtttgtgaaaaaagctactttcgccaacagtctcaacagcaggcggggttagccaccacagatacaagctgtgactcagtggtgacaagtggtcatcaacaccatttgactcctcagcatcctccaagggatgccagtcctgcaggacttttgtctattgcagatgaaactttaacagagtttttatcaaaggccactggaaccgctgtggagtgggtccaaatgcctgggatgaagcctggtccggattctattggaatcgt

SEQ ID NO: 6923 - DNA, 348 bp, Gossypium hirsutum
  Clone ID: uC-gsronu33B055c03b1
ggggatcccaatggttctgcgtcgttcggccatcattggatcactgcgacgatgaatgacgaccttcggtgaccccccctttttgctctttcattcactccagcgtggaactcatcgatttaagccccgaaatcccatctccgacttcgatttcagcgaaggagacgaggtcttcaatagctcgtacgcaaaggtaaagtttcactctccctcttttattttattatacagaaacatatgaaagcgaaaggaatatgaaacagatgctaaactgaattgaaataaatagccctaggtagtttgtaaagactcccccttctgtctcattgcttttctatcgctttcccc

SEQ ID NO: 6924 - DNA, 224 bp, Gossypium hirsutum
  Clone ID: uC-gsronu33B055c05b1
gaagcttctgaaactgatggtggttttttccacttaatgtgatcgatccatttttgggactaaaagatggtaacagaatcttggtttcgtaatctttggaaaattccgcggaggcaagatggaatctctgagaaggttgagatcggagtgttggcattcgaagttgcgagcttgatgtctaagcttgtgcatttatggcagtgtttgagtgattagcaggtttt

SEQ ID NO: 6925 - DNA, 272 bp, Gossypium hirsutum
  Clone ID: uC-gsronu33B055c11b1
tgacgcgccctgttgctgtgcaataagctctgcggtatgttgttcttttttattttcctattcttctatttatctttatttttatttatttatatttctctttttatttttctatattattatatctctatatttttttttttcatttcttttttttttttccaatttacttctattgcctattaatttattttctcctcactttattatatatattttctttatactattttaataaatataatattataatttaatctaacttttatatt

SEQ ID NO: 6926 - DNA, 373 bp, Gossypium hirsutum
  unsure (1)..(373): unsure at all n locations
  Clone ID: uC-gsronu33B055c12b1
ttaagctatggaggtgacacattatcttgggggagaaaattatgtattttggggtgngtctttattttcacatntatgtttttttatttttttttttttaaaattttttttatttttttttttttttttttttatttttttttattttttttttttttttattttttaatatttttatttttttttttttattttttttatttttaaattttattatttttattttaattttttttttatttattataattatatttatattttttttaaattaattttttttaattatatatttttatttattatattataatttatttatttttttttttttattatattttttttatatttatataattatttttattta

SEQ ID NO: 6927 - DNA, 393 bp, Gossypium hirsutum
  Clone ID: uC-gsronu33B055d01b1
cccactcgttcgcccacgcgtccgcccacgcgtccgggaaaccctttatcaaaaaaccgcttcgggcaagcccttcgttgatgttttgaatgaaggtggtgtcctccctggcatcaaggtcgacaagggtaccgttgagcttaatggaaccaatggcgagactttcacccagggtctggatggccttgcacagcgatgccagaagtactatgaagctggtgctcgctttgctaaatggcgtgctgtccttaagatcagtgctaatgagccaaccgtgcttgcaatccaagaaactgccaacggtctagctatgtttgctgtcatctgccagtattgtggtcttgttcctattgacgaactctgaaaatttcgtttgcagtttactattttttt

SEQ ID NO: 6928 - DNA, 364 bp, Gossypium hirsutum
  Clone ID: uC-gsronu33B055d02b1
cccactcgtcttctgaacatcagcatcagagcgtaagggtttagagaagaatatggcggccaaaaggaagacccccgtcaagtcccgaaacccagatctcattcgtggcgtcggcaagtattccaggtctaagatgtaccacaagcgtggcctttgggccatcaaggccaaaaacggcggcttttttccccgccatgaccccaaacctaaggtccccgccttcgtcgagaaaccccccaagttttaccctgctgatcatgtcaagaagccccttctcaacaagcgcaagcctaaacccaccaagctcagagcaagcattacgcctgggacggtgctgattttgttggctggtagatttatgggg

SEQ ID NO: 6929 - DNA, 462 bp, Gossypium hirsutum
  Clone ID: uC-gsronu33B055d04b1
gtacaactatgttgattttatccccattttgaggccattcttgagagggtatttgaagttatgcaaggaagtgaaggaaatcagattgcagcttttcagggaccaattccttgaggagaggaagaagcttgcaaccacaaaaagaattgacaacaatgctttgaaatgtgccattgatcacattcttgatgctcaacgaaagggagagatcaatgaagacaatgttctttacattgttgagaatatcaatgttgctgctattgaaacaaccttatggtcaattgaatggggcattgctgagcttgtgaaccatccctagatccagcagaaacttcgcaacgaaatcgacacccgtactaggacccggcgtgcatgctactcgaaccctcacccattaagctttcatatccgcatggcagtgatcatgtgagactcttatgctctaaattgtcattccttttc

SEQ ID NO: 6930 - DNA, 377 bp, Gossypium hirsutum
  Clone ID: uC-gsronu33B055d05b1
aaacttttgtgctttaatatattcataggatattatattacgaggaacctaggaatgggttctttaggtaagttcaagccatattttgctgcaattttcctgcaagttggccttgcaggaatggatatcttatctaaggctgctctcaaccaaggcatgagcaattatgtactcgtcgtctaccgccacgccattgccacccttgttatggctccttttgcagtcattctcgaaaagaaagtgaggcctaagatgaccatatcaatctttatcaaaataatggttctcagcttactggagccagtcattgaccaaaacttgtattacgttgggattgaagtcaccacttgcaccctttgatgctgccctgcataata

SEQ ID NO: 6931 - DNA, 575 bp, Gossypium hirsutum
  Clone ID: uC-gsronu33B055d06b1
cccactcgtctgttccagccaaaaaggaaaatggcgaattcgatggcaaatttatctagaagggtttatagatgcctcctctgtaaccccagagcttctcatcttttcaatgcccctttgcaccaccacccccgatttcctcctctgctgaaccttccgactcgtactctgttccattttccaactcaccttcttcgcaatcctcaacccccttagactctgccctggactccaacactaagagtctgttatactactgcccgtttgataatccctttgatacctctcatttacccgcctcttctggctccctccgtcacttctcaccctctttcacatgactccccctctcccccttcctctctctcttctctctcctccaccccacctttctttcccattctctcccccttcctcctcaccttcctttccctctctcctttcctccctcttattctccactctctattcttcttctaatctttaccttctctctctccccctttccccctccctccttctccctcctcttatccctctctccccctctctctctccctccccttctcctcccc

SEQ ID NO: 6932 - DNA, 384 bp, Gossypium hirsutum
  unsure (1)..(384): unsure at all n locations
  Clone ID: uC-gsronu33B055d07b1
gtctctttgctgctcagatactcttccagggacaaacactccccaaaaccagaaggagagaccaaagaacaaaacctaaaaacttgctagaggcggcagacacaaacgtgctaggccaaaagagaagcagggaaggaagcacaaagtagaacgggaaaaatgaagctggaagtgtatgctgatcgaatgtcccaaccatctcgcgctgtcatcatcttctgcaaggtaaatggtatagattatacggagcgcaaggtagatatctcaaagagagagcatttgactcctgaatttgctgaaatccatcccatgaaacagctggctgccattgttgacgngaaatttaaggttgtttgagagccactccattcttatatatcttgc

SEQ ID NO: 6933 - DNA, 326 bp, Gossypium hirsutum
  Clone ID: uC-gsronu33B055d10b1
tccactcgtccgcccacgcgtccgcccacgcgtccgatgggttcaagatgtcacccgcgatagggaggatattggctgatttagcgcttataggagaggcatagggagatgtgtttaaacagtttttgaatccaagaattaatttatattttattcttaatatttcgtcaaattatattcaattttttttttctcttttcctatatatattttttttattttctttttttttacttactttttttctattttctctttttcttcaacttatttcttctttttattttttttcttcttttactttttttctcttttttttatctttt

SEQ ID NO: 6934 - DNA, 446 bp, Gossypium hirsutum
  Clone ID: uC-gsronu33B055d11b1
gcgatattgaataggtgaaggacgacaaccctgcagcgtcagactctggtgctactgctggaaatgactcaagaggtgctcgaccggcaaagcaggagcctgtagaacagccagctagttcaccagagcctaagactcccaagcctacttcctctccttcagaagatcgcatttttgcaagtcctcttgcacgaaaattggctgaagaacacaaggtacctctctcaagtatcaaaggaacaggtcctgatggacacattgtaaaggctgatattgaagattatttggcttcacgcgggaaggaagtttcagcaccaactcctaagacaaaggatgcataacttgcagctttagattatgtggatatccctcattctcagataagaatggtcacagcatcacgcttattattctcaaaacagactataccacattattatttaaca

SEQ ID NO: 6935 - DNA, 281 bp, Gossypium hirsutum
  Clone ID: uC-gsronu33B055e01b1
ctcttccaaaatattttccccagggagtgaaaaggaacaaaaaatcttctactcaagaaaagagagaaagatcttccttagcgaaactatttgcaggaaaatcaaaaagaacagtgatgagttattacaatcaacaacagcctccagttggtgttcctcctactcaaggttatccaccggaaggatatccgaaggatgcttatccacccacgggatatccttcacaaggatatcctcaagggtatcctccttaaggatatccttcttcctaccccccctaa

SEQ ID NO: 6936 - DNA, 647 bp, Gossypium hirsutum
  unsure (1)..(647): unsure at all n locations
  Clone ID: uC-gsronu33B055e03b1
ggagctttacctctctgaattctatttactgaagtagtgaagattttagaagacaagtgtgaacgcgtgataacggagctctcatgatgcttttaatatggttagtaaggatgagagaagcaatggattctttattaattcaaggagatattcttgatttttagctaatctttttatttacttatactttggttcattgatgtgatttatctcttttatattaattttttttatttttctttttattatcttttatttttcgtgaatttttgttagttatatactgatacttttttttagattatatatatttacttttttataattctaaatattttttatttgtataaatatatttctttttttttaattttttttatatttttatattctaataatttgtatncatctaaatatttcttatttatattctattttttttattcttatgtttaaatactttttttattattatattcttttatattttaattattataatacttttttttatatcatatttttaatcatattagttattattttttttatcttttaaacataattatatttatttattatttcttttattatacttattatatttattatttatttaatatttttatatacttatttatttcttt

SEQ ID NO: 6937 - DNA, 296 bp, Gossypium hirsutum
  Clone ID: uC-gsronu33B055e05b1
aaaattaaaattataaaaaaaaaaaaaaaaaaaaaaagaaaaaaggaaaaaaaaaaaaaaaaaaaaaataaaaaaaaaaaaaagacaaaaaaaaaaggggggggccgttttaggaggcccagggtttcttccccttgctttgtaaccaaaaaacttttttgggggggtcccctaaataaaattaatgggcggtcggtttaaaaccccctaattggtaaacccttggggtccccaaaattattggcctggcggcaattccccttttgggggggggggaaactcccgaggggcccccc

SEQ ID NO: 6938 - DNA, 524 bp, Gossypium hirsutum
  Clone ID: uC-gsronu33B055e06b1
tttatgttccggcttacgtcccgtgcttgctccctccttcccctcttttcgtgttatcctgcgtctctctcctggcccccccttttccactcccctcctgtgactcccctcctctctcccatcttcctcttttttctcccccacctcccttttccctgtcttcctcttttttgtcctcccccccatcccccccccctctccacccccctattctcccccctcttctctcttcttcgcctctctccctttttgtttcacttctttctcctctctcctctcctctctttttttctccttctcttctcctatcctcctcttcactcttctctcttctcttcccccccccctctccatcttcctctccctccctcctctctcatcccctttttctctcttcttctctcttctaccttgtctcccctcttctttctcctttccccatgttccctctcccctctcccttttctccctccctttttatccttctcttcctccttcctcttctcttcctctctccctctctc

SEQ ID NO: 6939 - DNA, 430 bp, Gossypium hirsutum
  Clone ID: uC-gsronu33B055e08b1
ttcgaatggttaaaacttcgaacagacaaggctcttgtggaagatcccaagttcaagcgctacgtggagctctacgcgaaggatgaggatgctttttttagagattatgcagccttgcatatgaaattatctgaattagggtttatttcaccaccatcaaagttattttttgaggtagatttggtatttcgttttcgtttcgagtcactcttatactttattaatattgtatctttattcatctattcttttccctctctctattctctattaattattttctttctttttttctttctctattctttttttaatttctttatttttcatttttcattcttttttcttttttttttatctttctctacctatatcctattaatttttaattttatctttactttcttcttacttttttttttattcattt

SEQ ID NO: 6940 - DNA, 415 bp, Gossypium hirsutum
  unsure (1)..(415): unsure at all n locations
  Clone ID: uC-gsronu33B055e09b1
ccgagaaagagcgagcccgtcgcgaccgtctttataatctcaaccggtccaatcagaaccagcaacgtcgtgaagctgccatcttcaaatcctccgttgatatccaacctgaatggaacatgctcgaacaaattcccttctcaacattcaccaaattatccttctccgtctccgaccccgaagacttacttctctgtggcgctttggagtattacgataggtcctttgatcgaatcaccccgaagaacgaacggagactcgagaggttcaaaaacagaaacttctttaaagtcaccacaaccgacgatccggtcatccgaagattggccaatgaggataaagcaactgtttttgcgactgatacgattctggcaactttaatgtgtgcccncaggtccgtttattcctgggatat

SEQ ID NO: 6941 - DNA, 337 bp, Gossypium hirsutum
  Clone ID: uC-gsronu33B055e10b1
aaaagtttgtagtattaagaaaaaattagaaaaaaaaagaacaaaatccccaagcagcagcagccaaaaacgggggcaaattgaagaatgggtgttgattattacaagattcttcaggtcgaccgcaatgcaaaagatgaagatttgaagaaagcgtatcgtaaactagccatgaagtggcatcctgataagaaccctaacaacaagaaagatgctgaagcgaaatttaagcaaatctctgaagcttatgatgttctgagtgatccccaaaaacgggcggtttatgattcaatacggagaagaagggttaaaaggccagatgtcgccttcaggggcg

SEQ ID NO: 6942 - DNA, 214 bp, Gossypium hirsutum
  Clone ID: uC-gsronu33B055e11b1
tcccactcgtccgagctgctccaattgaagcacaggatgtgtccaagcctgctcctgctcctcaacaagttgccaagcaaattcctgctggtattaacagtacgcgtgctgatggtcagaacactggcaatttcattacggatcgaccatccaccaagattcatgctgcccctggaggtggatcttctctggattaccttttcggtgggggacc

SEQ ID NO: 6943 - DNA, 159 bp, Gossypium hirsutum
  Clone ID: uC-gsronu33B055f01b1
tccgggttggacccacgcgtccgccaactttttcctgtcttcccaacgctgatccgatcacagtggccgacatgtttggttcttcatcatcgggttcggaggaagatgacgagggaatagactcttacaggaaaggaggattttatgccgttcggatcg

SEQ ID NO: 6944 - DNA, 631 bp, Gossypium hirsutum
  Clone ID: uC-gsronu33B055f02b1
cccacttcgtctttagacattacaaaacttaccggtagacagaaaaaattattcgagttgagactaaagatgaacgaagcaagaaaagctaatcaaacggctatggtggctgaaaagaaacgaatggaagctccacctgaatctagaggaatttctaagcaaaaatggctcgaggaaaggaagaaaaagattgggaaacttttggatgcaaatgggttggatttgcaaaaagcgtatatgctcgatactcaagaggcagccgaggcaaaatataagaaatgggaaaatgatcccgccccgtttgtttgtgactgtcttcaacaaactatattgtttatttgattcatataattgataatgaatatttttatctttttatatgtttcttataaattttattgaattttatccatatttctctctcttaactttaattatacattttttatcagcatttatattttactttatttattctttttatttattaataaatatcatttcttcatatattttttttattatatttcatttttaattcgtttttcttatttttatctatttttatttcattatatttacctcttgtcattttcatattccttttatacatctgttacttattttaatt

SEQ ID NO: 6945 - DNA, 296 bp, Gossypium hirsutum
  Clone ID: uC-gsronu33B055f05b1
taaagtcacttttgctccatcttcttcacccaattcttgtaagccacttggaaatctgagcaaatggatgacaagcatgaaggagatagaagaagatctgaacaagaaaataagcttcttgagtggacttattgtggcttttagagatcaaattcacactgatattcagctcaaaccgggcaacgatggtccttccataccagctcacagggctttacttgcagcaagatcagagatatttaggaacatgctagactcagatgggtgcaaagttccaccaagtgatgcatttacac

SEQ ID NO: 6946 - DNA, 335 bp, Gossypium hirsutum
  Clone ID: uC-gsronu33B055f06b1
accattatggtttcatatctgcagcgagctgcgccatgtcatgacaaaccttggtgaaaggcttacagatgaggaagtcgacgagatgatccgcgaagctgatgttgatggtgatgggcagatcaactacgaggagttcgtcaaagtcaatgatggtcaagtttaggacctttccatctataaccaggattcaaaattgggtgtctaataatatggaagtttgtaacaggtcatataattttgttttgatttcatttatctatttggacactttcttttttttatctctccttcttttttcctcttcatttctcctttctctttcacattttttc

SEQ ID NO: 6947 - DNA, 340 bp, Gossypium hirsutum
  Clone ID: uC-gsronu33B055g01b1
cccactcgtcctgtcacgcgtacggtacatcttcgcttggagattagatccaaaattcccctttcatcatatttccgattccccaatttttcctgaaaccctaatcctaatcccggattcttctcgtctacatcgtctagcaaatggcaaccgaggagccggcagtcgtggcagaccccgcaccggagacggaggaggacaagactgcttgagaccaaagctactttaaaatctggcagagcaaagaaaaccaaagaacccaataccaagaaagctgatgctcctcggaaaccacgggctgctccttctcattcaccttaccgagagatgatcaaagatg

SEQ ID NO: 6948 - DNA, 238 bp, Gossypium hirsutum
  Clone ID: uC-gsronu33B055g03b1
cccactcgttctgtctcccaaactgaatcaaaagaccactttccaccaccagctggcccagggcggctgcgaagaaggctttcatctctgtctctaaaactacaacccacttcttcaccggcgacgtcatggacatctcccagatccaagaccttgtctttcctggcagaatatgcctgtcgcctcatcatgaaacggcgggactgccccataccctctccttctttacctccccttt

SEQ ID NO: 6949 - DNA, 428 bp, Gossypium hirsutum
  Clone ID: uC-gsronu33B055g04b1
agaaattccatattagattcctgtagaagcttctagaatgataattctgtccatattaacactgatatagggcattctcggaaaagatggtccatcgtttccatgctgattcacaccaggggcaaattgcattagtaatttgctttctgtattgcatgttagctcgtgtaggcaagtgattctggaggttttccaaattgtaatcttaattttggagggtagatttaaaagctatagttttttttatagaaactactgtagtcggtttggaaagcataaacactaggatcttccgacctttgtaatagtttataggcacgatggacagagtattctcccgagagttcaccactccaagccaagaaaatattatgaggtgctttcgccagtggaatatgtagaatctcctcagttcctttgttttgaaa

SEQ ID NO: 6950 - DNA, 169 bp, Gossypium hirsutum
  Clone ID: uC-gsronu33B055g11b1
cccactcgtccgaagaaaacgacggatggaaactaagagcagcggcgtagccggcggcggatcagtctcagagtcgtcgaccatgatactccacaacgcggtggtcgtcacaatggattctgattgccgagtctttcaaaacggtgctgtcttcatcgacatagacata

SEQ ID NO: 6951 - DNA, 612 bp, Gossypium hirsutum
  Clone ID: uC-gsronu33B055g12b1
tggagatcccgtgttagaggaggcaatgtgaagtggagggcattgagataggatacaggcaactattcatggggtatgcgaagctctttctcctttgaccctgtttttttgatgttttattttattttctattccttcatatctttttaattttcttctttcttttacattatttttaatcttttatattttttccttttatcatttcttttctttctaatcttctttctttttttctttttctttttttttttatttattatttttcttttttttatcttattttttttttctatctcataatcttatttatatttatctcactatttttttttctcaatcattttctatattatccttcttttttttcacctattttttttctcttttattttttttttcaatttaattcttttcatttattctattatatttctttctttttatcactctttatattatacttactctatctcatattttcctctctcttttctattctttatttcttcttattcttctctctatttatcatctcatcttctttccttaatctttttacctatctaatctttcatctctcatctcattttatatatattattataactt

SEQ ID NO: 6952 - DNA, 129 bp, Gossypium hirsutum
  Clone ID: uC-gsronu33B055h05b1
cccactcttccttccaaaacggacttcgtcagggaaccgatgctttaaactttaaacgacgggttcataaacatgctatttgcggcatacccctcccctttctcatattcactatctatcccctcattc

SEQ ID NO: 6953 - DNA, 64 bp, Gossypium hirsutum
  Clone ID: uC-gsronu33B055h06b1
ccaatttttccgtgaagttaacgatgttcaatggacggggtggaactgttggaagaggaggtgt

SEQ ID NO: 6954 - DNA, 96 bp, Gossypium hirsutum
  Clone ID: uC-gsronu33B055h07b1
ccccatctgttcgttcttagaccgcgagcgtaactcccgggcgacgggagaaaactaacgcggggatgctacaccataaccctaaaattgatgact

SEQ ID NO: 6955 - DNA, 244 bp, Gossypium hirsutum
  Clone ID: uC-gsronu33B055h10b1
tcgcccacgcgtccgcccacgcgtccggttctcgagctctattgtcttcactcagcttctactgattttgatttgacaggacaattggtatggcctggtgcaatgcttttgaatgattatctctctaaaaacgctgagatgcttcaaggatgttccgcgatcgaattaggctctggtgtgggtatcactggcatgctctgcagcagattttgttgtcaaattctttttgactgatcataatgaa

SEQ ID NO: 6956 - DNA, 338 bp, Gossypium hirsutum
  Clone ID: uC-gsronu33B057a01b1
cccttatcatgctccaaccgagccagtacagctcggcggcgttttttaaggtcattagctttatgttaaccgccggaaaagaaagacaaaagctacaccgcattaaagcagctgcttcagatcggagccagctgctattcgaacatatccatacaagtgaatgcgacttaaactgagaaccgagcagaatgaagaattccgaaccaactataaaagcaatcattttgactgctaaaccaataatgatagatgcagcgcatcaacgattgaccctaaaacgagaacagaatcacgatttaacctgctaaaaaggaaaaatctgcttacaattacaacca

SEQ ID NO: 6957 - DNA, 422 bp, Gossypium hirsutum
  Clone ID: uC-gsronu33B057a06b1
gccttcatttaagttagatctttggagattacccgagatgggagtaattcatttgaagagattctcatatagccgtttttttaagaacaagctagaaacatatgtggactttccaattcatgatctcaatctctccaattacatttcccatattgataaccaattgtccaattgttatcaattatatgcgggaactaatcactatggaggcatgggaggcggtcattatactgctttaattgatcacgggcatggtagatggtacgagtttgatgacgacagagttttccccatcagtgaagacagaattaaatcatctgcagcatatgtccttttctatagaagagcccgggagatgtaattttaacggagtgaaacatatatcgggatttaaaggcagaacttaaacccgggttttaata

SEQ ID NO: 6958 - DNA, 557 bp, Gossypium hirsutum
  unsure (1)..(557): unsure at all n locations
  Clone ID: uC-gsronu33B057b03b1
gtctttttgagtctcacttcccttgtttcccgttggcagggcatcaagcgcaagttggtagaggggagtcatgcagagaacttgcaagctcataggtgccgtgctcgtcttgatcacttagattcagcggatgctgagaacctttctgaatggaataatgtgcgattgaagcgggtccttgtggactacatgtcgcgtatgtcatactatgactctgcaatgaagctggcagaaagtagcaacatacaggaacttgtcgatattgatgttttccaagaagctaagaaggttattgatggccttagaaatcaagaggtgggtcctgcccttgcctggtgtgcagataacaaattaaggttgaagaaatccaagagcaaattcgagttccagttgagacttcaggaaatcgttgaattgggacgagctgagaactacatgcgcgctatttcgtacgctcgaaggtaccttttcccatggggagcaactcattngaaagaatttaaacgagtcatggcacctttgcccgtagaagccacacttgatgtgcaaaatacaag

SEQ ID NO: 6959 - DNA, 568 bp, Gossypium hirsutum
  Clone ID: uC-gsronu33B057d06b1
ctcgatgggctgctgctgcccagtttgcacttgcggttagccttacttcatcgcagaatgaccttactcgcttggaaatcgaagatgagaatagtatcctcaagaaaacgagagatgctgtgataactcttcagggagttctggaagggaagcatgataaaacaatcgaagagtccctagatcagcgtcagatgtctaaagatggatggtggtcagcactttacagaatggttgaaggtcttgctataatgagcaaattgggaaggagcaggcttcatcaatctgattatggtttcgaagacagatcaatcgactgggatcaaactgaaatgtagagttcaatctctcccgtctggattttggattcataactgaatgcggttttgagtgtagcatctgaaaatttgccaaagtttacatcaaggattgttagccatgaatctgtctgataaccttctcttttttttttttggcattttgaaccccaaaattgccggacaatttaggtggattgttaaaagagctgcattataaatatcttctttgcacttttttttatccattttat

SEQ ID NO: 6960 - DNA, 416 bp, Gossypium hirsutum
  Clone ID: uC-gsronu33B057g06b1
cttttagttgccattaggagcggatacccaactttgatgattgctgatgacattgaacaggaagctttagcaactctggttgtgaacaaacttagaggtgctttgaagattgctgctctcaaagctcctggcttcggagaacgcaagagtcagtattctggatgacattgctatccttactggaggtactggtattagagatgagggtgggctttccttggacaaagctagcatagaagtcttgggtcatgcctctaaagtggtgcttaccaaggatgcaaccaccatcgtgggcgatggaagcacccattgagcaaggcatcttcgggttggccagctctgagatctcattgaggctgcataacaggattatgagaaggaaaaacttcaacaaagggatggttaattatttggtg

SEQ ID NO: 6961 - DNA, 509 bp, Gossypium hirsutum
  Clone ID: uC-gsronu33B057h12b1
gatgaacttggtctccctccccctacgggttccacaattgaaactggaggagggttcgaagcgactgatttggtgcgagctgtctcaaactcctcatgaatcgatgatttgtgggggttcgaggaacagaaccctaactacgattctttcgagtttggattcgttaataatttcaatgatggcaccgctgcatatgatgcactgttcgagtattccgatgtctattacgattcctccgatatttctggtcaactatggcggccggaaactttgtcggcagagtaaaaatctaaacttaaaatccaaaaaaaagagagaagaaagatagcaaaccaagctaaacacaagacagtcatagccgatctgtaaatttttttttcagctcatgttggggtttgcgttagaaaattttttattaaaggaaggtttatccatcacataaatatgtaattctcgctccttttatatataaatagtttttatttcttgttcaatgtgtttttttatat

SEQ ID NO: 6962 - DNA, 434 bp, Gossypium hirsutum
  Clone ID: uC-gsronu33B058a04b1
ttaatttatttcttttgtttcttttccattcggaggacctagttagtgcctcagcttctctttactctgtaatggcgaagtcaaagaatcacacggctcacaaccaatcttacaaggctcacaagaatggaatcaagaaacccaagaggcaccgccacacttccaccaaagggatggatcctaagttcttgaggaaccaaaggtatgcaaggaaacacaacaagaagaatggagaatcagccaatgaagaagagtaggcttttagtggggtaaaagaaaattctagcctgggttaggggtttctaattatgggtgttttgtttgcttcaatggaaattagggttttgtttttttcagcattagcactattttgattattatctttgatataaaatatttgaagctttgagcttatcaatattggattcaaacaa

SEQ ID NO: 6963 - DNA, 439 bp, Gossypium hirsutum
  Clone ID: uC-gsronu33B058b03b1
ccctgttgtactcttgaattctttccttcacttcctcgagaaataaaaatgtcttcaggttgctatagcggatctagctgcagctgcggcgacagctgctcatgcagcaggaaccttaaccttggatactcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagcaaaataacaggcctctgtaatgatttattttcaaggatgaatgcctgcaaggactatgactataattatgtctctgtctgagtcttgtgtaacagaagctttgtttgtggcgaaaataatg

SEQ ID NO: 6964 - DNA, 381 bp, Gossypium hirsutum
  Clone ID: uC-gsronu33B058b07b1
ttctttaaagacagaggtggagatcatcaaggaatggaatgtttaactgcaagatcccatcttaaaagtcgaaaagcaggatagtgcaattgttgagtgggataggcgaatcttgcataatcgtgatgttctgtcaaggattgagattgacgaggcaaaagttgttgagacccaagctagattggagccgacaactgcccgtaaattgagactcaccaacaagaggtcgataacgctttgcaaagaatggaaaaagaagcagaacgaatctataaagatgaccatggatcggttcttgaggatgaagctgcgtcaacaagagaagcaatgtatgatcaggcagaaaatgtgtagagggaaccggagcctatgaatgtacaa

SEQ ID NO: 6965 - DNA, 381 bp, Gossypium hirsutum
  Clone ID: uC-gsronu33B058b09b1
tgctcacgcgtccggctgtcttcttatgctcttccatgttggtctctttaattgctctcttggtgcattgaattcaaagcttttcaagactttatgacattggctacccttaatttcactctcactggtgatgaggggagtagcctctaatcttctccgagataatatttgggtgttatcaattttcaatttctctaaagttttaaatatctctatatatatcatgttacattagtgacataaatttgattttgtaatgtaattggtgtgattttcttatatatcatagatatataagggtattgatcctatttcttttggattcatattatgcagtttgctttgctttgccttttgtaataataatttttttttgggtgg

SEQ ID NO: 6966 - DNA, 447 bp, Gossypium hirsutum
  Clone ID: uC-gsronu33B058b11b1
ttcgtacgcgtccggtgtttatcaatgttccatggtggtacttggctttcaatatgatgattagtcctttcctaactcagagaaccaagagcaagtttgtgtgtgcaagtccagccaaatcatctgatatccttttcagatatattgcgcctgaacaagtaccagttcagtatggtggattgagcagggacggcgaacaagaatttacggttgctgatgctgcaacagaggttacagtcaaaccagcaaccaaacacagcgttgaattccctgtaactgagaagagtactgtggtgtgggaggtacgagttgtggggtgggacgtgaactatggagctgaatttgtgcccacagctgaagatggatacaccgtgattgtatcgaagacgagaaaagtgggtccggccgatgaaacggtgatctccaacagcttaaaacgggtgagcc

SEQ ID NO: 6967 - DNA, 479 bp, Gossypium hirsutum
  Clone ID: uC-gsronu33B058c03b1
ccccgggggtcccgttccgaattcccgggcgccccccacgcccgtttttaggatcccctcgaggttgggggggacgtggaatatttaagaggctaccggtatttttaggatgaaacatagcacaacaacgatctataaatttggagaatatgtttgtacctgaagaacatgagaagtcgttgatgtgttaaaccaagtctcttttcaggacaagttttgtttgataccagatgctgatgagtttctagattcactatggactaacaacaggcattgcagtcctctggagattgctttaaagttgattggataacatcttggatttgagttcccaatcctgtcgaattctagtgcatttgaagaaacattgcatgttttttagagtgtggagatggctgtatctttcaggacagtgaagttaaagagtgactctgcttatcaaggatgattcttcagacctgattatgtagactccgact

SEQ ID NO: 6968 - DNA, 424 bp, Gossypium hirsutum
  Clone ID: uC-gsronu33B058c07b1
ttgtattttccacttcactccccactatacacaccatcagtatttgcagatgatcaaagcatgcagaggaagaagaagaagcagaagaacacgaagtagtttgcattattcatttctcatctaaaactttaatcagattttgattaacatagaaaaaaaaaaaaaaaaaaactgttcaccaccccacaacattttataattcactagtctttttgttttcttgttgggttttcttttaaatgggttttctttgccattttggggttttatgttaaaggtctttttcttttctttttttcccctttccctggtttttgttgcttaaaaatggagtccacagagttgtaacatagggacaaagtggttttcattttgccctttggcttttattttttctggactttttttgaaagatggttgcttt

SEQ ID NO: 6969 - DNA, 343 bp, Gossypium hirsutum
  Clone ID: uC-gsronu33B058c11b1
tcgtttcgcgtccgcccacgcgtccggaaaatggcaaatatgcatcagccggtttgtgtgaaatataagttcatcactcccttgtaagagaaaacaactggatcttctttcatccttctttatggcatctttaaatcactctgttctctttgtatgtttacataatcacatttgagttgcgtatatgagatggaaaccataccatggccaagtacagctgttttgagcctttggagctatgttacctggctttcatttttcctaagatactcgccatacattcaaacttgagtttgagatttttagctttcaaatatatagattttttttaaaaggaataaaa

SEQ ID NO: 6970 - DNA, 436 bp, Gossypium hirsutum
  Clone ID: uC-gsronu33B058d07b1
tcgttataatgggtgttcatctttctttcttcattgccgaaattgagaaagaaaaatattgtttaagaagccaaggcattcggccatggttatctcaatttaaaggtatgtaatgtgattttttttttgtaattgattatgaaattaaagtgataagtactgtgacaaccctaatttgaccctagtcgggaagtggtttcgggaccacaaaaccgagtcataaaaataattgattgttatattctatgcttattatatgtgtacatgcatatgtgaaagtttcatgctctaattttggcatttgtatgtgaaattattaaataggacttgtgtgaaattattggggaagggggatggtaattttaaaaaggggtctattaatgcatgtcacaaaaagtttggactttcatgtcaaaaattcaatttttttattaat

SEQ ID NO: 6971 - DNA, 438 bp, Gossypium hirsutum
  Clone ID: uC-gsronu33B058d09b1
ttcgtagaattcagctataacaagatacttaaaggcctgtattaggagttttgctgcaatgttaccgtggtccaggaccctgaattaggacaggtgattcaacttcaaggtgaccagcgtaagaatgtatcaaccttccttgttcaggctggcatagtgaagaaggaaaacatcaaaatccacggtttctaagcctgtgctgtggaagcaggaaatactatctatctgattaggacatatctaagttggttggatgacaaagtatgcatgttgtgttacatgtgctttccagttcagtggatgattatgatatgtttggaagttttgtttggctatgttgattatattagacctttatatgtgttgaaatattctgtggtttggtgcttattttggcaattagtatgggtggagaaaaatgagatatagtaattagag

SEQ ID NO: 6972 - DNA, 328 bp, Gossypium hirsutum
  Clone ID: uC-gsronu33B058d12b1
ttgttagacccacaatcaggcaaggaccggggagcgcactttgaacgcacccaggattaatagcaggaccatgtgagaacttatgcaagattcaagataagcgggaatctggaagcacatgttggtactgacgaattagtaccgaactaaatgtaactgaaggctaagtaactaggaataggaggatgacccacataacagcatagagagataaagggtacgggtatatttaaatgcacaatcatggactgagtcccaagagagtgtgcaccaaaggcaaatagctgctcaaaggttacaatgaaagtgatcgccatatcgctgggac

SEQ ID NO: 6973 - DNA, 362 bp, Gossypium hirsutum
  Clone ID: uC-gsronu33B058e01b1
cgttcggcagactcaaaatacagctgaattcctgcttcttgatcctctccttgtcctaccttttccttcccctcattctctccgacgccagaaaggatgctctcatcgaaggatggacgtcgatcaagatcatcaaggatccgcacatgacagagatcacagaatttgccgtcgacgagcataacacgcagttaaaggggagtttgaaagtggaagaggtagtgaaaggcgagactcaggtgatctccgggatcaattacaagctggttctgcaggcaaaggatggaacagctgataactcatgcgaggctgtggtttgggagaaggcgtggttgaaaattaagaagcttacctctttaccc

SEQ ID NO: 6974 - DNA, 383 bp, Gossypium hirsutum
  Clone ID: uC-gsronu33B058e04b1
ttattaaaaaaaaaaaaaaaaaaaaaaaaaagaagaaatataaaaaaaaaaaaaaaaatggaaaaaaaaaaaaaagaaaaaaaaaaaaaaaaaaaaaggaaagaaaggggggggctctctagtggggccacctaaattcacttcactggccggcgttttacatcttctagagtgggaaaaaaatggagttacctacccgactttttacaagggaaatcccggtaaaccccggggtatacccaattaaaaggccttgaaaagatcgccctttttaacaattggggaaatatggaaaggggaacgggacgggccctgtttcgaaacatttagtcccctttttggggtggttacgcccactcgtgacggtcccttttaccagggcc

SEQ ID NO: 6975 - DNA, 421 bp, Gossypium hirsutum
  Clone ID: uC-gsronu33B058e11b1
tttttgttgttgaggacttgttcattgctcatgtgagtggattggacaccttggcttgtgtactccgaaatgctgttaagctgattgaggatggttctttggctgagcttgttagtaaacgatattctagcttagacacagaacttggtgcccagattgaggctggtaaagctgattttgaaatgcttgagaagaaagccatggaatggtgagagcccaaggttgctttagccaaacatgaacttgcatagatgattttacaatctgtactggaggaatacctgattgaccgattatggtcaatgttttcgagttttcctttttagttaaggaataagtcatgatgcttaatacaaaataattagatttttgagcttataacaatgcattaagtgcttaattttaaagaaaaatggtatgt

SEQ ID NO: 6976 - DNA, 444 bp, Gossypium hirsutum
  Clone ID: uC-gsronu33B058e12b1
tcgtttgtttactggaaaaccctagaaaccagcggctctttcttcaattttcgcttttttaggcggcggtaactcagaggtcgttttcttcttcttcacaagacacaatggcagatggtcatgaaactgacaagaacatcgagatttggaaaataaaaaagctaatcaaggcactagaatctgccaggggaaatgggaccagcatgatatctctcattatgcctcctcgtgatcaaatatcccgtgtcacaaagatgttaggtgatgaatttggaactgcatcgaacatcaaaagtagggtcaaccgtcagtctgtgttggctgccattacttctgctcaacagaggttgaagctctataataaggttccccccaacgggctggtgctgtacactgggacaattgttactgaagatggcaaggaaaagaaggtgacaattgact

SEQ ID NO: 6977 - DNA, 136 bp, Gossypium hirsutum
  Clone ID: uC-gsronu33B058f01b1
gctggacccctgaggaccgtttctgaatcccggccgtcccacccgaccgttcttttccccgcccacgcgtccgcagtccagaggggttttttaaacgctttgcccctgtaaaccacgggtgacgaacaagtactac

SEQ ID NO: 6978 - DNA, 206 bp, Gossypium hirsutum
  Clone ID: uC-gsronu33B058f05b1
tttataaaaaaaaaaaaaaaaaaaaaaaaaaaagggaaaaatttaaaagaaaaaaaaaattaaataaaaaaaaaaaaaaataaaaaaaaaaaataataattataatgtaactcttttttatttgcggttgctttctatactacatcttcttttaatagtcatactttttttttaatttaaacttctttatataacaacccctttcc

SEQ ID NO: 6979 - DNA, 370 bp, Gossypium hirsutum
  Clone ID: uC-gsronu33B058f09b1
tttttgatgtcggtggccaagacaagatccgtcctttgtggaggcactatttccaaaacactcaaggtctcattttcgtggtggatagcaatgacagggaccgtgttgttgaagcaagggatgaactgcacaggatgttgaatgaggatgaattgagagatgccgttttgctcgtatttgccaacaaacaagatcttcccaatgcaatgaatgctgctgaaataactgataagcttggtcttcattctctccgccagcgccactggtatatccagagtacatgtgcaacttctggagaaggcctttacgagggactcgattggctttccaacaacattgctagccaggcatgagggaggatgggtgtttg

SEQ ID NO: 6980 - DNA, 361 bp, Gossypium hirsutum
  Clone ID: uC-gsronu33B058f12b1
tctttttggaagtgaacaagaagggcgtacatacgactggttttccacacacacatttttttaggaaaggagaagtgggagattggagcaattatctcacacccttcatgattgaatgtttggagaagcttattcaagagaaattgaatggctcgggtttaacatttaaactgtcctccaaaacttcaaacaatatcgcttccccatgatcgtggggatgtctattctaggttttttgggagtgaaatctcttttattcccattttctttataaataatctgtactaatcatgataagaataaattgttttggggtatgtttttgtggattttatgtgaaaataaataaaaaattgcatta

SEQ ID NO: 6981 - DNA, 167 bp, Gossypium hirsutum
  Clone ID: uC-gsronu33B058g03b1
gttttaaagcacgaaataaataaaaagaatgttgcatatttttcccatatccaaagcacaatgacaagttactgtggaaccctttgtttcgttcaatgtaacaaaaaagtctttagttctaaataaaaaaaaatttaaaaaaaaaataagagaagtaaaataaataa

SEQ ID NO: 6982 - DNA, 366 bp, Gossypium hirsutum
  Clone ID: uC-gsronu33B058g04b1
acttgacagctcaaaatacacaaacattatttggtattttacatcatccaatcataatacatcatcaaatcaacaagtccaaggttaatgataaacttacaccaccgcaaactatgtttgctttatttaggctaccactgccatacacaatcatacatgccaaacgggcttagtagaaactataacatggatgaaacatggttctgtttgtggaatgccagttcctactgcagaacaacgcattcttgtgtcccacccaccatagcgcggtgggaggttttggtgatggtgctttcttcttcagtggattcagctttaggatcgggctccttaggcagacttttagcattatgttcaatgccattt

SEQ ID NO: 6983 - DNA, 440 bp, Gossypium hirsutum
  Clone ID: uC-gsronu33B058g05b1
tttttgcgtccggttcctgcagagtgaggaagctcccctgaaagcttcagttgaaaatgcctaagcaaattcatgagatcaaggacttccttctcactgctagaaggaaagatgctcgctctgtaaaaatcaagaaaagcagagatgttgtcaagttcaaggtccgctgctccaagtacttgtacaccctttgcgtgtctgatgctgagaaggctgacaagttgaagcagtctcttcctccaggtttgagcgtccaagacctgtgaaattaaaactgcccttagcttgtactaggcaatgaaaactagattttgacttttagtttattgcttgcatttcgaatcgttttgcaacgatcaaaagtttttataatggatttttatttggtgtttttttatggacgttagtaatgttattaaaaccctttatttattttagta

SEQ ID NO: 6984 - DNA, 352 bp, Gossypium hirsutum
  Clone ID: uC-gsronu33B058g08b1
tcttatatgctgagcctcaacgtttcgaaagggacatgttaattcgaatttcgctgaccccaaatcctggctttcaggtgataatcgcaacatcatgaacggtaactcctccccgactcaccttccaactcactcttcactcacttactccaacgccaatctggatcgcgtcctctacaacgatctcgtcgagatgatccctctcgttcaatccctcatcgagaggaaaccaagtagttcatttacaaggcgtggttcgatgatatacaccaagaccccttcaagggaatccttatctggaaatgtttactgatatgaaagggaggaatggagctcagtcaattccaatgag

SEQ ID NO: 6985 - DNA, 434 bp, Gossypium hirsutum
  Clone ID: uC-gsronu33B058g12b1
tgtcacgcgtccggaattttttctcccctcaagttcctttctgcccattgtaacaatttcgttattggaaaaaaaaaagaaaaaaaagagaagttaatggaaaacaaatactcttgttcttccctccgttgtttgctccctcttgaatattcaccgaaatcccaaaaatcccatcttgtttttgttttgtttttgaggttcaaatttctcaaaactctggaaaggaatcacacatacctatggaggaattcaagacgatcaagaagaaaatgtggatgttttctctttagtctttctttctgtttgaaaaaacgatctccctagaattgttcacttgcgttatggaagctatcatcgaaacaatcatagcactgatcatcggcaacaacgagaaagtcgctaaccatcaaaactttgttcttaaaagctctttt

SEQ ID NO: 6986 - DNA, 422 bp, Gossypium hirsutum
  Clone ID: uC-gsronu33B058h02b1
gttcttaagcaactcaagaaagtggctgccaggggattttataccgacactgcttattcaccgccaacggaagggccaacccatgatgagatagacatgaaaatcttagggaacctgagcagtgacccttacattgtacacaccaaagagtttacccaagggaacggcaacagcagaccaacagttcaaatcgttggtttgacactacatgaaacttccacacctattccaacacctggaaaccccaacacatcattaactcggacgaaaacacccccaatagagtctgcaaaaaggctgaatccattggtgtaccattccgcaaagagccaacccatgaagatatactctagactatcgaacgctgatgaaagcggcacatggagtggattagggaaaactgattgagacaaagcaccttt

SEQ ID NO: 6987 - DNA, 455 bp, Gossypium hirsutum
  unsure (1)..(455): unsure at all n locations
  Clone ID: uC-gsronu33B058h03b1
tgttcttggagggaaataacaaacggaagacagggaaatctttactttgttttttctttttccactttgnattctacaatgctaatcttttgatttcctgaagactcatctttgtcattcttgtttatcattaattatctgtttttcttactatttagtaccccaataaccccccccccacacaaaatggcaattgcttggtctgaaaaagcttcttttatggaggttatgtctaggcctccttctttatctccaccggtcattctaacccatgacgaattgaaaaaaattgccgaatacaaagccgatgagttcgctgaatcaggaatggttctgggtctaggcactggttcgacagccaaacacgccgtggatcgcatcagtgagttgcttcgcctcggcaagctcagaaacatcgtaggaattcccaccttcaagaaaactcatgagcaagc

SEQ ID NO: 6988 - DNA, 358 bp, Gossypium hirsutum
  Clone ID: uC-gsronu33B058h05b1
tttgtttgccgtccgcgcccggtcgcacacagggcgggattttttaaacaaggtgatacattcactgcccaatggaacaatgaaggcaagggaagtcggcaaaatggatccgtaacctacgggaaaaggattggctctgagggctgggcacgggggtcccagacccgaacccgaaggctgccggcgcactgcacgagctgctcccgcggcgagagcgggtcgacgcgtgccggacgggggacggactgggaacggctcccttgggggccttccccgggcgacgaacagtcgactaagaactggtacggacaaggtgaatccgactgtctaattaaaacaaagcattgagaaggtccca

SEQ ID NO: 6989 - DNA, 329 bp, Gossypium hirsutum
  Clone ID: uC-gsronu33B058h07b1
ttgtcgtttgatccacaaagacctacatggggggaatttaaagcttcttatccaattatcgtgacatccaggtcccagtaggagttgtttcccacaaagggtaaatagaaagtgagataaataggagggcataagagatggattcgagcaatagcataagaacaggaggttaaagcagcgttgtttgcacgctcagtgcgggaaaccaggatgaaaagtaatgaattcaaaggtgggatcaaggtcttcaatgaagaaaaaatcggcaatggtgagggaaacaattgctggtgggtgataaagggtgagctttgaataaagggcaaacc

SEQ ID NO: 6990 - DNA, 402 bp, Gossypium hirsutum
  Clone ID: uC-gsronu33B058h09b1
tgtttttaaaaaaataaaagagaaaaaatctgaggaatgttttgaggagacgaatctccatagactacattatggagaaggcatcggggcctcacttctccggcctccgtagtccgacctccgcctcttcctcttcgtcctttttcgccgacgccaacgctcctcgtcagcccttcgtcatcggtgtttctggaggtacagcttcaggtaaaacgacagtctgtgacatgatcatccaacagcttcacgatcaccgcgttgtacttgtcaatcaggattcggtttatcggggtttaaatactgaagagttaaaacgcgtgcacgagtataattttgatcaccctgatgcttttggtactgagcagcttctggaatgtgttgagaagcttaaaagtgggcaat

SEQ ID NO: 6991 - DNA, 442 bp, Gossypium hirsutum
  Clone ID: uC-gsronu33B058h10b1
tttttatttgagaaatttccaatctattcaaagcgatatttaaaaaaaaagttatgagtgaattggagggaaattgatttttacgtatgtaatgcatcagaaaaaatcggaagttcagctcggaaaagaaagcagcggcgtctcctccggttttaatcccaaaccttccaccggtcaccaccaccaccaccaccaccaccaccagcatttcaattaccaccaccgtttacaacagctttccgatacaacagcgccggcggttaccgggacgtctccggtttacgttttccctcagataattactcagaccacgtctggaaatgatgcgattgcacctcctccgtcttcatcttccacttctccgaccccttacaagagacgccttttgacccaaacgccgtctctcaccaaatcccctactttgtaccatttcaccacttcc

SEQ ID NO: 6992 - DNA, 187 bp, Gossypium hirsutum
  Clone ID: uC-gsronu33B058h11b1
tcgctcacgcgtccgcccacgcgtccgaaaaaaagagaaatttaaaaaaaaaaaaaaaaaaaaaaaaaaaaaaaaaaaaaaaaaaaaaaaaaaaaaaaaaaaaaaaaaaaaaaaaaaaaaacataaaaataaaaaaaccaaaaaaaaaaaaaacacactagtgacaccacctataataaaacacact

SEQ ID NO: 6993 - DNA, 356 bp, Gossypium hirsutum
  Clone ID: uC-gsronu33B060d01b1
gcgccctcgcttccgcccactcgcatgtgctaacaggacgcaagggacacctatggaacacgcacttgaggaggtcactcatctacagaatcaccttcgaagttgcttgctaagggactcatacacatgccgtgtgctgacgactgtgcactaatctactgatagatgaggcgcgagccactagatgggcaagcacagggagctatgcgagggagagcaggactttgctgatcctatggcatgctcatactaccaatgcacgggttacccatctgatctgagagactgatcgctattactgacacgctaggtactatgacaacagctcatgtgaacacgatgctgttttcccatga

SEQ ID NO: 6994 - DNA, 369 bp, Gossypium hirsutum
  Clone ID: uC-gsronu33B060d10b1
tgttttcggacgacgatgcgagaggaaaatggagtatgggatctcacactgtcgctgaagcttgttacctaactacatagatgtgtctgcttgagcatcggtaacactgtattggagatactgcagtaggctttgcaggttagttgtaaaagaatgcaaaccacaaactaagattgttgacatttgcgagaagggtgatgcatttatcagagagcaaacaggctgtatgtgtaagaatgctaagaggaagattgagagaggtgttgccttacccacttgtctttctgttaataacattgtatgtcatttctctgcacttgctagtgacaccttcgagctgcaagaaggtgatatggggaagagtgacat

SEQ ID NO: 6995 - DNA, 240 bp, Gossypium hirsutum
  Clone ID: uC-gsronu33B060h07b1
gttttgttttctttaacgcgtacgggaaaagtcggggggggtttctcttaatggtcccacttcccttcgtttccagggttgggttaatcaagcaacgaatttggcccgttttatcatttaaggagtcttgttctccccttccattacgtgggatcgaaagctcgatgtcttattttttcaccaatgagtggacgtattgtcaagtaccacccaaggttatcgctcagattcggctgcagc

SEQ ID NO: 6996 - DNA, 502 bp, Gossypium hirsutum
  Clone ID: uC-gsronu33B061a02b1
cctcactcgtccgcccaattctagtagcaactgatggggcagctcgtggtcttgatattcctcacgttgcacacgtggtgaacttcgaccttcctaatgatatcgatgactatgttcatcgaattggacgtacagggcgtgcaggcaaaactggtttagccacagccttcttcaatgagaacaatactaatatggcaaaggcattagcagatctaatgcaagaagcgaatcaagaggtacctgcttggctcactcgatatgcagctcgttcattcggagcgaggaatcgtcgtcctggaggaggaggccgattcggtggacgtgactttcgaagggattcatcttacaacagaggtgggtcagattactatagtggaggcaacaacaatttaagtggatacggtggaggctacggcgcacacgttgccagtgcatgggattgagtacacactcatttatttctactagtttcagcgtctatagtagcagagcttcctttttt

SEQ ID NO: 6997 - DNA, 292 bp, Gossypium hirsutum
  Clone ID: uC-gsronu33B061a04b1
atgaccttggaagtgtaagtaacgcaaaaaggcaagacaggagatgagtgatgagacaacctgcacaaaactggtggtggttcgtctgtcagattggggagtcagacaagcattcaaacattgataatttgtatatgaagtctatttggattttgtggtatacagacagacggagtgcatgtatgatattaatgttgtattatttgaaacacaccaatatccattgacaataaatttgtgtttaattgttgcagaaaagaaacaaaaaagcaagataagttaacaacgaaat

SEQ ID NO: 6998 - DNA, 461 bp, Gossypium hirsutum
  Clone ID: uC-gsronu33B061a05b1
ttcacgcgtccgcgacgatttcccgatggaagtcctccgtgccacacaattaactttcctcgatataaggttcaaccgaatcaaaggcgtcgttccggcgacaggtttcaaattagacctcgacgttctcttcatcaacaacaacaatttcaggcaacgtctaccggaaaatttaggtgatacaccggcgttatacataacatttgcaaacaacaagttcaccggtcggatcccgccaagtattggcaaagctaaaaaccttctcgaagtactattcctcaacaacgaactcactggttggttaccgtacgagatcggctacttacaaaacgccaccgtttttgacgtcggaatgaataaactaaccgggccgataccacattcgtgcggttggttgaaaaagatggagcaactcaatttagccggcaatgaattttacggcgaagtaccggaaatcgttg

SEQ ID NO: 6999 - DNA, 100 bp, Gossypium hirsutum
  Clone ID: uC-gsronu33B061a07b1
gtgagtcatcagctcgcgttgactacgtgcgtgccctttgtacatcataatgtcagcttcaacttctagcctaataaaaaaaaaaaaaccaaaagatatc

SEQ ID NO: 7000 - DNA, 349 bp, Gossypium hirsutum
  Clone ID: uC-gsronu33B061a09b1
gattaagcaacatggttttgaagcgttcaatggcactaatgaataggacggaagctgttaattactgtcaaacatatgccaaagtctataataggtactagagattcccatgacggcacgtgatgtgtatagcaacggccgcggttaccgaacatataaaaagcgagactgagatcggagctattttgttgagatgacatatgcacgaatgcttcatgagcgggtgagatgagccggaactgaagggctatatcttcgacgagactaggggagaaaaccacggtgactagcaaaaactccatgagagggtgcagcagcttcaacaacaacatagctcggctggagaaag

SEQ ID NO: 7001 - DNA, 356 bp, Gossypium hirsutum
  unsure (1)..(356): unsure at all n locations
  Clone ID: uC-gsronu33B061a12b1
gccaagttttcccaagtcatcctcctcatcttgctcgtgttgctgcccgggcaagaaggaacctaaagatccatcagagctttatagggatgcaaaacgggaagaacttgatgctgccatctttaaccttagggaaattgacaattatgatgagtatgaaagatcaatgttgatctctcaaacaagctttgagaaaacttttggcttatcttcagtcttcattgaatctacactaatggagatgcaggcagtggctgaatctgccaacccttccacactaatcaaggaagcaattcatgtcatcagctgtggctatgaagagaagactgcatgggngaaagagattggatggtata

SEQ ID NO: 7002 - DNA, 474 bp, Gossypium hirsutum
  Clone ID: uC-gsronu33B061b04b1
cgcggagtttcattaccccatcaaaaccgaggagttcgatcataaacaagacaactcatcatcatcatcatcatcatcagttgatgaatcatcattagcaggatcattatcttcaccagaatctgatatcactttctttgatttctctgattccaaatgggaagacaatgaaattgaaaacttcagtttagataagttcccatcactggaaatcgattgggaagccatttgagtccctaaaaacacaactatcatgtaattttcttgtattttcttaggtctaagcatcttttacctttgtcatgtaggctttttttttctttccttagtgtctctagtggtctgtctacaatgggatttttgacatttgtagaagatcatggaggtttctaaattaggggtatcagcttagaaatttgatcatgttaaaaaatatatattgtggaagcgccagagaagaggtatttcctttct

SEQ ID NO: 7003 - DNA, 495 bp, Gossypium hirsutum
  Clone ID: uC-gsronu33B061c07b1
atttgcgggtggagaagacgagagctcatctctctgcttcaaagctcctgtccaggtagaattctcttcttcctttgcgttgtgttctttgttgttcagtcgccatggcttcaaagcggattttgaaggaactcaaggatttgcagaaagatccacccacttcttgcagtgctggtccagtagctgaagacatgtttcattggcaagcaacaatcatgggaccctcagatagcccttatgctggaggtgtgtttttagttaccatccatttccctccagattatcctttcaagcctcctaaggtcacgtttaggaccaaggtcttccatcctaacatcaacagcaatggaagcatttgtcttgatatcctcaaagaacaatggagccctgcactaaccatttccaaggttctgctctcaaatctgctcgttgctgaccgatccaaaccctgatgaccctcttgtccggagattgctcacatgtataagactgatc

SEQ ID NO: 7004 - DNA, 315 bp, Gossypium hirsutum
  Clone ID: uC-gsronu33B061c12b1
cttggattgtggtggggtatggacagcttggtgatgagtgggctattgattgaagaaagcttaatatgggtacaggttttgctcaaggtgcttttgggaagctatacagaggtacatataatggcgaggatgttgtgattaatatattgcaaaggccaaaaacaaaacatgtgaaggctcaagttaaggaataagcccttcagtaggaacttattaagattgcatgtctaatgcatactaccattgtgcgatttaatggtgttgggtgtaatgacctggttgcatttatgttcatgtgaatgaatgaaattattt

SEQ ID NO: 7005 - DNA, 532 bp, Gossypium hirsutum
  unsure (1)..(532): unsure at all n locations
  Clone ID: uC-gsronu33B061d05b1
gtaaggccagggtcagatcaagcaaaagcagatgcttgggagaaagcagagatggttaaaatcaaagaccggtaataatacattgacaccgagaagcactaattgtttagtactaaacagttgtaggcaattagaagcatatgatcttcttcactaacaatgaattacaggtatgtgaagttaaataacactatactcgaatgggaggaaaagaagaaaaagaaggccagaagcaagctggacaaagcagagaagagtgaatcggagaaaaagagagcaagagccttaaccaaatttaggaatgaaatggactacatcaaacaagttgcagatggagcaagagcacaggcaaatgctagacaaagaaatgatgagcttaaagcaaaggaaaaggcaaacataattagaacaacaggagagcttccaatgacatgcttctgctgctgaatttaactaaatagtagtatcatgactcttaagtcacatataanaccactacacaatgctttgactaattaaacgatgccttagc

SEQ ID NO: 7006 - DNA, 272 bp, Gossypium hirsutum
  Clone ID: uC-gsronu33B061d08b1
cttcgtgtatttggggtggcaactcttgagaaaacagttcatgatgacatcaaaaagcttgcctcagctgtatatttgcaagtgagcattataagtcaggccctaatatttgtaactcgatctagaagttggtcctttgttgagcgtccgggtttactactattggcggcctttgtcatagctcagttgattgctactcttattgctgcgtatgccaattggagctttgctgcaattgaagggatcggatggggcttgcccttctgatcctc

SEQ ID NO: 7007 - DNA, 212 bp, Gossypium hirsutum
  Clone ID: uC-gsronu33B061d11b1
tcgatcgcgagggccgccctttatttttttgggtggtgttttttaacccttccccgacttgtttttagaaagaaagtttgcccttctgtcacttaatccgtatgtgcaattcccttgttctgctgatttaaggaaaactatttacttgccctaagatgtaatcttttgaaggaccagtgctgcccattatgaaattttagaggaaaagggag

SEQ ID NO: 7008 - DNA, 371 bp, Gossypium hirsutum
  Clone ID: uC-gsronu33B061d12b1
tcgcaggtatcagactgaggtattacagaattatgatgagtgggctattgatttaagaaagcttaatatgggtacagcttttgctcaaggtgcttttgggaagttatacagaggtacatataatggtgaggatgttgcgattaagatattggaaaggccagaaaatagccctgagaaggcacaagttatggaacagcagtttcagcaggaacttatgatgcttgcaacactaaagcatcctaatattgtgcgatttattggggcttgtcgcaagccaatggtttggtgtattgtcacggagtatgcctagggtggcttacatcgtcagtttcctacaaggtggctctttccgtgctgagcctattaaaatt

SEQ ID NO: 7009 - DNA, 493 bp, Gossypium hirsutum
  Clone ID: uC-gsronu33B061e01b1
gtagcagctcttggaaatattcctaccattgctttttgtgacacagactcaccaatgcgatatgttgacattggtattcctgctaataacaaggaatgttctatggtgccccggcagtaattactttccgcattcccacaaaggctgctttgcaggaggcatattcaactccaatcttgccattagatgttcttgcagaaagacctcctgagaagaagtttgactgggctaagaggttgctggctaagtatggatctcaaatctctgtgatatcaattgtggttctattcatctacctgatcgtgacaccatcaaaatccagtgctgcaaaagcaagcaagaagaagcgctaagtatagtagatgtgctgagaaaagccgacctttctttttgtttgcagtaaatagggcttccctttgttggtgggttttaattttttcttttattacgggtagaacatatgttatcgggaatttctattcaaatgagttta

SEQ ID NO: 7010 - DNA, 350 bp, Gossypium hirsutum
  Clone ID: uC-gsronu33B061e03b1
gtgacccatagcttctctaccaatgtgaacaccatcaccgtgggtacacaacatgcattggatccatcaaccacaatcaaggcacgggtgaacaatgccggcaaggtaagcgcactcatccagcacgagtggcgcccaaaatcgctctttaccatttctggagaggtggataccaagtccatcgataagagccccaaggtcggacttgctttggcactcaagccttgagagcctaaaaaaaaaagaaagaagaagctcattttggaaagggtatggcagactttaaaagaggtcctgaagttcttagccgttgttgaccattcatggcgtctgcccctctctacctttca

SEQ ID NO: 7011 - DNA, 297 bp, Gossypium hirsutum
  Clone ID: uC-gsronu33B061e04b1
ctcacgcgtccgtctagacctaggtctaggtctaggtcaagatcccgctcctggtcgaggccaaggcataggtccaggtcacatagtcgcggcaggtcaaggtcaagaagtcgaggcagggttgacgctggaaatcctggcaacacactttatgtgaccggtctatctcaaagggtcactgagagggaccttgaagagcatttctccaaggaggggaaggcggcatcgtgtttcctggttgttgaacctcggactcgcatatctcgtggttctgcttctgctatctatggacagtgt

SEQ ID NO: 7012 - DNA, 336 bp, Gossypium hirsutum
  Clone ID: uC-gsronu33B061e08b1
tcggttgatttgagctttttgcgtttcttgtgcgggttagcaaattgcaaagatgcagaacgaacaaggtcaaaatatggatctttacattccccgaaaatgctcggccactaacaggctcatcacctcaaaggatcacgcatccgtgcagatcaatgtcggccatttggatgagcttggcagatacactggcacattctccacctttgctctttgcggctttgtccgtgctcagggcgatgcctgatagcgctcttgacaggctttggcagaagaagaaagccgcagataaactgcagtagtctggtaccgctttattaccctcctctgtactcg

SEQ ID NO: 7013 - DNA, 418 bp, Gossypium hirsutum
  Clone ID: uC-gsronu33B061f01b1
ctctcatactcatttcgattcacacatacatcctgcggcgccagccgagccatttgtcttccacttgttatatccctcttttgccttccgaaaagagcagcaaaatcaagtaaggttgatttaaacccagcttctttatcacagagcttcttcctttctgttcttatctttttgatcaatcgtctctgcttgataatggcaactaggcttcaatttgaaaattcatgtgaagctggagtcttttccaagctgaccaatgcctactgcttggttgcaatcggagggtcagaaaacttctatagtactctcgagtcggagctggcagatgccattccagttgctaagacctctattgctggcactagaataataggacgtctatgtgctggaaacaagaatgggctacttgtacccccac

SEQ ID NO: 7014 - DNA, 228 bp, Gossypium hirsutum
  Clone ID: uC-gsronu33B061f07b1
tcggtaataaaaacagtttcatttccattctgagtttgtgttttttatttgcgtttggtggctaagatgagctcaactagaacagaaaatctggtgtggaacacaagggtaaaagctcgtttgaatctgatttccagtacgaataccaaccgtgaaagcgtggcctatccatccttcataccttcggaatttgaagctagaggtggcagaaaaggtaccacaaggaat

SEQ ID NO: 7015 - DNA, 290 bp, Gossypium hirsutum
  Clone ID: uC-gsronu33B061f10b1
ctcacgcgtccgagttctagatcgcgagctagaacgtggacttcatattcggtgatgccgccgccgttttccagagctgcaacatctacatccgtcgaccaatgagcggccaaaagaacaccgacacggcccacgggagaaccgaccagaatgagaatacgggcatagtcatccacaattcacgagtgacagcctcgcccgatatgaaggaggctcagggggcgtccaagagtccctcggcgaggtcccggaacaactaatctccatccgtcttcatttccagtaccttc

SEQ ID NO: 7016 - DNA, 390 bp, Gossypium hirsutum
  Clone ID: uC-gsronu33B061f12b1
tcgttttaatggaagcctcatcttcacaccatggactagcaatcctcttcattgtcctcacttcacaaatagccttaaccttagcttatccaccatttctcaacgatagaaacattgaatacatcaaatcttcatgcagcaccacaacatatcccaaattatgttaccagtccctctcagtctatgcgagcagcatcagcaccagccccaaattgttagtccacactgcactcaatgtaactcttagagccagcaaagcgacttcgaggctgatggtaaagatctcgagattccacggtttggaaccaagggtagctgccgccatggctgattgattcgaggtgatcggggactcggtggatgagctgcaacagtctttagtgggtactt

SEQ ID NO: 7017 - DNA, 242 bp, Gossypium hirsutum
  Clone ID: uC-gsronu33B061g01b1
gttaggcccgcggcggatagcataatcaatgggggctgtgatagcgtttgatcaaaaccatatggtaatgctttcgatgtttgcatgttattcttttagatgcgcatgccatctaagggagaaatgtacctctgaatcctgttggttccttttgaccttctgaaattaatagttgtagatgggataatctgcttctatatgtactttttgatttaaagttgaatggcttacataaaaaaaca

SEQ ID NO: 7018 - DNA, 301 bp, Gossypium hirsutum
  Clone ID: uC-gsronu33B061g02b1
gtgacagggcgggcacgggtacacttacactgggtcaatgatgaccccatcacaactacaattacactgcttagtggagatatgcaggtggccttatattagataatatcttttatgaatattattttgtggtgctacacatagaagattgacatcataatccagttattgtggtgagtctacatctgttaataaagatagggatgtaccgagagatccctggggagggccgatggagataaacgcggttgattccgccactgattgatgacaggagtaggaatctgcatgacctggactg

SEQ ID NO: 7019 - DNA, 167 bp, Gossypium hirsutum
  Clone ID: uC-gsronu33B061g05b1
gtttgtggttgatgttgcaggaagcaaaattgaggaccaatagaactatataatataatatatatatatatatataaatgtgactctgtttttgtttacattagaaaataaggtgtgtgttctaattttgcgccgggatgatggctacggcgcctacccttatccct

SEQ ID NO: 7020 - DNA, 307 bp, Gossypium hirsutum
  Clone ID: uC-gsronu33B061h03b1
ctcactcgtccggcttcaccaaaccggtggtactgtgtgaagcgagtactactttgccgcatttagtatttgatgagttagttatggtctgattatgtaagatgttttcaatgtttctttataaatacttattctctattcatcaatacttgtatactctgttttttaattctcttgtttttatattattattttcttttcttttttcttatactttttatttattaatttctacccctttttttttcattatttctttatatctatactttttttatccttacttacattttttttaatttctttt

SEQ ID NO: 7021 - DNA, 289 bp, Gossypium hirsutum
  Clone ID: uC-gsronu33B061h04b1
cttgacgcgtgggttttggaggagaagaccctggagtttttctcatggactacgtggagggaggtgttgtgaaatcaaagagttcaatatggatactgaaagctatgactgattttttatgggcaattattaattgcattgaaaggcacttcttaaacatgttgtccatggatatggacgttgcctacagaaaaggctttggtttaagtgaaaaatgtgattttgcggtttaaggatctaatgatgatctaatatattggatcttaacctctgtaggaaactgaaagac

SEQ ID NO: 7022 - DNA, 93 bp, Gossypium hirsutum
  Clone ID: uC-gsronu33B061h05b1
ttcactcgtccggatgaacttagtgaacccatgtgggctcattgagggacttaacggtgtaatagcaaccagatattttgatgtctacttccc

SEQ ID NO: 7023 - DNA, 416 bp, Gossypium hirsutum
  Clone ID: uC-gsronu33B061h07b1
cttcacgcgtccgaaaccctaaaaggtgttctttgttattcttgaaaagaaaaatataaattttttacagagtttgttcatcaaggaacgaatttgtacgatttgtcgttttaagagatgattgtcagttcaaatatgggagccgaagccgatatcatatttcgccaccaagttgttgatgtaatgtcgatttccacccaagtttctcgcttcgattcggttgcagcttgtgctgagaccattggagatgctgctattgagtcatctgttgtcaaatttgtgccaagaattcgttctggtagctgtgcgaacattggtccacggagaactatggaggatgaacaccataaggattgatgatctcttttcccatgtgggctctatctttcatacttcgtattccaagtgctttttta

SEQ ID NO: 7024 - DNA, 509 bp, Gossypium hirsutum
  Clone ID: uC-gsronu33B061h09b1
ctcacgcgtccgcccacgcgtccgcccacgcgtccggttcaaggccgctaaagcagactatcaagatgaacatcaatgctaaggccccatcaacttcaacctcttcgcttccactctccaaattgaaatctttcgatgtacacaacattgaggggttgtacactcacacgctagatgagtgcctgcaacatctcaccagcctcaaaagattaacaataggagattgcacggaggctgatttagagggcatgcaatgggaaccccttaagaatctctctcatttggagattgataatattccaaagctggcgtctctctccattcggcttcaacatcttgttcaactgcaaacattaaaaattcataactgcactggattgcggtcactgcttcctgtgttccaacatctcactttccttgaagagtttccagtataggcctgccagcagctgcagctatctggagcctggcttccatcactttcccagatcatacaagcctcctttctt

SEQ ID NO: 7025 - DNA, 333 bp, Gossypium hirsutum
  Clone ID: uC-gsronu33B061h11b1
ataaaacaaaaaagaacaactcagttttctttgtttatttcaagcaaaaatggaagcacgagagccacataatgcgacggcaaggacacattcaggcgtaatcagtgaactccacacgtctccctggcattcgccggtaccctacttgatcggcggattagctgccatgctgggtcttatagctgtagcgcttctcgaccttgcatgttcttattggaaactattgggttacaactagaacgacggtgaaggggcaacggctagagacttacacgccgcaaatggtaataggagaagctgctcggccggatattgaaccaaaggctcttgtta

SEQ ID NO: 7026 - DNA, 524 bp, Gossypium hirsutum
  Clone ID: uC-gsronu33B061h12b1
cccacgcgtccgcaaactttttatttttctttctcttgagtctacgtctctctcgctcgctctctctatttctttaatggcgagaggagaatcaaaactcatttgaaatcaaggcatagcaatagcagtagaatagcttcgcctattcacggcgcgaatctcgagaggacttcattggactctcttattattttctcagctgcagattttttgacaacggaacataatttttgcttgcatgaaaatttgagaaacaaggactctgcttgacaacttggagactaagttaaaaatgtcatctgtaagcaaggctgatcggaaaacagctttggatgtggcctcatggtctttcaatattgtcacatctgcgggtataatcatggccaataaagccttgatggctacctaccgcttcagttttgctacaacattaacaggtttgcattctgccactacaaccctgttaactggtcctcttagatggctgggttatattcagaaccttcatatcccattacccgacc

SEQ ID NO: 7027 - DNA, 93 bp, Gossypium hirsutum
  Clone ID: uC-gsronu33B062a02b1
gttgttgtctgcggtgcattgtattaacagcagggaggtgtatttgacaagctatgaaggtactataatccgagaataaaaaatacaatcatc

SEQ ID NO: 7028 - DNA, 304 bp, Gossypium hirsutum
  Clone ID: uC-gsronu33B062a03b1
ctctctaaaatctcacttcaaaacagggggggttttttttaaactaaggggcaagttttcgatcgaaaatcaagaatccactgtccgtgaaatcaagcctaataacagaagaatcatgggaggtggtggacctgatgaagatgacaccattaaccagaagtggccgccatggctgaaacctttattgaaagaacaattctttgttcaatgcaagcttcacatcgagtctcataagagtgaatgcaatatgtatttgcttggattgcatgaatggacctttttggtccttttcgccttgctttat

SEQ ID NO: 7029 - DNA, 396 bp, Gossypium hirsutum
  unsure (1)..(396): unsure at all n locations
  Clone ID: uC-gsronu33B062a11b1
cttcaatagagcagtttgttggtctaagcttggactctgggaaaaatctgtagaggactgcaaccaggctcttaggatccaaccaaattacctaaaagccttacttcgaagggctgcctcgaacgcaaagcttggacggtggccagatgctgtgagagattatgagctcttgagaaaggaacttcctggagataatgaagtggctgagtctctgcataatgcacaggttgcactgaagaaatcccgtggaatggatgttcttaacatgaaaatcagcgntgaagtagaagaaatttctagcctagagagattcaaaactgcaatatcgacaccagtggtccactttaaagtggcaaccaatgaacaatgtgaagaaatatccccattcgtaaattt

SEQ ID NO: 7030 - DNA, 166 bp, Gossypium hirsutum
  Clone ID: uC-gsronu33B062a12b1
acgcgtccgcttcaatagagcagtttgttggtctaagcttggactctgggaaaaatctgtagaggactgcaaccaggctcttaggatccaaccaaattacctaaaagccttacttcgaagggctgcctcgaacgcaaagcttggacggtggccagatgctgtgaga

SEQ ID NO: 7031 - DNA, 219 bp, Gossypium hirsutum
  Clone ID: uC-gsronu33B062b05b1
gttctttatccttgtttactgcactgccggtatcggaggtgtatcacattaaccctgcggtgacttttgggttgcttttggcccgtaaagtatctctcattagggctgtggctaacatggtgtcacagtgcttgggtgccttttgtgagagtgggttggactaagctttcattatgagatcgttcaacttcccttggcgacagttgcaaacatcggttg

SEQ ID NO: 7032 - DNA, 422 bp, Gossypium hirsutum
  Clone ID: uC-gsronu33B062b07b1
tttttattaaagttgaaaattgtctttttggtagatattaatctatttatggaaaaatttatccaaaaaaaataaaaaaaaaaaaataactttaaaacaaatcttaaaagatcttatagatctacataaaagatccttctacctattgcattacaaaccctggcgctcctttcttatgtccccaactttccttcccctatttttccacctttcatctcttttttcgggtccccttttttaattcccctttcccttttttttccacctttccatctaggaaacccctggctgtcccccattattattcgtcctttcaccctatccccctttttcccctggtagctttttcctaaatattccctcccaacatttccttccctaccctttaccatatcctaattgtcactttgacccccccctct

SEQ ID NO: 7033 - DNA, 453 bp, Gossypium hirsutum
  Clone ID: uC-gsronu33B062b09b1
gatagccatgcagctaataaaaagcattgagagtccagtcctagcacctgctttcgatcctgtcaataagctaaaccgtgttgagctactcctgaatgaacatgagagaagttccaagcaaagtgatcctgaactattgagaacaattgttccttcatctaatcagcctgtttctacagattgtgataggactaatgctagaaggatgaatgaaagttcagggaaaattgcagttgaagctaaagatgatgcatctactttaaagattagttcactcagcataaatccgaagcaggatgagtctaaaatctctacagatgctgctactaaaagtgatgctgttgaggtggtaaacataggatcagtgacggtaaaagtcaataaatttactgactcacctggttttttaacagtaggcactattcctcttaatcccaagaccccacagcttgg

SEQ ID NO: 7034 - DNA, 348 bp, Gossypium hirsutum
  Clone ID: uC-gsronu33B062b10b1
gttaaagggtacatttcaaaattcgagtttcggggcaggtggtgctaccattgctgctggaagattagttgttgacaatggcgtccttaaggcagtttggccacacagtggacattaccgtccgttagaagaaaactttaatgaaagctttaacaacttcatttcatttctgagggagaacaatgtaggtcataacaatgtcaaggttaaaaaaaggtactattctttttgcaaatgaaaagaatgcgctgattattggtgctgataatgcttgtttttattatattcagatgactccggtggatgaggaaggaaacttggctggcaagcaatgaagcagtaaccgac

SEQ ID NO: 7035 - DNA, 160 bp, Gossypium hirsutum
  Clone ID: uC-gsronu33B062b11b1
actagttctagatcgcgaccggccgccctttgggtttttttaatttttttttgggtttttttttttttttttttttttttttttttttttttaacaaaaacatacctacttttattcattaaaacacaaataaaagcctaggatccattgaattcattcc

SEQ ID NO: 7036 - DNA, 135 bp, Gossypium hirsutum
  Clone ID: uC-gsronu33B062b12b1
ttctaagtggactccttgtcatattattattggttttttggaaccctgttcacaaagagtctgtcatcataatgccagcctttggagttcagcttgaaacacactatacgagtggaagaatcatccgcagattca

SEQ ID NO: 7037 - DNA, 308 bp, Gossypium hirsutum
  Clone ID: uC-gsronu33B062c06b1
attttctattaaaatggcgatggcgagtgttcgagcgagtctcttacaagcagccctgcgtgtttgctctcgtcctactgctcctcccacgcgtggcttcgcttcctcttctcatcacgatgatgcttatgaaaccgcaaaatgggaaaagataacatacttaggtgccgctacctgcactgtcttagcgatttataacctatcataaggtcatccccaccatgaagagcctcctgcatacccatatttgctcattcgcacccagggggttccctgggggcccgatgggtctgtccgggagaaaagga

SEQ ID NO: 7038 - DNA, 52 bp, Gossypium hirsutum
  Clone ID: uC-gsronu33B062c07b1
agtgaaagctaccaccccagcaggtatcctttctcggaattccccagggtca

SEQ ID NO: 7039 - DNA, 446 bp, Gossypium hirsutum
  Clone ID: uC-gsronu33B062c09b1
tgtttttcagccattatcacccacaaaagtggggggcaatgcccctttcctcgacctccattgtcctctaaccactcaaacaccccatctttgactccttcctcttctttaactccgtcatcttaaaaaaaaaaaagtggatagttgagctgctattgagattttcttttttctccccaaccctgtcttatcttggttgctacctgcctcctgcatgaaacagaaacagagttccctttcttgcttctcactgttgcgatgaagtatatccggaccaacaacttgaaacggttattttcattaaaaagacgcagtttcgaagaaggtggtgccaaccaacatggggttttcgaagaagacaacaacaatgatagtttctaagattgcttctgttgcagagcgttctcagcgaccttcctggcgaagcttctcctttgaagaatctt

SEQ ID NO: 7040 - DNA, 451 bp, Gossypium hirsutum
  Clone ID: uC-gsronu33B062c12b1
gtttctcttcttggatctttgtgccgcattcggggcacagcttcgggtcctctaaaataagcaggctgtatttctaaggacccttactccatgaatctcctatgatgcatgtgaataacaacattctatgtatataactgttcctttttccgtctttttttttttcggtgaccctctattttagatgggttaactgtggagaggccagtcctcaaacactaggattggccaaggcaatattactatattagtcctgcttctgacaaagtttgccttcaattataagtagggtttccacaatgttatggaacctaaagggagtttttatgaattatgatagaattcaccttggtcttttggaaggttatatcttctcattcatgtttgaatatatatcaaacacgggtgttagatatgggtattcaacagtatcagaattgatggaaatctg

SEQ ID NO: 7041 - DNA, 296 bp, Gossypium hirsutum
  Clone ID: uC-gsronu33B062d02b1
aaagagggctccaaatctcaagcggcgggtgttttgcattgatgtaatcgcggagtgcatagttaatggtcctaagccagcactgtataaggaggttgaagctttccagggacttctcaaatctgataccagcaaaagcctgatccacatcttctttgctcagcgtggatcatcaaaggttcctgggattactgataggggcttggtgccaagaaaagtgaatatggttgctatactttggcggaggtttaatgggctcggggatagcaacgggtttgctttttagcaactacaca

SEQ ID NO: 7042 - DNA, 321 bp, Gossypium hirsutum
  Clone ID: uC-gsronu33B062d03b1
ttctttgtatattgaagtttcctttctcgatgggggatttagccaaacaagatgcagatcttcgttaagactctaaccggcaagacgatcactctcgaggtcgagagctccgatacgatcgacaacgtgaaggccaaaatccaagataaggaaggcatcccttcagaccagcagcgctctagaatttgccggaaaacagctcgaagacggccggaccttggacaattacaacattcaaaaggagtcaactcttcacctagtcctccgtttgcgcggtgggatgcaacatttcgtgaaaaccttgactggcaagacaatcac

SEQ ID NO: 7043 - DNA, 317 bp, Gossypium hirsutum
  Clone ID: uC-gsronu33B062d04b1
tatagggttagctggtacccccgcaggtaccgtttcctggaatctcccagggttcgacaccacagcgtcccgctttatttttatctcttaaacctctaaacacccaagcgggggggagattctcatattagcaagacgaggggctgtctatcggacctcacaaagaccatcatcctgcccacataacccccatggccctttcaatttctccccccctggaccgaaatccccaccaaaaagggccaccattcatcgcaacgcaatacccatggtcttcagtcattaaagagatccccaaaaacgccactcccttgaat

SEQ ID NO: 7044 - DNA, 287 bp, Gossypium hirsutum
  Clone ID: uC-gsronu33B062d05b1
ctctctctattcaacaagccggcgagggggggaataccggagagggagagcattgcctgctggtcacggcctccgatctcggaccagggttctgcttttccagacccctttagatagaaaggttccattccatcgtccacttatcttatgacctacaagattggcgactatgtggacgttaaggttaatggcgccgttcacatggccttgccccacaaactctaccattggcgtactgttcgagtctggaacatcaccatgcgcgccattcgtgatgtggtcatcat

SEQ ID NO: 7045 - DNA, 91 bp, Gossypium hirsutum
  Clone ID: uC-gsronu33B062e02b1
cgacccacgcgaccaccctttcgaccgaaaaaccacgagaacaacacggaggcacgctaagaaaacagccacgcccaaacaaaaaagggca

SEQ ID NO: 7046 - DNA, 242 bp, Gossypium hirsutum
  Clone ID: uC-gsronu33B062e03b1
tacgaggattctactaaatgttatcgcgggctgttgaatgtcgatatgctgtgtacgattttgattttctaacgggcgagaacgtcccgtagagcagaatctttttgatcgtatggtgttccgacacgtcaaggatcaggagcaagatgatttacgccagcttcaaagacagattcatgcgagaactggacggatttcatgtggaattgcacgcaacagatccaactgagatgtgtctctgt

SEQ ID NO: 7047 - DNA, 396 bp, Gossypium hirsutum
  Clone ID: uC-gsronu33B062e04b1
tttggttctcatacgaggaggttcaccatatggggggggtgtttacactggtgatggcacaagattaaccaagtgaaactgagctagctcttgcagagcatcaagggaagtacctggccagcgtgatctagcggctttatcaggcatgacataccccccatacttttgtttttcgatctattcttcattaaattgagctgtggttcgggtttgtgaattggtcttttggcatattctgtacctgtcagcaatccagcatgaaaagatagtaacacgaattattggtaccctctttgccaaatttcattttagttgagaaacatgtaccatgatttgatattcttatgggctttgtcttatcaaataaaaaggccatattttgggaatcacggttct

SEQ ID NO: 7048 - DNA, 388 bp, Gossypium hirsutum
  Clone ID: uC-gsronu33B062e06b1
ctcctttcgtccgcttcatcttctccttcatctgccgggatactttctacacaatttgtgtcctcaaactctcctcccatatttcagatattcctccttatcttctccccacagatctgtaactctctctccttctgttcccatattctagctagcaaatgattatgatctgtgctaactggatgcttctatgattgatcaaagaatggcatttatggagtcagagtttaccaacttttaaagagaaaaaccctcagctggaggtggctaatgaactcattcatgggcagcatccacatttgaaaggcttttacaagaacaaaaacgaacgggtggtttgcgtgaagaatatgactccctgagatatccttttttatgcaaccaggct

SEQ ID NO: 7049 - DNA, 422 bp, Gossypium hirsutum
  Clone ID: uC-gsronu33B062e07b1
tcgttcacgcgtccgtatcaccccaccaacgaatccataacgaaaaaaaaaaccacataagtttatggcttgtattgtggtcggtgacacgattcccgatggtactgtctcatatgctgatgaggcccatcagattctaaacgtgtccgtacactcccttgctgccgctaaacaggtcattctctgtggagttcccggtgcttttacccccacatgcatgcttgaaacatgtaccaggtttcattgacaaggcagaggagctcaagtcaaaaggcattagtgagattatcgctatcagtgttaatgacccatatgtgatgagggtctgtgggcagtcattttccgaaaacaagtacgtaaagttattttccttattactcatagtgccttcctttaaaacccttatgttttttaactttatt

SEQ ID NO: 7050 - DNA, 438 bp, Gossypium hirsutum
  Clone ID: uC-gsronu33B062e12b1
ttcacgcgtccgggctgaggttgagtcaagccgtggtcaacttaagaagagcatgagttattctagttcgaggaggattgaggtagaggagcttttgccgtatgcgcatggatacaccgagctaaattttttctaaaggaggttacgacctgcattcaatgagcttaaatatcatttggcaagaatttcaatgtgcttctacctctcagcaatatttttttttttctgaatcaatcaggtaaaattcactttgaggagatccattcttgagggtgatagagacgttcctttgctcactaaccaaaaaaaggtgtaaacttaactaactcgaattccaactcaatcataacatgatgtcagcttacaacattccaatctcaatgcaactgattaacaaaaaagtccacttctaatccatctcgaaacaagcttcgatag

SEQ ID NO: 7051 - DNA, 432 bp, Gossypium hirsutum
  Clone ID: uC-gsronu33B062f08b1
tttttggcaggcttttgatgaggctatttgtgagttggtatactttgggtgaggaatcttacaaagatagtacattgatcatgcaacttctccgggacaacctgaccctttggacatctgacatcacggtattccccccccccccacacaataagtttgtgtttgcacacaatcatgaaattctcatgcagctctgctgtctccagacataaaaaaaatctttaaaatgccacatggatatgaaaaatgcctaaagctatattcctgagtgaacttagttgctttcattgacatgactacagttctctaccatgttctctaaacttcctggaatgacatccttatagcttaatgccaggactaatttcttaaagtttcagttaattctccgagattatcagtgcttctttaccctatttcaagaatggttct

SEQ ID NO: 7052 - DNA, 354 bp, Gossypium hirsutum
  Clone ID: uC-gsronu33B062f10b1
tcttacgcgtccgattcttgtttactgcacggggtggtttctctggagggcatatcaacccggctgtgacattcggtttgtttgtgggacgcatggtgtcactcatccgagccctgatgtacatggtggctcagtgcttgggtgccatatgtgggcgtggattggtcaaggtttcccagatgacctactacaacaactactggggtggtgcgaacctagcttcaaccagggtttaacaatggctctggactgggtgctgagaccactggtacccttgttcttggttacactgttttctccctcctcttgatccttatcaggaatgcatgagctcttctatgtttctgtgttggt

SEQ ID NO: 7053 - DNA, 296 bp, Gossypium hirsutum
  Clone ID: uC-gsronu33B062f11b1
ctctttgctcttagagctgttgttccaaacatgggcaaaatggacaaggctgggataattaaggacgccattgattacatccaagaattgcacaatcaagagggtagaatccaggccgagatcagcgagttagaatcgggaaaactgaagaaaaatccaggtttcgaatatgatcaagagttaccagggctgagatctaagaagactaaactcgataacatttttgattatggtggatcaagagcttgccctattgaagtgcttgaactgaaagtgacgcacatgggagaaaggac

SEQ ID NO: 7054 - DNA, 355 bp, Gossypium hirsutum
  Clone ID: uC-gsronu33B062g06b1
aattactggtagacccacgcaaccggttttttggaaccaccacgctagcttttatctggaagaaaggtttaatggttgggggggatattaaagctagcataggagactatagtctcttcacaatcagtgaagaaaaaaattgaaatgaaaccttacatgcttggaacaatggctggaggagctgctgactgccagtttagggacagaaaattaggcatcaagggccggatgcaagaacaagcaaacaagcgaagaaattcaggtacaggggcataaaaactgtaggcaaacattctctattattaccgaggaatgggacttttggttggaaccatgatcgctggatgggatgaaa

SEQ ID NO: 7055 - DNA, 433 bp, Gossypium hirsutum
  Clone ID: uC-gsronu33B062g11b1
ttttaaagcaaaagcagccgaaatgagcggagcggctactgtagcgtatttagctcgaatagcagctcacaaagagagggttcggattctctaccgccgtgccctcaaagataccctcaattgggccgtccatcgccacctcttctatcaagatgcctctgatcttcgcgaaaaatccgaagccaacaagcatgtggaagatcttgacacaatcgacaaaatgatagctgcaggtgaagcaacctataataagtggcggcatcctgatccttatattgttccttgggctcctggtggttccaagttcactcgaaaccctgtcccgccatctgggattgagatcttatatgatcatggcaaagatgctccccgcttttcccttgttctttctctatcccccccctaccttgctttgatactttttcgtagcttt

SEQ ID NO: 7056 - DNA, 420 bp, Gossypium hirsutum
  Clone ID: uC-gsronu33B062h04b1
tttgctccggtgaggaggaagccggttgctaagtccaaacctgcttcgaaggccaaggaagggaaacgtgctaaaacaacttctaaatccccttctaagacaaaggctaaagcggcggctaaaccaaaggctgctcctaaggctaaatccaccgcaacgaagacgaaggctgtggctgctgtgaagccgaaggcgagtgcatctgctaagccaaaaaccgtagctaaatcgaaggcgaagccaaaggaaaagccggctaaggcttcgaggacttcaacaaggacttctcctgggaagaaggcggctgtccctaaagctactccgaagaaggctgccgcgcctaaaaaggctccttcgaagagtgctaaagcgaaaagtgtcaaatcaccggcgaagaaagcacgacgaggaggggaaaag

SEQ ID NO: 7057 - DNA, 74 bp, Gossypium hirsutum
  Clone ID: uC-gsronu33B062h05b1
caaaacaaagcaacatataatgggggggggtttaaacaaaagagaggggggtaaatagaagacacacaaccgtc

SEQ ID NO: 7058 - DNA, 360 bp, Gossypium hirsutum
  Clone ID: uC-gsronu33B062h08b1
ttctatcttatctcttcagtgaatcctctgacagagggggataatggcttctttcaatgacatgttctcgagctttgtcctggctttgtcatttgcaagctttgatgtcgggttcggtgcccgtactcttctgtaactgcgtaagctacctcctttgccagtgttcccaaatctgtacaatgcctcttttccaacgctggcgttaacgtctatatttttgtccgcggcccagctttgacaacagtttgttcccgcccttgcctaacattggcacctttgcccgaatgtaccataggtgccactttgccacctatttaccacagctttttccacaattcccaacttacgatcccattctat

SEQ ID NO: 7059 - DNA, 108 bp, Gossypium hirsutum
  Clone ID: uC-gsronu33B062h09b1
tgttcggcaaaggaagtagtggcagcagtagacggggataagaatttggtcactttcagtgtgatcgaaggagagctaatggaagagtataagagctctgctatcacg

SEQ ID NO: 7060 - DNA, 134 bp, Gossypium hirsutum
  Clone ID: uC-gsronu33B072a01b1
ctcacgctaccgcccacgcgtccgctctcccgctccttctcgctgcgatttcgtcttcaagatctcagctctcaaatcgtagcgctcctttctatcaagccatggctctggtcttgcatgccggaaaaacaaac

SEQ ID NO: 7061 - DNA, 182 bp, Gossypium hirsutum
  Clone ID: uC-gsronu33B072b03b1
ataaaatataaaaaaaaaaaaaaaaaaaaaaaaaaaaagaaaaaataaaaaaaaaaaaaaaaaaaaaaaaaaaaaaaaaaaaataaaaaaaaaaaaaaaaaaaaaaaaaaaaaagaaaaaaaaaatataaaaaaaaaaaaaatggggggcccttttaggggaaccaaatttttcctcctggt

SEQ ID NO: 7062 - DNA, 222 bp, Gossypium hirsutum
  Clone ID: uC-gsronu33B072e03b1
ctacatactcccaccccgaccgcttgattttgatcagacggtaatcatgccgatcagaaacatagccgttggccggcctgaagaagctactcatccagatgctcttaaagcagctttagctgagttcatatcaacgataatcttcgccttcgctggacctggtacatggctggtttttaatttatgtcgacccttctttggtttattctccatatctacttt

SEQ ID NO: 7063 - DNA, 454 bp, Gossypium hirsutum
  Clone ID: uC-gsronu33B074f11b1
tacagaaaagccccattctgatccacatttgctttaaaatcctctcaaacatcaaaatttgtttgcaaacagaccaaaaaaatccagctatgggcaatacggagaagctgttgaaccagatcatggacctcaaattcacctccaaatcgctgcaacgccaggccaagaagtgcgagaaggaggagaaatctgagaaattgaaggtgaaaaaggcgatcgagaaaggtaacatggacggtgctcggatctacgccgagaacgccatccgtaagcgcactgagcagatgaactacctgcgtctcgcttcccgactcgatgctgtagttgccaggctcgatacccaggctaagatgaccaccatcaacaagtccatgggaaatatcgtcaagtctctcgaatcttccttggccaccggcaatttgcagaaaatgtcagagacaatggataaattcga

SEQ ID NO: 7064 - DNA, 453 bp, Gossypium hirsutum
  Clone ID: uC-gsronu33B076a03b1
cccacgtttccgtttgaattctttccttcactttctctagaaaaagaaaatgtcttcaggttgcaattgcggatctaactgcagctgcggtgacaactgctcatgcagcaggaaccttaaccttggatactcggagaagacaaccagcactcagaccatcatctccggagttgcgccagtaaagatgacctttgagggaccagagatgagcactactgaatcaggacatggatgcggctgtggatcaaactgcaaatgtaatccatgcaactgctgaaaagctcgatgaaagccatagattatgaaaaaagaaagcagcaaaataacaggcctctgtaatgatttattttcaaggatggatgcgtgcaaggtctataattatgtctctgtctgtcttgggtaatagaagcattgttgtgggaaaaataatgtataagcccattggttgggagc

SEQ ID NO: 7065 - DNA, 365 bp, Gossypium hirsutum
  Clone ID: uC-gsronu33B076a04b1
cccacgttttctatttgacaattcctactgttcagcacctaacagcaaccatgtggactgacgaaggaatggttaagagaattagaggggaagctttcactaccagagtgagcgttcagcttggaaatgagatgatatatgcggctcgtggaatttttaatcgtttgcttcctgatgtttacatcgctagtgattatagaaaacgcttagaggctggaaactcgcctggatatggaatttcactagttgctgaaactacttctggctgctgcatctctgcggatactacaggttcttatccacgaggggatgaagaacaagatattgaagaatggggaaaaaaagagttgatacctgcaactgat

SEQ ID NO: 7066 - DNA, 275 bp, Gossypium hirsutum
  Clone ID: uC-gsronu33B076a06b1
ctgttatttggggggggaaaatgagcagtggcgcggggaaaaccgtgggggtaaccggagcctttggctacatcgcgttatggcttgtgaagcagcttctactttgtggttacactgtcaaagcctctgtttgtgacccaaatgatccaaggaagacacaacacttgcttggacttgagggtgctgagagcaggctcatgttgttaaaagcagacctattggaaccagggtcctttgatccttgggttgaaggttgtgtaggtgttttccacact

SEQ ID NO: 7067 - DNA, 213 bp, Gossypium hirsutum
  Clone ID: uC-gsronu33B076a08b1
ctcacgtgttcggcaactgaggaaatgttcccagctggacttgtgtaaaaattctgtagggactagggagtgaaaaagtaacattttcatttggtttcctgattttcatttgtactgtttatggtaactggatctttgatcaactagtagcttaatcattcagtcttgcgccagtaaagatgacctttgagggaccagagatgagcactactg

SEQ ID NO: 7068 - DNA, 397 bp, Gossypium hirsutum
  Clone ID: uC-gsronu33B076a11b1
acgttcacgtttccgcgattacccattaccccaattttacagatcaggtctgagtgttctaggtgctcggctgattctatcctctaaggttcatgtctgatcttgacatccagattcctactgcctttgatccgtttgctgatgcaaatgctgaagacgctggtgctggtgccaaggaatacgttcacattcgtattcagcagcggaacggtaggaaaagcctgaccactgttcagggattgaagaaagaatttagctataacaaaattctcaaggacctcaagaaagaattttgttgtaatggcactgttgtccaggacccagaattaggggaggggtattcaacttcaaggagatcaaaggaagaacgtctccactttcctcgttcaggctggta

SEQ ID NO: 7069 - DNA, 436 bp, Gossypium hirsutum
  Clone ID: uC-gsronu33B076a12b1
cgacccacgcgtacgttacttttacgaatagagcaacagtcaccaaaagtaaataagaactattagtaaagggaggaaaatgagcagcggtgcaggaaaaaccgtgtgtgtaaccggagcctctggctacatcgcgtcatggcttgtgaagcagcttctacttcgtggttacactgtcaaagcctctgttcgtgacccaaatgatccaaggaagacacaacacttgcttggacttgagggtgctgagagcaggctcatgttgttaaaagcagacctattggaacaaggttcctttgatcctgtggttgaaggttgtgtaggtgtttttcacactgcatctccattctatcacgatgtccttgacccaaaggcagaattacttgatcccgctgtgaaaggaacactgaatggtttgagctcatgcgctaagacccct

SEQ ID NO: 7070 - DNA, 465 bp, Gossypium hirsutum
  Clone ID: uC-gsronu33B076b02b1
ctttcttcttttgtccagattcaagctagggagagcaagttctttagcaagatcttccaccttggggccaaaatttctcctctagtggtacctacaccaacgccagcaccagcatcggcgccggtactagcaccgacagtggcacctgcaacggcaccggctaacattggtatccaagatccttattatggcctctatggtcatggctctggcatgtttccccctgcaaaagagggtgtcaccactagcaacactcccaccgcttttgaaaacgatcttttcgccgaggaacttgcggatgaaaaatacgaaagcggctacgagaaaaacaactactattacaacaacaacaacaacaacaatggctacactctcagcagctacaacaacaatggctacagcgggcactacaacaccaatggctacaatgacaactacaacaacaatgggtatgagacagaaaga

SEQ ID NO: 7071 - DNA, 407 bp, Gossypium hirsutum
  unsure (1)..(407): unsure at all n locations
  Clone ID: uC-gsronu33B076b03b1
cttaattatatgtttttgttcttatcagctttgttttgcattgctgtagctggcgttttaggccaagctcctcctactcctagtaatcctccgacatccacgccggcgccgccgactccacccgcttccacacctncacctactactcaaccacctgcaacacccacaactacttctccgccaccagcttcctctcctcctcctacttcatcaccaccaccagtttccactcctcctccagcgactcccccgcccgttagctccccaccaccagcttctcctcccccggctactccacctgccgcaactgccccaccggcttctacacctccggctaccccaccacctgcttctccccctcctgctactgctnctgcagctaccccaccaccagctcctttggcttc

SEQ ID NO: 7072 - DNA, 456 bp, Gossypium hirsutum
  Clone ID: uC-gsronu33B076b06b1
cgcttgtcttgttttaggaccccgacagcaaggttgcctgtgaaacatgcaccaagaccaacatggtcatggtctttggagagattaccaccaaagccaatgtagactatgagaagattgtccgtgacacatgccgctctatcggatatgtttctgatgatgtgggtcttgatgctgacaactgcaaggtcctggtcaatattgagcaacagagccctgatattgcccagggtgtccatggccacttcaccaagcgcccagaagaaattggagctggtgaccagggccatatgtttgggtatgccactgatgagaccccagaactcatgccccttagccatgtccttgcaactaagcttggggctcgtcttactgaggttaggaagaatggcacctgcctctggctaaagcctgatggtaaaacccaggttactggtgagtactacaatgacaagg

SEQ ID NO: 7073 - DNA, 381 bp, Gossypium hirsutum
  Clone ID: uC-gsronu33B076b11b1
ttcacgtgttcgcccacgcgtccgaaaggaaggaagataggagagtcaggttgcaggctcagttttctcaaatgcgaccacttacaatggcatcttctgttgcaccacgaatgccgatgtacccacctggtggtccaggtcttggacagcaaatattctatggtcaagcacctccgattttcccccctcagcctggatttggatatcagcagcagcttgttccgggtatgaggcctggcagtgctccaatgccaaatttcttcgtaccaatggttcagcaaggccaacagggtcagcgtcctggtgggagaagggcctgagctgctcagcaaaatcagcaaccagttccattaatgcagcagcagatgctaccccgagggc

SEQ ID NO: 7074 - DNA, 397 bp, Gossypium hirsutum
  Clone ID: uC-gsronu33B076b12b1
tattaatttggtttcgtgagttatgtgtggggttaatgatgatgatgattctcctgaaaccaattagcggcagagatgccgtcctagtacttaggagcaacgccacttaccagtgcaatggccttctcggcggctgcgttatccgggaagaattggagtcggagctggatttgttgatgatagattctaccgttatcagaatcctccagcaaggtagcggtcacatatctatagaggcgcttaatgctaataaggcagcagcgaagccttgccctgaaaattattcgaattgtattacaaaatccaagtcagggaaacataattgtaatgggaataaccttttttgtagatagtgatgttgatcaacctatctatgacaataagcgccctatgcctt

SEQ ID NO: 7075 - DNA, 435 bp, Gossypium hirsutum
  Clone ID: uC-gsronu33B076c04b1
aagttgtgatgtttatagttttggtattctcttgcttgagcttctaacagggagaaagcctatagagaagttgccaggtggtgtcaagaggaccataaccgaatgggtggagccgcttatagcgaaggagcggtttaaagagctagttgatcctaagcgtcgggggaacttcgatcacaaccaattgaaacaagccatctacgttgctgctctatgcgtgcagagtgaacctgagaagcgcccaaacatgaaacaagtggttggcatgctaaaagggtatgacactagaggcaacttgatgcagacgagaatggatagcgtaaagtacaaggaagaattgctggcacttgatcaaagaagtgatgatgatgatgatgatgatgatgatgatggtgatggtcttgaggaaagctgtggagtatttggcgctatgga

SEQ ID NO: 7076 - DNA, 526 bp, Gossypium hirsutum
  unsure (1)..(526): unsure at all n locations
  Clone ID: uC-gsronu33B076c05b1
aaaaatttaatctgtgttcttaggggtgaagactttaaaaaaggagtctaatgaattcttggtcaggatcaggaagaaggcccagaatcatggcttcctcgttgtcattacctcaaaataccatcaccgacatcctctctagattgcccgtcaaatccctaactcgattcaaatccgtttccaaaaactgggccgacctcacttcagcccctgctttcatcgccgcccatctacgccgctcttctactgacccatctctcctcatccgccgctaccactcccagtctggttgggactacgggatctggctcatcactacccccacactaagttacgccacccagctcttgcgtatccccctggaagaatcacttcctctgttcccgaaaatcgtgggttccgtcgatggtttggtttgtcttgatatttccccttgttatgcttctgatttcgtatgtggaaccctggactaaacaaataaacgtctncctttgccntgattactntctcagagataccctatttg

SEQ ID NO: 7077 - DNA, 493 bp, Gossypium hirsutum
  unsure (1)..(493): unsure at all n locations
  Clone ID: uC-gsronu33B076c08b1
ttttgattgtaccgagactaagcatcatgtagggggtaggaagccttaccaccatgaccacggacaccaagatgaagaccatgaccccagccccaggataagccatgaccagnggccagcatgagggaagaccatgaccacgagcaccatgatgaagaggatcatgaggaagagcatgaccaccaccaccaccaccaccaccaccaccaccaccaccgacatcatcaccatggagaggaagaaagggatgagacagaggagcacgagggcgggttcatggagaagatccggaagtattctattcattattgaatataccctgcacgttttctaaaatgatcatagtgatctagtgttgcatctatctatatgtttatttgggtaattttcactttctagtcaccagcccttagggtatgcgtgcatattactcattagtgtgccttactatgggttgtaaataagattgcactcgtttgagatgaaccatatg

SEQ ID NO: 7078 - DNA, 263 bp, Gossypium hirsutum
  Clone ID: uC-gsronu33B076c12b1
tctcttgttggaaatcaaactcaagttcatcgacacctcctcgaagtttgggcacggacggttccagacaacacaggagaaacagaaattctatggtcggctcaaggcataatcttggaaaaaccggtcggaaattcatggttggattttgttttgcattttatcaatttgatgaatgtttgaatttgctgagttggttcagtttttgcgctatagattgttcctagttttgaaccaaatatacccaatatcgtacttgtttt

SEQ ID NO: 7079 - DNA, 108 bp, Gossypium hirsutum
  Clone ID: uC-gsronu33B076d02b1
gcaactttacttttgaacacgggaagagggcaacaagggaggggggcaaacacaacagagcggagccgcaccaccccgagcgagctcgcggccctgaaaccgcaaaac

SEQ ID NO: 7080 - DNA, 315 bp, Gossypium hirsutum
  unsure (1)..(315): unsure at all n locations
  Clone ID: uC-gsronu33B076d04b1
tatattaagaatcngnctaaaaaaaaataaaacgggtatgtaacggaaatgaccgttgataaaagaattttaaaaaatttggtgaaaaaaaaaaatgagagtttgaggcaatatgacaaacgggggaaataaataattattttaggcttaatttggccaacccggaataatttttgaaaaataaatttaaaaaaaggggccaatgtttatttaaaaggttttgggcccaaaattattaaatttaaaacggcgggaaggggggggaaaaaaaagggtaaaataatggttttttttttttttatttaatttttttgg

SEQ ID NO: 7081 - DNA, 235 bp, Gossypium hirsutum
  Clone ID: uC-gsronu33B076d05b1
cttactttaacttataagtcccagctaatattagaatcatgggtgttgtcacttatgactatgagaatacctacccagtcgtccctgccaggcttttcaaggcctttactgttgaagctccgaaagtttggtccacggctgcacctaatgcagtcaagagcctagaggttgcagctaatcctagctctggaagtatcgtaaaaatcaactttgctgatggccttccattccaatt

SEQ ID NO: 7082 - DNA, 211 bp, Gossypium hirsutum
  Clone ID: uC-gsronu33B076d06b1
attcattacttttagcaaaagtaaaagggaaagtaaaaggagggttttgaggagggtgaaagatggctggttacaggccacaggatgaactacgacttccttatcaagggggagccatccggggattcgcgagtaggcaagtccaacctcttattagggtttaccaggaacgtgctccagccaagattacctttgcgggaccagagatgag

SEQ ID NO: 7083 - DNA, 422 bp, Gossypium hirsutum
  Clone ID: uC-gsronu33B076d11b1
tttaatatcacaaatcttcttctccttctcagaaatcttagtatcatcactatggcctcaaatcccaaggtcttctttgacatgacgatcggtggtcagcccgctggtcggattgtgatggagcttttcgcagattgcactcctcgcactgcggagaacttccgtgccctctgtactggcgagaaaggcgtcggccgcagcggtaagcccctccactacaaaagctcttctttccatcgtgtgatccctaactttatgtgccaaggaggtgacttcaccgccggaaacggtaccggaggtgaatccatctacggatcaaagttcgctgacgagaactttatcaagaagcacactggtcccggtattctttcaatggctaacgctggaccgggaactaacggatctcagttctttatttgcac

SEQ ID NO: 7084 - DNA, 366 bp, Gossypium hirsutum
  Clone ID: uC-gsronu33B076e06b1
gcctggtacttttgttaacattatatcctttgatgacctgagtgggggactggtgtagatcgatctctaagggcacattgtggcaacctatgtcaccgaaaatgtgagcagctgacgcttctttgggtatcaggaagaaccttctgatgtttctgctgattgagccaagacggaattaatgcttagttcatttaggtattatgaaccacttggtcatcgtcatcttgttttaaaccaattgacaaaaactcgatatggcattcttgcctttctttgctatacctcccctcttaggttctcccaatcatttgaagaactgcgaatgtgaattcataataatattcaagaggctgatataaaaaatag

SEQ ID NO: 7085 - DNA, 426 bp, Gossypium hirsutum
  Clone ID: uC-gsronu33B076e07b1
tccacttgtccgccagttttcccttcttctttttttccctgtgatgaagatgggttttaggagctaccatgttgatgaatttcaagcccttaattgcattgaatggctgaaaccatcttgctgacctactccttcttcatcactatcactctcgctatcatcttcatcgacttcatcgtcttcgtcgtcttcgaatgatcagcacgggcacgattataaaccccatggctatcttgaaactgcctgtttcatttcaacagcagctacaacaacacgatggtgggcagcttgcgcaggaacctattcaatgcctaccactgatcagcaagcttacagagaacaaatcattgaaaggggatgatgttgggaattctcgatcagaatccaaccttgaaaaggtggctttttattctttaaacttttgaa

SEQ ID NO: 7086 - DNA, 468 bp, Gossypium hirsutum
  Clone ID: uC-gsronu33B076e09b1
tatggttcgatggtctcaaggcccatgctgcccgacatgtgaccgataagatgatgttcaatgcttctttcatatttcctcacaacacaccaactacaaaagaggcatattactacaggatgatctttgagaggttttcctctcagaacttgggcagacatgactgtactctgtacaggactagttgaatcctggagacacccttttgatcatcctgagcggatccatgaggaggctatcctttcttcacgtttaccatcactccatggtggtcatcatgtgttatatttgcttagacagtgctcagtcctccgtacccatggtgctggtcaccaactgcgtggtgcatggcgtaatgaacacctattacctgttgtgcaccctggggatgcaccctaagtggaaaaaaatggtgacggattttcaactagtgcagttctggttaagctttttgatcatggccatgct

SEQ ID NO: 7087 - DNA, 462 bp, Gossypium hirsutum
  Clone ID: uC-gsronu33B076f06b1
cccacgtgtccgtccacgcgtccgcggacctaaatttaatgatccggttcaagtatcttgtggagctgcacatactgttcttgttgcacatgatggatacaagctatggtcctggggcaggggaaggagtggagttcttggaaatggtaaaactgttgactgtttcagcccaacaatcgtgctgtggccaccactgaatgaggatttcaagcaagaagagctgaatcaggatgataaaattgtagatcaaaagggttctgatggagtctcggagatggagaagaagttatctttggccatggaagagatgaagctcctccaatcaaaactttccaccatggaacgctatgcaagcatacttcatggttcaatctttggtaaaccttttgaagtgcaagatattccgatctcgttgcagaactctggcacttttgatattgcaggggaatgggaaaacatgtt

SEQ ID NO: 7088 - DNA, 453 bp, Gossypium hirsutum
  Clone ID: uC-gsronu33B076f08b1
taaattttaaaaaatggctcatcgtatagcgtggtctgtgtgtgtcgtttcgtattttttattcatcggtttgatatcgtcggaggctttctcggtcgtcggatcagaagttgatccgttgatcaggcaagtaacggacggtcaagatgatggagtggagacacagcctttgaccgctgagcatcacttctcgctgttcaaggctcggttcaagaaatcgtacggctcggaggaggagcatgattaccggttcaaggttttccgggcgaacttgagacgagcggcgcgtcatcagaagcttgacccgtccgcgactcacggtgtgactcagttctccgatttgactcccggtgagttcaggaagaggtttttggggttacggaggttgagactgcctaaagatgcgaaccaggcaccgattttgcctaccgataatttgcctgaggattttga

SEQ ID NO: 7089 - DNA, 119 bp, Gossypium hirsutum
  Clone ID: uC-gsronu33B076f12b1
tttgttttgagatgattgcttattattatctatctatttggacgtgttgtgattggtgttaaaaaaaaaaaaaaaaaaaaaaaaacaaaaaaaaaaaaaaaaaaaaaaaataaaaaata

SEQ ID NO: 7090 - DNA, 172 bp, Gossypium hirsutum
  Clone ID: uC-gsronu33B076g06b1
ggactgtaattgtcggggctagatactccattgagcacattaaagcaaagagggcagcagttctatttggccaaatttccaagtggagtgccattgttgttaagagttccatgctgttatcaatatggatttttgacattcctgatcttattggactgctttttgagctatt

SEQ ID NO: 7091 - DNA, 301 bp, Gossypium hirsutum
  Clone ID: uC-gsronu33B076g08b1
aaactacatcgggagagcttttgacaagcaacccatagtgtgaaacccctgaaaccatcacccctatggctgagttccttgaatctgaattcaaatcacatggatcaggcatcgaagtccggtaacaattgcgcagcaaacctttttcggctctgaacatcgatgttctgaatctcatatgcagctgaagagtggggtgtttattggcttatagcaccatactcatttggttcaccaccgtcatgacttctcactaggtgcagggtttggtttgtttggatattttcttttatttggaaac

SEQ ID NO: 7092 - DNA, 514 bp, Gossypium hirsutum
  Clone ID: uC-gsronu33B076g10b1
acgttccacgtgtccggaaacaaggaaagaaaaaaaacgaaacagatgggaatcagattcatattaatggtgaacaagcaagggcagactcgtcttgcccaatactatgaatggctcaccctcgaagaacgacgtgccctcgaaggcgagatcgtccgcaagtgcttagcccgcaacgagcaacagtgttcatttgttgagcatcggaattacaaaattgtatacaggcgttacgcttcgctgtttttcttagttggagttgacaatgatgaaaatgagcttgcaatattggaatttatacatctcttggttgaaaccatggaccgccattttggcaatgtgtgtgagctagatatcatgttccacttagagaaggctcatttcatgctggaggaaatggttatgaacggttctatcgttgagacaagcaaggctaatattctaagtccgattcagctgatggacaaagcatcatgaggggtgtaaaaggttagttaattttctagaatgaata

SEQ ID NO: 7093 - DNA, 496 bp, Gossypium hirsutum
  Clone ID: uC-gsronu33B076g11b1
ttccacgtgtccgggaaaagttggtaccattatcagttggcgttatgtgcatgatggaaaggctaaagtctcaaagcagctagttgaagcgatagatcctagtaagaacttgatcactttcagagagatagaaggagatcaactgaaagagtataagagctttgtagccacgcttcaagcttcgcctaagaacaagggtagtggcagcatagtgcactggactgtggaatacgagaaactgcaccacgggattgcacatcccgagactctgttgcaattcttggtggatgcctccaaggacattgacgctcacctcacccaaccaaactaaaggatcgattaagaacatccgatgtccgtactgctcactactactacctgaagcagtactaatctaattaagaataaattgacagctaccttacttctttgtttcaattcgaatatgtatacacgtttggatcaatatgctgtcaaggagagggagctttatttt

SEQ ID NO: 7094 - DNA, 492 bp, Gossypium hirsutum
  Clone ID: uC-gsronu33B076h04b1
ataatctttcttctgctttgtcgccacgatttcagcttcagatcgcttctatttcttagctggaagctaatactgcagaatgggcaaggaaaagactcacattaacattgtcgtaattggccatgtcgactctggaaagtcaaccaccactggccacttgatctacaagcttggaggtattgacaagcgtgtcattgaaaggtttgagaaggaagctgccgagatgaacaagaggtcattcaagtatgcttgggtgcttgacaagttgaaggctgagcgtgaacgtggtattaccattgacattgccctgtggaagtttgagaccaccaaatattactgcactgtcatcgatgcccctggacatcgtgactttatcaagaacatgattactggtacctcccaggccgattgtgctgtccttatcattgactctaccactggaggttttgaggcaggtatttccaaggatggacagacccgtgagcatgctct

SEQ ID NO: 7095 - DNA, 355 bp, Gossypium hirsutum
  Clone ID: uC-gsronu33B076h05b1
cccacgtttcctctcaagccgcacacgcagtgatcgggggaggagttgatataaatggaggctgtcagaaccgttaaagacgtttccccccacgagttcgtcaaggcttacgccgcccatctcaagcgctccggcaagattgagcttcctccatggactgatattgtcaagaccggtaaactgaaggagctcccaccctatgaccctgattggtactatgtcagagctgctttcatggcttggaaaatatacttgaggggaggtcttggtgttgttcccttttgcaggacctatctatagttctttgtccttttgtactttttccctccctcttttctctgtcctttcgtttttt

SEQ ID NO: 7096 - DNA, 130 bp, Gossypium hirsutum
  Clone ID: uC-gsronu33B076h08b1
tcgaattgtcctgcctatgtatatagtcagtggggggagggcatttccagctatggatgcagcatgagtctcacccgggaaggcgaatccaagcagggcatatgagggacgctagggcaagctgacggta

SEQ ID NO: 7097 - DNA, 357 bp, Gossypium hirsutum
  Clone ID: uC-gsronu33B076h09b1
gagcccaccgacctcacgcgttcgttacgtatccgggactacagtaaaacttgcgggcgcgcgagcagtataagattgacttgtttgtaacaacaggcttccaacagtggatatctatgtggatacaattctatggtggtgatgtgtcttccgcctccagatgagacatcaactcctattgtgggttcttggaagtccgagaatgggacgacaacattgttatattggagcttgaggacaaagaaccaaaaaaaattgacgggcaccaaatgaaggtctccgggaacttcgagaacttggggtcgaatatgtacttcaagaagtcggaaaaaggcgattatgtagtgggtgtaatac

SEQ ID NO: 7098 - DNA, 382 bp, Gossypium hirsutum
  Clone ID: uC-gsronu33B076h10b1
acgtttttctctctaggattttgattacatcttcggggaactgagcttctttcttttaattagattttcaatcctttcctttcctacaaaacgttaacaacaaacaggtttttctttgggcggtttcatgctaatttgattggcttttcttttgttcttttttacacattcaatggcacccagcagcagaagaggcaaaacatcaagaaacgcatgcaagcccagacgaagtaaatacaggaagaagctcgtaaagccgagcatcaatattcaaacgtccacatcagcaacgttggacgattcggcttccaagattgatgatggatttgcattgcatcatattattgaaggagatgatgacgtctctaccacatgaacatgc

SEQ ID NO: 7099 - DNA, 435 bp, Gossypium hirsutum
  Clone ID: uC-gsronu33B076h12b1
accgattcggaatttcgggctacgacctacgcgtacgcttcattcttgatgtcattggccatgtcgactgtggcaagtcgaccactactggtcatttgatctacaagctaggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactttatcaagaacatgattaccggtacctcacaggctgactgtgctgctctcattattgactcaaccactggtggttttgaagttgttatgttaaaggcttacagactggccagtttgttttttttcc

SEQ ID NO: 7100 - DNA, 441 bp, Gossypium hirsutum
  Clone ID: uC-gsronu33B077a02b1
caaacttattaacggagcagacagtcagataagcagagaaaatggaggctgccagaactgttaaggacgtttcccctcatgacttcgtcaaggcttacgccgcccatctcaagcgttccggcaagatcgagcttccttcatggactgatattgtgaagactggtaaactcaaggaacttcctccctacgatccagattggtactatatcagagctgcttccatggcaaggaagatatacttgaggggaggtcttggtgttggtgcctttaggaggatttatggaggggctaagagaaatggaagtcgccctcgccatttctgcaagagtagtggatctgttgcccgtcacattcttcagcaattgcagaatgtgaacatcattgatattgatcctaaaggcggaaggagaatcacatcatacgggcagcgtggtctggacc

SEQ ID NO: 7101 - DNA, 351 bp, Gossypium hirsutum
  Clone ID: uC-gsronu33B077a10b1
gaattatgctccttttggtttgtagtctgtactaacggaactagttatctttcctattatcatctaaatttgtgctttttcttttctttttttctctcatggattgtcttttgaatttgtatattgatggccctttgtgttctcacactttccttcagttactttggatttagatatgtttgatctgttaactgaaacatggagaaattgtttcctattgtttcttgtgatgtaatctgatctagtatgttttaatgaactaaaaaaaaaaaaataaaaatattaaaaaaataataaaaaaaaatacaaaattttaaacaattaaccccatatatttacattttttatcac

SEQ ID NO: 7102 - DNA, 482 bp, Gossypium hirsutum
  Clone ID: uC-gsronu33B077b06b1
cccactcttccgcaacttttcggggcctgatggaccgtttgatgtcgaggtttttaattcagcaagtgactatgtgaaattgatgaagtcaatttttgacttcgagcttatccgcaagctgcttttatctccgaagtttacattctgctatgatgcacttcatggtgttgctggagcttatgcaaatcgcatctttgtggaagagcttggggcacaacaaagctcacttttgaactgcacacccaaggaggactttggcggaggacatccggatcccaatctgacttatgccaaggagttggttgagcgcatgggattgggaaaatcgaactctggtgttgaaccaccagagtttggtgctgctgctgatggtgatgctgatcgtaacatgatcttgggtaaaaggttctttgtcactccatcagattcagtagccatcattgctgcatatgctgttggtgcaattccttacttttcttctg

SEQ ID NO: 7103 - DNA, 252 bp, Gossypium hirsutum
  Clone ID: uC-gsronu33B077b07b1
ttaatgtgatggttgtggacgatatttatccatggtttcttctgtggactatctaatgtcttgatttcgagctttgaatttttatgaaactgaatcattatgttctttggaattaatgaaaactgttattattcagtgtaacatgtgatagagcgatatatgatgcaaaaaaagatgacacacaaagagaaataatccatatctgagtgctcgccttgatcatgtatgaagaaatggttgtggtcgtctggc

SEQ ID NO: 7104 - DNA, 207 bp, Gossypium hirsutum
  Clone ID: uC-gsronu33B077b09b1
cccatgcgtccggttcccgctcctaatgaagttgtggaattgcttcctgtcaaaatttataacaagtcacacaaacttcataatgatgaggctggacagtaagtatttatttttctctgctgtttgagaaatgtgaagcacacttgaattttttttttttgttgacgaatagttgaagatgagatttaactgtgtgtgccttgactt

SEQ ID NO: 7105 - DNA, 393 bp, Gossypium hirsutum
  Clone ID: uC-gsronu33B077c02b1
tcacacgcccgcggtcctatagaacatttcgcaactgttccctagcagggggccattctgatcaatcttgagggtgacaacacacagttcaagcagagagcctattacacaaacacaacatcaatcctgggatgggcgcagcgagtctacatagctacaggcctaacttcagagggaggtgacagtgccctacattcacttctaatgagagttatcataggcaacaaaatgaaagtgggagcttacacatatatgaagcgcgcacaccatatcctgggattcgcaggggccaatacgccacacggtcttaagtagttggcactcagaacaactgaggcaacatccatgttaaagaagagagagctgaagggtatgcggccatcatatatgaaa

SEQ ID NO: 7106 - DNA, 602 bp, Gossypium hirsutum
  unsure (1)..(602): unsure at all n locations
  Clone ID: uC-gsronu33B077c05b1
cgatttccggggtcgaccttcgcgtccgagccatctgtgaataagtgaattgatatccaagcgttccattccatttccgtatagttcgaaaacacttaagtaccttcgatcatattttagtgtcaaaaaatggccgaggagcataccagcaaggcccctgagttggagagcaacgttagcggtgaaggagcagtggagagcaaggagcgagggttgttcgatttcatggggaagaaagaagaggagaagcctcaagaggaggtgatcgtaaccgagtttgaaaaggttaatatcgaagagacaaaggcagaggaagaaggtgaggagaagaagaagcatggtctcctggagaagcttcaccgatcagatagcagcagctccagctcttcaagcgacgaggaagaaggtgaaggagaagagaagaagaagaagaaaaagaaggagaagaagggactggaagaaaagattgaagagaaattagaaggggaaaagaaagaagaggacacctcagttccagtagagaagtgcgatgagccagtagtccatccagagacgccagagaagaaggnttttctcgagaagatcatggagaaactccctgg

SEQ ID NO: 7107 - DNA, 494 bp, Gossypium hirsutum
  Clone ID: uC-gsronu33B077c12b1
ggctttcctttttttttttttttgggagaaagcttggagttttggtttggttcttttgtggttcagcactttaagctgctatctggttaatgcagctgacgataaaaatggtggttttggagcttctttcatcttcggtgattctctggtggatgctggtaataataactatttaccaacgttgtctagggcaaatattccaccaaatggaattgattttaaagcttccggtggaaaccctactggcagatataccaatggtagaaccattggtgacattgcaggagaagagttgggagtaccaaattatgcagttccatatcttgctccaaattctactgggaaagctatactttatggtgtaaattatgcatcaggaggatgggggaattattgaatgcaactggaagaatatttgctaatagactgggattggatatccatatcgatttcttcaacaatacatgaaagcaatttgataattggtggggtca

SEQ ID NO: 7108 - DNA, 410 bp, Gossypium hirsutum
  Clone ID: uC-gsronu33B077d05b1
cttattcgcccaccataatgattggccctggcactgggttggctttttacaggggtttccgtcaggaacggctcgcactgaaagaagctggtgctgagtcgcgtccacctgtattgctctttggctgcagaaaccggaaaatggacttcatatatgaagatgagctcaacaactttgtcaacagtggtgcactatctgagcttgtggcagccttttcacgtgagggacccaccaaggaatatgtgcaacataaaatgatggagaaggccaaggacatatgggacatgctttcccagggaggttacctgtatgtgcgtggcgatgccaagggcatggccagagatgcccagcgagctcttgacactatggaggatgctcagaaagcccgaatcagctcaaaggctatgagc

SEQ ID NO: 7109 - DNA, 445 bp, Gossypium hirsutum
  Clone ID: uC-gsronu33B077e01b1
cccacttcttccgctggtctttgctttccagttatggagcttcaactcccttcattccaggtcctcctcagcatcctccttgtttccttcttcatattcagaagtttaaagaaatcaaaacccaaaaatcccgaccttaagccaattccagggccgagaaaatacccggtgatcgggaatttgcaccaaatcgctagcccatcaccccacaagaccttgagagacttggccctgaaacatggaccactgatgcatctccagctgggggagatatcgacggtgatagtatcttcaccggaagtggctaaagaggtgacgaaaacccacgacattaacttttcgtacaggccagccatggaagttcccagggtctacacctacgatttcaccaacatcggctttgcaccctacgggaactactggagataccttcgcaaactgtgca

SEQ ID NO: 7110 - DNA, 546 bp, Gossypium hirsutum
  unsure (1)..(546): unsure at all n locations
  Clone ID: uC-gsronu33B077e06b1
cttcattttaagagtcgattgattcttcgaaaaccatagacgaaaccaaatatggcggtgaaagcaatcgagtcggttcaatgctttggccggaagaagacggcggtagccgtaacacactgcaagagaggccgtggtttgatcaagatcaatggttgtcccattgagcttgtcgagcccgagatcctccgtttcaaggccgtcgagccaatccttctcctcggccgtcagcgttttgccggcgttgacatgaggatccgagtcaaaggtggaggtcacacttctcagatctacgctatccgtcaaagcatcgctaaagcccttgtcgctttttaccagaagtacgttgatgagcagagcaagaaggagattaaggatattttggtcgggtacgataggactttgctggtcgctgatcccaggaggtgcgagcctaacaagtttggtggaagaggtgccagggcaaggttccagaagagttaccgctgaagaactgtcatggctcgntctgatgtngttcttagtgaaatgatatggctatgcttg

SEQ ID NO: 7111 - DNA, 538 bp, Gossypium hirsutum
  unsure (1)..(538): unsure at all n locations
  Clone ID: uC-gsronu33B077e11b1
gaagtttgtatgaggaatttaacctcaaggagcttattgaagagcttactaacttggcaggagctttcaatcttgcagattttgtgccttttttgggtgcttttgacttacagggactcatagcccgtacaaggacacttggtgaaaaacttcacgaagcccttgagacgattattaacgaccatcagcaacaaaagcaagatgattttgttggtacaatgcttacagaattaaataagcaaatgaatcccgatggtgatataatggatcgaaatagcatcaaagccataacaatagatatgattgtgggttccttggacacctcagctgcaacattggagtgggcattatcagagctcataaggcatcctatggtaatgctgaaattccagcaagagttagaaagtgttatcgggaagagaatggtggaggaaaatgatttaccaaaattggagtacctagatatggctgtgagagaaactntaaggcttcatccttgtgcacctttactagttcctcgtgagtcaatggaggacat

SEQ ID NO: 7112 - DNA, 519 bp, Gossypium hirsutum
  Clone ID: uC-gsronu33B077f02b1
caatttttgtctttacctttctcttggctgtaatgatgggtgcagtttgagcgaattttctcagaactgaatgtcaagcaaaggttggaggtaccctgatatgtgtttctggtgcgatattaatggttctgtttcgtggtccagctttgagtggacagaaagatacagactttgctctaaatgacataagtgccaggggtcaaccagaaccttctggatggctcgtgtctactcttctgggatttggactggaacattggcatattggagttctatgcttgatagggaactgtatgtgcatggccactttcctagctattcaggctccagtgttagccaagtatcctgcaaacatttctgtcacagcattttcctatttttttggtgccatattgatggtaacaacatccttttttatgaccaatgagtcaacagactggaagttgacgcggtctgagctttttgctgtcttatatgctggaattattgcatctgctcttaactatggactcctgacat

SEQ ID NO: 7113 - DNA, 542 bp, Gossypium hirsutum
  Clone ID: uC-gsronu33B077f05b1
gtccgcccatttttccgcccacgcttccggccatttctacgcaggaatggtttgcttctgtgagaaaacatggagccacaccccacaatacaggatcggttactgccaacaatgccctgacatggtgaagtggcccgccgagatgggaaatcccccttcactttacttcaatgctggcatgttcgtgtttgagcccagccttgtgacttatgaatctctcttgaagactctcaaaatcacacaacctaccccatttgcggagcaggactttttgaaaatgttctttaaggacatttacaagccgattcctttaatttacaaccttgttctcgccatgttatggcgtcatcccgagaatgtggagcttgaaaaagtgaaagttgctcactactgtgctgcgggatctaagccttggaggtacacagggaaggaggctaacatgcaaagagaagacattaagatgcttgctcagaaatggtgggacatttacaacgacgagtcacttgattaccgtaccagcgcggctgatggagggacagaga

SEQ ID NO: 7114 - DNA, 470 bp, Gossypium hirsutum
  Clone ID: uC-gsronu33B077g04b1
cttgttttgagtgtagagatgaggaaaatcatgggtgccaaagttctcttcttctttgctttgctttccttttcagctgtgtcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccctgttctgtctgctagagaaggcatcgtttcgttgggaggcccttacattcctttcaaact

SEQ ID NO: 7115 - DNA, 444 bp, Gossypium hirsutum
  Clone ID: uC-gsronu33B077g06b1
atcacagacaaaatgaccaagatcagaacatgttttttgcgatcacgtcattcaatggagttggatcaggtagcatttccccaagttgccatggtggaggctgcaaaggaaaatctagaaaaaggccgtcgccattctttttcatttagaggggaaataaggaccagcagccaatcagctccacttttttctgagaataaatctgacccttgtgagaaaattcaaccgttatcagcacgaaagtttagctcatatgtattaccgacaccagttgctacagaaagttctattggattaggtaatccagctccccaatcttcaaaagcaagtttgaatgagcaatcaaacaattcatggcattcatcttcacttgaacataagaaacatgagatgattttgggagatgagaaagtctctggatccgcagttataatgcacagtctt

SEQ ID NO: 7116 - DNA, 373 bp, Gossypium hirsutum
  Clone ID: uC-gsronu33B077g07b1
ataatacgaactgcagggaattaaattccctataaaatcgtttctcgaaaaattcctttccgtttttaatcaaacccgatttcctggtttctttttcttcatcgatcgccgccgtgcgtaaaacatgaaatatcaaaagcataatgcttgccgaattagaaaaagaaactatggggcctgaacagactgaaggaacaagctttccaccatcggagccaatgctttgtgccaacgggtgtgggcttttcgggacggcggcccgtttgagtttacgttcaaagcgctagcgatgcctacatgtcggcgtggagcaccccgcttttgcataagctgaggtggagaaatctgaaaatttgaaagacgaacatgtgcc

SEQ ID NO: 7117 - DNA, 477 bp, Gossypium hirsutum
  Clone ID: uC-gsronu33B077g08b1
cctgtttcaccagctatgggtatcgacttggtcgccggcggcaagagcaagaagacgaagagaactgctcccaagtctgatgatatatatctcaagctccttgtcaagctttaccgttttctggtaagaaggactggcagcaaattcaatgcggtgatcttgaagcggctatttatgagcaaaaccaacaagcctcctttatctctttctaggttgattcaattcatgaagggcaaggaggataagattgctgtggcagtcggggctgtcaccgatgacattcgtgtgtatgaagttcctgcgctgaaggttactgcgttaaggttcactgaaacggccagggcaaggattgagaaagctggtggggaatgtttaacatttgaccaacttgctcttcgagcacctcttggacagaacacggttctcctacgaggtccaaagaatgctcgtgaggcagcgaagcacttcggaccagct

SEQ ID NO: 7118 - DNA, 513 bp, Gossypium hirsutum
  unsure (1)..(513): unsure at all n locations
  Clone ID: uC-gsronu33B077g10b1
ccctcttcgtccgatctcctcccacttccactcatcatttagacgaaaatcttcttgggttttcataaaatgtatagaatactctttgtttttggatttttggtgtggcggatttacgtgtgctagaaaatatggagaaatcgatgttgaaggcggagttttccaaagaaatgtgcacgtctcccaccgtggagcccagcgattgtgggaacggcgagactccgattaattatcaacgattgttacaatcttggagaagacagccctgtgtttgaaaacttgtttgaattttgtcaaatttatgctggtgggacaataggtaaattttgatatggggttgngcttctcttaatttgatttgtgcattttcagttgtaattgattgtcatggctggcagatgctgcaagaagattaaacaatcagttatgtgatattgctataaattgggctggtggtttacatcatgccaagaagtgtgaggcatctagcttttgttacatcaatgacttggt

SEQ ID NO: 7119 - DNA, 550 bp, Gossypium hirsutum
  Clone ID: uC-gsronu33B077g11b1
ccctcttcgtccgcccacgcgtccgcaacttctcaaaaagtatcttttctctctttcatccaaaatacccaaaagtcaagagtagattaaactaatggccggaatcggacctttgactcaagattgggagcccgttgttattcgtaaaaaagcccctaccgccgccgccaagaaggatgagaaagtcgttaacgccgcccgccgtgccggtgccgagatcgagtccataaaaaaatcaaatgctgggacgaatagggcggcatcaagtagtacttctttgaacacaaggaagctcgatgaagacactgagaatcttgctcatgaccgagtgccaactgagctaaagaaagccatcatgcaagctcgaatggataagaaacttacccaggctcaacttgctcagatgatcaatgagaagcctcagattatacaggagtatgaatccggaaaagccatccctaaccaacaaataattggtaaactggagagggctcttggtgcgaagctgccagggaggagtgagtgagtaagagtctcgtagaaagacaaa

SEQ ID NO: 7120 - DNA, 507 bp, Gossypium hirsutum
  unsure (1)..(507): unsure at all n locations
  Clone ID: uC-gsronu33B077h04b1
cccacttttccggtcgaagttgatatccaactatcacgcgttaggtttattgcattatataaatcatgaaatctttccttcctttctttgcattcctctcacttctcctgtttgtagacaccattgcagcagctaggaaagatgctggagagcactggggagctgtaatgaaagatcagcctatgcctgaggcactccaagagcttgttcggattgaggctgccgttgccaaccccgatgagaaaaccaagtgccatacatcaggtaacattgagcttaaggaagagaagattattgctaatgaggagttcgaaccaaggccaaacatttcagcttacggtgatgacgctaatctaaaaggagataaatcatcatcttttgcagaagattttgaaccgagacctaacatttcggcttacgggggcgatgatgctggtcttaaaggacagaaagaatcattcactaaagatttcgatccacagccaaatatctncgcttacaataact

SEQ ID NO: 7121 - DNA, 76 bp, Gossypium hirsutum
  Clone ID: uC-gsronu33B077h06b1
aaaaaaaaaaaaaaaaaaaaaaaaaaagggggaaattaaaaaaaaattttaaaaaaaaaacaaaaaaaaaaaaaaa

SEQ ID NO: 7122 - DNA, 433 bp, Gossypium hirsutum
  Clone ID: uC-gsronu33B078a01b1
cccacgcgtccggcgacggacagctatctgcatgcgaaggggctcttgtacattatgaagacatggggatcccgaaagatgtggcaaaactgggcgttcgtcacggcatgtggggagctgtaaaaaaggtaccactccggcatgagggcataccagagtgcaagaaaaaccgagacttcattgtctaaatgtgcactcatggcaagaatgacaacaaagatctcttgtgatgagaacataagttcttccggtcgtgttttgagggatgtcgaaatctatcaaagcatggatattattaagatggtgtatttttttatccttatttggtgtggcattttatattattatctatatgaatatgtttatttattatataatattcttcttgaattattattttgttatcttcaaattcttagtctatgtatattta

SEQ ID NO: 7123 - DNA, 460 bp, Gossypium hirsutum
  unsure (1)..(460): unsure at all n locations
  Clone ID: uC-gsronu33B078a06b1
gccgcgccgtacccgccgcgaccaaccccgccgcccactttgctgcctcgcataggagatgngagcaccggacggggggatttataaaatcttttttttggttgaacaaccgaagcattcatctacttcaacagaatcccaacaagatctggaaccgtgttgtatctgtcaggaagaatatgcaaatggagatgacactgggatactagattgtggacatgacttccactctaactgcattaaacaatggttaatgctaaagaacttgtgccctatttgtaagacaacaggcttgcttaaatgatagcaaaagctgatgttagagctgggaaatttcgttatcttttgatcgtcattaagatcctataataagggtttaggtgcgcatgaaccatacaaaatttgaagatgctgccgctaattttatgtactgcaagatgagttgtttgtcgaataacct

SEQ ID NO: 7124 - DNA, 265 bp, Gossypium hirsutum
  Clone ID: uC-gsronu33B078a10b1
ccctcgtgaccgctatgtttcgccatatgcagtataacatgtattctttaaaacgactggatattttgaagcgcatggtattgttttgcaaggcagctgttgaggttccttggtatgttccatgtggaggtgtctgctatggagatggaaatctggttttcattgctaatgattggcataccgccttgttgccagtctacttgaaggctaattatcgagacaatggtttgatgtccttcactagatccattctcgttgtccataa

SEQ ID NO: 7125 - DNA, 410 bp, Gossypium hirsutum
  Clone ID: uC-gsronu33B078a11b1
aaataataaaaaaaaaaaaaaaaaaacaacaaaaaaaaggagaaaatataaaaaaaaaattatagaaaaaaaaaaaaaaaaaaaaaaaaaaaaaaaaaaaaaaaaaaaaaaaaaaaaaaaaaaaaaaaaaaaatggggcgggccctaaaaaagagacaaaatttaaacaccgggccagggaaaaaaaaaactttttaaaagggacccaaaaaaaaaaaaaaagggccccggtttaaaaaccgcggaaggggaaaaacccgggggaccccaaaaaaaaaagcccggaaaaaaaaccccctttcccaaggggggaaaaaaaaaaaaaggccccccccaaaggccctctcaaaaaatgtcgaaccctaaaatggaaaaggaaccccccctaaaagggcacaaaaaagcggggg

SEQ ID NO: 7126 - DNA, 397 bp, Gossypium hirsutum
  Clone ID: uC-gsronu33B078b07b1
ccccgtcgccgcgggctattgaataattttagataaagaaacatatccatttatatcaacacaaatgtttgtaaaattactttaaactttctatgcacgtaattcatcaaagaaatttgatttgcaatttgtttttttttaattaaattttaatgaatcaccttcatttatggtttactttaattaagtttaggactttttccttgtataaatgaaggtctattactttctttattgtcagcgttaacattctacggaattacctgtgaattattttttcttgcctatttgtaattcttttacttgtttctctttgttgtttatctctttcttgtttttaaatttcttttcttcatttttatattttttctacttttccttcttaacttttgtttct

SEQ ID NO: 7127 - DNA, 173 bp, Gossypium hirsutum
  unsure (1)..(173): unsure at all n locations
  Clone ID: uC-gsronu33B078b11b1
gaaacatanctctcgatggctttagaaaaaattctgtgcatgttatcttttcaaccagttgggaagaaggacatgcctgacctgtgacgaaggtagatatcaattttttgctaggtttgggagtggaatgacgagaatagcttcaactgaccttctgtctgattatatggcca

SEQ ID NO: 7128 - DNA, 424 bp, Gossypium hirsutum
  Clone ID: uC-gsronu33B078c04b1
cccacgcgttcggccctagatcgcgagcggccccgttaccttcacattttgacgcggatctgcgataggacgctgacggataagaccctatccttggagggtgaccgccccaagacgagcgacagcgtttagggtcacgatgcaggacaaggagggcctgctacccacacatgcgtgacttatcttcgcggggaaggacttggatgacagtcggaccttagccggcttctgcatgcagacggagatacactgttctcattgcctagcgagaagggggggcgccgtgaagaggaagaagaagacctacaccaaacccaagaagatcaagcacaagaagaaggcggggccagctcgcagggctccagctctacaaggcggacgagcccgggaaggttcagaggctggggacagcgtgtcctaatgc

SEQ ID NO: 7129 - DNA, 439 bp, Gossypium hirsutum
  Clone ID: uC-gsronu33B078c08b1
gctgttctagaacttctagggaaaactgggactgtaacaagcttctggatggaccatattaagacccattgctatgctacatattcatctgtagaagaagcaatagagacaagaaatgctgtttacaaccttcaatggccacctaatggtggacgcctattggtggctgactttgttgatccccaggaagttaaaacccggcttgatgctccaccacagactccaactactcctgggacttctggttctactgctcctcaagctcaacctgcttctcagccccagccctctccacgtcagcaggtttctagacagcagcatccaccaccttctgcacttcctccaccgcctttgtctaacccttcaccagttagagaacggctccctcttcctctgccaccggcagagaaagtagatcctcctattgtcactctggatg

SEQ ID NO: 7130 - DNA, 443 bp, Gossypium hirsutum
  Clone ID: uC-gsronu33B078d03b1
taggattttttttccaaaaaccattaaaccatcatatgtttcctctttcttttcccaacccgagatgcatccaacagtcaagcttcaatctggttctcttccctttcgcgatccaaccttcgatgcgtcgggctcaagcagtcctccaataagtgacatcaggttagctcggggttggaaatcgtcggaggcagcatcacactatcaagccaacaccttgagagtataaacaaatatggtagaattatcaagtgagtgattatcagaagctcgatttggttggaagctcatcgaagatctatcacactatccaaaaatcttttcagtagtttttgagtattttggccaaggattataatggcatgtataataggggttgcacgggtgagaacgtagactgggacagaccgtatgtccctagttcgaaggttacactagagtca

SEQ ID NO: 7131 - DNA, 437 bp, Gossypium hirsutum
  Clone ID: uC-gsronu33B078d05b1
tataattttttcattgagaaaggtcgacctgtcttgcaggggcttcacgctattgatttcttagcaaaagaggtgcttggttgggctcaagcaatgcctaaatttgcagctgaacttgtgaagtttgtgcaaactttccttgaacgaacctttgaaagatgtcgaacttcatacatggaggcagttcttgagaagcagagttatatggtcgttggaaggcatgatattgataaattgatgcgacgtgatccagctagtgcatgcttaccgaatgcacttggtcagccaaatatgggaaatattgtttctgatatggaaagtatggagattgaatcagaactaaatgaactcctcttaaatttgcgtcctattaggcaggataatctaatccgtgatgaccataaacttgttttgctggcatccctcagtgattcatt

SEQ ID NO: 7132 - DNA, 428 bp, Gossypium hirsutum
  Clone ID: uC-gsronu33B078d10b1
cccacgtttccgcgagggtttcctcaagttcccatctttctttggctttcgcatcagctccatggatcgggcgcagctcctcctcgtaggattacctctcttcctcttcgccactgatctcctcagcctcttcactcctccgcccccaaagccgccgtcccatcaccatcaccatcaccaccatcatccccacctacccaaacctccactcaatcctgaaaccctagatatttctttacagaaacccagcgctagtggaggaatcggctatggcagcacggtgaatatcaatttctgcgcttcatgctcttacaggggaaatgctgtgacaatgaagaagatgttagaagcccagtttcctggaattgatgtaatccttgataactatccaccatcattgccgaaacgtttgctttcgaaagtggttc

SEQ ID NO: 7133 - DNA, 408 bp, Gossypium hirsutum
  unsure (1)..(408): unsure at all n locations
  Clone ID: uC-gsronu33B078e02b1
cattgttttttccttttccaaacaatcaaaagattcagaacccactcttttcgaccatggcagtatcaacattctcttttgctttgagccttgccattttctcaatctgggccgttgatgcagctcaccaccatgcgacagcgccgtccccttcttcttcttcttcatcctcctcttcctccactgtggactgctcgactctgatactgaacatggcggattgtttgtcgttcgtgtcaagtgggagcgaggtgtcgaaaccggaaggaagttgctgatctggattgaaaaccgtgttgaaaacgggccctgagtgttcatgtgaggcatttaagagcagtgcttcaatgggtggttcaattgaatgtcactaaggcctncactttgcctgctgcttgaaaagtttct

SEQ ID NO: 7134 - DNA, 341 bp, Gossypium hirsutum
  unsure (1)..(341): unsure at all n locations
  Clone ID: uC-gsronu33B078e03b1
cccacgttttcgagattatgaaaaaaagaaagcagcaaaaataacaggcctctgtaatgatatattgtcaaggatggatgcctgcaaggtctataattatgtctctgtctgtgtcttgtgtaatagaagctctgtttgtggtgaaaataatgtataagccatttggttgggagcaaattgtccttttctccaaaggatttttgctgctcattcatggtgacttggtttatggttttatctgttgttgttaaaatcttataaaaatatatatcggttgctgctcttggtttgtatcaaanaaaaaaaaaccaaaaaaaaaaaaaaaaacaaaaaaaaacaaa

SEQ ID NO: 7135 - DNA, 365 bp, Gossypium hirsutum
  unsure (1)..(365): unsure at all n locations
  Clone ID: uC-gsronu33B078e10b1
cccacgtgnccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagaacgaaattggggttccaagtgcgcgaactaaagaaaatttaaggttcagttcatttaaaccgaattcaatgtcaaatgccctggcgtaacctaaaatagcactgtgatagcaaaaacaaatttgaatcagatgggtaaataaccaaaaggccctatcagtagcaaatggaaaacagacaagccccctgaatatcgaattggacctcccatgataagttgcaaaaggaacgggaaaaggtgcaggaaactg

SEQ ID NO: 7136 - DNA, 399 bp, Gossypium hirsutum
  Clone ID: uC-gsronu33B078g08b1
gcgcccactttttgcggccacgcgtccgctcggcatttgttggggtcgggttcacaatgtgcttaacctctattatttacgaggtttcgggagcatgggaaaggcggcacatagagtcaaaccaaccgcttaagtctcaagaggtaccacggcccaatcaagcaccggtaacggcaccgttacaaacacaaacggatacgaacgcccatggtaatgaacccgaaaggagagctttagaaagtgggaatgccaattaagtttaaaacatctataaggtgtaaaaaatggtgttcaatgaaagttttctgttgtacatataccatctcattgtgtagagatgctttacatgcttgtctattgttgattttattaaacgttacttggggaaaaagctttttt

SEQ ID NO: 7137 - DNA, 424 bp, Gossypium hirsutum
  Clone ID: uC-gsronu33B078h07b1
aaggagtagaattcgtcaagatttaaaattataaaagagtgacttatataagaaagattccaatgaaggaaagaattaagatcattctaccaccaatttgacattagaaataaaccttcttattcaaaaaacatgttgccctgtaaaaccaaataataggagaaagaatatttcagaatattataaaaagctcaagcatagaaaatatagaaaaaaaaaaaaaaaaaaaaataaaaaaaaaaaaaaaaaaaaaaaaagaaaaaaaataaaaaacaaaagaatgcttttccgctggcatattgggcgaaaaatgtattataatgcaacggacgtcggtttacaatgaaagtcgggggatcccattgctgaaattgccaagcctttcttttcgcaactcaagcccggtgctgctgcgattctcgcc

SEQ ID NO: 7138 - DNA, 350 bp, Gossypium hirsutum
  Clone ID: uC-gsronu33B079a02b1
cccacgcgtacgaacacgcgtacgaccacgcgaccaaggagaaaccaagttaggctggttttttgactcaaaccgcacgaagacaagactcgctgggagcatcagaacgaaacccagcctccaacaggagccaatcatggacgcacatacacacgccgcgtcaatcaatacttgccaacggctagcgcttcgagctccaaccatacatgaccagcgttgccgaggatgccaagcagagcaagcaatggaaccagctccagacaatggaaatctcaagaagataagtcattagctgagaatgtaacagcaatcgcttcagatcctaaaattaagggtgcagatgcggatgc

SEQ ID NO: 7139 - DNA, 477 bp, Gossypium hirsutum
  Clone ID: uC-gsronu33B079a09b1
cgaagtgtatggtatgatgaaatcgtgaaggaagtctcttcctacttgttgaaggttggtttcaaccctgacaagattccatttgttcccatttctggttttgagggtgataacatgattgagaggtctaccaacttggactggtacaagggccctacacttcttgaggctcttgaccagatcaatgagcccaagaggccttcagacaagcctctccgtctaccacttcaggatgtgtacaagattggtggtattggaactgtcccggttggtcgtgttgaaactggtgtcttgaagcctggtatggttgtgacctttggtcctaccggtctgaccactgaagttaagtctgttgagatgcaccatgaagctcttacagaggcacttcctggtgataatgttgggttcaatgttaagaatgttgctgttaaggatctcaagcgtgggtatgttgcatccaactccaaggatgatcct

SEQ ID NO: 7140 - DNA, 259 bp, Gossypium hirsutum
  Clone ID: uC-gsronu33B079b01b1
cccaaggtacggcaacaagggaacaagggagcacaatgaggccattagaaggacgattaggggtgcgacaggaacaagagaagaaaaaacaaggtggaaatagaaggccgaagggggaaaagaaccagggcgcgaaagaaagagacacaaacctggcaaacagaaatcgaaaagggcaaagaatgggaagtgaaaaggcagatggcaagaaagccaactaataagaaaaaagaaaacaagaagaacacgagaaagaaac

SEQ ID NO: 7141 - DNA, 476 bp, Gossypium hirsutum
  unsure (1)..(476): unsure at all n locations
  Clone ID: uC-gsronu33B079b10b1
tagattttctgaaacactagatgttgaaatcaaaagatgggctgctggtaaagagggaaatttgcgtgctctgctgtcaactctgcaatatgttctttggcctgaatgtggctggcagcctgtttctttgacagatttaatcaccgctgccgcagttaaaaaggtttacagaaaggcaactctttgcatccatcctgataaagtccagcaaaaaggtgccaatcttcagcagaaatatgttgcagagaaggtgtttgacttgctcaaggaagcatggaataagttcaattcagaggagcttttctgagttcaaatcgttgattatatagctaaagaaattcgtcgtttgacaaactaggcattggagttgaatgaaaacacgactgtccagcagctataattcgcttagctgctgctgttgcctgctttggtttgatgaatcattaagtcagctngtaaagagtggcacatgatgc

SEQ ID NO: 7142 - DNA, 400 bp, Gossypium hirsutum
  Clone ID: uC-gsronu33B079c01b1
cccacgttcacgggcaatcaagagaacatgcgatcactatgagaccattagaagctggattctgagtgactacagcaacaagcgaatgcaaaaccaaggtgcaaacacaccacaactgcggtacgatgaaccaggagttgaaagaaagagccaaaacctgcgaaactgtaatagatagctgatcaacatgcaaagtagaacgacgcataggaagaagagctgatacaattgaagcggtaagcaaagctgaacggaggatgctatggtgatccagaagataagcttttgttcattgttagaatacgcggaatcaatgccatgcacccaaggaccagaaagatcttgccagtcctacggtagagacaagattccaaaggtggctcatttaaagcgaacaagg

SEQ ID NO: 7143 - DNA, 257 bp, Gossypium hirsutum
  Clone ID: uC-gsronu33B079c02b1
cccaatgtgacgggcaaacaaaaaagctagagatcaaaaggggaccttatgaagctggattatgagtgactacggcaagaggccgaagcaagagcggcaagctaacacaccactactcggttacgagaagccatgtagtaaaacaatgtggcgaaccgagcgaaacactattagctagcagatagacacggaacgctgactgaaatggaggaagagctgcacatacaatgtggctgacaatggcagctccagggata

SEQ ID NO: 7144 - DNA, 250 bp, Gossypium hirsutum
  Clone ID: uC-gsronu33B079c05b1
cgaaaggtattccgccccgcaaagaaaaacaaccgagcggaggagccttgaaagagagttttgcggggcccaaacccccaacccgagctccctcatgcgtaactaacgaaccccaccggcagggatgatcaaccacgcggcgagaactgacaaaaacgatatacaagcggaggtccggcgggctatgccatggaagaacaccatcaaccaaaaacatccacgaagaaaacgcgggagggcatgaacggag

SEQ ID NO: 7145 - DNA, 449 bp, Gossypium hirsutum
  Clone ID: uC-gsronu33B079d08b1
cccacgtgtccgcccacgcgtccgcccacgcgtccgatcattacctgtgaaattctgttctcatttttctttcaagaactaagcgaaaatggcagcagaggaaggccaagtctatggttgccacactattgaatcatggaacgaacagcttcaaaaaggcaacgaatccgaaaaattggtggtggttgatttcactgcttcatggtgtggaccctgccgtttcattgcacctttcctggctgaactagccaagaagttcccttctgttacctttcttaaggtggatgtggatgagttgaaggaagttgctaccgattgggcagtggaggctatgccgactttcatgttcctcaaggaggggaagattgtagacaaagtggtgggagcaaagaaagaagagcttcagcagactctgtaaagcatatggcttgccccagtactacttcagc

SEQ ID NO: 7146 - DNA, 459 bp, Gossypium hirsutum
  Clone ID: uC-gsronu33B079d11b1
cccacgtgtccgaaaaaaaattctgacaaaattttttctttaattttcagctttcttccttttacattcttcgtaattccaatctatcatcacataaacaaagaaaaaaaaaattctgggtttcttatcgaatctccaaatctttctctttcattgaagaaaaaaattgaaaaacatgtgtcctatgaggttcttgttggtgtttttctcggcgattttagctgggtatttcgcttggagaacggcggtgggttcatcggttgatgccgatgatggggtttctgaagtttcaaggacaattgttgccaaaaatgaacaagatttcagtttcaaaatgatggttaagaatggattctgggtattggttgatatggctagtggaaggtatttggggaggaatttaaggcattgaagaataatgagaaattaaagagctcttaacagtttttgattggattg

SEQ ID NO: 7147 - DNA, 256 bp, Gossypium hirsutum
  Clone ID: uC-gsronu33B079e01b1
aaaatgatgaagtgccaacaaagaagtcagggagcaaagtgatgccttatgagggatgattatcagtgacaacgacaagaagcgtaggcacgaacggtgagcaaaaacaccactactcggtgaagatgaaccctgtgttgattctcacagacaaaacgggcgaaacactatcagctaccagaaagggggcgaagccgtacatgatggaatgcataaatgcacgcactatatggctaactatgggagataccgggat

SEQ ID NO: 7148 - DNA, 501 bp, Gossypium hirsutum
  Clone ID: uC-gsronu33B079e02b1
gtcactctgaagttccgccattaaagctcttcattaacgtggtgccctttgctgattttttatcacaaacacagcccattagtgtaaactccatcaatattcaaaaaggaacttcaatggctgtaaagaaatcctgtttgattgctatattcgatgttgatggaacacttacagctacaagaaaggtggctacccctgaaatgctggagttcatgaaggaactgagaaagtgggttactgtgggagtagtaggcggatctgagcttgttaagagatctgagcaactagtgaaagcagtgattaatgactatgattatgtattttctgaaaatggacttgttgctgataaagatgggaaactcattggaacccagagtttgaagtcctgtctcggagaagataagctgaaggaatttataaacttcagattgcattatattgctgacatggatatcccgataaaaagggggacatccattgaattccgaagtgggatgctta

SEQ ID NO: 7149 - DNA, 570 bp, Gossypium hirsutum
  Clone ID: uC-gsronu33B079e05b1
gtcattttttatcctcaagctatattcaaggatccatttaggaaaggaatcaacatcttgttgatgtgcgatgcttacacaccagccggcgaacccattcctaccaacaagagatttaatgcggccaagatctttagccaccctgatgttgttgctgaggagccttggtatggtattgagcaagagtacactcttcttcaaaaggatactaagtggcctcttggatggcctgttggaggattccctggaccacagggtccgtactactgtggtgtaggtgctgacaagtcctttggtagggacatcgtggactcccactacaaggcttgcctttatgctggcgttaacatcagtggaatcaacggtgaagttatgcctggtcaatgggaattccaagttggtccatctgttggaatatctgcaggtgatcaaatatggattgcacgatacatactcgagcgaatcactgaaatcgcaggagttgttctttcttttgatcccaaacccattccgggtgactggaatggtgctggtgctcatactaattacagcacaaagtcaatgagaaat

SEQ ID NO: 7150 - DNA, 437 bp, Gossypium hirsutum
  Clone ID: uC-gsronu33B079e10b1
cccacgtgaacgcccacgcgtccggcggtgtacagataggggaatctttaaacaatacttttggggcatgggacaatgccaagaagtacatggaggccggtgtgtccgagcatgcaaggaccctaggtccaaagggacccgatcctcacaaggcagctgtcatcggtgacactgttggagaccctctcaaggatacctgcggtccatcacttaacattcttatcaagcttatggcaggcgagtcacttgtgtttgctcccttctttgccacacacgggggtctactcttcaagatcttttagggaatggatggctggaaacgcacggtggaaggctggttagcatcactgtttaaatagtgatggttccattcaggcattactgttagagtctcgcatgatgggatccatccacagtttggtatgaggtcgtttaat

SEQ ID NO: 7151 - DNA, 493 bp, Gossypium hirsutum
  Clone ID: uC-gsronu33B079f09b1
ggaatttgccaggatggcttttcctctattgtactaaagagaccgcttcttttgcgcttaacaaacttcattcattcattcaatcacctactctttctttttattttttttctctcaaagaagcaagcaaaaattttagggagcacaactccccccccccaagtttcgctgttcagtgacaatggcgattgtgaagatggtgatggctgtggttatcatggcagcgtccctcggagggaaattgggtgcagcacaagtgcaccatgtggtcggaggtgaccgtgggtgggacgtttcctctgacgtggcatcttggtcctccggtaggagcttcagggttggagacaaaatttggtttgcctacgccgcagcacaggagagcattgctgaggtgaatagcccggaagaatatgagtcgtgcgatgtgagcaaccccataagaatgtacacggacggcatagatggcatcccactggatggggagggggatcgt

SEQ ID NO: 7152 - DNA, 104 bp, Gossypium hirsutum
  Clone ID: uC-gsronu33B079g01b1
cacactctaaagaaccatcaatgaagcatttgatcaaagtggggccctttgaagagggattatcagaaccacacgcaatgagtgtaagctccaacaatatggaa

SEQ ID NO: 7153 - DNA, 485 bp, Gossypium hirsutum
  Clone ID: uC-gsronu33B079g02b1
cacttacttaggctggggagcccatggtggcggtgctttcggtggaatttacccaaccattgtggacaggagtggagcttacatcgttaggcaagctgccaagagcattgcagctaatgggcttgcacgcaggtgcctcgtgcaggtctcctatgctattggtgagcccgagcccttgtctgtcttcgtaaacagctacggaacaggaaagattcctgacaaggaaatcctacaaattgtgaaggagaactttgatttcaggcctggaatgatcaccatcgacctggacctcaagaggggtggcaatggccggttcttgaagacagctgcctatggacattttggaagggacgaccccgacttcacctgggaagttgtgaaacccctcaaatgggaaaagcctcaatcttgaagtccacccgtccgtactgccccgtgcttttctcatccgccgtgctgaataatcccgatgtttcgtagctcct

SEQ ID NO: 7154 - DNA, 247 bp, Gossypium hirsutum
  Clone ID: uC-gsronu33B079g03b1
cgcccaagtgccacagcatgatgatggaccttgccgctctggaggcgcttaaaaaacattttcgggtacacaaccccacaacaaagacaaggcgggcaccaaagccaatcgactcgccacatgctcacaaagccggaagcgggaaaaccctggcccaaccgaacaaagacgggcagaacaacaaggccttgtagccggcccccgcaacagcgaaaagccccgcaccgaacgaccataccaacaaccg

SEQ ID NO: 7155 - DNA, 529 bp, Gossypium hirsutum
  Clone ID: uC-gsronu33B079g05b1
taaggattttatctccaaaccttcttcccatttcttcattacattgttcaagaaaaaagaagcaaaaaaacatggccaaagttctgttgttcattgcactatgtgtgcttccagctttggttagtgctacacgcattctgaataatcaattggtggtagaaggctatgtgtactgtgatacttgccgtgctggttttgaaacccctaagactagaagcctagctgatgccatggttaggttggtatgctccgacaggaagagcggccaagttgtcttcaaaaaggagggatacaccgacaaaaccggaaaataccagattcgtgtatccgaggatcacttggatcagatctgtgatgcagttcttgtgaagagctcccagcttggttgtgccacaatgtcccccggtcgtgaacgtgcccgtgttatcttgaccaacttcaatggcatttcatccaccacccgttatgccaatgccatgggcttcatggttgacgagcctgaagcaggctgtgctgagatgatgagatg

SEQ ID NO: 7156 - DNA, 397 bp, Gossypium hirsutum
  Clone ID: uC-gsronu33B079g08b1
aattattttaggcagaaaaggaatcacagatcagaatcgggactcggttaataacatatttgagctcagagctagaaattcaggccactcaaagaacacaggtggtgcgctttgggacattttcagaagggaggatgttcctaaactggaagcttatcttagaaagcattctaaagaattcaggcatatctattgctccccagttgaaaaggtaatccatccaattcatgaccaatcgttttacctcaccatggagcacaaaaggaaattgaaggaggaatttggagttgagccatggacgttcgaacaaaaccttggagaggcagtttttattcctgccggatgtccgcaccaagttaggaatctgaagtcatgcaccaaagttgcttgggacttt

SEQ ID NO: 7157 - DNA, 301 bp, Gossypium hirsutum
  Clone ID: uC-gsronu33B079g11b1
gcgcccatgtgatcgcccacccgtccgcaaaaataacaggcccgtgcaatgttaaaaaggaatggatggatgccggccagggctataatgatgactgtgcctggggcgcgtgcaacagaagctctggctgcggacgaatatgtgaatcaaccatttggatgagagcaaagggacctgtgctccaaaggatgctggctgctcacacatggcgactagacccatagatttatcctgggctgataagatctgatccaacaatatatccgtcgctgctgacttgaaaaaagagggcaacaccgac

SEQ ID NO: 7158 - DNA, 310 bp, Gossypium hirsutum
  Clone ID: uC-gsronu33B079h03b1
cccacgctgtcgaatcctaactataacggttccaccacttggaatactctggagagagagtgtagcggcggcattccccgttatctgggtccacggtggggccttgctctattcttggccgttggatttgggtctttatttttgtagattctttattacgtgctctgttgattatgaataatttataggcatacttttttttttatttttttataaattttagcggttggtattttctatgtgagatttattaccatgccgcgccatgtacatattcatttgtgttatacatatacctactgatttgttg

SEQ ID NO: 7159 - DNA, 458 bp, Gossypium hirsutum
  Clone ID: uC-gsronu33B079h04b1
gtttcaatctggggtcgtatcttagccggtacttgccacagggccaatatggacaggacattcattgttcgacggaactaccttcattatatcaagaaataccaaaggtatgagaagcgccattcaaacatccccgcacatatttcaccatgcttccgtgtgaaggaaggggatcatgtcattattgggcaatgcaggccgttgtcgaagaccgtgaggttcaatgttttgaaagtgattccagcaggatcttccggtggtgggaagaaagctttcaccggaatgtaagcttttctatggtagtccatggttataggaaccaatagagaagataatcaaagaaattaagttcttaaactgcatttagctttgaggatattttactgttagaattgttttcttttttttgggtaattttcttgttttgattttggtcgaattaccgaatatccggaatt

SEQ ID NO: 7160 - DNA, 202 bp, Gossypium hirsutum
  Clone ID: uC-gsronu33B079h07b1
gcgctttattatctaggattagaggaccatcgggctatgggggacgatcatcttattatgggcattctcggtctcgttcaccatcccctatgcgttctcctcaccatccttcgagttctagaggccgctaccgctcaaggtcatactcacctgctccaagacgacgaggaaactattctgtttcaccaggtagaaagcatga

SEQ ID NO: 7161 - DNA, 136 bp, Gossypium hirsutum
  Clone ID: uC-gsronu33B079h09b1
tcgatttgtatcttatagtcgtgtgatttctcaccaataaggatatattagtattgtttccaccaaaaaaaaaaaaaaaaaaaaaaaaaaaaaaaaaaaaaaaaaaaaaaaaaaaaaaaaaaagaaaaatgggaaa

SEQ ID NO: 7162 - DNA, 455 bp, Gossypium hirsutum
  Clone ID: uC-gsronu33B080a01b1
cacattccgaaacacagaatcgacataagcatagggggggatttcaagagcagttttgcgggcaaagattagcaccaattcaggagcaacaatcgagcaactcggtttctcatttgccaatccatcaacaataccagcacaagcaccagcaccagcaggcatctggtcccgtcgtagttaccacgaaatgggaaacattcgattcatccccggcaacattgccggtcacctcgacatctacatcttcatcaaccgctaataactcagccccaccgaagttcccttgggaattcttcgattaaagacagtatgctactatgtcctctttggttttcatttcattttttatctgtgtgaatgtgatttggggttgcttcttcttcttgtacttagattttctcaagctacccttttcttttcttttttttccattttattaaagcttgcattaagtt

SEQ ID NO: 7163 - DNA, 113 bp, Gossypium hirsutum
  Clone ID: uC-gsronu33B080a03b1
ccgcccacgcgaccgcccaccccggggggggaatttataaaaaaccgcggtgggtaaacacccaagcccaagaaaaaaggaacgaggggaagaatcgacaaggaatccataac

SEQ ID NO: 7164 - DNA, 460 bp, Gossypium hirsutum
  unsure (1)..(460): unsure at all n locations
  Clone ID: uC-gsronu33B080a05b1
cccactttttcgcccacgcgtccgcccacccntccgcgcgggcgttctacagaccctgtggggctgctgaggcaattgaaaagattctcacccacaacagcaagggaatcaaattccaaattctttcgaacccagaatttcttgctgagggaactgcaattcaagatctttttaatcctgatcgtgttcttatcggaggccgggaaaccccagaaggcaataaggctgtccaagcattgaaggaggtttatgctcattgggttcctgaggagagaattcttaccaccaatctttggtctgcagagctttccaagcttgctgccaatgctttcttggctcagaggatctcatccgtgaatgccatgtctgctctttgtgaggcaaccggngctgatgttacgcaggtctcttatgctgttggtaaggacacaaggattggacccaaattttgaatgctagt

SEQ ID NO: 7165 - DNA, 470 bp, Gossypium hirsutum
  unsure (1)..(470): unsure at all n locations
  Clone ID: uC-gsronu33B080a08b1
gctgtccctanccgttatcagatagcaggaaactttggtggagtatctgatgtgactgtgcgtgtcggatatgacaaagcaggtttgccgattggccttcaatttatggggaaaccttggtcggagcctacattaatgcatgtagcatatgcaatgcaggccttgtgcatctcggagtatagaaagccgaaggttttctatgatctacttcataagaactgagcagcgcagggtgggaacctccaggaaccgtgggaaggtaacctgacatcggaactatttggtagtttcttctcaatgatgaaatgaccggcaactgacttcccctggtatatgttagcaataaacgaagtattgctgaattatgtggattaggaactgccatcgttgagaaatgggacatatctcaaaaatgaaaaatcattagtagagaaggtgaaaactgtgcatcacatcggtaaacggactta

SEQ ID NO: 7166 - DNA, 518 bp, Gossypium hirsutum
  Clone ID: uC-gsronu33B080a11b1
ctttctcttccgaaattgagcaaagaagatgggggcggtgatacaaaagacttgttgcagcttctgttggacctcaagcagaagaacgatagcggaatatcgataacaatgaatcaagtcaaggccttgctcatggacattgtggtcggtggaactgatacaacatcaaccatgatggaatggacaatggctgaactaattgcaaatcctgaagcaatgaaaaaggtgaagcaagaaatagacgatgttgtcggttcggatggcgccgtcgatgagactcacttgcctaagttgcgctatctagatgctgcagtaaaggagaccttccgattgcacccaccgatgccactccttgtaccccgttgcccgggcgactcaagcaacgttggtggctatagcgtaccaaagggcaccagggtcttcttaaacatttggtgtattcagagggatccacagctttgggaaaatcctttagaattcaagcctgagaggttcttgactgatcatgagaagctcga

SEQ ID NO: 7167 - DNA, 111 bp, Gossypium hirsutum
  unsure (1)..(111): unsure at all n locations
  Clone ID: uC-gsronu33B080b06b1
gcggangttgtccaacgaaggactatcaccgcatgaagtttttataaaatttttcgttctcaaacccnccnnggatgactaccctaatggattccaaatcccagtccatta

SEQ ID NO: 7168 - DNA, 66 bp, Gossypium hirsutum
  Clone ID: uC-gsronu33B080b08b1
gataaaattgtcaatatgacttaaccaagctcaattgaggggtgattataatcattctttgtatac

SEQ ID NO: 7169 - DNA, 428 bp, Gossypium hirsutum
  unsure (1)..(428): unsure at all n locations
  Clone ID: uC-gsronu33B080b11b1
gngttgtgtccaagatgatgaaactcgcaggccatcgatgggttaggtagttcagatcctagagggcgttttggatgtgaacctgcctccaattccgaggtttctacaagtgcttggggacaattcggagcatgtagtcttcttcacagagtcatcttcaaaccagagttcacagacaccgagctacacctcaactgcgtcttctcaggcgaagagtaacacatcatcaatgagttcatgaatcttgaaaaacattttccggaaataagttacggtagtttggtttcagcatgtgtaaatatgttgtaatttcagagctgtttttacattattttcctaatacgcaagccattcctattgagaaaaaagagctgatggttccctaactctttagaaccattgcagctttctcagggtttccataaatg

SEQ ID NO: 7170 - DNA, 495 bp, Gossypium hirsutum
  Clone ID: uC-gsronu33B080c02b1
gtagtgatgaggaaaatcatgggtgccaaagttcggttcttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggaagttgtttcttgtgctgatatccttgttctgtctgctagggaaggcatccgttcgttgggaggcccttatattcctctcaaaactggaagaagagactgtagaaggagcagagcacatgt

SEQ ID NO: 7171 - DNA, 550 bp, Gossypium hirsutum
  unsure (1)..(550): unsure at all n locations
  Clone ID: uC-gsronu33B080c06b1
cgatnacttgtgagctgagagggatatcctcactaaagggggtcattttttaattgttcagcttagatactctttccagacaaagtctaagctttatttaatcctggactttataaatggaggccatctcttctttcacctatatcgccaagggatattcagtgaggatcaagcaaggttttatactgctgagattgtatctgctgtttcacatcttcactactgcggcatcgtgcatcgtgatcttaaacctgaaaatattcttgtggatgctgatggacatgttatgcttacggatttcggactggccaaggaaattgatgaatcgagccgatcgaattcaatgtgcgggacaacagagtacatggctccagaaattttacagtccaaaggtcacaataaagatgcagattggtggagtgttgggatactgttatatgaaatgttaactggtcagcctccatatacacatgcaaataggcagaagcttcagcanagaattatcccagagaaactcanacttccaccatttcttactacagaagctcac

SEQ ID NO: 7172 - DNA, 381 bp, Gossypium hirsutum
  unsure (1)..(381): unsure at all n locations
  Clone ID: uC-gsronu33B080c09b1
ggcgtgaatcaatggcgtcctcggatcttattggcaggggggagactagatgactagatcgggctttcacccccaaagcnccaccatatgnggggccacaggcgggaaagagcaggaaacaatagaggctactaaggagccaggtgctacatacatggcggccaaatttgatgggatattaggacttgggtctaaggagatttcagttggggatgctgtcccagtgtggtacaacatggtcaaacaaggtcttatcaaagaccaggaattttcatttnnggcctaaacgcaatgtaagagaagaaacggggggcgaaataggggtcggcgggggtgatccaaaccactacaagggcaagcacacaaaccgtcctataacac

SEQ ID NO: 7173 - DNA, 392 bp, Gossypium hirsutum
  unsure (1)..(392): unsure at all n locations
  Clone ID: uC-gsronu33B080c12b1
tcctcgcgtccgatttaactatcaaataccacaggcagagtgttatttaanaaattttgtggttttacaccccccaaacggagacgngggtaactgatcattaaggggagcaatttagggaacttgtgacaggacaaatactgaaccgggtgcgggtgaaaggaggaaattaactgggatttggaactgtacctggataatattaggcatctcaagaaattcatatcaacagaagagaagtcaccttcttgaagaaatgcttttcgggaaagtaacagatggaattgaacagtctatgcaaagtactgaatattcctgggctccaagaagaaattttcgaccgtatggagaaaccatggaaaagcactcattcccttgacaagccaaggaaa

SEQ ID NO: 7174 - DNA, 479 bp, Gossypium hirsutum
  Clone ID: uC-gsronu33B080d01b1
ccatgtttccgaaaaaattgtgtttagatcagagatggggttccaaactcctttggtgctcccagacatcgatttcagtaagccagacctaaaaccaggcagcaatgagtgggatttggtgaaagggcaagtccagcaagctcttcaagagtacggttgcttcgaggctttgttcgacaagatccctctacaccttcgagaggcaatattcagatccttgcaagagcttttcgatctccctttacaagccaaaattcggaatgtttccaataagccttatcatggttacgtcggccaataccctcaagtcccattatatgaaagcatgggcgttgatgatgcaaacattactgaaaaaggtgaagccctgactactaccttatgggcctaaggggaattcaagtttcagcaacactatacaatctttctcagaacaaatgccggaagtagatcatattgtaggaagaatgatttggaga

SEQ ID NO: 7175 - DNA, 520 bp, Gossypium hirsutum
  Clone ID: uC-gsronu33B080d03b1
tcctcgtttccgcccacgcgtccggcaaaacaataaaaaatgccgatttctcgcattgcagtaggatctgcagctgaggctggccaagctgatgccctcaaagcagctttagctgagtttatttcaatgctcatttttgtttttgctggtgaaggctcgggcatggcttttaacaagctcactgacaatggctctacaacaccggctggtcttgtagctgcatcggtggcccatgctttcgctctgtttgtggccgtttctgtcggtgctaacatctcgggtgggcacgtaaaccctgccgtcaccttcggtgcctttgttggtggccacattaccttggtccgaagtattttgtattggattgctcagttgctgggatccgttgtcgcttgcttgctcctcaagttttcaactggtggattgacaacatctgcatttgccttgtcatccggtgtgggagcatggaacgcagtggttttcgagatcgtgatgaccttcggtttggtttacacggtttacg

SEQ ID NO: 7176 - DNA, 487 bp, Gossypium hirsutum
  Clone ID: uC-gsronu33B080d09b1
caaaggttgaatctttgggtggccactaggtgtttggtaatagaactcagagagtttggatatttggtcaaggtagtttgaaggttggttatttgaatttcgggggtaacacccaaggttacacattgtggacatcacggctatatacaaagtttctcggtctctttttcatgtccgagctggacgacgtaagggttgtgtgatcgagagcaacccttcgccgcacggcgggcgtggagctttgccttccgaaggcggcaatccttccgatctcctcttccttgctggtggtgggattgtcttttagagtttgggtaccctatttttagctagcttattagtctgtaaaatattactatcgaagaagcttgtttttcgttgtttttttggggttttctttatttgatctcttattggattaataaagaagagaagtagttgcatagatgattcagctcagtattaagagggttcctactgttgtttc

SEQ ID NO: 7177 - DNA, 190 bp, Gossypium hirsutum
  Clone ID: uC-gsronu33B080d11b1
tttttgttttctcattccataaaatattcctagcaactttggttggaagtctgtagaatcaggaagagcttattaagagttggtgtggaagagagcatagtggaataaaataataaaattgaaatgaaaataaaaatcaaaagaaaaagaaaaataaaaaataaaaaataaaaataaaaataaaataagg

SEQ ID NO: 7178 - DNA, 560 bp, Gossypium hirsutum
  unsure (1)..(560): unsure at all n locations
  Clone ID: uC-gsronu33B080e03b1
gtaatgactcatggctcctttgaacatgcaggtggggtggcattttattatcggtccatgcagactatgcacaaacgagtacattcttgaaagagctcatgcctcccaacataattcttgttcacggagaagcaaacgagatgggaaggcttaaacagaagcttatcactgagttcactgatggcaacaccaaaatcattacccctaagaattgtcagtctgttgagatgtattttagctccgagaaaatggctaaaacaatcggaaggttggctgaaaagaccccagacgtaggtgaaactgttagtggtgttctggtaaagaaaggtttcacatatcagataatggctcccgatgatctccacatcttctcacagctttcaaccgcaaacatcactcagaggatcactatcccattcactggcgcctttggtgtgataaagcatcgactcgagcagatatacgagagtgtggaatcttcaacagatgaagagtctggngttccaacattgcgagtgcatgatagtgtgactgtgaagcaggattcagataggcacatc

SEQ ID NO: 7179 - DNA, 415 bp, Gossypium hirsutum
  unsure (1)..(415): unsure at all n locations
  Clone ID: uC-gsronu33B080e04b1
tccatgcgtacggggattgaaataagaaataactgagggaacaatttataaagtacttgtagttcctacgaaaaaaaaaaaaaaaaaaaaaaaaaaaaaaaaaataaaaaaaaaaaaaaaaaaanannaaagggggggccgttttaggggtccaaactttagcaacccatgcatgcaaagaaaaaatattaaaatgggggcccaaaaataaaattaaggggccggcgtttaaaaactggaaaaagggaaaaacctgggggtaaccaaattaaatggctttgaaaaaaatcccattttacccagttgggaaaaaaccaaaagggccccaacagatcgcctttcaaaaaagttgcaacacccaaaagggaaaagggaaccccccttgaacaggccaaaaaagccggggggggggggg

SEQ ID NO: 7180 - DNA, 547 bp, Gossypium hirsutum
  Clone ID: uC-gsronu33B080e07b1
tatctattgcctccgagccatagaagttacggtgaaaggagtggtttggagacagatgggagacaattttcagatttttataggaactcaagtgaggagctttttataaagtcgttgatggagagtccaatggggatgccagttccaaatatggagatgttggggtttaagaatctctcccagaattttcgtgctgatagtgaggagcttttcagaagctggctcaccaatggagagaaccagggtcacaattcttctaatatagcacatcgtactcggcaagcgtcgcgaagattatcaacagagatggccagtttgtcgagtcaacagcctaccactttgcttcaaaagaaaaagagcagtgatgtattacatctgcaaaacaattccgttgggggagaaacatcaggggatttgaatcaaaattcagccagaactgctggtgacaggggatttcaggctagtaatttatatttggccaaggcatggtttcatagttcacagcccatgacaagaagcagatcttctgatttaagaagagatatgc

SEQ ID NO: 7181 - DNA, 140 bp, Gossypium hirsutum
  Clone ID: uC-gsronu33B080f02b1
ccatgcgtccgcggacgcgtgggtttttctgagagagagaaaataataatttcattaaataaacaaatcaagaaacaaaaaaaaaaaaaaaaaaaaaaaaaaaaaaaaaaaaaaaaaaagtttgcaagaagaaaaacaac

SEQ ID NO: 7182 - DNA, 560 bp, Gossypium hirsutum
  unsure (1)..(560): unsure at all n locations
  Clone ID: uC-gsronu33B080f04b1
tttacttgtccgcccacgcgtccgcccacgcgtccgggtgcttcctacactgttgcatccgctgctcttcttcttaccttgaacttgttgttcttcactttggttagctctacctacgtgccttgcccaccaccaccaaagagccacaagcctacccacaagagcccaccctcggcacctaaacagccagccacttgccccaaagatacactgaaactaggtgtttgtgctgatttgttgggctcggtgcgcgttgttgttggaccgtcgaggaccaaatgctgctcactcatttcgggtttggctgatctcgatgctgctgtttgcctttgcactgctattaaagctaatgtgttgggggttaacctaaacgttcctgtttcattgtctttgctcctcaattcctgcgaaaagcaaatgcctgctggttacaaatgtgcttaagcaatgtttgggtttttcttttacgtgttctttttttttctgggccgtgtaaatttggtgttttgatatgtcaagggttagataaaatggntaaggtctcttaccttaaccaatac

SEQ ID NO: 7183 - DNA, 538 bp, Gossypium hirsutum
  Clone ID: uC-gsronu33B080f08b1
cctctcttcgtcatcttcaataatttcttccgttgagcggggtttgagattagctttttaatttttcattatgggaaagatcaagatcggaatcaatggatttggaaggatcgggcgtttggttgcgagagttgctctccaaagcgatgatattgagctcgttgctgttaacgatcctttcatcaccactgaatacatgacctacatgtttaagtacgacagtgttcacggtcaatggaagcatcatgagcttaaggtgaaggactcaaagacccttctctttggtgaaaagcctgtcacagttttcggtatcagaaaccctgaggaaatcccatgggctgaggctggagctgagtatgttgttgagtctactggtgtttttactgacaaggacaaggcttgtgctcacttgaagggtggcgcgaagaaagttatcatttctgctcccagtaaggatgctcccatgtttgttgtgggtggcaatgagaggaatataagcctgaccttacattgcttccatgctagttcaccaccaact

SEQ ID NO: 7184 - DNA, 571 bp, Gossypium hirsutum
  unsure (1)..(571): unsure at all n locations
  Clone ID: uC-gsronu33B080f12b1
tagagattattgttttgttttgttttggttttaggaatgggggactccattttgagaacattagattatgaaagcaaaggatttgtagcagtggggctgctttgtttgatgatgatgatgattcaaaagggttatgcaagagaattccaagtgaattggggtcttcatagtggctccaatgctcaaacttacaatcaatgggctgaacacaacagatttcagattggtgactcacttgtgtttaactacgcaccaaaagaagattcagtgctatatgtgagtgaggatgcctacaagaactgcaatgtagagtcaccctggtccaaatacaccgatggccacgctgttttcttattggatcattcagggccataccatttcatcagtggtaccaaaggcaattgccaaaagaacgagaagttagtggtcgtcgtcttagctgatcggaccaaccgttcttccaccgcaaacgtaaccaacgctccttctccgcgccatcttgttcggtcgatgtaatggtgccgtctncagcacccgtaaacgaaaccaatgctttcttctctcaccaacc

SEQ ID NO: 7185 - DNA, 503 bp, Gossypium hirsutum
  Clone ID: uC-gsronu33B080g06b1
ttattttactatgtgtgcttccagctttggttagtgctgcacgcattctgaataaccaattggtggttgaaggctatgtgtactgtgatacttgccgtgctggttttgaaacccctaagactagaaggctagctgatgccatggttaagctggtatgctccgacaggaagaccggcggagttgttttcaagaaggagggatataccgacaaaaccggaaaataccagattcgtgtatccgaggatcacttggatcagatctgtgatgcagttcttgtgaagagcccccagcttggatgtgccacaatgtcccccggtcgtgaacgtgcccgtgttatcttgaccaactccaatggcatttcatccaccacccgttatgccaatagcatgggcttcatggttgacaaggctgaagttggctgtgctgagatgatgaagatgtatcgggaggatgaggaggatgtctagtgtgtgggtttggattatttgcatatgaaatgtgat

SEQ ID NO: 7186 - DNA, 371 bp, Gossypium hirsutum
  Clone ID: uC-gsronu33B080g07b1
agttgaatatcattgctggaggggtctcagaaaaaagaatgtgttgagggtgcaattgcggatctagctgcaactacgccaccaggtgaccatgcgatctgcgccatgacatacggtccatggcgaagacaaccagcactcagaccatgatgaaggagaggcgcccgcgaagatgaccttcgagggaccagagatgagcactactgcatcaggacatggatgcaagtgtggatcaaactgctcttgcgatccatgcaactgttgaaaagcttgatgaaagccctagatgatgaaaaaagaaagcagcaaaataacaggcctctgtaatgatttatttgcaaggatgaatgcctgcaaagtctatgactata

SEQ ID NO: 7187 - DNA, 490 bp, Gossypium hirsutum
  unsure (1)..(490): unsure at all n locations
  Clone ID: uC-gsronu33B080g10b1
gcggccaatttttctatgtgtaggaaatgtgggaagccatttggggtcaaaggggattggagaacccgcgagaagaactgtggcaagctatggtattgcacttgtggctctgattttaaacacaaaagatccttgaaagatcacattaggtccttcggcaacggccattctcctcatccttctcttgaaggatttgaagaccttgacaaggattgcattactggctccgaagatgaactcactcactagcatgttcaattcccaactaccctttcttcaacctttaaaccttatataatttccggtctgttgaatcactggtagagtatcaaaggacttgcatttaagtcttcaattaacaccaacaccagatcactagttaaacctaaagccgatgtcaaccgaagacttaaacacaaatccttcatcattttacccgtaattcaatagacatttaatntccgtgttttaaattagctatagctttaaa

SEQ ID NO: 7188 - DNA, 367 bp, Gossypium hirsutum
  unsure (1)..(367): unsure at all n locations
  Clone ID: uC-gsronu33B080h03b1
tgggtggtgggcggggggtaggtaggtactggtgacgggtttatatacangtttggctgcaaaaaaaaaaaaacacacacgatgtctcgcgtgtacgtggtcaacctatacccaccagtatcagagcggcatcttgaagatgagtaacgtgtctctgcagttattcggagtgtatgggttgctcggaggcctcctggttatgctttcattgactctgatgatcacagagatgctgaggatgccattcgtgaattagatggcaagaatggctggagagttgagctttctcataactctagaggcataggtggacgtcgaggcggaggtagtggtagttgccgtagccgtcgtaaacactcttgtggtt

SEQ ID NO: 7189 - DNA, 537 bp, Gossypium hirsutum
  Clone ID: uC-gsronu33B080h06b1
gtgatagacaaggttcaggcttatatgggacgcgtggaagaagctactcgccgcttgtctgacattcgagaagagcttgatgccctgatagatccaatgagaaaggacattgcatttctgcgtaagaagatagacaccgttaaccgggagctgaaaccattgggacagagctgccagaagaaggaaagagagtacaaagaagctcttgaagccttcaatgacaagaacaaggagaaaacacaactagtcagcaaattaatggagctggtgagtcaaagcgagagattaaggatgaagaagctggaggagctgagcaaaagtattgaaacacttagctaaaaatggtgctgactaaaacaacatacatgatgtgctttgcgtgttgtaatttgattgattgtgtcatatattttattgttttactggccatgtttttcagctggtttttcaattaggaaagtagccactgagcaggtgtcaccaaacatgtaacttttatttgctcctcgtgttctatctaactcaccataataattt

SEQ ID NO: 7190 - DNA, 348 bp, Gossypium hirsutum
  Clone ID: uC-gsronu33B080h09b1
cccactttactgctgatgtggaatcaactttccctccgtgcggtcatgctctattctggggggccaaactcaacatacattcacgagcctccatatttcaaaaacatgaccgtagaaccaccacgcccgcatggagtgaaagatgcctattgcttgctaaaattcgactcagtagtaccaccagagcacatctatgctgcatgagcatgctaaagcataggcctgctgctcagttgcttcttgagcgtggggtggacaagaaggacttcaattcctatggtagtcgtcgaggcaatgatgaagtgatggcaaggggcacctttgccaatatccgcattgtcaacaagc

SEQ ID NO: 7191 - DNA, 520 bp, Gossypium hirsutum
  unsure (1)..(520): unsure at all n locations
  Clone ID: uC-gsronu33B080h12b1
attgtgtgttattctaatcgccgatctcttcaatctggggtggttcttgcccttttttctagttgtatcttcagacgatcttcaatctcttcggacattttaggcaatgaagcccggagtttcttcattgaacccatatgcagcatcatacatacctcttgccaaaagggaggccagtgataatgtgacagccaaagatattaaacacagcaatgagaatgcttggttcaaaccttcctcacactttgcatataacccacacagtagcaatgcttctcttggctcttcagcctatggtactgaaaagcaccaggttgcagaaggttctgcagtgaaaagccatcctgctcatggttctttgatgcacaatcctggtgaaatgactgacaagcagattgtggatgaagaatttgacatggattnggagtatcttcgcatgtcatttcctggtctgtccaatgagtctcttttggatgtctacttggcaaatgatggagactttgaagccactggtgatatg

SEQ ID NO: 7192 - DNA, 506 bp, Gossypium hirsutum
  Clone ID: uC-gsronu33B081f05b1
ctggtgcgcctccaggtaccgccccggcataactggctggacccacccctccgcccatctttcatccgatcctttgcataagactgcaaagggtatttctcttctctcataggccttccccttctatattgctctcttgctaaccaaaacccctctattgcctttcccttaccaacgcttttccttttcgctctccttttggtcctctcccaaaaggaaaagaaaagaattccatcttttctttttctctccttctttattcccttattctttcctggctagctataatcgtagcctggaagctgtgggttaatctcagttcgatccaaggaaatgggggctccagggaagcccaaagcggatgagggtctagattcacaaggccccaaaatgggttttagctgtgatttctatacgagctccattgaagcctaatacacatgtggtccatttcatacaataatgatgaacaaggctgccactcatgttccaccactccaaccggt

SEQ ID NO: 7193 - DNA, 55 bp, Gossypium hirsutum
  unsure (1)..(55): unsure at all n locations
  Clone ID: uC-gsronu33B086c01b1
gnnatagagaggaaaaaaaaagcttcaatctttggatgttaagtttgaaaaacac

SEQ ID NO: 7194 - DNA, 55 bp, Gossypium hirsutum
  Clone ID: uC-gsronu33B086e04b1
tagtaatagattagtttacacctttcttaaaaagctcggtttttttaataaactt

SEQ ID NO: 7195 - DNA, 199 bp, Gossypium hirsutum
  Clone ID: uC-gsronu33B086f10b1
tgtttcgcgtccgaggacgcgtgagcaagtaaggagattttataaatatatttgatttgatataacaaaaagaatattaattaataaaaatattcatataaaatttataaaaaaatttattaatattaaaattaattataatataataattttattaaaatattatttaatataattattttataaatattataattat

SEQ ID NO: 7196 - DNA, 101 bp, Gossypium hirsutum
  Clone ID: uC-gsronu33B086h04b1
gtctaactctcggatatatcaacgacgaatatttggtagatttatattacaaggatccactgtcacaaaattccatttccacacccacaaaatctctctct

SEQ ID NO: 7197 - DNA, 375 bp, Gossypium hirsutum
  Clone ID: uC-gsronu33B087a01b1
cttttgatttctgaattcgatcacaaggcatctcgagaggggaggatcaattctcgagcctgagctggtaaatgtctagttcaggatacggataactgaatgacaaacgggcatgagttttcaaaactatattttgcttctttaagacacagggtataacagttgttaatttatctgcgactacatttttacagacattatattggctacatggatatatttcttcagagccgggatgacagaatgaaatattatggaccctgaaagcaactccatggattaagcaaactgcttaaacatttttatctccctatgtaaaagttatgctcaagccaaattattgcaaaatccttggacctaaaatccccggaaatg

SEQ ID NO: 7198 - DNA, 284 bp, Gossypium hirsutum
  Clone ID: uC-gsronu33B087a11b1
catgactggagctgcgactaacgttatttttggccttgcgttgggttacaagtcttgcattattcctatttttgctattgcaatcagtattgggtgcttgacagacggcggcatatctatgggtggtctctagcgttacctggttttgtttaatttactactgtatcttgtcattgtcaagaggtgcccccttggttttccaaggcggcttgaaacttttgcttatgattttcgctgaagttgcggaattatttattatgaaaaaaaaaaaaaaacaaacaaaa

SEQ ID NO: 7199 - DNA, 86 bp, Gossypium hirsutum
  Clone ID: uC-gsronu33B087b01b1
gatttattttttcggtgtattaagtcgaatcccggggaaccgtgatatccaaatgcgcatttatccccccttaaatgctgttgtga

SEQ ID NO: 7200 - DNA, 446 bp, Gossypium hirsutum
  Clone ID: uC-gsronu33B087b08b1
atttgaagtcttatgtgttatgaaaattttcatgtttgagactcatgtctccggttgttagtgaaatcctccgttctgggtttatgataaattcttcacttagacgaaggactcatcttgttcaatctttctctgttgtttttctttactggttttatgttttctcataaataaattgtcctattttaccatatatacatatatatataataagtagttatttagcttacaatttagtctctctttttttccttttaatggcttcttctagtggaaactccatgtccaattcagtatccgaagaggatttgcacaatcaaaggaaacggaaaaggatggaatccaaccgagaatcagcgaggcggtctaggatgaggaaacaaaagccttggacgagttaatggcacaagtgactcaattggttaaagataataatcaaatcttaa

SEQ ID NO: 7201 - DNA, 329 bp, Gossypium hirsutum
  Clone ID: uC-gsronu33B087b09b1
aaatcattgattttcttcacctggtttctctattgttctcttatgttttttgggatttaaactgtttggttttgttgtttggtttctaatcggattgaaatgaacttttatagggtttgttccttttttgggatactctatcagtagcacctgtgattgttgtgttttggaaaacaggtcccttttgaacttattaaagatatcaaagacttttgcttatgaaatgctgtttacctttttatttttattatttcttccttactatcttacttttaccatacttttctttctctctttctctctctctatctctttacatcatttttttt

SEQ ID NO: 7202 - DNA, 460 bp, Gossypium hirsutum
  Clone ID: uC-gsronu33B087b10b1
gctgaaaggaagggaaaggaatcaaagatggggggaggaatggaggcaaacaagaacaggttcattgaagattggagcagtgcgagagagaatctggagcataactttcgctggactcgccgcaacttagctctcgtcggcatattcggcatcgctatccccgtccttgtctacaagggcattgttcgagaatttcatatgcaggatgaagataatggtaggccatacaggaagttcttgtgagtttttctccgcaaagctggataataaatgttgacgagttcaactgggttttatcttggacaacaatttctgttatttactttggttttggaaaattgtcatgttattatttgctcgggttagaaacaaatttctgtgctctgcttcttttaagtttctggtgtagcttttgaatatttgggttcctcatttatatactttttatctttctctcctc

SEQ ID NO: 7203 - DNA, 61 bp, Gossypium hirsutum
  Clone ID: uC-gsronu33B087c01b1
acatagttaaagtagaaacccactgcccgtacgcggtccggaattaccctggtttgtccca

SEQ ID NO: 7204 - DNA, 186 bp, Gossypium hirsutum
  Clone ID: uC-gsronu33B087c08b1
gtctcgtttggtgacttggtcgttgtcgtcgtcttttcttcttcaatagagtcagaatgtcttacgcttacctcttcaagcacataatcatcggtgatactggagtggggaaaccatgcctcctcctacagtgcaccgacaaacggcttcagccggtttcatgtttctaccacctgtgttgaatct

SEQ ID NO: 7205 - DNA, 307 bp, Gossypium hirsutum
  Clone ID: uC-gsronu33B087c10b1
ttcgtttcgctgaaacacctcgaaaaacacagggaaggatcttttctctgccagggccggtctattatgcaaccattagaccaccatcagcttggtggcttgcgaccccaatgtcaaccaactttctccggacatagcctcgtccacgaagatccggtaacccagtcctatgaagtggttcctacccctttggagaaacaagcccagagcttatactgttcttaaaaaacgaaacaaacttaaaagatttgattaagattttaacgccgttcgacccctacccaaatacatgcgtgactagacgctt

SEQ ID NO: 7206 - DNA, 439 bp, Gossypium hirsutum
  Clone ID: uC-gsronu33B087c11b1
gcccaccaaaataatgaccacttcgttgcttctatctcttttattcagctttgtagtacttgcctcagctgccaactttaaccaagacatcgatgttacttggggtgatggcaggggcaagattctcgaaaacggaaaccttctcactctcaccctcgacaaattctccggctctggttttcaatccaagaaccaatatctgtttgggaagatcgatatgaacattaaactggtcccaggcaactctgctggcactgttaccacttactatcttcgttcggaagggtcgacatgggatgaaatcgacttcgagttcttggggaacctaagcggagacccatacatagtccacaccaatgtatatacacatggcaaaggtgacaaagagcaacaggtctacctttgggttcgatcccaccaaagactttcacacctactc

SEQ ID NO: 7207 - DNA, 321 bp, Gossypium hirsutum
  Clone ID: uC-gsronu33B087d10b1
ttctacgccaggggttactcggggtattggttcgaatgatggtgctggtcttggggcatctttattccctggacttaatccacttggtggtggtggcggcagcggtggttttggtttgtttggatccggactccctgtatttgaacaagtacagcaccttctaactcaaaatcccaacatgatgagggtaataatgaattcaccagcttttcaaagtctgatgaataacccggagttgatgcgtagtttgtttatgagccattcttaatacgcgcgagattattgattggtatcctgagcttgtacattttacttaatgtt

SEQ ID NO: 7208 - DNA, 342 bp, Gossypium hirsutum
  Clone ID: uC-gsronu33B087d12b1
gtttaagtcaaatttcccagaaaataaaaaactttccagcaaaatgtcaggaagaggaaaaggaggtaaaggtctcggaaaaggaggagccaagaggcatcgtaaggtcctaagggataacatccaaggtatcactaagccggccatccgtcgtttggctcgtcgtggaggagttaagagaatcagtggcttgatctatgaagaaaccagaggagtgttgaagattttcttggagaacgtcattcgcgatgcagtgacttacactgagcacgctagaaggaagaccgtgacggccatggatgttgcttatgctttgaaaaggcaaggccgtactctcttgga

SEQ ID NO: 7209 - DNA, 215 bp, Gossypium hirsutum
  Clone ID: uC-gsronu33B087e03b1
ctttgatctctacactccacatcgcagcaatgggtgaggaagtaaaggctttggttcctgagtcactgttgaagaagaacaagaggaatgaagaatgggagcttgccaaaaagcaggagctcgaagccgccaagaagaagaatgtcgagaaccggaagttgattttcaacagggctaagcaatatgcaaaggagttcgaggctcaggaaaaagag

SEQ ID NO: 7210 - DNA, 419 bp, Gossypium hirsutum
  Clone ID: uC-gsronu33B087e05b1
cccacgcgtccgcttgaagctgtggggcaagatttctttacctcatatgatgaggtttatgacactttcgatgttatgggattgcaagaaaatcttcttaggggcatttatgcttatggttttgagaagccatctgcaattcagcaaagaggaattgtacccttttgcaagggacttgatgtaattcaacaagcacaatccggaacaggaaaaactgcaactttttgctctggaattctacagcagcttgactacagcttagttcagtgccaagcattggtccttgcaccaacccgtgaactagcacaacaaattgagaaggtcatgcgggcattagggtgattacctttggtgtcaaggttcatgcttgtgtagggtgggaccagtgtccgtgaagatcaacggattctctcagtggg

SEQ ID NO: 7211 - DNA, 340 bp, Gossypium hirsutum
  Clone ID: uC-gsronu33B087e09b1
tcgccctcgcgtccgcccacgcgtccgaaaatgtcttcattaggcacttcaaagggtgttcttgaaatcgccaaatttggcctttatgttacgatccccatcgttcttatgtacactttcgccaacaacactaagaatctccagaaatttatgggaaatcgatcctacgtagtgtatcctccggagggaccaagacctccatcacctgaggagttgagagagatggcccgggagctcgctcggaagaaaaataatcattgaggctctttagggctggtagtgatctatgtagcttttccggtcgtacctattagttgacctattactactctacgaaaac

SEQ ID NO: 7212 - DNA, 408 bp, Gossypium hirsutum
  Clone ID: uC-gsronu33B087e10b1
tactatccgaggcttcgtctattgtatccgaagtgcccgattatttattcgggttggagaactccgatgagatccaacctcgtgacccgaaattaaggacacgtcagcttttgtatgagaataattcggtttcggatcccggttctcctgccccggttgtttcttcttctcctttttgttccacgtcatcagctactgttgtaccttcagtggctaaaccggataatcctgaaccggttttgaagtcaaagcaaagtcaaacggacagtttcgtggagcaacccgtttcgcaaccgaccacatattcgggtactccgatgtggcatcattatgttccggattctcattattctgctcctgccgtacaacaaatacccgtttattatgttccgggtcatgtccaacccg

SEQ ID NO: 7213 - DNA, 297 bp, Gossypium hirsutum
  Clone ID: uC-gsronu33B087f02b1
ggtgaccctctgatgggtggaaatacatgatagaagagatagggcctaatgcaaggaaaggcaagggcagtgtttcaaggttaccgagcttgtatgatgcatatactcaaccatataaggaggagatattcctcttaccacatttattggttttggccaccttttccattaacttgtctcttttttaacactttctttcttcatcataattttattcttaaccatgaccacttcaagacttttttccacatatcttcttcttatgctatattcctttaaatgtggcaccaccctgtc

SEQ ID NO: 7214 - DNA, 163 bp, Gossypium hirsutum
  Clone ID: uC-gsronu33B087f04b1
atctatgatggatgtggagaggaggcatggtaaattcaagcctgttattaagaaggcactggtagaatcggatggtgcaccattcatgaaatttgcttccttgcggcaggagtgggccattaataactgctacaccagatctatggtcctattcatcttgttg

SEQ ID NO: 7215 - DNA, 321 bp, Gossypium hirsutum
  Clone ID: uC-gsronu33B087f06b1
gctctctgttgccttttcaaacagatgctagaaacacttaatccagcatggggaggtaaaagacaatgcttaagaagaacactgacaggcccttggtagagtttgaggaactgctgattgtaaaaatgttgctttgatacacaatcttggtcggcgctacagtttaatgattgggatctgcatccattatctatatcttgatactgtttatggctagatagctgtgaatatagtagcaaagggttttgagttgttagttttgaacttgacagtattagtttgtacactttgattttgcttttggcctatgatggtatgttt

SEQ ID NO: 7216 - DNA, 279 bp, Gossypium hirsutum
  Clone ID: uC-gsronu33B087f10b1
ccctcgcgtccgaaattccccacaaatggccatcactttctcagatctccacacggaatctggccttaaatcccttaatgacttcctcaccggcaaatcttacatctctggggataagctgactaaggatgacataaaagtttatgctgctgttttgaaaaatcctggtggttcatttcccaatgtgagccaatggtataattgtgtgtctccccatctcgcttctaggttccctgggaaagccgttggggcttcatttgcggccacagcctgccccag

SEQ ID NO: 7217 - DNA, 398 bp, Gossypium hirsutum
  Clone ID: uC-gsronu33B087f12b1
cccacgcgtgcggcttgaagaaaatctcaaatcaatgaacatcaacgaagaagaaaacaagaaccctaagaaccctaaccctaacactaaagatgaagaagatggtgaacttgaagaaggggagatcgcaggtgaagaagatgatacgacgtcgtcttcgttaaagaaaggtatcgtcgaacagcctcacccgttggagcattcatggaccttttggtttgataacccttttgctaaatcaaaacaagctattgggggtagttctatgcgccctatttacactttctccaccatcgaacaatgctggagtctttacaataacatacatcatcaaagcaaattgtctcctgtagcggacttccattgtttcaaacataaaatcgagcccaagggggaag

SEQ ID NO: 7218 - DNA, 290 bp, Gossypium hirsutum
  Clone ID: uC-gsronu33B087g03b1
gttgactttatttttcatcattttttcgtacaaagaaacaattagtctttggttcgcaatggccaactccattttgataacagattatcaaagaaaagcttttaatgtagtggggttggggctttctctcatgctgctaatgatctcagaagggttatgccagagatttcttagtgaactggggccctcacaatggcaccaatgctgaaaattacaaccaatgggcagaaaaaaaacagatttcagattggggacccacttgtgtttacctttcacgcccaactatgatt

SEQ ID NO: 7219 - DNA, 343 bp, Gossypium hirsutum
  Clone ID: uC-gsronu33B087g04b1
ccttgttctctctcacctaagaaagaaaacctcgaatttcttgtgaagttggtgaaagaaggaaagcttaagccagtaattgattcagtacatcctctaagtaaggctgaagaggcttgggccaagagcattgacggccatgccactggcaagattcttgtggagccataagttatgaaggttacctgataaatagcactagtttttcagtttctcattgagtggtgtagctcaccatttctaagttcacaaagtactcagtatcttgaacaattccatgtttggtgtgagaggttcctaaactttcttgtattttgctggtgggataaacaatgtcggtgtg

SEQ ID NO: 7220 - DNA, 472 bp, Gossypium hirsutum
  Clone ID: uC-gsronu33B087g07b1
cccacgcgtccgggtcctttgggtcacatcgaatacaccggtcagggcaactttttggttcacggcaaacccaagtttgccaagaaactagcaatgttagccggtgggacggtgatcacccccatttatcaactcatccaagccattttaaaagaccccaaggacgagaccgagatgtatgtcgtgtacgcaaaccgaaccgaggacgacattttgctgaaagaggagctcgacgactgggctaagaagcatgatcggttgaaagtatggtacgtcgtacaagaatctataagggaaggatggcaatatagcacaggtttcatcacggaaagtgtaatgcagggatcacatcccggagggctccagcgacacccttgcgttggcttgtgggccgccgccgatgatccagttcggcgtgcagcctaacaagagaagatgaagttttacgtcaaggattttttgctgggatttt

SEQ ID NO: 7221 - DNA, 353 bp, Gossypium hirsutum
  Clone ID: uC-gsronu33B087g10b1
aaattgctatctctgaaggtgtcttaataaacgccttcgatttaccttcgatttccatttacttctctattgctacgtttttgaatttttagtgagcgaaaatgagagagtgcatgtcaggccacatcggtcaggctggtattcaagtgggcaatgcctgctgggaactttactgccttgaacatggaatccagcctgatggccagatgccaagtgacaagactgtcggaggaggtgatgatgcttttaacacctttttcagtgaaactggtgctggaaagcacgtccctcgtgctgtctttgtggatcttgagcctactgttattgatgaagtgagggcctggtcttaccgt

SEQ ID NO: 7222 - DNA, 369 bp, Gossypium hirsutum
  unsure (1)..(369): unsure at all n locations
  Clone ID: uC-gsronu33B087g11b1
cgtacgcgtgggcagccggatgctctagcatatggaaagacagcagagcagttgctgaaggagaatgtttcgcagcatcttattcctcataagacgttctctgggaatcggccttctctcagtcttttgctaccatctcttaacgcttacaatattgggcagctcttggcaagctatgaacatagagttactgctgaaggttttgtttggggcatcaattcttttgaccagggggagttgagctgggntaagtcactagctactcaagtccgaaaacagcttaatgcatcacgtacgaaaagtgaacctgtcgaaggctttaattttagtactactaccgttgttaacttgatatctacagggcagttc

SEQ ID NO: 7223 - DNA, 437 bp, Gossypium hirsutum
  Clone ID: uC-gsronu33B087g12b1
attgccattgctctcattgaatcatgtatcattggtgtgtagatcagttttggattctatgaggctctatgacgaaatcttgggctttgttctcatcaaacgcccctcttctttaaaattcaatggagcttggttgcttttctatggcactgttatacacttaattcagatcccactcattgttgatttcctcacctttgttttaccccggccattcaatctccatggctcatcccattttatttcctgtgctgtacttcctttctcttctctcttctttccttactctctccttttttttttttctttttccccttattttcttttttattcttttctactacttatcctcctttcttcttttatttttcctcctctttctcttttacctctcatccctcccttttttttcttcttccctctttctccctctcttt

SEQ ID NO: 7224 - DNA, 194 bp, Gossypium hirsutum
  Clone ID: uC-gsronu33B087h04b1
cgataaactttatccagtgattaaacgaacagagtgaggaccgacgaagatctgaaatcgaacgaacgaagatttggggtgttttggcgttggattggcgtctaaaactcgggggcagtctcgaccgattggagagggtgacaacaaccaccactgtggtgaagcaccggctcaggctaagtggagctgggggc

SEQ ID NO: 7225 - DNA, 387 bp, Gossypium hirsutum
  Clone ID: uC-gsronu33B087h05b1
ccttcgcttccgcccacgcgtccgtccacgcgtgcggttcgccggaaaacaacttgaagacggtcgttccttggtcgactacaacatccagaaggagtcaacgctccatcttgtccttcgtttgcgtggcgggatgcaaatcttcgttaagacgcttacgggaaagacgatcactctcgagggcgagagctctgacacgatcgacaacgtgaaagccaatatccaagacaaggaaggcatgccggcagaccagcaacgtctcatgttcgccggaatgcaactcgaggacggggcggactttagccgattacaatatccagaaggaatcgactcttcatctggtcctgcgtctttgaggtgggatgcatatcttcgtcaagactttga

SEQ ID NO: 7226 - DNA, 360 bp, Gossypium hirsutum
  Clone ID: uC-gsronu33B087h09b1
ccctcgcgtccgcccacgcgtccgctttttcttagttttcctttttgtcccttggttatttgatatttccccctcatggccgccgctgatgtcgagttccggtgcttcgtcggagggctcgcatgggccaccgacgaccgggccctcgaagaagccttcagtgcgtttggtgaaatcgtcgaatcgaagatcattaatgatcgcgagactggaagatcccgaggctttggattcgttactttccgtgacgagaaagctatgagggacgcgatcgaaggaatgaacgggcaaaatcttgatggaaggaacatcaccgtcaacgaagcccaatcgcgcagaagtggaggcggtggcggagga

SEQ ID NO: 7227 - DNA, 551 bp, Gossypium hirsutum
  Clone ID: uC-gsronu33B087h10b1
tcgccctcgcgtccgataaaaattaaaattggggttggttttatttttaagggggggtttttattatgtttgcacactttgtgtctccttttttggggcgtcccgctgcttttctcgctttgccctctttttgtgtgttcgcccctttgcttctttctgtgctgtttttccgtgtcctccctctttttgtggggttcttctctctcttctccattgttttttgtctctgctgtgctctctcttctttttccttcttttgttgtttttttttgcttcttttgtttccccttgtgtgggtctcttctttttttatgtttcttgtggtgcctttatttgtctcttgtttttgctctcccctctttttttcttcccttttcttgtgtgtctcttgtcttttttcccttttttttttttttgttttccttcttctcctctttttttctctctcctctctcccccttctcctcctctctttctttttttcgcttttctcttttctctctctccctcctctcttttctttccttttctctttcttctttttctttcct

SEQ ID NO: 7228 - DNA, 85 bp, Gossypium hirsutum
  Clone ID: uC-gsronu33B087h12b1
cggtcgcgtgggataaataattcatatataattgattttaatttaaaaaaataaaaaataaatagaaaaaaaaaaaaatatttac

SEQ ID NO: 7229 - DNA, 450 bp, Gossypium hirsutum
  Clone ID: uC-gsronu33B089a02b1
tctgaagttttgggaataccattttgtgtgcggatgggagaatcactttaaaggtgatgtgcggtgatcctgctgctgggactgtgagatgccgatgtgaaaacacagcgatgatcggggagaggaaaaatgtcaacctttctggtgacgtggaggatcttcccacactcactgagaaggataaagaagacatcttgggatggggagttcccaacagaattgatatgattgctctttcctttgtacgcaaagggtctgatcttgtcaatgttcgtaagggcctcggtccccatgctaagaagattcaatcgatgtcgaaggttgagaatcaggagggtgttatcaactttgacgagatcttgcgtgagactgatgcatttatggttgtccgcggtgaccctggaaaggaaattccggttgagaagatctttctagcacacaagatgatga

SEQ ID NO: 7230 - DNA, 462 bp, Gossypium hirsutum
  Clone ID: uC-gsronu33B089a05b1
aaataaattaaaaaaaagcctctttcctgtctctcggcggtttactgtacaatcatgtctggcttcattagcaaatatgctgatgagttggctaaaaacgctgcttacattggaacccctggaaagggtatccttgctgctgatgaatccactggcaccatcggcaagcgtctttcaagtattaatgtagagaatgttgaagacaacaggcgtgctctccgtgagctcctattcacaactcctggagctcttcagcacctcagtggtgttattctctttgaggaaaccctttatcaaaaaaccgcttcgggcaagcccttcgttgatgttttgaaggaaggtggtgttctccctggcatcaaagttgacaagggtacggttgagcttaatggaacccatggcgaaactttcacccagggtctaaatggccttgcacagcgatgccaaaaatactatgaagct

SEQ ID NO: 7231 - DNA, 112 bp, Gossypium hirsutum
  Clone ID: uC-gsronu33B089a06b1
cttttctgtgtttgctattggattttaaatgattgggcgattaaaaaaaaaaaaagggtttaaaaaaaaaaaaaaaaaaaaaaaaaaaaaaaaaaaaaaaaaaaaataaaaa

SEQ ID NO: 7232 - DNA, 365 bp, Gossypium hirsutum
  unsure (1)..(365): unsure at all n locations
  Clone ID: uC-gsronu33B089a08b1
agcttcttggcctgtgcagggtctaatacggcgttggaggccttagctcgagaggaggattagggagcgtgcagaaagggagttgctagaggcttctgcgtaatttctgctcaggttgcttctggcatctttttgactttcagtttgttagtgcatctttttcttccaaaatatgaagtactctcaacgtgcttgatttggcattttagttatcaatttccatttccttatgtgaaaatgctcgtttctatggatgcatgctttcacaacaaactgtaccctggtatactcatgaataatttcatgagaagaaaaaataaggtgctggcttgtaaataaaaaaccanaanataaaaaaaaagaaa

SEQ ID NO: 7233 - DNA, 299 bp, Gossypium hirsutum
  Clone ID: uC-gsronu33B089a10b1
tttgtctgcatttttatggggtatggctgtggggggcttagattatagtttgtaaggcaaggctaaatggtggatcaccatcatttctaagttgtattcaaggtccacataggagaaaaaaaatctcaaaaatgctgcgtgattcgtttttagtttttttaccagtttcacggataaataagacatgtcttgcacattgtattgtaatattttatgagaaatttcgaaattaggaatcatctattctcggattatacaataaggtagttgaagttaaaacaaaaaaaatactaaaatta

SEQ ID NO: 7234 - DNA, 337 bp, Gossypium hirsutum
  Clone ID: uC-gsronu33B089b02b1
aacgaatgcacgccactagggttttaagagaagagcgagatggcttcaaaaaaattagcttccatggccttctttttggcactcaacattctcttcttttccctagtcagtgctcgtggctcttgctcttcacccacccctaaaccaaggccaaacccaaaacccaacaccctcacccctactgcattcgcacgaggcaggtgccctagagatgccctcaaattaagtgtatgtgccaatgtgcttaacttagtcaatgtcaccgatggttcacctccagagatgccatgctgttcccttctaaatggccttgtcgacctggaagctactgattggc

SEQ ID NO: 7235 - DNA, 105 bp, Gossypium hirsutum
  Clone ID: uC-gsronu33B089b07b1
tttttttgaaaagagagggtggaaatagattacgaaattttacttacatatattcatttgaacacaaataaaagcataggatacattgaattcatacagaactta

SEQ ID NO: 7236 - DNA, 596 bp, Gossypium hirsutum
  Clone ID: uC-gsronu33B089c04b1
tggtacgcctggcggggccggcccggacttactggctggacccacgcgtgcgtcctacgcgtgcggtttgtgggagttaaagagatgggtggggtaatggctactttgggatggcagaaaaccattgagaaaggcttgggtcaaggatactatgggggcggttctagttggggaagccaggccactaaaatggagaacaaataccagaatggctatgcgatgtcttacagcgaacatgaacgccatagccaaatccgctgccccacctatggaatgagcgaatcctacactacttacggccaatctcatggcacccacaacggaaacgcaatgtcgaaaccccaatttcatggtcatgggaatggctacggcagccacatgagcaacgggatggctcacactcaagcatatggctctaaccatcacaacagccctggaaaacaccaaggccctgggtatggcagtggctttgggggctaccctcccaaaaaccatggaatgccgcatagcccaccgcaccacggcggcaaactgtcaggccaaggcaacgggttcctgaagccccaagcataccgccctgggagaagcatggccta

SEQ ID NO: 7237 - DNA, 579 bp, Gossypium hirsutum
  unsure (1)..(579): unsure at all n locations
  Clone ID: uC-gsronu33B089c05b1
cccacgcgtacgatttggcctgtcaatagcatcgggatggttgagctcaacaaaacaaggcgatggcagaagtgaagctccacggcttctggtcaagtccttttagtcatagagtgatttgggctctgaaaatcaaaggagtaaattatgaatacatagaggaagacctttctaacaagagtgaactgttattgaagtacaatcctgtttacaaaaaaatccctgtccttgttcatggcggcgagcctattgccgagtccctcgtcatcctggaatacattgaagaaacttggcccaataatccactactgccgattgatccttatgacaaagccatcgctcgattttggattcagtttggagtagacaagggtccgattttcagtgacttttttcgatcaacgtgtggtgaagaacaagagaaaacaacaaaggaattattagaagccttgaaaatcatagaagagcangcacttggggacaagaangtttttggtggaaatgccattaatttagtggatatctcttatgggatgatagcctattggttcaaattattgaagagtaattgaagtaatg

SEQ ID NO: 7238 - DNA, 509 bp, Gossypium hirsutum
  Clone ID: uC-gsronu33B089c06b1
gctacccaccccctctgcgtctcacagttcacttgtgtgtttagtgtagccaggatgttaaaaaaaacctccattaatggctgcactaaggagcttccttaggaaaagatgtttaacatgcgacgagctgatgatgacaaggaggctgatctccaccgaacccatcattgattccccttcttttgcacaaagactcagagatcttcccaaggatctccctggtactaaaattaagagggaggtttcgcagctaattggaagaacaccccttgtctttcttaataaagtaaccgaaggctgcggcgcgtatatcgctgtgaaacaggagatgatgcaacccacttctagtattaaagacagaccagcatttgccatgatcaacgatgcagaaaagaaaaacttaatctctcctggaaagacaactctgatagagccgacatccggtaacatggggataagtatggcattcatggcagccatgaaaggttataaaatggttctaactatgc

SEQ ID NO: 7239 - DNA, 328 bp, Gossypium hirsutum
  Clone ID: uC-gsronu33B089d01b1
cgtccgaaaaggcataaactacattggccttattgaaaagtgtttgttttccaaacccgggcggagcatgtaggtggagacatgattgcaagtgtaccaaaaggagatgccattttcatgaagaggatatgccatgattggagcgacgaacactgcgccaagtttttgaagaacagctatgaagctactgtcagacaacgggaaagagattgttgccgaatgcaaacttcctgataaccaagatcctagccttgccacgaagatggatgaacatattgattgcatcatgtgggctcacaacccatggtggaaagagaggaccgtaaag

SEQ ID NO: 7240 - DNA, 272 bp, Gossypium hirsutum
  Clone ID: uC-gsronu33B089d02b1
gagcaagtcggtggagacaagcatgtaagcgaaccaaaaaggagacgccatactcaagaagcggaaatctcaagataggagcgacgaacactgcgccaagatttcgaagaactgcaaagaagctccgccagacaacgggaaagagaacgacgccgaaagcacactcccagaaaaccccgaaccaagccttgccacgaagatggctcgccataacgaccgcaacatgcaggcccacaacccagccgggaaagagaggaccgcaaacgacccac

SEQ ID NO: 7241 - DNA, 102 bp, Gossypium hirsutum
  Clone ID: uC-gsronu33B089d03b1
ggtttttgaggataggaaacataaacgagactagggggccataaagaaccacatgggcgagcgagagaaaagagtgtaaaaaactttcccagaaaaaaatac

SEQ ID NO: 7242 - DNA, 550 bp, Gossypium hirsutum
  unsure (1)..(550): unsure at all n locations
  Clone ID: uC-gsronu33B089d07b1
ttcacgcgtccgaaaaggcattaacttcgatgtgccttatttcattgaggatgcttctagctgtcctggtgtggagcatgttggtggagacatgtttgtaagtgtaccaaaaggagatgccattttcatgaagtggatatgtcatgattggagcgacgaacactgcgccaagtttttgaagaactgctatgaagctttgccagacaacgggaaagtgattgttgccgaatgcattcttcctgattaccccgatcctagccttgccacgaagttggttgtccatattgattgcatcatgttggctcacaaccctggtgggaaagagaggaccgcaaaggaattcaaggcactagcaacgggtgcgggatttcaaggcttccaaatcaaatgctccgcttttggcaccaacatcatggagtttctcaaaagtgtttgaatcttacatgcttttggattctgaagcttggtgattgttgtctaaaggtggattttctggaatacatacttnttgttgacagaaaacataaagaacgaaatttatgnttttacg

SEQ ID NO: 7243 - DNA, 552 bp, Gossypium hirsutum
  unsure (1)..(552): unsure at all n locations
  Clone ID: uC-gsronu33B089e01b1
cccacgcgtccgcccacgcgtccgcccacgcgtccggggtgctgctaaaggactcgcttttctccatagtgctgaaataaaagttatatatcgagacttcaagacttctaatgtcttgcttgattcgaactacaatgcaaagctttcagattttggattggccaaagacggaccaacaggtgacaagagccatgtttcgaccagggtaatggggacttacggatatgctgctcccgagtatttagccacaggtcatttgactgccaagagtgatgtttatagtttcggagttgtgttactagagatgttatccggtcgccgagcggttgataaaaatcgaccttctggagagcatagtctagtggattgggccaaaccttacctagccaacaaaagaaaaatgttccgtgtgttagattcccgtctcgaaggccagtactcgatggaaggagccttcaagggtgctacccttgctttacgatngcattctactgaacccaaattccgaccgagaatgaacgaagttgtaatagtattggaacaaacttcaaa

SEQ ID NO: 7244 - DNA, 516 bp, Gossypium hirsutum
  Clone ID: uC-gsronu33B089e02b1
ttaacatatggcaagctcaaagatggtggtctgagggcttgtcaggatcaaggggcgtgtacaatgttcagaggttaaaccgcaatgcatttgcactacccacaccacctatatccgaagatgagagctcaaaaatagaatcagcagaagcaagccctgtaacaccgccattgactagagaacgattacctcgtaacttatatcgtccaacagggatgagtgtgggctactcatcctcagattcacttgatcaacatccaatgcaggctcggaattattgtgattcccggtgttacctcaactccaaaactttccagtattagtggtgccaagacagagatatcatcaatggatgcctctatgaggagtagttcatcaagagaggctgatcgctccggtgagctgtctattagcaatgccagtgaccttgagactgaatgggttgaacaagatgagccaggggtttacattactatcaaagccttggcagggggtaaaaaggagcttaagccgagt

SEQ ID NO: 7245 - DNA, 572 bp, Gossypium hirsutum
  unsure (1)..(572): unsure at all n locations
  Clone ID: uC-gsronu33B089e11b1
ttttggttatcgccgctgctgagcatgataagctggaaaagcccaagaaagctactgtttccgccccagctcaagctcagccggctaagcctgctaagttcccttccaagccatctcctcctgctcaagctgtgagagaggcaaggaatgatcctggacgtggaggtcgtggtgctggacatggaggaggccggggatatggtggaagagggttcaatcgtgattccaatgtcaatgataactccaatgcattttcaggagggtacagaccttctgaagagggagaagaaaggaagcaaactgaaaggcgtggaggatatggtgggcctcgaggctctttccgtggaggacaccagggtggttttaatgatggagaatctggagagggggagcgccctcgcaggatgtatgatcgccgtagtgcgacacgacgtgggaatgagattaaacgtgatggttctggatgtgcgaattggggtagttctactgatggaatngctccggaggccgaagaaaatgtccctgagaatgaaaagaatgtcggcattgagaagcaatctggagaggaagat

SEQ ID NO: 7246 - DNA, 556 bp, Gossypium hirsutum
  Clone ID: uC-gsronu33B089f03b1
cgactgtacttgctggtttggttacaatgttgcacgcatgcctggatatgaaagctgtggtactgggaaaataccattatgtcctctacttcattgttctggcaatgcagccaaggatgttgatgaccgtcgacgaaaacctcaaacctctatcggtcccagtccgtgtaggtcaagctgttgatgttgtcgggcaggctggtcgacccaagactatcactggcttccagacccattccactccggttcttcttgctgccggtgatagagcagaactggctaccgaaaagtatattcccctttcacccatcctggaggggcatgttattttgaaagaaaacccagactacagagaggatagttaagttaaaaagcaagaactcggccgctacttccatggttggtgattgtaatgtgacactgttttcaaacaaattttcgaactttattattatttttttcatgataaagtttttcaagtcaaaacgactagatataaaatgttagttaaaccaggcaagctttctttaccgcaataatcccttttacatttctt

SEQ ID NO: 7247 - DNA, 361 bp, Gossypium hirsutum
  Clone ID: uC-gsronu33B089f12b1
gtgaaccgagacctaacatttcgggggtgagattctaaaattctggtggggaaatacataaataatcatacactaaacatttctatccacacccaactatctacctttacaataactaattaaaagcgatacccatgtaccatgggcttagactcacatcttccattaatttcaccatcagatcccgagagaagctatatgtattatattattgaaaaaaatcacattgttgttataaatatctataattctgtgaccactatcattacagaacaatggcaaaagaactgtgaccactatagggatctttgtgatataaactataatgcacatcaaattaactatgatttccacacttatt

SEQ ID NO: 7248 - DNA, 510 bp, Gossypium hirsutum
  Clone ID: uC-gsronu33B089g07b1
gcttccgcccacgcgtccctctcattctggtagtttatttaaactaggggggcgttatctaaaatggcttaatgcaaacaaaaagaatggcctctactgtataagaactggttcctatctctggctgcttgcactgcaaaatctgaaagagggacgttgtcctcttgaacctgtcgaattggcattgattcttttcgcaatgggatatcccaaggaaacacagatttatgttgcttctggccaggtttatggtggtcagaacctaatggcacccttacggaacatgttcccgaatcttgttaccaaggaagagttatcaagtaacgaggagttgtcttgttttccgaaacatgtaacaagcttagctggactctacttcttggtctgcctgaaatctgatctgtttgtaatgaccccaccgaggtaactttgcttaattgattatttgttctagaagtacatacattatcctcaaaatcaattaaaccttacaaggacttatgtctaaat

SEQ ID NO: 7249 - DNA, 531 bp, Gossypium hirsutum
  Clone ID: uC-gsronu33B089g12b1
ttattatttgagcccatagtcaccctctgtagtcacgtagatttaagaacttgcgggggcaaaaaaaaaaatgtccaaacttcttcccttgatacagacccccgacagaataactgcaccgtgtgcaaggcaaacatctattcctgttcattggttcccctctacggtcacagctcatcttcacattctcaacccaagactccacattcagatctgatcattccccaaagaccacctccttctacatcgaacatgaccgccctttcttcacatctaaataaacagcttcacgaaaactttttccattctcagacccaagcatttcataaccaacaatacttcccaccttatggaggatatgcaaccttggcatcatcccaccttaatggtgtaccgatgactaatttcttccatccgatgatcggaactttcgaagaaatagagtatgctaaaatatactgaagctcatacacaagtatgttcgcttaccctaaccaagcttgttacccattaatcaggactaacaatctt

SEQ ID NO: 7250 - DNA, 312 bp, Gossypium hirsutum
  unsure (1)..(312): unsure at all n locations
  Clone ID: uC-gsronu33B089h07b1
gtcatttctggagacattgtgtaataatacggggtcctattaaagcaatgccgggcatatgatctgtgaagatgctttatcttgaaacctctcagtttcttagcggccttaattgcatgaaccaaangcaattgatcccatgtgattatgtcttacagtctacattgggtatgcaccaacttgatgtctgtagattttggatcttttaagccaccgattcttttgggctttgaagcttatgtttggcggtataacaaaggtgaagaaagtatctacccccgcttaaatctctgattggttaaattttcatta

SEQ ID NO: 7251 - DNA, 461 bp, Gossypium hirsutum
  Clone ID: uC-gsronu33B089h11b1
ttcatccgaagccctagagatcactcggaagggcaggaacaaacctgtgagagtgggggttaagcgcgacgaactaaccctggagggtatcaagcagttttatgttaatgttgaaaaggaagagtggaagctggaaacactttgcgatctctatgaaacactggccattacccaaagtgtcatttttgtgaacacaaggcgcaaggttgactggctaactgacaagatgcgaagtcgagaccacacagtttctgccacccatggagacatggaccagaatacgcgtgatgtcatcatgcgggaattccgttctggttcttcccgtgttctcatcactaccgatctcttaggccgtggtattgatgtgcaccaagtttcccttgtcatacacgacgatctgcctactcaaccagaaaactacctctacctaatcggaagaagtggtatgtttgggagaaaag

SEQ ID NO: 7252 - DNA, 468 bp, Gossypium hirsutum
  unsure (1)..(468): unsure at all n locations
  Clone ID: uC-gsronu33B089h12b1
tatgtttctcaacaagggaacctaattgattgggctgttttttttggattaaacggggaggaaaaaaaatgcactcaagtcatctgcttctggaagagccaatcaggatggcttcaatcctggagccatcaaaggctacttttttcccggcaatgacgaatatagtgggaactttaggtccaaggtctcgatccagagaggttctttctggttgccttactgctggaatgtctgtggctaagttcgatttctcttggcatgacccggagtatcatcaggaaacattagagaatctaaaggcagcctttaaactcactaaaaagctatgtgcggttattgcggatactgtgggccctgagttgcangttgttaataaatgtgagaaagcgacttcacttgaagcacatgctacccgtaatttcgacacccgatgaaggacaggaggcatcttctaacttattgcctatc

SEQ ID NO: 7253 - DNA, 374 bp, Gossypium hirsutum
  Clone ID: uC-gsronu33B090a06b1
acccggacttacttccccgacccacccacgcgttttatttgccctttgcataacgtaacgaatctgggttgattctatacaatggctcagggcggttacaaactttgacctattagctttcatagttagttgcgcacttggtcaggctcctagctcggccccaaccaattcaccgccgtcttctaaccctactccggctcccaaggtttcttcaaccatgtctccaaccgctacaccaaccgcatctccgccgtcaacatccactcccccgtcttcagcccctgaatcttcaccaacttcctctcccactacttctcccccagctcctctcgctggttctcccgctggctctccccctaccgctgattctacca

SEQ ID NO: 7254 - DNA, 432 bp, Gossypium hirsutum
  Clone ID: uC-gsronu33B090a09b1
ttttaaccccaagttttcactttcaaaaaactgggcacatttacaatgtctggcacgtgcggcaactgtgactgccctgaccgcagccaatgcacgaagaagggaaacagaaacaccatgatcgttgagactgagaagagctacatcaacaatgttgagatggatgctccagctgagaacgatggcaagtgcaattgctgcactggctgaagctgtacagactgcacctgtggccactaaatcaacatacaatggtcatgcttcagatcatggcatatatagggatctaaataatgaatttaaggctgaataatttgtgtctgttgcagtttgtgtggcgacttatatctgacagttaacctttctatgctctactatgatgtaatggctatgcttattgccttattttgggtaatgaagtatccttactat

SEQ ID NO: 7255 - DNA, 432 bp, Gossypium hirsutum
  Clone ID: uC-gsronu33B090b02b1
cccacgcgtccgcaaaaaaaaaaaaaaaaaaagagagaaaaataaaaaaaaagggggggggagaaccatggcctccatcggacttaacatagagacctgcctccacgtctgaggcatggactatgtttactgctagggtttgccttactcatttcactagtgacccatctttgggtgatgaaaagcctgcctttttcagcattaaagcctttgtcagcttgatcaggcctgagcaagcaatgtggtaccgtgcttgcataacatgcaacaagaaagttactgaagctgctggatctggctattggtgtgagggatgccagaataatgatgaagagtgtaatttaagatacataatggtctcaaagatctctgatacaagaggtgaagcctgtgtttcagtcttttatgaacaagcagagaaaattgttggat

SEQ ID NO: 7256 - DNA, 602 bp, Gossypium hirsutum
  unsure (1)..(602): unsure at all n locations
  Clone ID: uC-gsronu33B090b10b1
atcactctgtaggtttattgcattaaataaatcatgaaatctttccttccgttctttgcattcctctcacttctcctgtttgtagacaccattgcagcagctaggaaagatgctggagagtactggggagctgtaatgaaagatcagcctatgcctgaggcactccaagagcttgttcggattgaggctgccgttgccaaccccgatgagaaaaccaagtgccatacatcaggtaacattgagcttaaggaagagaagattattgttaatgaggagttcgaaccaaggccaaacatttcagcttacggtgatgacgctaatctaaaaggagataaatcatcatcttttgcagaagattttgaaccgagacctaacatttcggcttacgggggcgatgatgctggtcttaaaggacagaaagaatcatccactaaagatttcgatccacagccaaatatctccgcttacaataactaattaaaagcgaaacccaagtaccattggcttagacccacatcttccattaatttcgtcatcagattgtgtgtgaagcttntatgtttatatttgtgaaaaaaataagtgggttgtatgaatatcta

SEQ ID NO: 7257 - DNA, 369 bp, Gossypium hirsutum
  Clone ID: uC-gsronu33B090c04b1
acacccttcctattaccgttgactaccctgcaccacaacaggagactattttaaacaatggcgggggtcaaagatcattagtagctacagaaatcaaaaacctatctttgggctcagttgaaagatctcaaagctgaacttgctcttcttcgcgttgctaaagctacccctggtgcacctaacaagcttactaagataaaggtggtgaggctgtccattgctcaagttctgactgtaatctcacagaatcagaattctgcattgagggaggcatacaataagattaaatcttttgcctttcgatctctgtcccaagaagacccgagctatccgcagaaggcttaccaagcaccactcattttttaagac

SEQ ID NO: 7258 - DNA, 230 bp, Gossypium hirsutum
  Clone ID: uC-gsronu33B090c07b1
gttgatgaaaccatggctgaacctacccctgaggggtattggtgcttaaatcaagatttcttgaattttatctttgttttttcgtactaaaaatttctgtcggtcgttttcattttgttggaagcttgagttgaacttgttcttggttaccctttttcttatttaatcaaattttaaatttaaaaaaaaaaaaaaaaaaaaaaacactaaaatatatataaaatataaat

SEQ ID NO: 7259 - DNA, 410 bp, Gossypium hirsutum
  Clone ID: uC-gsronu33B090c10b1
ttacaacagccactaagtttgtcataaatgggagggctttctactagaatggctggcgagtgcatattggatgatgatgttcgcgtctgacaatcctacgaggagcaaggttactgacgcatttcgagaagcctccaagtatggcatgaacataccatgaacttgggcgtttaacgatggcgattacaagcctcttcagaattcccctggctcttacaatgaaaacttcttcaaggcactggactttgttgtaacgaagctaacaagtatggaattcatttgattctgagttaggcaaataacttcataaaattcggaggaaaaagataaatacctttaaatgggcaaagcaacgaggacggaacctggaccaaaaattatgatttttttcccgaactctgtgggcaaaa

SEQ ID NO: 7260 - DNA, 92 bp, Gossypium hirsutum
  Clone ID: uC-gsronu33B090d03b1
aactggtagctggggaagctagccggggttctgaaaaagagcgactgttcagattttttttaaccaaccatgggttgaagatgctgttgtcc

SEQ ID NO: 7261 - DNA, 358 bp, Gossypium hirsutum
  Clone ID: uC-gsronu33B090d05b1
tcgtcccacgcgtccgttttttttccggccacgcgaccggcgatgcaggggggggtttcttagatattcacctgggttagacactcagtggatgctaagatgcaccatgcttacatgatagtaaccgatgacgggcggatatactgaaaatgaactacacaacgttggagcggatgatgaaatacctggcccctccatgaggggaaagatggagaggtgatttagctaatactgagaggccaatgggcacacttatttgtgaggacaaaatttcagggtaggaaattgaggtcagtgatggccaatggatcaagttgactaatttatctccttcttcctttgcttttatgggtggaga

SEQ ID NO: 7262 - DNA, 119 bp, Gossypium hirsutum
  Clone ID: uC-gsronu33B090d06b1
atttttataaaaaaaaaataaaaaaaataacaaaaagagatttttaaaaaaaaaaccggcattctatcacaaaaaaaaattactacaccatcttcttttatccaaccccctcctcttct

SEQ ID NO: 7263 - DNA, 525 bp, Gossypium hirsutum
  Clone ID: uC-gsronu33B090d09b1
atgtgaaactggtagctggggaagctagtcgaagttctgaaaaagagcgacgatcagatttttttttaaccaaccatgggttgaagatgctgttgtccgttatttgaatcgcaagccagctgccggaagtgatgcaccaggaagcatatgaatcataattttgaaacttaaattggtgcctggaacgttctttcattgatccattccatttaattgaaatagatgtgcactgttgttggatgactattgagagggatgtaggaaaggaagtagaatgtttagtcataattatcattaaacttcatttaaaaaaaaggggtagaatttagcaagatagtaatttttattttgttcaaaattggaatttatatatggtagattcatggttgctttcttggtttgacttgaatgcttttttttggttaacgaatgtagattgacctatcgaaatgctcaatttttgttatattcgattgtttaaaaaaattcacaccctctcccttcgggggcggccgttttaaggat

SEQ ID NO: 7264 - DNA, 543 bp, Gossypium hirsutum
  Clone ID: uC-gsronu33B090d11b1
cggacgcgtgggtggtcacccacgctttactgagaccatacataccctaacaacgcaaatggaggagctgaacaagttaatttggttaatgctaactgatagttacggattacgggaggattcactgaaaatgaactacacaacgttggtgcggatgatgaaatacctggcccctccaccaggggaatatgagagaggactctttgctcatactgataaaccagttagcacacttatttgtgaggacaaaatttcagggttggaaattgaggtcagtgatggccaatggatcaagttgactaatttatctccttcttcctttgtttttatggttggagatcctctcaaggcatggagtaatgggagattgaaatcagtgaatcacagagtgatgatgagcggagacaaagatcgatattctatagcagcctttgtcattccaaatgagggtactataatcaaggcacccaaagaacttatagatgaccaacatcctcagcttttcaaggaattcgatttcatggacttcttccttatgccttt

SEQ ID NO: 7265 - DNA, 547 bp, Gossypium hirsutum
  unsure (1)..(547): unsure at all n locations
  Clone ID: uC-gsronu33B090d12b1
gtttccgttgtcgtccctgcagcagaacagcgagagaagcatagcaatggcaagggtcaaggttcatgagttgcgacagaaatcaaaaaccgatcttttggctcagttgaaagatctcaaagctgaacttgctcttcttcgcgttgctaaagttaccggtggtgcacctaacaagctttctaagataaaggtggtgaggctgtccattgctcaagttctgactgtaatctcacagaagcagaagtctgcattgagggaggcatacaagaagaagaaattcttgcctctcgatctccgtcccaagaagacccgagctatccgcagaaggcttaccaagcaccaggcatctttgaagaccgaaagggagaagaagaaggaaatgtacttcccaatgaggaagtatgccattaaggtgtanggtaggatctctcacattctatttacatatcgattcgctctttactttctagcatcgtcttccgtaaacccgagttgggattttgtttcaatcttcatgtttggaaactcttttttgtccccttgtaaa

SEQ ID NO: 7266 - DNA, 491 bp, Gossypium hirsutum
  Clone ID: uC-gsronu33B090e02b1
agcgctttctctcatattgctccctgctgataggggtagaaagggtttctgtaggaatttattagttttgaaaacatggcagtcatttctttcagggttcttatgagagttgtgaccatctttgctcttatttttgctattgtctcacccaaagttgaagctcagtctgctgcacctgctccttctcctacaagtgatggaacttcaattgaccaagggattgcttacgttctgatgcttgtggcactggtgcttacataccttatccaccctctagacgcatcctcctacaccttcttttaaatcatattattcattttggtaaccgaggactatatggataaatctatcaagttcctttctatttccctttctttttgggagatggatggaggggctcaatgtttgacatgcctgtgatgaagaacatcacacggttgttaatgaacggaacccctgggactatgtctacgtcgccgtccttacccacc

SEQ ID NO: 7267 - DNA, 513 bp, Gossypium hirsutum
  Clone ID: uC-gsronu33B090e06b1
ctttcttcttgctttactagtatagctttcatgccggtcctcctctttgcagcatttgcatcttttagaatatcatttatctcattctcaaccatcttattggaatttggttctaatttttccatgtctatgtatcttccatcgcccttcccttctcgtttttccattttcccagcattttccatcaacttctgaaatatccttccttttctggagacttcctcaaaggtaccctcttctttaattacaccattagagataagaaggatgtagtctacatgtggaagaaaatgcagctggtttgtgacaagtattctggtttttccttgtaattcttccttgatacacctgttgaaaacctgcaaatgacttcagattagaccatatagcataaccacaagaaatctattttgagatcaaagaaggttgaatgttcaaatccaaaaggttgaaaatacattagaaagaaactggaattgtggaaagaatatatgagaaatatttgtgccttaa

SEQ ID NO: 7268 - DNA, 331 bp, Gossypium hirsutum
  Clone ID: uC-gsronu33B090e09b1
ttggtttagctcttgaacaaataccataagaggtacatgttgattggccgtgtaaaccagttccattacatagtgaagatttttaaagtggactaaggtcccgtggttttttcccttcaaggggttttccacgtaaattttggtgtcccctttttatgttaatgttgcgcacttatgtcaatatcttttgcagttttgataatgttactatagcaggtatgataactgtgagctgtttaatttatcagtaaattactctgtttattaaaaaaaaaaaataaaaaaaaaaaaaaaaaaaaaaaaaaaaaaaaaaaaagatacttatttataa

SEQ ID NO: 7269 - DNA, 493 bp, Gossypium hirsutum
  unsure (1)..(493): unsure at all n locations
  Clone ID: uC-gsronu33B090f08b1
ctttcgaaggaggaaattgagaaaatggttcaggaagcggagaagtacaagtcagaggacgaagagcacaagaaaaaggtggacgcaaagaacgcgttggagaactacgcatacaacatgaggaacacagtgaaggatgagaagattggtgccaaacttgctgcagcagataagaagaaggttgaagatgcaattgacgaggccatccaatggttagacaacaaccagcttgcagagtcagatgaatttgaagacaagatgaaggaattggagagcatctgcaaccccatcattgccaaaatgtaccaaggcgctggagctgacatgggtggcatggatgaggatgccccagctagtggaaccggcgcaggccccaagattgaggaagtggactaagaantttctctccattcttttcgacccttacatttgtttctttagtcgtttcatgttggtttcttttttattggactttagacatgtttttgaggat

SEQ ID NO: 7270 - DNA, 83 bp, Gossypium hirsutum
  Clone ID: uC-gsronu33B090f12b1
ttctatacaaacccaaaccccatcattaccttgagcactttttaggaaacattggggcatggtcaacggccctagtacctaca

SEQ ID NO: 7271 - DNA, 358 bp, Gossypium hirsutum
  Clone ID: uC-gsronu33B090g01b1
acatatttttattttggcatcacatatgcttaatggggggcactattaacaaagagggtgggcctatgtcttggaatcaatctaatagtctatcatcattaacaaggggctccatatctgggggaagaaccattgcaaaggaggatcaattaccaaacagtggtggaagcaatgatgtttcaaacacaaggtctaaccgatcaaatttgagtatgaacatggtagatgaggagcctgtaaatgaatcacccgaatttgagcatttttttcaagaaaagtactggaaaggggcacccttaagtccatgtactgagccaacagaggttggtaactgaggtgacagcaaccagcatccctt

SEQ ID NO: 7272 - DNA, 526 bp, Gossypium hirsutum
  Clone ID: uC-gsronu33B090g04b1
cccacgcgtccgaaggagtggtttgtcgggaaaggtcagaataaatctgaaagggaggctgaactgaaacatcgatttgagcagacaatgaaagaggcagcggataaatttcaaggagcgaacttgtatgtcaagaatttggatgatagcataagtgacgaaaagcttaaagagctattctctcaatatggtaccataacatcatgcaaggttatgcgggaccctagtggaataagtaaaggatcagggtttgttgcgttttcaaccccagaagaagcttctagagctcttgcagagatgaatggcaaaatggttgtcaacaaacctctctatgttgcacaggctcaaaggaaggaagacaggagggccaggttgcaggctcagttttctcaaatgcgaccacttacaatggcaccttctgttgcaccacgaatgccaatgtacccccctggtggtccaggtcttggacagcaaatattctatggtcaagcaccttcgattttcccccctaagctggatttggata

SEQ ID NO: 7273 - DNA, 574 bp, Gossypium hirsutum
  unsure (1)..(574): unsure at all n locations
  Clone ID: uC-gsronu33B090g05b1
cctacgcgtccgcccacgcgtccgcccacgcgtgcgcgcactcgtccgcgtgaattgcccgacatgtgcttgtggctgtcagaataactcaactgaatctgggagttgtgtaagcgaaaggtcttcacatttagcttcagctgttccgggcaaatctaccaatgcaccacctttgcttcagtgtacgagccatatgtgtccagttcgaattcactggcatgttaagctcaactacaaggaatactggcgtgtgaagatcacgatcaccaatttcaattacgcattgaactacagtgagtggaatctagttgtgcaacaccccaactttgacaatcttacacaacttttcagcttcaattacaaaccattaactccttatgctggcttaaatgatactgccntgttatggggacttaagttntataatgatttcctcaacgaagctggtcctcttgggaatgtgcagtcagaactattattcagaaaagatgcatcaacttttacttttgaaaagggatgggcttttccacggagaatatatctcaatggtgataactgtgtcatgccaccttct

SEQ ID NO: 7274 - DNA, 289 bp, Gossypium hirsutum
  Clone ID: uC-gsronu33B090g12b1
gggccgtttcttatttccttcttgatccacgcccccttatattttttactccaatcagcattaaggaaatgggagggtttttggaaaatttccgtggcttccactattatatctggcctgggtttcagtggatggacagaatctttaccacctaaaccaaaatgggatcgcgcaaaaaatgttgacattccaggggttgagttagcaaagagtgcagttgtgttaccacttgtctggaaccaaacatgaaattatctggattaatatttgtgtttatcatagactttta

SEQ ID NO: 7275 - DNA, 374 bp, Gossypium hirsutum
  Clone ID: uC-gsronu33B090h05b1
ccttcgcgtccggttttaatttaactacaaccgtgcctggtttgcctgacaatgggggaatcgtagatcgagtttagaaggaaaaataccccacaaaaatgtcgatcaccacatcatcatcggcaggcttcaagctgatctgtctcctccactcggcgggcgccttatcaagcggctcgctcatgatgttcgacatgaagggaatctacaccttcacccacgggatcgagaccgccacgaaactcctgggctcctccccgcacgatcagctgttgatccggacatccgattctttctcgggtttgctcctggtcgcgattgggttcttgctggtcatggtctcttttgtgaaagacaaaagctttcaatccttc

SEQ ID NO: 7276 - DNA, 159 bp, Gossypium hirsutum
  Clone ID: uC-gsronu33B090h09b1
ggtttgtatagtgtacttaatatgtttaaattgggcatttttgaatatgagccagtgcgaaaatggcttattcattttggttaagcttggttttatctttttgatctatttggtatatatataagatgtttaagcttaaaaaaaaataataattacaaa

SEQ ID NO: 7277 - DNA, 392 bp, Gossypium hirsutum
  Clone ID: uC-gsronu33B090h11b1
tttgttttccttagccctagagatcacttggaagcgggttttaaaacctgtgagggttttttataaacgctactaactaaccctagtagggtatcaagcagttttatgtcattgttgaataggaagagtggaagctggttacactttgcgatctttatgaaacactggccattacccaaagtgtcattttcgtgaacacaaggcgcatggttgactggctaactgacaagatgcgaatgtcacacctcacagtttctgccacccatggagacatgaaccagaatacacgtgatgtcatcatgccggaattccgatttggtatcttaccgtgttctcatcactaccgctctcttagcccgttgtattgatgtgtcacaagaatcccttgtcat

SEQ ID NO: 7278 - DNA, 459 bp, Gossypium hirsutum
  Clone ID: uC-gsronu33B096a04b1
gttggttatgaagttaaaaattcggatgcaaaggctggtgacagtaatgatgttactttggacaaggccatcccagaatgcaattcaagtgactttgaagagggtgatcatgttacgagaacagatgttgaggacacaacttttgcagtgaaagaggatgtcctgaagaaacaatggagttgaggaacgacttctatgggcaagatgcagccattgcagaacgtaaagacctagcgaatcccgatgaatcaaacatctttacaaacacggagatgagtttgttttggcgggttgaagatgaagttaaaaattcagatgtgaaggctggtgagagtaacgatgttcctttggacaaagccatctcagaatgcaattcaagcgactataaagagggtaatcatgttgaggacgcaaattttcagttgtaaggatggtcctgaagaaatgaagcaacattga

SEQ ID NO: 7279 - DNA, 357 bp, Gossypium hirsutum
  Clone ID: uC-gsronu33B096b08b1
cccactcttccgggaaatcaaagagattgatgaatatagtgactgtgatcagtggataaatggactgtgattttgatgctgttcatgtgttattttgttaaaattttttctatctaaatttccttttttttttttgttttaatttttattttattttatgttgttttgtttgtatttaaagtatgttattgttttttgtgctttcatgattgaagttccagtgcttttggctggtcggctttgtatttattatgctcttttgaagtctgggtttgttggattttaggcttacctatttgtttctgggttgtaggaaaattgtgatagtgttggctaatcttgttattttggtttttt

SEQ ID NO: 7280 - DNA, 120 bp, Gossypium hirsutum
  unsure (1)..(120): unsure at all n locations
  Clone ID: uC-gsronu33B096b10b1
cttattcatacagcccgaaaaaaccgagaacgaggagggggactctttaagcgccaatgccccttccttccaccttnaacactccacagcaaatcccataccaacctgaacccactaaaa

SEQ ID NO: 7281 - DNA, 676 bp, Gossypium hirsutum
  Clone ID: uC-gsronu33B096c08b1
cccactcgtccgcgaagattatagaaagatcttgccgggagaattttacccttcttgggtggagtaattacaaaaatattaaatcataatatttatataatattatataattataaataattttaaattaatttaatataactataaaaaataatatttataatatattatataattaatcattcattataactatattttaatatattctataaattatattatttaaaatatattttatataatatattatttaataataaataatattttatattaataaaaaaaatatataaaatttaatttattatatttaatattaataaaaattatatttttattatattaaatttaatttaataaatatcaaaaaataatatttctaaatattatcttcataaattttaatatatatttcaaattatatattatattttaattaatattaatgttatataatatataattatatttttacatataacaatgccattttatattaatacaatatataatttcgaataatcatttgattataatattaatactatatatacaattatatattactttgatattataaattatatattatttatataatatttcattaattttatttattttaatataatttattaaaaatattaaaaatcaatttataatttattataat

SEQ ID NO: 7282 - DNA, 608 bp, Gossypium hirsutum
  unsure (1)..(608): unsure at all n locations
  Clone ID: uC-gsronu33B096d01b1
gaagcattatccctatttgccacaagatccttatgacaaagctaccgctcgattctggatcaagttcatcgacgaaaagtgctttcctaccctttggctagctgcatggagcgccgagaatgagcgagaaaaagtgacgaatgaagcttgcgagtatctgaaaacgcttgaaagtgcgcttaatggaaagaaattctttggtggagaaaccattggaatggtagatattgttgctagctctgttgggtatttcattagggtcactcaagaaattatggggcaaaatctgctgtcagctgacaaatttccccaattattccaatggtctgaagatttcgcaaattgcagcattgttaaggaaagtttgcctccaagagacaaactacttccctttgtcaaaggtctcattgccaaatatcagcaagataatgctaaggcctaagccctcccaatgaacgtctttcacaatgattgtcgcatgcantttgccatttttgtatttgctgctttggtgtgtaatgacctacttgcttttatgttcgagtgaaaaataaattaactcattgtactcttaaataaaattgggtattaaagtattaatgagtttt

SEQ ID NO: 7283 - DNA, 335 bp, Gossypium hirsutum
  Clone ID: uC-gsronu33B096d05b1
cagatcgttcagaacatacgtagtgaaactggtgctcagattcgcattcttaaggacgatttaccttcttgtgccttgtccacagatgaacttgtacagatatctggggaagctgtagttgtgaagatgtttttttatcttattggatatcctctttattatgtactatttatgttattagctcttgctttgattctgtttgtgtaaattgttattcttgctactgttttattttttgttttttgattttgtttttcttataatttattactttatttatttttttattatttattctttattttttctttttatttttttgttttcttttttcc

SEQ ID NO: 7284 - DNA, 592 bp, Gossypium hirsutum
  unsure (1)..(592): unsure at all n locations
  Clone ID: uC-gsronu33B096d12b1
cccactcttccgggttaaaattcctgaaccgttacgcggaggatgattgcagcgttagggagtctggagacggtnttgntgtgctgttataggtttttttttttttaatatcatttttttttatatttttttatttttattattttttttttttatttcttatttttatttattttttttttatttttttttttttttttttttattatttatattttttgtttttatttgtattttttttattttatttattatttatttattttctatttatatttttattatatatattcttattttttttatattttttttttttttttttatttatttttttttttttttattattttttattttttttttatttttaatttatttttttttttatttttttattgtttttttttttttttttcttatttttttttcttttatattatatttttatttattataattttcattattttcttaattttttcttattttattttatctatttttattttttattttttttatttttttactttttttttttattttttattatctttaatttcatttatttttacattttttttttatt

SEQ ID NO: 7285 - DNA, 182 bp, Gossypium hirsutum
  Clone ID: uC-gsronu33B096e07b1
cctactcgtccgcccacgcgtccgacttgctctgctggttaggcctaagactacacatacaattcaggaagtactggaaatcctaccaccattttgttggtctctcttttttgtcgaatcgtattttattcccttttttctaatcattctttatttcctctctatttcttccctattttttt

SEQ ID NO: 7286 - DNA, 105 bp, Gossypium hirsutum
  Clone ID: uC-gsronu33B096e09b1
cccactcgtccgccactttgttcgtacactggagaaaacttggagtccatatgccgtggcagaacatttcatgcaccctgtgaaattgcattttagttcatcttt

SEQ ID NO: 7287 - DNA, 94 bp, Gossypium hirsutum
  Clone ID: uC-gsronu33B096e11b1
cccactcgtccgcccacgcgtccgaaaaaaataagaggggaaaattttaaaaaattttcctcattattttcacgggcgtccgttataggggatc

SEQ ID NO: 7288 - DNA, 54 bp, Gossypium hirsutum
  Clone ID: uC-gsronu33B096f03b1
gttactatacaaccgactcgagacatgattgtgagaggggcaaattttgaaact

SEQ ID NO: 7289 - DNA, 146 bp, Gossypium hirsutum
  Clone ID: uC-gsronu33B096f05b1
aataaactaaccactcccacattaaatattgttgctgaaacaatgtttttatcagctttgacatttaagcaccgaggcagatgtagagactaaggtttctcctgagccgctacatgaaacagtttgccaataaaatcaaatcaaat

SEQ ID NO: 7290 - DNA, 58 bp, Gossypium hirsutum
  unsure (1)..(58): unsure at all n locations
  Clone ID: uC-gsronu33B096f08b1
gtgaatancaagaaggaaaaaaaacccttaaaatcaagagccctaattctattttttt

SEQ ID NO: 7291 - DNA, 176 bp, Gossypium hirsutum
  Clone ID: uC-gsronu33B096f10b1
aaaaattctccaagccaaaccatttctccgctggcatttgcttacttcaaaaaaaaaattcaaattgaagaatgcctgtatttgcttcaagagttgggttcaggagacacgactacaagaatagatcaaaggaaccaaaccatgaccgtaaagacaaattgtccgaagtgtctaag

SEQ ID NO: 7292 - DNA, 84 bp, Gossypium hirsutum
  Clone ID: uC-gsronu33B096g03b1
tacgcagccgcgtagtctgaaaccccaaggagaaccccgaaggagaaggggggtatataagggaggtagccgggtatacccccc

SEQ ID NO: 7293 - DNA, 72 bp, Gossypium hirsutum
  Clone ID: uC-gsronu33B096g10b1
cggactcgtacccccacgcgaacgcacacgaatccggggacttttttaaaacaacttatccccaacttcccc

SEQ ID NO: 7294 - DNA, 150 bp, Gossypium hirsutum
  Clone ID: uC-gsronu33B098a01b1
aaccggatcgccccctggagcggcgcacaaagcgcgccgcaccggggggtcctccccaccggggcccccccccccacggcaccaggtacccccccctcccggggccccacaaccccccctgtcaatctccccctccctgtactcccaccc

SEQ ID NO: 7295 - DNA, 322 bp, Gossypium hirsutum
  Clone ID: uC-gsronu33B098a07b1
gttgtgtactggatgcctctttcggagggttgccgggggtggttatgacaccacctcgttcgattgaacaccaccctggttgctgcagctgctgcttttttggtcgtaacaagaagcattcctcaatggcacacagccctgaggaaaatcgtgctctgagaatgggtgattctgatgacgaggagatgaacctgtccctgcttccaaagaggttagggaactcaacatttctcattgattcacttccctggggccgagtttcaaggtcctccccttgcagatcattcagctggtgaagaatgggctcccccccgggtgctct

SEQ ID NO: 7296 - DNA, 544 bp, Gossypium hirsutum
  Clone ID: uC-gsronu33B098a11b1
gctatttactacaaaaagttactccctgcacttgggaggaattagttaaggaatgtggtggatataaatacagtttatggaggttttgctgcagctgttattgatgatcccctgtggaccatgaatgtggtgtcttcctacgctgccaacacactgcctctggtctacgatcggggccttattggaacttatcatgattggtaatttcaaatgcatttacatggcatctgaatcctagtcatgttgttcttttgatgtttctcatgggtgtctaatctgttgcatcttttccaggtgtgaagcattttcaacatatcctcgaacatatgatctccttcaccttgacggcctcttcacagctgagagccacaggtagatattgggtgcatttcccatttgatgttctttgtttgttctgggttgtgaacataattgcatgtttggttttggcaggtgtgacatgaagtatgtgctgttggagatggaccgaattctgcgacccatggggtacgctttattacgggaaacaaggctttttattgat

SEQ ID NO: 7297 - DNA, 546 bp, Gossypium hirsutum
  unsure (1)..(546): unsure at all n locations
  Clone ID: uC-gsronu33B098b01b1
aagcttgtgccaaagcaaaaacagntagaggggtttttttgacatcatctgccgtagctgggtctatcaacacactggatgggacagatctcgtcatgacagagaaagactggaccgatatcgagttcttatcatcagcaaagccaccaacttgggggtaccctgcatccaagacgttggctgaaaaggcagcttggaaatttgctgaagaaaacaacattgatctcattacagttatcccttctctcatgactggtccttcccttaccccaattgaccccagcagcataggccttgctacatctttgatttcaggcaatgaattcctcataaatgctttgaaaggaatgcagatgctgtcaggttcgatctctatcacacatgtggaagacgaatgccgagcccatgtttttctggctgaaaaagaatctgcatcgggtcgatatatatgcagtgctgtcaataccagtgtgccagaactagcaaagttcctcaacaaaagataccctgacttcaaagtccctaccgattttggagatttcccct

SEQ ID NO: 7298 - DNA, 542 bp, Gossypium hirsutum
  unsure (1)..(542): unsure at all n locations
  Clone ID: uC-gsronu33B098b11b1
ctataggtatgctggacgcccgtggtggtgccgttccattactcccgggacgtcccacgcctccgctttcttttccgcccacacgcgcgcataaacaannggtacttttataaaacttttgcgtgttttaaacatcccgtttgtgcacatgctaaatcatcaaaataacatcctgatgtatgagcatctaattgcttagcgttgctattggtgacatgctcatgcctctagctaactttatttagatgaagatgctaggtccccttcctatcttaattaatggaagcttgctcttaatttcattttttgagtataatctcaattttcagacataattaaaagaaatgtatcaaagttatttactgcctgtaatgatgctccacagatgggaccatagcgacatatttgggctttgcacatcaatggctattattcttgacttggctttattttgaattgcacactaattttatcttgcattgcccttataatttccagaatacccaggcgaggtttcttcccaggctttgcaccctgttggc

SEQ ID NO: 7299 - DNA, 557 bp, Gossypium hirsutum
  Clone ID: uC-gsronu33B098c01b1
cccactcgttcggacgtcgatgatttcttcaacttgggtcccattttaccaggtttcgagtctaaccaaatggatgtttttgaatttgactcgaaacctcaatttatccatctaaccgctcctaagccctttgaatttgcacctcaaatcactgaactttcagctggtaaacctccagctccttcgaattcgagttccagctctcataatcgaaaaccgtcgctcaaaatatcgttaccgcataaagtagagtggattcagttccgcaaaccgtattcgactaaggcacagccgacgaattcaaattccgaagacaaaaataagcattacagaggtgtccgacagagaccgtgggggaagtttgcggccgagatccgagatccgaaccgaagaggttcacggatctggttgggaacctttgataccgcaatagaagccgcaaaggcttacgaccgagccgcttttaagctacgtggctcgaaagcgattcttaacttccctctagaaagccggaagcttgacgtaaccgccgtcgacggagagaggaaacggagcac

SEQ ID NO: 7300 - DNA, 481 bp, Gossypium hirsutum
  unsure (1)..(481): unsure at all n locations
  Clone ID: uC-gsronu33B098c02b1
gttgttaaatcaaagcgatcaatatggcgactgagggcgatcattgatttcttctgggcaatcatcaattttatcggagtgtttttttcgaccatgttctcgatggaaaagtcagatgcctatagaaaaagctctggttcaagcaagaaatgggatggtggtccaggaggaccaggaagtggaccgtatggtggtggtggcagcccacgtcgaccatcacgtggactagacaatgttcgaggaattgatcatagttcccttcctgcttgcggctcttgctgtggtggctagttcccaaacattgttgtgtctaattcatttttattttgtgcaagaaatttataagatgttagtgtcaatagactgcctgtgaaataaaaaaaaactttagaaactctttaaacccttttatttttctctctctcgaattttgacattttttattgtcataaattaaaaattgttgattataaacnaaaaa

SEQ ID NO: 7301 - DNA, 615 bp, Gossypium hirsutum
  Clone ID: uC-gsronu33B098c03b1
ccctctcgttcgtaacaaaaaatataattaataaaaagggggggattttttaaaatattggtgtgttttttaaacagaaaatacaagtttcaggggttagtatattttttagtgtttagttggcctccttctttgttggccttttttttcctctcctttcttggctgctcttttgcgtttctcggccccttttttgtgccttttctcgccggtttctttttctgtttttttttttttagtcctgtggcttgcgttctttttcttgttttttgcaccctgcttttttcttggtgccgtgctctgtattgtttccttttccctgtttttttgttcctttttctccttctctctgtttggttcatttgtctttcctctcttttccctcttctcctttcttccttttcttttttctctttttttcctttttgtctcctctcctctcttttttttttccttctttttctttccgccttctttgttctttgtttttcctctctattctttctctgtctgtcttattttctttttctcgctttttttttttttctttcttttccctttgtgtcttcctttttctattttttctctcttcttccctcttttctttcttctttt

SEQ ID NO: 7302 - DNA, 530 bp, Gossypium hirsutum
  Clone ID: uC-gsronu33B098c11b1
caaggaaaccttcccttgagagtatgggggaaaatttagaacatgggtgtcaatgctgagaataagtttccagccattgagttccgttcatcggatttgaagcgaggaaccgatggatggcgcaatttgtgcaaaaaggttcaagaggcttgtgagaaattcggttgttttgaggtggtttatgatacgatatcgacgaaagtccgagaagagagttttgggttgatgaaagaattggttgaggttccggtggaaaggaaacaaaagaacactagtcccatgccttatcatggctgggttggaccatgcgagcaagtttctttgttgtatgaaggtttcggaaattggaaatgccctccaactattgactctgttaaaagctttactcaacttatgtggcctgaaggtcacccacacttttgcgacactattcatactattgggacacatatggtggggccaaacaaatcaatctggctaatgctaattgatagctctggatttggagattacctattgaaggctaactt

SEQ ID NO: 7303 - DNA, 572 bp, Gossypium hirsutum
  Clone ID: uC-gsronu33B098d04b1
cccactcgtccgatctcttcaacgttcacaatgggcgcggttcacctactcaacttgctccatttcacgctctctttagttgtcattgccgtcaatggccacaatataacggccattctcgaaggttttccagattactctgtttacaatagtttcctcacccaaacaaagctggccgatgagattaacacccgagagaccatcacttgccttgtcctcaacaatggggctatgtctgccctcacatccaaacaccccctttccgtcgtcaaaaacatcctcagccttcacgttcttctggactactatgacccccaaaagctccacaaaatctctgatggcactaccctcaccaccacgctttaccaaactactggtaatgcccctggaaaccttggtttcgtcaacatcaccgacctccaaggtggcaaagtcggcttcggctccgcaattcctggctccaaactcgactcatcttacaccaagtctgttaagcagattccctacaatatctctatccttgagatcagcgctccgattatcgctccgggtatcttaacggctcccggccc

SEQ ID NO: 7304 - DNA, 364 bp, Gossypium hirsutum
  Clone ID: uC-gsronu33B098d09b1
gttcattcggtgtgtctgtctctcgcaaccgagagggggcctttgttatacaccatggtctcccaagttcttcctcagccatttaacccagtgaagaatcgtgggttctctgcatttctgtctcgtggcccttctccattagctacttccaaggtttcggtttctgggtttcattcaaaattccctgttgggtcgagtttcagttgtttcgctcgaaggggtttcgttgtgagggcagaatctaaccctgaaggtgaaggtgaagctgaagctgaaagacatgaaaatggtgttgtagaacccaaaacgaaagctgaaactgaagctgaatgcgaaggtgaaggcgaaggttaagatccggctg

SEQ ID NO: 7305 - DNA, 352 bp, Gossypium hirsutum
  Clone ID: uC-gsronu33B098d11b1
cttactcgtccgagatcgcgagggccgccctttttgttttttttataaaatttgtttgtccaaagagcattgtgtttgcttttgtgttaaaaaaaaaaaaaaaaaaaaaaaaaaaaaaaaaaaaaataaaataataaaaaaaaaaaactaaaaataaaaaaaaaaaaaacaataaaaaaataaaaaaaaaaaaaaaaaaaaggacctgggggggggggggcttttaaaaggaaaaaaatttaagaaccgatcaaacagaacttaaaatttttaaaatgggtaaacaaaatacaattaaggggccgatttttaaaaaagaaggcactggaaaaaccctggtattacaaaattt

SEQ ID NO: 7306 - DNA, 325 bp, Gossypium hirsutum
  Clone ID: uC-gsronu33B098e04b1
ggcaaggaactcgagaaggatctctcaagttcttgaagaacggtgatgcaggtagggtaattatgattcccaccgagacccatggtgggtgagactttctccgaatacccaccactcggacgttttgctgtccgggacatgcgccagaccgttgctgtcggtgtcatcaagagtggtgagaagaaggacccaactggtgctaacgtcaccaaatctgttggcaagaagatctgagagattattgcagagattattatatcagtttttattacagctttggacatttatcttaactctgggctttaaaccttcctttttgtgtgac

SEQ ID NO: 7307 - DNA, 561 bp, Gossypium hirsutum
  Clone ID: uC-gsronu33B098e06b1
cccactcgtccgggaagatgcagaagctctgattcgaaagatggacctcgaagcaagaagtttgcagccaaatgttaaggctgtacttcttgctaagttaagggaatataaatcagatctaaacaatctgaaaagtgaagttaaaagaatcgcatctggtaatttgaatgcggctgctcgagacgagttgttagagtccggcatggctgatactctcacggcatcagctgatcaaagatcaagattaatgatgactacagagcggttgaatcagagcagtgacagaattaaggacagcaggagaaccatgttagaaacagaagagcttggggtttcaatccttcaggatttgcattcacagcgacaggctctcttacatgccaataacacgctccatggagtagatgacaacatcggcaagagcaagaaaattttgacagctatttctaggaggatgagcaggaacaagtggatcattggcaccattatcgccatccttatcattgcgatcgctcttgttttggacttcacacttgctaaataggccaatatttgtattct

SEQ ID NO: 7308 - DNA, 532 bp, Gossypium hirsutum
  Clone ID: uC-gsronu33B098e07b1
cttttatctacatttcgctcccagaaattatagtgaaagcatagacaatgagaggaacattgatgttgacttggattctgatcatctgcctctcccaagtagcagtgaagagccaatactactcgaagacccgaccatatcatcccaggccagttaaggtcaccaatcttcacgtttttatgcacaaaactgcgggcattacagcagtccaggtagcccaagctaacatcacaagcaacgataataattcatcagtgccatttgcctccctagttgcctttaatgatcccctcaggactggtcctgagcctgactcgaaggtgattggaaatgttcagggtattgcgctcctatccagaatgaatgcatcaagcacacaatacatagattttggatttaataccggtaggtttaatggcagctcaataagcgtattttcaaggggagaacctgagctgcagttgttcgaggaagaggaaacttcttttgttatcagggtttgttttttttacccttttcattcatttccctc

SEQ ID NO: 7309 - DNA, 200 bp, Gossypium hirsutum
  Clone ID: uC-gsronu33B098e10b1
atatacatcactaggattgagaaggatcaagagtgaatttttgtgagggggtaagggagaaaggacaaatacaaaagacagagagaaaatagactagtagtgaaaatgtcaaaatctaaatagcccaaaggtgagcgaatccgcaagtggcaaaatgagagtatttgcgagagaaaaagagataagaaaaaaataaaact

SEQ ID NO: 7310 - DNA, 482 bp, Gossypium hirsutum
  Clone ID: uC-gsronu33B098e11b1
cctactcgtccgaggaactgttaccttagaggatcatggacactttggtaactctcaggatacttgggaggaagttgatcccgatgagctttcatacgaggaactccttgcactcgctgaagtagttggaaccgagagcaggggcctttcagctgattcaattgcctccttgccttcactgatattcaaggcaggaaatagtcaaactggaaccaatgattcgtgcgtcatttgccgtgtagactacgaggatggtgactccttaacagcactttcttgcaaacattcatatcatcccgagtgcataaacaattggttgaaaataaacaaggtctgccctgtttgtagtgcccaggtctcgacctaatggcaacgagactgcttgttttttaatatgcagaatgtgtcttcccttttgtatgggaaagaaaatatttgggatcagtctctttagaaacttttgggtgaaaccacctttggaa

SEQ ID NO: 7311 - DNA, 411 bp, Gossypium hirsutum
  Clone ID: uC-gsronu33B098e12b1
attacacaagcttgatcacaagtcccttcctttgcgaaagatttttagctattgctctcgaagttgctcgtggaatggaatacattcattctcaaggagtcattcatcgtgatcttaagcctgaaaacatccttatcgacgaggaattccacttgaaaattgctgatttcggtatagcttgtgaggaggcacattgtgatctattagcagatgatccggggacttatcgatggatggcacctgagatgatcaaaaggaaaccgtatggacggaaagtggatgtttacagctttggactaatcttgtgggaaatggtagccggtacgatcccttacgaggatatgaatcctatccaagcttgatttgcagttgggaacaacaatttgagacctgtagtccccggagacctgt

SEQ ID NO: 7312 - DNA, 465 bp, Gossypium hirsutum
  Clone ID: uC-gsronu33B098f03b1
acaattggtagctttacgacaccgacgcgacggttttgacggctgttagcggattccgggataaccgtggtcgtcgcacttcctaatgaactactttcatccaccgctgctgatcagtcgtttgcagacaactgggttgaagcaaacataacaaagttttacccaaagacaaaaatcgaagccatagctgtcggtaacgaagtgtttgtcgatccggccaacacgaccaaatacctcgtaccggcgatgaagaacatccacgcttcgttagttaaatccaagcttgattccgccattaaaatctcttctccgatagctttcagtgctttaaaaacctcgtatccttcatcggccggttcgtttaagccggaatcgattgaaccggtgattaaacccatgttggattttttggtacaaactcgggccttaacttaactggtaatgctcacccttttttttgttatt

SEQ ID NO: 7313 - DNA, 105 bp, Gossypium hirsutum
  Clone ID: uC-gsronu33B098f08b1
cctactcgaacggaacatctgaccttctcattgagaggctgtttaaagacttcggagtgtatcagaacaacgccggattgtctcacaagaaaaactacactgccg

SEQ ID NO: 7314 - DNA, 486 bp, Gossypium hirsutum
  unsure (1)..(486): unsure at all n locations
  Clone ID: uC-gsronu33B098f09b1
aaaaaacaaagtaaaaagaaaacctagagaaattatcgctgttcggccgactcaagaatctgcgcagtcccaccaccactgcgatcggtggagaacgacgcgcgcaacccttgtctagagccttggcttaacgattgccggtctcagctccagaaatcctatcccacgcttcgatttcgacaaagtgaatatggatttcgatagcccattcataaaggtgaactctccttttcattttattttcttatgctcaaggattcatgcaaaaactgggaaatggagaggaaaaaaaattgaaaaaggaaacaaatctgggtctcacctttcgatttttttttgtgttttggatttcaaaatgtatattgtgcgtgtaacccattacaagtgattctctttaggcctttatgccgggagaagaagagaaaaaaaaatgaaaattaaatattccattttttttttctggnggtttcctggccctatttttgc

SEQ ID NO: 7315 - DNA, 481 bp, Gossypium hirsutum
  Clone ID: uC-gsronu33B098f10b1
gttattaaaaggaataagcttcgatttccgaatggggaaaataatggtgaagggacgccaaggagagcgagtcagactctatgtaagaggaactatcttgggttacaagaggtcaaaatcaaaccagtatccaaacacttcattgatccagattgagggagttaccactaaggaggaagtagcttggtatgccggcaagcgaatggcgtatatttacaaagctaaggtgaagaagaattgctcgcactatcgctgcatttggggaaaggttactagacctcacggtaatagtggtgtcgttcgtgctaagttcaagtctaatcttccccccaaatctatgggagatagagtccgagtcttcatgtaccccagcaatatataagtttgttaaatgcccggcgtttgatcgatgactcgagtgactctatcttttttcttcgtctgtcaaaatgttgagtgtttttgaggccattcttttttc

SEQ ID NO: 7316 - DNA, 107 bp, Gossypium hirsutum
  Clone ID: uC-gsronu33B098f12b1
aatattaaaacaaaaaaaaaaaaaaaaaaaaaagaaaaaaatttaaaaaaaaaaatgggggaattaaaacaacaaaaaaaaaaaaaaaaaaacaaaaaaaacaacgg

SEQ ID NO: 7317 - DNA, 504 bp, Gossypium hirsutum
  Clone ID: uC-gsronu33B098g04b1
gcttttctatgcacccatcagccaagtcgaccgtgcaggggggtttaccgaggaccatcttaacaaagacaagacatgccagttcaagatcgtcaagaaaccctacaccaacgtcaacgaaacccttgaatggaccatcgaacgagacgtgccgacggcgacgttctttatccgagcctacgctttggactccgacgaccacgaggtggcgtacggtcaaaacaccgacgccgagaagaaaaccaatctgtttgaaatccaagccatcaccggccgccatgtttcgctcgatatagcgtcggtttgtttcagtgctttctccgttgtgtcgtgtggggttcttctttatggagaaaagaaaggcaaggaaatctcagcaggagtgggatatattatgggtttaagaaccctaattaaacctttgaaaggatttttatagtaatggggttgatctgcatggttatttactttttttggggtcttaattctagatgatgggagata

SEQ ID NO: 7318 - DNA, 386 bp, Gossypium hirsutum
  Clone ID: uC-gsronu33B098g06b1
ggtgttctaaatgcagactctaatatgtacataatataaggtgattgtagacgggataaaggcatattagctgaaaaaaaaaaaaaaaaaaaaaaaaaaaaaaaaaaaaaaaaaacagaaaaaaaaaaaagaaaaaaagaaaataaaaggaaaaaagagaaagaacagcataagaatagagaaatgaaaattaaaagaaatgaaaactaaagggggccggcttatacagagaaaaccctggagtccccagaaaataatagcactgatgcaaaattcccgaggccccaacaggaataagagtaaacagggctaaaacggacgtccatcagaaaagcagggcaaccccaaatggaaacgggagagcgccctgaacagttttatgaagg

SEQ ID NO: 7319 - DNA, 371 bp, Gossypium hirsutum
  Clone ID: uC-gsronu33B098g07b1
atcatagtgtcctgtacatactcaagaatgcatgttgagattgagtagcagctgactgttctttattttccaggagcatttgctaatagtgtgtgaacttctcaaggcaaacttatacgagtttcataaatttaatagggaatcaggtggagaagtctacttcacaatgccaagattgcagtcaattaccattcagtgtttggaggctcttcagtttttgcacagccttggcctagtacattgtgatctgaaaccggaaaatatcttagtgaaaagctatagtagatgtgaggtgaaggctcttgatcttggtatgcagttgttttgtgattcattatttatgatcccttgttccaattctttgtcctatt

SEQ ID NO: 7320 - DNA, 551 bp, Gossypium hirsutum
  Clone ID: uC-gsronu33B098g09b1
cttacttcgtgggcggacgcgtgggttctactacggggacattttgtagaggcaataaccctactgcattcctgatagccagtctcaacatcacccaggacccggcctcatatggcaccttgtttgcaatggatgatcctctaactacagagtttgaactaacatccacgctcgtcggaaatgcccaagggctctacttagcattgagtcgagaccttaccaagttttctgcagtcttttacgctgactttacgtttaccactggcaggtacaacggcagctccttcagtttattctcacgatttccccccacagatgttgttcctgcccctggcacaattcgtgaaatggcaatagtgggagggacaggtaaatttaggatggccacaggctttgccctcctgcgacccacttcttcaaacgacacggtcggggatgctcatgtcgaattcaatgttactttgtaccattattaaacccaattacaaatattgaatccaacgaataagaacaataaaatgatgctttcctaaagatatatttaatgtatt

SEQ ID NO: 7321 - DNA, 458 bp, Gossypium hirsutum
  unsure (1)..(458): unsure at all n locations
  Clone ID: uC-gsronu33B098g12b1
ctcccaagtttcaccaaaagaaaccgnggtnattataaaagcctttgttgcttacatactaaggtaacatcacgtctacctcttcattcatctcagaccaatccgattcgccactatgtcaatcaaaaccaaccatttccatcctctatttctatttctgaccataagcttcctaatcgccactgttgcataccccatcgacgctttggaatcaaggaagcttgacgagagcacagcaccaggtgatcaaggcatcaagtgtaccccatcatgcgtacaaagtgctccaccaccgtcgccgtctccaccaagccctacaccaccatcaccgtccgctcttccgccacctacaccaaaaaaagtcgccatcccaatactgtccaccaccacctagcccgccttcctttatctacataactgggccaccggggaacctgtaccctattgaccaaaatttc

SEQ ID NO: 7322 - DNA, 81 bp, Gossypium hirsutum
  unsure (1)..(81): unsure at all n locations
  Clone ID: uC-gsronu33B098h03b1
gatagtgtattttatagccgcgtgatttctcaccaataaggcagggtattattataagnttccaccgtggaaaaaaaaaca

SEQ ID NO: 7323 - DNA, 61 bp, Gossypium hirsutum
  Clone ID: uC-gsronu33B098h07b1
cccactcgtccgcccacgcgtccggtgacaataggaaggttggcctctccagttttaattg

SEQ ID NO: 7324 - DNA, 581 bp, Gossypium hirsutum
  Clone ID: uC-gsronu33B098h08b1
gttgatgggcaacttgagttcaaggctgtcctctgtgggcccaagagggctccttttgatctctttgacacaaggaagaagcccaacaacattaagctctatgtgagacgtgtctttatcatggacaactgcgaggagttgattcctgaattcctcagctttgttaagggtattgtcgactcagaggaccttcctttgaacatctcaagagaaatgttgcagcaaaacaagatcttgaaggttatccgcaagaacttggtaaagaagtgcattgagctcttctttgaaatagcagagaacaaggaagattacaacaagttttatgaggcattctcaaagaacctcaagcttggtatccatgaggactctcagaacaggactaaaattgccgaattgctccgctaccactccaccaagagtggtgatgagatgaccagcttgaaggactatgtgaccagaatgaaggagggtcagaatgatatctactacatcactggtgagagtaaaaaggctgttgagaactctcccttccttgagaagctgaagaaagaaggttatgaggtcctttacatgggtgatgc

SEQ ID NO: 7325 - DNA, 440 bp, Gossypium hirsutum
  Clone ID: uC-gsronu33B099c03b1
ctcatttaaaatcggacatgcaacctttcctcacccagggacttatatgcagggttctggaaaactaggacttgggattagaaacgatgttgctcgtagtaatttctttgtagattcaagtacttgttacgaacttgtagcagctgagtatcttggagatggagttgtttctgagccaggttggttgcagtttatgagaaaatggggtccaactattgtccatgatattagtattttgcctttggtgcttcggtattccatggcaaacattttcatcaagcttccagttgagctctatggaagggaaggccctactgggcctaaggagaagaacaattgggtaggcgatgaaagaggctagttttccggtggcctccgatctcaatcaactcttgttgttacctatctgttgctgctgtgttcatcataagttcatagca

SEQ ID NO: 7326 - DNA, 366 bp, Gossypium hirsutum
  Clone ID: uC-gsronu33B099d09b1
tgggtttatgcatagaaacaacaatagcattattgagcttatagattttgttgtcttttttctcttttcctgactaaataagaagaaaaatatcagtcatgtatttataaattattaaatttacaatgtgttgatcgtaatctgctagtaaatggtaaaatgcttctctattctgaattgtccagactcaggtttgattgttagatatggagtgtctgagatgggtacttcaggaaaattgaagaatcgaagtaatattaggtggccagcatggccttaatacgaacctgcagtgatgttgagaagcgaggaacaagaacaagatttgcagaaaaggagaattatttgctgcaaatactacgatga

SEQ ID NO: 7327 - DNA, 431 bp, Gossypium hirsutum
  Clone ID: uC-gsronu33B100b05b1
cccacttcgtccgctaaaaaaaaaaaaaaaaaaaaaaaaaaaaataaaaaaatttaaaaaaaaaaaccccaaaaatacaaaaaaaaagaaacataaaaaaaatcaactcttatgggggcgggccctctttggggccccaggctttcctccgcgggcttgcggcagtattgcttttcttttggggcccccatatttccaattctggggcccccgtttttccccgtttggcctgggaaaccccgggggtctcccctttttatgcccttgcatcacttcccccttttccctggcgttgtcatggttagggggccccccccccttgctcttcctctttttttccactcccttgttgtaatttgttcccccctcccctacgtcccttttccttctctctctctgcttttactttactctctctctattcctccctt

SEQ ID NO: 7328 - DNA, 75 bp, Gossypium hirsutum
  Clone ID: uC-gsronu33B100d08b1
gtgctcggcaacagcaaagatcacgggagtaaactagaaaaagaaactgtcctcaggctgcaattgccgatctaa

SEQ ID NO: 7329 - DNA, 546 bp, Gossypium hirsutum
  Clone ID: uC-gsronu33B100e05b1
aaattttaaaaatttaaaaaaaaaaaaaaaaaaaaaaaaaaaaaatagaaaataataaatatagggacaaccaataaaagaaggacacaagattcctaacacgggcgggcccctctttgggtcccatgtttccctccccttgcttgctaccctgtgctttttttttaggggcccctactggcatttccctggccgtcccctcccaccgtggtttgtgggaaacccctgtttttccccatctttttttttttgcttgtcccccccctttcgcccgttgcctcttttgcgaagggtccctgcccctttggccctccccctcgtttgtcccccttgattggctatgggtcctcccctttttgcggtctcttctggcgcggggggggtgggtgtctccttctttcctttcctttttcctttttctatccttacccccgtctcctccttcttttcccttctcttcttcgctcttcttctctatttcctccttttgttcttcttctgttccttcctcttgttttttcttctttctttttcctttcccttttc

SEQ ID NO: 7330 - DNA, 107 bp, Gossypium hirsutum
  Clone ID: uC-gsronu33B100f02b1
attgtttgcttgtcgtaagccaatggtttggtgtattgccacggagtatgctaagggaggctcagttcgacagttcttaacacggaggcagaaccttgctgtgccat

SEQ ID NO: 7331 - DNA, 210 bp, Gossypium hirsutum
  Clone ID: uC-gsronu33B101g02b1
tttcactcgtccgcccacgcgtccgggcatgctcgatgtttgcacataccaacccattacatttagatgtgtttcagagtgtggcgcgatttgaggctgaagtggttgctatgacagcagatctacttggctgtaaagagaaggcttttggaggacaagtttgtggaaacattacatcaggaggaacttgtgtgcatattgttagtagtg

SEQ ID NO: 7332 - DNA, 581 bp, Gossypium hirsutum
  Clone ID: uC-gsronu33B101g11b1
tcgtttaaatctaccattgcaagcgcttcccaggatgggaaagtaattatatggacagtggccaaggaaggggatcagtgttattttttatattttttttattttttttttcttttttctttttttatttttttcattttttccttattcttatttttgtttttcttatatttttctttcattttttctttttattcttactttttatttttttttttttttttattttattttcttcttctttcattttattattttctatctctatctattttttttttttatatttttttcttttcttcttctttttttatcatctttattttttcattttcttttttcttcttttctatcctttcttttttctttttctattttctttattttttctttttattctttcttttactttttctttttttcttacttatctcttttttttttttctatttatttttatttactttttttcttttttttatttttatattttctttatctttttttattatttcttctttaaatcttttttatttttttttattatatatttttattttcttcttttttttcttttattc

SEQ ID NO: 7333 - DNA, 312 bp, Gossypium hirsutum
  unsure (1)..(312): unsure at all n locations
  Clone ID: uC-gsronu33B103a10b1
tgtgaactcaactaatggcaacaatccgtctaatccacctgaaaagaaaattccgaacaaaaataaataaaaagtaaacattttattgcctctaaaaaaaaggagacattttatcattgccagctacgttcttagagctcagtgcaagaaagagaacaattgggatgaattttttatactactaataacaataaggaattaataaaaagaaaagtataaacttcagaatttcctttccaatcaattttccattattataccggtgaccaaacatcngatnaaaaaaaaaaaaaaataaataaaaaaaaataa

SEQ ID NO: 7334 - DNA, 528 bp, Gossypium hirsutum
  Clone ID: uC-gsronu33B103d10b1
tccactcgtccgcccacgcgtccgcccacgcgtccggtacttttaactctaagccaagaaagcaagtcactagggttttaagagaagatcaaaatggcgtcaaaaagatcagcttccatggccctctttttggcactcaacattctcttcttttccctggtcagtgcttgtggttcttgctattcacccacccctaaaccaaagccaaacccaaaccccaaccccacccccactccatcttcacaaggcaaatgccctagagatgcccttaaattaggtgtatgtgctaatgtgcttggcttagccaagcccgtcattggttcacccccagtgatgccatgctgttcccttcttgatggcctcgtcgatctcgaagctgctgtttgcctttgcaccgctatcaaagctaacatcttaagcatcaaccttaacattccagtttcccttagcttgctcctcaacgtttgctcaaagaatgttccttccaacttccaatgctaagtcttcactgttcccaacattctttct

SEQ ID NO: 7335 - DNA, 527 bp, Gossypium hirsutum
  Clone ID: uC-gsronu33B103e07b1
aaagttcacggcaaaaccctcgagatattccacgatgatcattcaagtcaagctacatcaatcaaacagagagcagaagaaacattccagcagacatatatggattatgagccgagtgggacgactccaatacgaagcgaacaagatgtaccgaccaaggggactattgaatcattacgagccatgccaatggaagccttggtcgaagaatttcgagaaaacaactcgtacgagtcatttgaaccaaagttgttaaagtcatcagttgtaccaacacgctctccccttaccgaaatcaactaaaatccagtgtgctctctcttacattcataatattctttgcaaaaattatatttgtattttgtatgattaaggccacacctgttagtcatcattcatcatcatcattggatgattgtaaggttgcagccagtaaatggaggtgaaaggtggtatactaccagttaccagaggccatacttggtaagaataatggaaaaaaaaagggtaataagtctttttctttc

SEQ ID NO: 7336 - DNA, 286 bp, Gossypium hirsutum
  Clone ID: uC-gsronu33B103f04b1
gagaatctctctgctagggtttcttttccatgccgccgccgccaccgctcaagccattccacggcctccgacgacgccccgacctccgatcgcgacggaggtggaccgattcgacggtttcggctaaagattcagccaactggggatgtacgtgggacacgtacgtgcgcaaagggtggtggtgcagggctgatgtgcggcggctagggttgaaggttgtatgctgctagggttgctgctggaatttagttagtgggctgtttagtttgggttaggtgtcgtgcca

SEQ ID NO: 7337 - DNA, 323 bp, Gossypium hirsutum
  Clone ID: uC-gsronu33B103h07b1
tccactcgtccggtttccaggtctgccgaaattggcttgggttttgggccatcgggctatcaaaaattgggtttttcgggtttggttttaattgtaaaatgggttaaatgtgatttgggctatccgggcttttgtaaatggattttaataattttggacttgttaatttttgggttttattattactgttgggttttctaacgggccgggcaaatttgggcccgtacagtatttgattgctgctataatatttttttatgtaaaataaacaaaagaatttaacgaaattatctagaaatattatgcggacatgttgtaagcct

SEQ ID NO: 7338 - DNA, 460 bp, Gossypium hirsutum
  Clone ID: uC-gsronu33B104a03b1
cccacgcgtccgcggacgcgtggggtcaacatattcaaggatgatgttgttatccagtttattaatcccaaagttcaagcttctattgctgcgaacacctgggttgttagtggctctcctcagacatagaaattgcaagatattctccctggaatcatcaaccagttgggacctgataacttggacaacttgaggaaattggcagagcaattccagaagcaggcacctggtgctggtgatggtaccggtactggtgcagttgtcactcaggaagaggatgatgaggaggtaccagatcttgtacctggtgagacttttgaagctgcagcagaagaagggcaagatactgctaaatagtgttttctctctaattttattgtgatatgttctggtggttctttggtgcgcttaccttgtactcttaatggcttggttcagagtaaaccattttgctttctag

SEQ ID NO: 7339 - DNA, 514 bp, Gossypium hirsutum
  Clone ID: uC-gsronu33B104a07b1
cccacgcgtccgctttgagtatccatacaataatgcgctacatcatcatgtggaaagtataatattatcttgtctggaaagcaagaatgatgcaatagtcgaccatcttcttcaagaatgtgatttgatcaggaaattgatccaaactgacaaatatccatttctttctggtgacaataatcagccaactttacctgctgctggaaaacatgcaccacgagcgggaaacatcggtcacattacacgtatctcaaataaacttgtacagttaggaggcagtaatagctgcattcagacacgtctacagggaaatagcgaatggaatgagtggctagctaatgttctgcaagaacgcaatgcagttgaaaatgtttatcgatgggcgtgtggacgcccaacagcattgcaagacagaataagcgatgaagatgatcttcttgatagagattatgatgttgcgattttggcaaataccctaagccaggcttttgggtacaaatggcatgatgataat

SEQ ID NO: 7340 - DNA, 541 bp, Gossypium hirsutum
  Clone ID: uC-gsronu33B104a09b1
gcaaccaatacccgaacagtagatcacccttttcttttaatcattttgcttttacttacacatgacttcaaccacgctctccacatctccacctctccttccaaggccgtccaccgaacctactcaaccccccgtttccaatgacccgccatcctttacccccatccatgatgcgtctgatatcaaccaaatagagttactctccgtgtcttggaaccaggattatggctgctttgctgctggcacctcccaagatttccgcatttataattgccaaccctttaaggaaaccttcaggcgcaatctcaaaaccggtggtttcaaaattgttgaaatgcttttccgctgcaacatcttggcacttgtcggtggggaatccaattcccactatcctccaaacaaagttataatatgggatgatcatcaaagtcgctgcattggtgaatttgcatttaggtctgaggctcgagctgtcacattaagacgagatcgcattgtgtggttctggagcacaagatatatgtctaccgttttatggatc

SEQ ID NO: 7341 - DNA, 511 bp, Gossypium hirsutum
  Clone ID: uC-gsronu33B104a12b1
tttctctctcttttttcaaccctaaccctacctcaccaaccaggattcaacatgaagggaggaaaatctaagtcagatactaagagtgccaagctatccgtgaaatccaaagctggaaagaaatcggggaaggctgccaaggatccaaacaagccaaagaggcctgctagtgctttcttcgttttcatggaggagttccgtgagcaatacaagaaggatcaccctaaaaacaaatccgttgccgctgtcggcaaagctggtggagataaatggaagagcttgtctgaagctgaaaaagcaccttatgtagccaaggcagaaaagcgaaaggtcgagtatgaaaagaacatgaaggcctacaataagagacaggctgagggtcctaaagacgaagatgttgagtctgacaaatcagtgtctgaggtgaatgatgaggatgatgatgaagaaggcagcggagacgaagaagatgatgagtaggaaggtccgggtggatagcataatcaatgta

SEQ ID NO: 7342 - DNA, 483 bp, Gossypium hirsutum
  Clone ID: uC-gsronu33B104b03b1
cccacgcgttcgcagggtttaaatccttttaatgctgatgatacccaagcatctgcagcaggaactggcattggttcctcaacccatagcacacctattcagctctcttcatctgcatcatctccatcctttggattgggtgggaatgcaaccttctcctctggcacttcaatttttgggtcatcagcatcagtggctaaaccttttagttcaggtgcaagttttggaacaagttcttcctcttcagaaactaactctctgagctctagcagtggcattgctgctggcgcatttggttccaattggcaagcccccaagacactcacatttgggttatcatcgggattttcctttggatcatcaacttctgttagtgctcctagcagcgcacctactatctttgggtcatccaccggtgcctcctcaagttccatattttcattcacttcggctgcagctgctactccatcacagccctgtgtt

SEQ ID NO: 7343 - DNA, 430 bp, Gossypium hirsutum
  Clone ID: uC-gsronu33B104b04b1
gggaaaggcggcacatagagtcaaaccaaccgcttagttctcaagaggtaccacggcccaatcaagcaccggtaacggcaccgttacaaacacaaacggatacgaacgcccatggtaatgaacccgaaaggagagctttagaaagtgggaatgccaattaagtttaaaacatctataaggtgtaaaaaatggtgttcaatgaaagttttctgttgtacatataccatctcattgtgtagagatgctttacatgcttgtctattgttgattttattaaacgttacttggggaaaaagcttttttacttaaaaaagtaaaaataaaaaaaaaaaaaaaaaaaaaaaaatccctctaatattttctgattcttttttcttctttttttttctttctctttattattatttttttcctttaatctactccttct

SEQ ID NO: 7344 - DNA, 560 bp, Gossypium hirsutum
  unsure (1)..(560): unsure at all n locations
  Clone ID: uC-gsronu33B104b11b1
cccacgcgtccgagctgggatccgaaccttgttaatccttgtacttggtttcacatcacttgtaaccaaaataatcgagtcactcgagtagatttaggtaattctaacctgtctggacatttggtacctgagcttgggaagcttgagcatttgcagtatctggagctttacaaaaataagatccagggaaccatcccaactgaacttgggaacttgaagagcctcattagtttggacctatataacaacaacatctcagggaccattcctccttcactagggaaattgaagtctcttgtatttttacggcttaatgacaacaaattaactggaccaatccctagggaacttgccggtatttcaagcctcaaagttgttgatgtctcaaacaatgacttgtgtggaacaattcctaccagtggaccatntgagcacattcctttgaacaactttgagaaaaaccctcgactggaaggtcctgagctgctggngcttgcangctatgacacacactgctcgtaaaggacatgttgacgctataaagctccgaatagatatga

SEQ ID NO: 7345 - DNA, 375 bp, Gossypium hirsutum
  Clone ID: uC-gsronu33B104b12b1
cccacgcgtccgcgggattacccgctgagtttaagcatatcaataagcggaggaaaagaaacttaccaggattcccctagtaacggcgagcgaaccgggaaaagcccagcttgagaatcggtcgccatcggcgtccgaattgtagtctggagaagcgtcctcagcgacggaccgggcccaagtcccctggaaaggggcgccggagagggtgagagccccgtcgtgcccggaccctgtcgcaccaagaggcgctgtctacgagtcgggttgtttgggaatgcagccctaatcgggcggtaaattccgtccaaggctaaatacgggcgagagaccgatagcgaacaagtaccgcgagggaaagatgaaaagcagttg

SEQ ID NO: 7346 - DNA, 268 bp, Gossypium hirsutum
  Clone ID: uC-gsronu33B104c02b1
cccacgtttccgcggacaggtagttgaaggcatggatgtggttaaagcgattgagaaggtggggtctagcggtgggaggacttccaagcctgttgttattgctgactgtggacagctttgaaaaagggcttattgaattgtgtttccttcataatatctggtctttttaggctccttttttttatgctatgctgcttctatggctactgggttttggtgttttttaagaagctgcttgatgtagctttttcattaactgccataaatt

SEQ ID NO: 7347 - DNA, 236 bp, Gossypium hirsutum
  Clone ID: uC-gsronu33B104c07b1
ttttcgttcttgtatttttgttgaaccattttcatctacttgataaatgttattgagtttttagggattgaaatgatttgaattgcaaagagattgtttcttgctatctttgtggaataattagcacacaatgttttaggaaaaaaaaaaaaaaaaaaaaaaaaaaaaaaaaaaaaaaaaaaaaaaaaaacaaaaaaaaaaaaacaaaaaaaaaaaaaaaaaaaaataaggacccc

SEQ ID NO: 7348 - DNA, 522 bp, Gossypium hirsutum
  Clone ID: uC-gsronu33B104c11b1
cccacgcgtccggaaacaggtagcaaggttgtttgggccagctatattcgaggcatcaaagctaaaagttctgtttttaggagtggatgagaagaagcacccagggaagcttcccagaacttatacacttacacatagtgatataacatcgaaacttaccttagcgatctcacaaacaattaacaactctcaggtaaatctttttatctcatatttcttttgagttttttgtttttttattatttagaataaaaaaacaggggatttggggctttgattacagttgcagggttgggcgaacaaattatacagggacgaagtagtggctgaatggaagaaagtgaagggaaaaatgtcactacacgtccattgtcacataagcgggggccatttcctcttggacttgtgtgctagacttagatacttcatctcctgcaatgaactacccgtgggacggtttttgatcattcatttttttggtgatattctttaatatcattccttctgatttaaatcttctgg

SEQ ID NO: 7349 - DNA, 463 bp, Gossypium hirsutum
  Clone ID: uC-gsronu33B104d01b1
cccacgcgtccgcttctcactacttgtcctacacaggaattcagcaaagcgtttccaaaattttcgagtgtcgagcaagaacatctccaccagctttttattcaggtcattacctctttacatgggaatatagaggacgaatttgagtctttatgcaatgaaacacaggtaggagatgcccttgataccgtggagcaacttgtggaagaacaatctcttgaccatttgtcttcagataggactactgtaatggatgcagtgcacaatttttcagcagcaaagaaagctgagatccattacttaagaggcctgctggaaagggctgaagaacataatcggctcattcaagctcgggtggacctacttaggaataagacacaagaagtcccggacataaaagatgttattgggaagttgagaggtggaaatctcaagttccagggaacacaaaatgtggagcttt

SEQ ID NO: 7350 - DNA, 549 bp, Gossypium hirsutum
  Clone ID: uC-gsronu33B104e06b1
cccacgcgtccgaagcaaaagaaaagatccacacacacccatcaaaggatcaaaagttgcagagataagagaaacaaatactggagcttttttcatcttttgtctctcatcaaaagaaaagaaaatccttcctttcttattttcttttgtcttccttaaagctcataaaccaagttgagctgcttctggtttggagaatggtgtaaagaacaagtcttgcatggcgaaccatagagttggagagacaggtttgacagactcgggaccttcttccaatcaccaccaccaccaccataatattccttatgctgttcttcatggaatgaatgtcccccaaagttttatgcatcaacaagggcctgcttttgattttggagagcttgaagaagcaattgtgctgcaaggagttaaaattagaaacgatgaagctaaaccacctttattcacagcaggcagaccagcagctaccctggagatgttcccttcttggccaatgagatttcagccaaaccccaagaggatgttcaaaatcaggaggggaaagcactg

SEQ ID NO: 7351 - DNA, 498 bp, Gossypium hirsutum
  unsure (1)..(498): unsure at all n locations
  Clone ID: uC-gsronu33B104e08b1
cccacgcgtccgggggggtagcatgcatgcatgctccttaaccatgagcagtcaatcatgcttgttgatgagcctgttcggataattgattggctaaagagacttgctttgatatctacattgcgctctatgtctgttccgtgtttgaattgtgtaatactactggagttagaagcactgcggatcggactggaactgatttgttctgtagatgggtataaacatatttgctatagttttcatactctgtcagccatggtgcaagagattcttggaaaatattctacctggtgttgatgccattagttggtaaggaaaaattgacttgtcttttttcacttcaaatcactgttatgatcatttcttgttgtatttgttgttgacgtgtggtngttggggtgttatgtgctaagtcgttgtcgacattgcctgttcgttttttgcttctgtggttgggttggtatcgcttttatgttaatcctagcatctaaataaacg

SEQ ID NO: 7352 - DNA, 399 bp, Gossypium hirsutum
  Clone ID: uC-gsronu33B104e10b1
tctttgaatggaatttgcatatttacctatattctctgttcgtcgtaaaaaaaaaaaacaaaaaaaaaaaaaaaaaaaaaaaaaaaaaaaaaaaaaaaaaaaaaaaaaataaataaaaatatctttaaaataattaataaataataaaaaaaaaaattaaaataaaaaaaaaaaataaaaaaaaaaagggggtggcttttttaaaaaaccaaatttacctcccctttttttgcaacttataatttttttttttgggacccaaaattaaaataaatgggcgggcttttaaaaccctttaaatgggaaaaccccttgtttaccaaaattaaactctttggaaaaaaacccctttttacacattggtgttttataaaaaaaggccctaccttatttttcttt

SEQ ID NO: 7353 - DNA, 543 bp, Gossypium hirsutum
  Clone ID: uC-gsronu33B104f05b1
aagcggccaccaattcatgtacttgtaatatgcccaactcgagagcttgcgattcaagctgcttcagaagctaagaagttgctgaagtatcacccatctatcggtgttcaggttgtgattggaggtacaagacttgctctagagcaaaaaaacctgcaagcaaacccttgccagattcttgttgctacacctggaaggctcagagaccatcttgagaatactgctgggtttgcaacaaagctgatgggtgtgaaggtccttgtacttgatgaagcagatcgtttactagccatgggttttcgtaaagacatagaaaggataattgctgctgttccaaaacaaagacagacacttctattttctgcaacagttcctgaggaggtccatcaaatctgccacattgcacttagaagagatcatgaattcatcaatacggttcaagaaggcactgaggatacacatccactggtccgacaggtgcacatggttgctccactagatatgcagttttccctactgtatgtccttttgaaagaacatatt

SEQ ID NO: 7354 - DNA, 540 bp, Gossypium hirsutum
  Clone ID: uC-gsronu33B104f10b1
acctactctactatggagtgcgttgtatagtcaggagctaactttgggtcaagttgattttatctgttcaactcccatgccagatggtaaactgaactacaatgatctcatagatacgacttttaagatatttcaggagatttaccctggggaagaattctttccggagacatccttagagaatcctgagggtgatggtgatgcttctccggagacataaagatttactgaatgtaatataatctctacctaatggtgcatctaacaatccagctccttttccaatactgtggtcaagtgattggaggatgccgttatcaaatgatgtatttgaagtggtgaagaaaaaaggaaagggatttgagaggacattgtggtttacggattttgacttggtttcccatgtataaacttgtgttgtatccattctttactagttgtattttggtcggattctttgcttcttttacaggtctgatgtaacagtaaataaacaattctccccgcgaagtttgaaaaaagttatagcggcagttatga

SEQ ID NO: 7355 - DNA, 533 bp, Gossypium hirsutum
  Clone ID: uC-gsronu33B104g06b1
cgcagctcctctccctctatgccatttcagactcctttcactccgataacgacaaaacggagaggtctcccgacgaccctcacgatagtaagtcctcctttgcttatccttttcgttttgtttattattattttttaaaaggagaaagaaaagaagaagatagcaaaataataataaaaaaccagtaaaatcaaagaaaaatcgaaaaaaaaataaaatcaccttttgaaaaatattctttgtattctcaatattctctctgttttcgaatatattttacaccgaaaaaaatccctcccccccccttgttacagactttcatcagctttatatagccgattaaaactaaaaatctggaaaaaaaaatcaaaaaccccacttctttctgatatttgctgtgcttgtgtccccctttttcgcaggtttggtgaccgcggagtgcgcgcgacggccgcggagcgacaaacacggtgtgcgggcactgttgcggcgtgccgtggggagctgctgcgcctaggcttcttgctggtgtt

SEQ ID NO: 7356 - DNA, 72 bp, Gossypium hirsutum
  Clone ID: uC-gsronu33B104g08b1
gatcagctgaaaaaacaaattcaaataattaattaatattttttataaattaacttaccttaattaaaaaca

SEQ ID NO: 7357 - DNA, 435 bp, Gossypium hirsutum
  Clone ID: uC-gsronu33B104h04b1
gtgaagggcaagggtcttttgatttatcatgaattcgtaagacagagacctgtgtatactctcgacacaatctggtcaattttttcacctgcgattgtttgatgtttcaaagcggctcgttattttttgctcaagctatggctactcatcgctgctcttccatattttttcgcattggcaaggtgaaatggggactgcaacacaagcacatccgaggatttttgtgacgcgttgttgcatgcagttccaagagttttgtatataaatagaaattatatttgaatatatatattgcataaatggtggaaggaaaatgaataaatgaggaaattcgatacaattttgtttttgttccgttagaagaaaaaaaataaaagggtgtacattccatttaaaaaaaaaaaaaaccacaaaaaaaaacataatacctaaatt

SEQ ID NO: 7358 - DNA, 423 bp, Gossypium hirsutum
  Clone ID: uC-gsronu33B104h09b1
aaaaaaaaaaaaaaaaaaaaaaaaaaaaaaaaaaaaaaaaaaaaaaaaaaaaaaaaaaaaaaaaaaaaaaaaaaaaacaaaaataaaagacagggggggccgctttagaggaccccgggttccgtccccttgcttgccccccctttcccttttttttgggggcccctaattccttttccttggccgcccttttcccccttcggggcggggaaacccctgccgttcccccctttattccccttggggcgcccccccttttcgccggttggcgtaatacccctcgggcccgccccgtttgccttttcccaccggtggcgtcccttgtttggcgaaggggcccccccctttttgggccctttacccccctcttttggtggtgttcttcccggggggtgttttttttttccctcccttttccccccc

SEQ ID NO: 7359 - DNA, 407 bp, Gossypium hirsutum
  Clone ID: uC-gsronu33B106a05b2
cacagttcctcaagaaaatgaatcactctgacaacagtgaggaccctcagcttccaaccatcaagatccgtcatccctcctcccctcaccacccgtcctccgccgttacccctactcccaccgccggcgcccgccgtaagatcggtgtagccgtcgacctctacgacgaatcagctttcgccgtccgctgggctgtccaaaactacctccgacccggtgacgccgtcatcgttctccacgtctcacctacctccggactctatggagccgactggggcccactcccccacaccccacagagcgcggaaaccccggagtcccagaagcacatagaagacgaattcgatgccttcacggcttcaaaagtggcggatttggccagacccttgaaggattccggggtcccc

SEQ ID NO: 7360 - DNA, 563 bp, Gossypium hirsutum
  unsure (1)..(563): unsure at all n locations
  Clone ID: uC-gsronu33B106a06b2
cccactcgttcgcccacgcgtccgatccatggcggctaaccgcttcaactcccatctgggtttagctctagcctatctaatcttcctcatttcaatccccaaatctctatcagtccttgagcctcagcctgctcctccctctgtctgggatatccttcctaaattcggtctccccagtgggcttctaccaagcactgtcaccgattacgtcctccacgatgatgggaggttcatcgtcacgctggacagcccttgctacattcaattcgagtacttggtctactacgaaacgaccatcactggatcactgggttatggctccattaccgattcggaaggcattcaggtgcagcggatcttcttgtggttcgatgtgaatgagatcaaggtcgatttgccaccctccgactccatatatttccaagttggattcatcaacaaaaagctagacgttgaccagctcataaccatccattcttgccgtgatgaggttacgggctcttgtanatattcttcggaatcacttcttcagcttccaacgcctagaaacgaaattgaggagc

SEQ ID NO: 7361 - DNA, 480 bp, Gossypium hirsutum
  Clone ID: uC-gsronu33B106b01b2
cccatatttccttgttctttgtcttcaattttaaaaaacaaacaacttccatttttatttttattttattactaaattctacttattgaaaaaaattatttgtttttttttattatcttttatacgcaaatatatataaaaaatccatttacaaacatgaaaggtgaatatttagaatccaaaaatcagaaccccaataacatgttctcaaagctccaccaccaccagcaccaccctcatcaacatcaacatcaacatcaaccccaacaccaaactcaccctttttctcatcacttccaactctctcgtgattctcagactcccgactctgatgacactacccatacccctcccaaagatcttaccaccaaccacagcccttctctccccagtggtggtggcaacggcggtgcttctcgtggtggtgccaacagtggcgacggtgctagcatcgaaatcgttcgtagacccagaggtcgt

SEQ ID NO: 7362 - DNA, 561 bp, Gossypium hirsutum
  unsure (1)..(561): unsure at all n locations
  Clone ID: uC-gsronu33B106b04b2
gcccgtcatgtgaccgataagatgatgttcaatgcttctttcatatttcctcacaacacaccaactacaaaagaagcatattactacaggatgatttttgagaggtttttccctcagaactcggctagattgactgtccccggaggagctagtgtggcatgcagcacagctaaagctgttgagtgggacgctgcctggaaaaacaaccttgacccttcgggccgggctgccttgggggttcatctctctgcttatgacgcagagactcccctcagcaacaagccatccaaggttattgatagtataccacggatggactttcctggagttgccatacagagttaatgcctgcctactggaagacaacagaatgtgtgaattatttaattaaatgaggaggaactgttgcctggtccaatggatggaagtatttaataaaatgagtaggagctgtggcatgtccatcaaacttccgaatacatngttgtataatataggtgatatttacgagtaccaagagattctgtgatcatcgtatcatctttcgtatcatcagcctat

SEQ ID NO: 7363 - DNA, 567 bp, Gossypium hirsutum
  Clone ID: uC-gsronu33B106b10b2
cttttatagaagccaaagaaaaaaaaatatcccatctttatagtcgctctctttctcccaggttatttcaatctgctacattgggtacccaagcactaaactttctccctgggttcctctttagtaaggaatttggagttggtggtggtaaaaaatggagttttccagggcttctatgattagttgttttgcgttactcttgtgctcctccttggcatatggtgcctctagtcctccagctcctatggcaatgagtcccagcccgacaccgtcaccggcaccagcccctgcaccggaatatgtaaacctaacttatttgctctctgtggctggtccatttcacacattcctcaactaccttgaatccactaaagtcctggatactttccaaaaccaagccaacaacactgaccaaggcattacgattttcgtgccaaaagacagtgcctttaaagctcttaagaagccttcattatctaatctcactaacgaccaacttaaatcactcatccttttccatgccatgcccaaattctactctctcgccgacttcaacaagcttagtac

SEQ ID NO: 7364 - DNA, 507 bp, Gossypium hirsutum
  unsure (1)..(507): unsure at all n locations
  Clone ID: uC-gsronu33B106b12b2
ccgttctttgcgaaggaaggacgctttcagaggcgtggctcacgagaatccgagggccttctccccgtcggcttacgaattcttccaccccaaaacccaaaatcatgacaccaaatacccatgtgcagcctccaaatgctcaccattgcctgtagcagctgaagtggactctaacaaagcacttgaaaccaaagcattaccacaacagaaacccgggcatccactcggctggtggagtgtgcatagtttggttagacttgtggcttcggcatgggcggtttctatgtgattcaaacccgccgagttactgctacaactaatcaaccaaacactggtcagctcgatgcctgatagtgtactcttcaagcaccaaatctccattgtataaatacatataggcgaatgctctattagaattaagctgttcttcaatctttnttcttgcttatttatcattgaggatccctgctatcatggagtgtatttgattatgattcacttgtatat

SEQ ID NO: 7365 - DNA, 493 bp, Gossypium hirsutum
  Clone ID: uC-gsronu33B106c04b2
atttttgttagaatagcatcagcagcatcagcagcagcagcaggcctaaacgatcaaccaaccagaaaagagaaacaagatggtttcagggtcagggatctgcaccaagagagtggttgtggatgcaaggcatcacatgctaggaaggttggcttccattttggccaaggagttgttgaatggccaaaaagtagtggttgttcgatgcgaagagatttgtatgtcgggtggtttagtgaggcagaagatgaagtacatgaggttcttgaggaagcggatgaacactaagccttctcatggccccattcattttcgtgctcctgctaagatcctctggcgtaccattcgtggcatgattccccacaagaccaagcgtggggcagctgctcttgctcgattgaaggcttatgaggggattccagctccttatgataagacacagaggatggctattcctgatgctctcaaggttctgaggcttcagaaaggacac

SEQ ID NO: 7366 - DNA, 537 bp, Gossypium hirsutum
  unsure (1)..(537): unsure at all n locations
  Clone ID: uC-gsronu33B106c07b2
accaactcactgatgtcgtcctccctgaatcgaaagattggagggaagcagacattgtcagccctgttaaagaacaaggctcctgtggatcttgctggacattcagtaccactggggcactagaggctgcttatcatcaggcatttgggaaagggatctctctatcagagcagcagctagtggactgtgctggagcctttaataactttggttgtcacggagggttgccgtctcaagccttcgaatacatcaaatacaacggtggcctcgacactgaggaagcttacccttacactgctaaagatggtgaatgcaaattctcacctgaaaatgtgggtgtccaagtcattgactctgtcaacattaccttgggtgccgaagacgaattgaagcatgcagtcgcgttggtccggccggttagtgttgcgtttcaagttatcactagtttccggttttacaagactggngttttcaccagtgacaaatgtggtaccacttcccaggatgtgaaccatgccgttcttgcagttggatatg

SEQ ID NO: 7367 - DNA, 527 bp, Gossypium hirsutum
  unsure (1)..(527): unsure at all n locations
  Clone ID: uC-gsronu33B106d07b2
gtaaattctgcgcaagagaagagctggaaagctacctggtgacaccaccttgattttaaaagcatggtggcagtcacattccaaatggccttacccaacagtgagtgtgatgtatttctcaggtagttctgatcctcaaaatgtgttcttttcaacagttttctgataaagtgttgcttcaggaagaagacaaagcaagattagcacagaaaacaggattacagttgaagcagattaataattggtttataaaccaaagaaaaaggaattggcataataacccctccacttctctgaagagcaaacgtgagaagtaggctgctaatgatgtatatgtgtcttgatgaaaatgagcttttcacgagaacatttgtcgattttaatttggaaaagaagtatgcaggttaaaccagtgatgaagccttaatgtaagcaaaagacaagctctctgcatagcattaatatagctctgctagatggttctgtaatcattcggctcatgcttntctatgatgtacaagaacgac

SEQ ID NO: 7368 - DNA, 68 bp, Gossypium hirsutum
  Clone ID: uC-gsronu33B106d08b2
caaaacaaaaaaaaaaaaaaaaaaaaagaaaaatgtttaaaaaattttagtaaataaagaattcaaat

SEQ ID NO: 7369 - DNA, 110 bp, Gossypium hirsutum
  Clone ID: uC-gsronu33B106e01b2
accactcgtgcgcccacgcgtccgaaaaaaaaaaagaaaattattaaaaaaaaaattggagaacaagaaaagaaaaaaaaaaaggaataaagcatatataaaaaggaaaa

SEQ ID NO: 7370 - DNA, 52 bp, Gossypium hirsutum
  Clone ID: uC-gsronu33B106e05b2
aaaattattaaaaaaaaaaaaaaaaaaaaaaaaaaaaaggagaaaaataaaa

SEQ ID NO: 7371 - DNA, 510 bp, Gossypium hirsutum
  Clone ID: uC-gsronu33B106e12b2
gttgtttgaggacctttttagcggcctcaagccgggctcgatgttagccgaaggcagtgaaccagattacctgttggaagctgtggttggtcatgtttacgagggttctttccatatgcctaatcgatcaaatacacaacttcctacatcttctcaacctcaaaccgtggagagtgactattacggagaaacccaaaagggaccaaagcagtccagcatcaaagtaagaagggctaaaccgggtgacaacccaaaggctaggccaagggatagacagttgatccgagatcggcttaaagagcttcgagaacttgttccaaatggtgctcagtatagcattgatggtctcttggatcaaaccattaaacacatggtgtatttaaggagagtgaccaaccaagttgagaaattgcagcaatgggcgcaccgtgaggtgaccagtcgtaagaatattagatcatctgaaaccaaagaaaattaccaactcgaaacaagctggggtttcgagat

SEQ ID NO: 7372 - DNA, 517 bp, Gossypium hirsutum
  unsure (1)..(517): unsure at all n locations
  Clone ID: uC-gsronu33B106f02b2
agaaaggttttgttagattgatgctactttttctgggtttttcttatcttcttctttcctgtgctgctgttcccactactagaagcctcaaatcaaacaaggaactcccttcttctgtccaagatttacttgctcaggatgtaatggaattgagtgatggagaggaagtgataacggaaggtgacagattcaatggggaaaggatgttaatggaaagcactgattatccagggacaggtgcaaacaagaaccatgatcccaaaactccagggagagcttaaaaaacattaagacccataacctatttgttttatgtatagcttaagacatgacaggataaaaggcaagtctttgaatctgggtttcctccaatatttcgctagaatttcctctcttttaaggtttgctgcttggatagtgggaaaactatgatggaaggtttggactgtactttacagtttacagacaaaacctggtgggtattgttcataanaatagataatggtaaaaagatgtc

SEQ ID NO: 7373 - DNA, 526 bp, Gossypium hirsutum
  Clone ID: uC-gsronu33B106f03b2
gaagatgtttccatgggagaacctgacgtctcctttgtagatagcgatgccggtgatgataaaaccagtgctgattattacttcgattcttactctcactttggaattcacgaagaaatgctcaaggatgtagtgcgaactaagacatatcaaaacgttatttatcagaataagtttctattccagaacaaagtagttcttgatgtgggagctggaactggaatcttgtccttgttttgtgcgaaggcaggggctgcacatgtttatgcagtcgagtgctctcacatggctgatatggctaaacaaattgttgaaacaaatggattgtctgatgtgattacagttttgaagggaaaaattgaagaaattgagcttcctgttgccaaagtagacatcattatatcagagtggatgggttactttttgttgcttgagaatatgttgaatacagtgttatatgcgcgtgataaatggctggtcaatgatggtgttgtgctaccagataaggcttctctttacttgacag

SEQ ID NO: 7374 - DNA, 568 bp, Gossypium hirsutum
  unsure (1)..(568): unsure at all n locations
  Clone ID: uC-gsronu33B106f07b2
cggacgcgtgggcggacgcgtgggttgctccttgcgtaccttccctggtggcaaagtggaaagactctatggccttggccctgtctgcaaattcttgaccaagaacgaagatggtgtcactctttccgcccttagtctcatgaatcaagacaaggtccttatggagagctggtactacttgaaagatgctgtgctggatggtggaattccattcaacaaggcctatggtatgactgcatttgagtaccatggcactgatcctagattcaacaaggttttcaacaggggaatgtctgatcactctaccatcaccatgaagaagattctcgatacatatgatggtttccaagggctaaaaacattggtcgatgttggcggtggtaccggtgccacgcttagcatgatcgtctctaagtaccccaccataaaaggcattaactgtgatttgcctcatgtcattgaggatgctcctagctgtcctggtgtggagcatgttgtggagacatgtttgtaagtgtaccaaaaggagatgccattttcatgaagtggatatgtcatgatnggagcg

SEQ ID NO: 7375 - DNA, 454 bp, Gossypium hirsutum
  Clone ID: uC-gsronu33B106f11b2
cttcttcctcttttcttcttccttcttcttcttcaaagtctagcctccaccaccgcttgcgccgccgctacctcctccgacgccggtactctttcttttcttctcctctttctcttttcttctcttttcttcttttttccttcatctcttcatcatcagtcacctctatccctaacaacaacaacaacactccttcaaacgacgtcgttaatctccctgtttaggtcatggatcgcgtattgtttctagggtttcgaattttttgtctttagttctttttagtactttgaattttgatgtaagcttttttctggttgtttgactcttttttttcttagtttggatgtctatgaaattctcaccgctaaataattttatcggaggaatgtgaatctccggtatgttgttcgctaagattggtaaatcttaactgaaattcattcgaaagctctgc

SEQ ID NO: 7376 - DNA, 544 bp, Gossypium hirsutum
  unsure (1)..(544): unsure at all n locations
  Clone ID: uC-gsronu33B106g06b2
atagttaaccaagtatgaatccaactcttgttttcttcatcatcatcttatgcagtacttccatcagcatttgcctggcagataatgataatcttcaggatgcttgtccgaccaacacgacagttacacggatggtgttcataaacggtttcccttgcaagaacccttcaagcatcagttctgcagatttcacgacatcaaatctaaaagatgctggagatacagacaactttcttcattcctcagtaaatatagtcactgctgcagatttcccaggcctgaacaccctcggcctatccattgctcgaaccgacctcgatctggatggcatggtaatgcctcattctcaccccagagcctctgagttattctttgttcgcaaaggcatcgttcttgcaggtttcattgacaccaacaatactctctttgagtccttaatcaatgaaggagatgtgttcttggttcccaggggcctgctccatttttgcttgaacgctggttatgaagccggcangcgttctctgtgatgaatagccagaaccct

SEQ ID NO: 7377 - DNA, 515 bp, Gossypium hirsutum
  Clone ID: uC-gsronu33B106g08b2
ctctgatgctgagagtcaaattagttcagacatgggcgctcgtttaatggagagcttctctactgctacagtcaattccatccaagcccccaagctcgattctcctccgagcagcgtgtcaaccaacggggtttcatctccttcagctggtgcaagctctgagtccttcgatggtctggctgcttcgaaaatttctactcaggaacacatttcagccccgaaagaaaaagctgtggatattggagatgttgacagccattcttcaggggcacaaagcgattccatcgtgaaacctgttgtttctgttaacattgagcccgagcaaaagctggtgcaacaagacatagtagacatgtacatgaaaagcatgcagcaatttaccgagtcattggctaagatgaaactgcctctggacatcgacagtggaccgaccaaatcggagaattcaagtaccactgatcagaaaatacaggcatcgaaaaacaccggcttccgagtgttctacggaagcaggg

SEQ ID NO: 7378 - DNA, 568 bp, Gossypium hirsutum
  unsure (1)..(568): unsure at all n locations
  Clone ID: uC-gsronu33B106g09b2
ctcccatcagcctccagctcaagagttaatcgcaagagacttgcatgataatgaatggaaatttaggcatatatttcggggccagcccaaaaggcacctcttgacgactggatggagtgtctttgtaagtgctaaaagactagttgcaggtgattcagtgctttttatatggaatgataaaaatcaattacttcttagctccacgatctcgtcttttagtactgatatttcgtgtaggatgatcattggaaagaagtatgatcacgacgattttagtgaaaaggggttcaaagctacgcttcgagagggtaaattggagctacgattaatttagctgattatattcctcaaattagagcacttgatctccagggactaacaaagcgtatgaaaattattgccaaggattttgatgacttttttgagaagataatcgacgagcatgttcgatctaaagacgaaaacagagtcaaggacttntgtgatgtcatgttgggattcatggatcagaagaacaaatgaatacgtgtcgagcgagacacgatcaaagcaatatatngacatgcta

SEQ ID NO: 7379 - DNA, 390 bp, Gossypium hirsutum
  Clone ID: uC-gsronu33B106h01b2
ctgaattgtttaaggaactccaatctgtccaaagtcagctgatatcggagagatcaagatgctttaaacttgaggctcaaattgcagaactacagaagatgttggaatcattagagtccatagaaaacgaagtgcaaatacttaggagacaaaagtccgcactggagcaggagatggaggtttcatctacccagcaacaaggttcaggtggtgtttggcggtggatagcccgaggcacatagaagttgcatatttttcataccatcattgctacggtatctccgaagcaatggctaggtaagttccaatcccactgatatcagagagtgcaatctactcgaatatcacttaaattggacatgcgggttacatttttgttcgtacttttct

SEQ ID NO: 7380 - DNA, 397 bp, Gossypium hirsutum
  Clone ID: uC-gsronu33B106h03b2
gttgtgttcatttcccattctacaagtactgggactcagctatctacattgagactgatccatatgctatgcatttgcagcttctatattgccatggatccatagatttagaaggagaaagcaaaggactactctgcggcaggaacaactgttggcccttccaccttgaatttagtgccccatatctcctgttcttcagaaggcactggagggatcttggtcttaggatgactcatagcttgttaatcctcctactgctgtggagtagaaacagtcttgaggaaaagaagctagagatttgccacaggcacctttcaggaattcagcattatcagcaaaggccacatatccgatggctgtgattccccgacagagaggaaccttaccaaattgatca

SEQ ID NO: 7381 - DNA, 72 bp, Gossypium hirsutum
  Clone ID: uC-gsronu33B106h07b2
ttatatataaaaaaaaaaaaaaaaaaaaaaaaagagagggagttaaattaaaaaaaaattttagaaggacaa

SEQ ID NO: 7382 - DNA, 515 bp, Gossypium hirsutum
  unsure (1)..(515): unsure at all n locations
  Clone ID: uC-gsronu33B106h09b2
ggatggcgaagcttttggtctccgatgaggctcgcagagagttcgccactcttcgtcgcactttcgatgaagttaactccactttgcagaccaagttcagtcaggaacctgagcctatcgattgggaatattatagaaaaggaatcggctcgcgattggtggatatgtacaaagaggcttatgagagcgtagagatccccaagtttgttgacacagtcactcctcaattcaaaccgaaatttgatgcattgttggttgaattgaaagaagcagaggagaaatctttgaaagagtccgagcgtttggagaaagaaattgccgacgttcaggaactgaagcaaaagatcagcaccatgacagcagatgagtactttgagaaacatcccgaactgaaaaagaaattcgatgatgagatccgcaatgacaattggngctattgacatgtttggtaatataagggtcaggctataaaacagtcccaaccagtatttctgagtgggtctattatttctttg

SEQ ID NO: 7383 - DNA, 66 bp, Gossypium hirsutum
  Clone ID: uC-gsronu33B106h10b2
tttttttaaaaaaaaaaaaaaaaaaaaaaaaaagggggagaattttaaactattatttgtacttat

SEQ ID NO: 7384 - DNA, 453 bp, Gossypium hirsutum
  Clone ID: uC-gsronu33B107a03b1
gcgtcctctcgtgcgcccacgcgtgcgcccacgcgtgggcccactcgtacgcccacgcgtgctcggacgcgtgggtgacgagccaatgactgcaggtcagtgcaacatgattgtggacaggcttggtgattatctcatagaccagggtctttgatcactttggtgcaaccctaatagttgcaagttcttcctggcttcttctatacaaaagtgcatataccaccacctcttgtaatggttggctgcaattaaataatagtattactagtattaaagacgtgtggaaccttttgcagaaacaataggcttggtgtttgtaatagtgatatatgcttgtgatccttttgctttgtttctgtgcttgcttgatggatggtattgtcaagattgtggagtgaggtactttgtctaaattttacaatgaattgttctagttgatttggtaaatccatg

SEQ ID NO: 7385 - DNA, 421 bp, Gossypium hirsutum
  Clone ID: uC-gsronu33B107a11b1
tgccatttgctaatattgctacttggagtggtggcgctctcctctccctcttttggtacctacgagtctcccaactatgggaagccccctgctcctgttcataatcctcctaagctgaaaaccgccaccatatgaacataaacctccggtctatgaaccaccaaagaaggagaagcctgaacctaagccaccagtttatacacttccaaagaaagataagcctgaaccgaaaccaccagtatatgaacctgcaaagaaggaaaaacctgagccctaaccaccagtttatacaccaccaaagaaagaaaagcatgaacccaagccaccgatgtatgaaccaccaaagaaggaaaagcctgagcctaaaccgccagtttatgtacctgcaaagaaagaaaaccagaacccaaccaccagttat

SEQ ID NO: 7386 - DNA, 406 bp, Gossypium hirsutum
  unsure (1)..(406): unsure at all n locations
  Clone ID: uC-gsronu33B107a12b1
ttcaatgctatagcaatactgatacaagattttggtgctgtcatgaacaagggcttcttccatggatactcgataattaccactctcatgatccttaatcatgcactaagtggaattgctgtatcaatggtaatgaaatatgcagacaatattgtgaaggtctattctacttcagtggcaatgcttctcactgccgttgtttcagtgcttctgttcggcttcaatcttacccttgctttcttcctcggtgctactgttgtatcggtatcagtatacttgcactccgccnggaagctgcaaagatagtgacttgctgcgctatgttgggctgacattgtaaagtctgtgcctgagggtatgtcattgcatttcattcatatttggtcccacttgttctatcactatg

SEQ ID NO: 7387 - DNA, 471 bp, Gossypium hirsutum
  Clone ID: uC-gsronu33B107b03b1
gattaatcggatttggtgtcggagctccgggatctacctgctcactgcttgttcacagtcataccgggcttggagaaagtctcgacaccctggcacgctaacatgcgcatatacaacagagagtgcaccaaacagttcacaccatatgtccgcaacaaacatgctcccaccattgctactgtaatctcttgtgctttccttttaatcccgttactattagtttccctcatttttaaccgcatcaaagcttatttttgactccaaaagattctcatcttcatacaagtttacctctcgatttacttttcaatcctatgtcttacctccctcgtcactggacttgagccgcttaagttcttttacgccacttcgccgtggacctacgtgggtttacaagtgcttcaaacgcttgtggacgtgctttacttgctgctgctgttgatgtatatgatactggttttctcgacggag

SEQ ID NO: 7388 - DNA, 328 bp, Gossypium hirsutum
  Clone ID: uC-gsronu33B107b05b1
ggtgcttttgccgttggagatttttgggacagcgcctgagccggctccggcgccggttgtcccggagaatggtggtttggtttcgagtcctaaagcagcggttaagggtactgatgtagctggtgcggtgagcttgaaatttcatgctttggcaatgggtttttcgtcatttgctgttttctgggctgtttttgggggattttgattttggattttatttttgcatgcgatgcttgtgttactgtttgtaatttgtggttgtgattaaaaaatatttgattctttgtttgttgaaaaaaaaagaccccgaattaagaaacaaaattgg

SEQ ID NO: 7389 - DNA, 375 bp, Gossypium hirsutum
  Clone ID: uC-gsronu33B107b07b1
tgttattcggctttgctttttcctgatttatagactaccaagcttgcctatatagtgaagaagaggaatttcagcatgtagctggatcgataagtgttctggtctgcatttggtgaaaaagcttatggcaattagagccttttgactatatttggcagaccaataagtttaagaatacaaattccagcgtcttgccccaaaggagaagatgacgacaatatatggataatatttggtacatgatcaagggatcggtgcctgcttaatgttatatatgctaattttagaacatgaattagaaaggttccgtggtgttgtgaccctgtatgtctatacatatatgtgttagtatataaaagcatgttgcttgaattg

SEQ ID NO: 7390 - DNA, 419 bp, Gossypium hirsutum
  Clone ID: uC-gsronu33B107c04b1
gtggtttgtcctaagcctatccgaacctttagatggtgtaccaacagctgttatcagactgagatggctgattcaaaaactggtgcagagcttcttgatataatcctccccgagggcagggtatggggccgagaatcccaccaaccaaatggcttcatcaccaccgtatttctgtggatcaccgccgagcagggcgtacaatccggaaatccaagatgcccgattcaacgacgagcagccggtgctacctccactaacatccccagcaacctcctcaaggggaggatgcgtgagggcgaaattcgggcagatgccagctgctgtacgaatcgagggatttgattgcctcaccagagatggccgccatcgcagcatctacgccgtggcttaaaagaaaccaagatatgacaacacaaatg

SEQ ID NO: 7391 - DNA, 361 bp, Gossypium hirsutum
  Clone ID: uC-gsronu33B107c05b1
taatattctgttttgtaatttcaattggagaagctgctttgtatttcatcttgtcttttccttttccttttttcgccggcattgtttgaacatggggttgtgcgcccgtcaattccaattaaaatatggtgacttttgtttttcaagttcctatcttttttatttttatttttttaaacgcttatagccattagcgatgctttcagatgtacaaataaaaaaataaaaaaattgagtatttctaaaaaaaaaaaaaaaaaaaaacaaaaaatagactaaaggaagaaaaaaatacaactaaatcatgaaaggcatgcactgcaagtcaatgacgctgtcatggctggagtgttccaaagga

SEQ ID NO: 7392 - DNA, 434 bp, Gossypium hirsutum
  Clone ID: uC-gsronu33B107c09b1
gctccctcgcgttcggacctcagcaaaggcaggccctaaaatcttgctctcttcactcctgctattttaaccatttcttccttgtgctcgccccttccctagcaagctacatttgcatggccccccctgaattggctcaacccagtgataaaacaaacgttttcgctaaacaagtcagtttgcgtaatcgtgcatatgttacgttcttggccggaaatggggactacatgaaaggcgttgtacggtcagccaaagggttaaggaaagtgaaatctgcgtaccctttagtggatgccgttttacccgacgtgcctgaggagcataggcggatcctggagaaccacggatgtatcgtgcggtagatcgaaccagtttaccctgctgagaaccagacccagttcgccatggcctattacgtcataattactccaagc

SEQ ID NO: 7393 - DNA, 505 bp, Gossypium hirsutum
  unsure (1)..(505): unsure at all n locations
  Clone ID: uC-gsronu33B107c10b1
tcgaaatcttcttcattctcattctctctccactgaactcttgctaaacggtatcgttttagtcagtctttcatcaatggcgaaagaaccagttcgcgtcctcgttactggagctgcaagacaaatcgggtatgctcttgtacccatgattgctaggggagtcatgttgggtgctgaccagcccgtgatccttcacatgcttgatatcccacctgctgcggaggctttgaatggtgtcaaaatggagttggtggatgctgcatttcctcttctaaagggtgttgttgctacaactgatgctgttgaggcatgcactggagtcaatgttgctgtcatggttggtggtttcccaaggaaggaaggaatggagaggaaagatgttatgtcaaagaatgtgtctatttacaagtctcaggcttctgccttggaacagcatgcagcttctaacttgcaggttttgggttgntgctaaccctgccaacaccaatgcattgatcctgaggga

SEQ ID NO: 7394 - DNA, 555 bp, Gossypium hirsutum
  Clone ID: uC-gsronu33B107d03b1
tgtttttattcacattattgacttcagaagcgggatggaatacattaattcggttgcaattacttggaaggggagaagatttttgtcatgctcaaaaagttgaacatacttgtgagccgaaatatttccaagactacgattcctttcactaacaaattatggaaatctgctgatttgctagagtctgaaaaacttgaaaaaggcatacaagattgtgtgatggagataattaagaaaagagaagacaaagttgtgggtggagaagctgacagcttcggtgatgattatttgggattacttgtaaatgcttatcatgatttgaacgataaaaacaagctttcattagaagacttggtaggtgaatgcaaaacaatctactttgctggtcaatcaactcttaattcattgctttcatggatagtcctacatttggcaatccatggagattggcaagaaaaagcaagaagagaggtgattgacatatttggtaaccaaaatccgcatcttgaaagcatccccaaactcaaaacgatgtctatgatcatcaacgaaact

SEQ ID NO: 7395 - DNA, 414 bp, Gossypium hirsutum
  unsure (1)..(414): unsure at all n locations
  Clone ID: uC-gsronu33B107d12b1
gcgtgcaccacaactacagagaagagagtaaaggggaaaaaaagcgtcgttgttcttgcttcttcttctacttcgctctctctctttctccgaagttcctccttcgttcttttatttattcagtattgtaaaagatggccgacggtgaggatattcaacccctcgtctgtgataatggaactggaatggtgaaggccggttttgctggtgatgatgctccaagggcagtttttcccagtattgttggtcgtccccggccactggtgttatggttgggatgggtcagaaggatgcctatgtaggagatgaagcacaatctaaaggaggtatccttactttgaaatatcctattgagcatggtanttgtgagcaactgggatgatatggaaaagatttggcatcatacattctaca

SEQ ID NO: 7396 - DNA, 570 bp, Gossypium hirsutum
  Clone ID: uC-gsronu33B107e03b1
ttggtgtcaggccttctactataaggcctgggggacgttttgatgcgatgtttggtaacatcaatcatgccttctggcacacagcattgcagagaattgagcactatggtgcacttatatttacataatcacatcatggttggtaataagaaaaccaaggatgtgcagttttatatagaggtgatggatatagttcacacattgggtggtgggaagagatctgcctatgaccctgatgagaacgctgaacagcaacgctagcgataccgaaagaataaaattaacacggacttccagaactttgtgaatcgggttaatgaggaatggggacagcccaaatttaaagcatgagacctttgatgtcatcagcctatgagagagcttgtctttcatggtgttacccataaagcctctgcttaaattgagccaacatcaaactgactggttgagctaatagatactgcctacgctgtgagcaccctaaggcgagaatgcatagtcaacctcgaaagagttggtcatcggcatatgaacctagatttgactattgatttaaggacttaaagcgag

SEQ ID NO: 7397 - DNA, 537 bp, Gossypium hirsutum
  Clone ID: uC-gsronu33B107e04b1
ctctgttgaaggcattttgagagatcttcctggtgttagtagggctgttgttgctttagccacttcattaggggaagttgaatatgatcccactgtaattagtaaagatgatatagtcaacgcaattgaagatgctggttttgaagcctcacttgtacagagtagtgagcaggataaaatcatacttggggttgctggtgtttttaacgagctagatgtacagcttatcgaaggcatacttagcagcttgaaaggggttcgacaatttcgttttgacagaagttctggagaacttgaagttctttttgatcctgaagttgccagttcaagatccttggttgatggaattgaagagggaagtaaggggaagttcaaactacatgttatgaatccatatgcaagaatgactactaaagatgaagaaacctcatttatgttccagctttttacttccagtttggttctcagtattcctgtctttctgattcgagtagtttgtccccatatacccttgttggatgccttcttgctctggag

SEQ ID NO: 7398 - DNA, 537 bp, Gossypium hirsutum
  Clone ID: uC-gsronu33B107e06b1
ctttgaggttgactgaaaaaactatggcggaagagggacaagtaatcacctgccacactgttgattcatggaaccagcagctcgagatgggaaaccagtccaagaaactggtggtggtggatttcacagcatcatggtgcgggccatgccgttttatatcaccaatcctggtggatcttgctaagaagctgcccaacgtcatattcttgaaggtggacgtggatgaactgaatactgtggctcaggagtgggctattgaggcgatgccaacttttgtgtttctgaaagaaggcaccataattgacaagggttgtgggtgcaaggaaagaagaattgcagcagaaaattgcctttcattcatctaacccggtgcagacagcatgaatcaacatttaaatgtacttgatgtctggagttgtttatgaaactaggatcttatgaatgtctgacagacagaccctaaatatgtgtgggtgtattatatttggtactctctttgctttgcctgttctattcagaattatttatattaaatag

SEQ ID NO: 7399 - DNA, 386 bp, Gossypium hirsutum
  Clone ID: uC-gsronu33B107e10b1
tattggtgtgcctgagcccttatctgtctttgtggacagttacggaaccggaaagattcctgacaaggaaatactccaaattgtgaaggagaacttcgactttaggcctggtatgatcaccatcaacctggacctcaagagaggtggcaatggtcggttcttgaagacagctgcttacggacactttggaagggacgacccagacttcacctgggaagttgtgaagcccctcaagtgggacaagccccaatcttaagttcagccctgctgcctgtctcagtgcctgcttatccatagtactgaataatattgccttgctgctcacctatactctattttcatccccagaatgcttctaatctcattcatatagtgccctattcatt

SEQ ID NO: 7400 - DNA, 325 bp, Gossypium hirsutum
  unsure (1)..(325): unsure at all n locations
  Clone ID: uC-gsronu33B107f07b1
tgcctcgcgttcggtgacagacaccggcgctggggacttcaagagagtgttcgatgtcaatgtattgggtggtttcttgggtgccaagtatgctgccagggccatggtaccnggtaagaaaggctgcatactcttcacatcaagtattgtgtcaaaaatcagggtgggactgccccatgcatacaaggcatcaaagcatgccgtcgcagggctgacgaagagcttgagcgtggagttaggtgagcatggaattagagttaactgcatctcgcctcacccaattttgaccccattgctgcaaaaatcaattgagaatattgataaa

SEQ ID NO: 7401 - DNA, 428 bp, Gossypium hirsutum
  Clone ID: uC-gsronu33B107f11b1
gctgtcaaagctataaatgagaaaatcctctcagtcttggatgaaacaggatcgggcagggtggacttgggcatgttttatgctgttcttgcgcccctttgtagtggacctccagataagcgaaaaaggatcgcctttgatgcactcttatggcgacctgtaaatgaaggtggttctcatattagaaaggtagatgcagttcagtacatcaaattgttgagggctatatttatcccttctcatggagctagtgaaatgctggaagttcatggagaaacagatacctcaatggtatctttcaatgagttccttatcatgttcaatgatcctgattggggctttggtatcttgtccactctcctgagttagaaactggaaataggaaatcgtcatgaacgccatgtctgctcagtttgccgtacccaata

SEQ ID NO: 7402 - DNA, 284 bp, Gossypium hirsutum
  Clone ID: uC-gsronu33B107g03b1
gttttatacctccactcatcggttgctggtgtttggtctgcacatgatgctcaaaggctagactatactactcaccatgccgattctctctatatgtaaagccatggctctccttggccccggaggtctttcgtctataggaatgatgatagtctggtattgcattctatcatgttgtgcttgtctatatgatactacatttctgtcactatcatgcgactggaatcggattgtatagtgcaccaaaggtgcagcttttgccattctgttaacaacgtgaaaac

SEQ ID NO: 7403 - DNA, 63 bp, Gossypium hirsutum
  Clone ID: uC-gsronu33B107g06b1
aaattaaaaaaaaaaaaaaaaaaaaaaaaaaaaaaaaaagaaaaaaaaaaaaaaaaaaaaaaa

SEQ ID NO: 7404 - DNA, 312 bp, Gossypium hirsutum
  Clone ID: uC-gsronu33B107g08b1
ggctaaggcttaaaccctaactaatattgggccctccgttccggttcgaatggacaagaatgcaagtcttgaaaagaccgtaccgccctaactcaccacctgcacgccatggcagaatcaatgaccactatcctatagtccatgagcttgcctctagccccggaggtattgcctctatacgaatgtgcataagaatgggatgactgactgtaatgtagttaatgacatatacatactacatatccggaaacattatatgacaggaatcggattggcaattactaagaaaggtgccactatggctatgatagt

SEQ ID NO: 7405 - DNA, 561 bp, Gossypium hirsutum
  unsure (1)..(561): unsure at all n locations
  Clone ID: uC-gsronu33B107g11b1
agaaatgtaaggaaatattagaaattaatttaagaaggcatacattgattgttttttataagtatgctattgattttatttttccttacaacatgttttttcattggtcaaatttcattaaaccttggtttgaaagttcaattaattttatgagtttatctagatttgtaaaggttaaaaatagtaattatgttgcattagataggtttattaaagcattttatatatttgctcttccaacaaaattttctatctttacctttaatggtgaattttaacataatcttaactttcttgatttttataattatgtgaaatttttgactcatcgttagaaattcttatggatgaccatatatattcaaagaaagttacaggttattttttacttgaatgctcatgtgcctaatatttctttgtttaatgttgatgaattgtttttgaaggagagatacttgatccatgctgatttgggagatcaaagtcatatctttgatcctggaaataagttcggtgcacaagaaccttangtaagaatttaatcatttaatatattaatct

SEQ ID NO: 7406 - DNA, 357 bp, Gossypium hirsutum
  Clone ID: uC-gsronu33B107h05b1
atgcgtcctctcgtacggccactcgtacgattttggagttgtggagattgtgcttgattttaagtttggagctatatctattaagccaactactatcacaatatgatatagatccaaggctcgaatatgatgatatcaatcctactccagctattaggaagctacttgattggcatgccatggttgaaagcaatgactctataacgctcaccatagccatacattatacttgttgtgagtcacctgaaaaagtacttcactatatccaccataacctctaaatcctcgaccgagatgtccatcactgagcatgaagcgtcttttcatggccagatggtgacacataacatgaaaagg

SEQ ID NO: 7407 - DNA, 290 bp, Gossypium hirsutum
  unsure (1)..(290): unsure at all n locations
  Clone ID: uC-gsronu33B107h07b1
tgttcttattggttatcatctatcacagcggggatgagttaatcctaaatttctgtttacatcaagcccatagaatcttgttcatgacaaagcagcagggggttactgtcctgcaaaactgatatatttgccacatttgctccggacagttggcatataattcaaagatgatataacatccttctttgatttgngaaaacataacgaaaaagatcccctaaagcctttgcatgggaaacttccaagagacttttgcgcgcatgcggtgctgttaactcaggacccatgat

SEQ ID NO: 7408 - DNA, 98 bp, Gossypium hirsutum
  Clone ID: uC-gsronu33B107h09b1
tgcctctgcgtccgaacaatacaacaaacaaggcggaggtttcaatttaagcttgttgattctcctcctgaagcacatggctttgagggttggtcacc

SEQ ID NO: 7409 - DNA, 376 bp, Gossypium hirsutum
  Clone ID: uC-gsronu33B107h11b1
cccacgcgtccggttgggattcaagggattgcttgggcttttggtggtatgatctttgctcttgtttactgcactgctggtatctcaggtggtcatatcaatccagcggtgacatttgggctgttcttgggaaggaaattgtcgttgacaagggcaatatactacatggtgatgcagtgcttgggagccatatgtggggctggtgtggttaaagggttcatggcgaagacaaggtacggggcattggtggttggagctcactttgtgaatcatggctacaccaagggagacgggcttggtgctgaaattgatggcacctttgtggcttgttacacttgtgttctcagccactgatgccagcggcagtgccagagac

SEQ ID NO: 7410 - DNA, 518 bp, Gossypium hirsutum
  unsure (1)..(518): unsure at all n locations
  Clone ID: uC-gsronu33B108a05b1
catcttttttatttcgcctcgtctacctcgacttaggtgaggcatgagtgcaagtttggtgagcagccacaatttagatgacgacgatgtcgaggatctagagatgttgctcgaggcatatttcatgcaactggacgggacgcgaaacacgatattatctgtccgcgaatacatcgatgacacagaagactacgttaacatccaacttgacaaccaacgaaacgaactcattcaactccaattgacgttgaccatcgcatcgtttgccatagccgtcgagacattagtagctggatggttcggcatgaacatcccttttacatggaacaacaaggaggggatatttggaatctttgtgggaagtattacagtcgggtgtgtgctgatttncttctgatcctaggatatgccagatggaagaagctgattggntcttaaaactgatccttcatcatcaactatgaatgtgcttttcaccatagttgtgccccatcaatgggatataattgagtatgtac

SEQ ID NO: 7411 - DNA, 368 bp, Gossypium hirsutum
  Clone ID: uC-gsronu33B108b02b1
atcagtgcaagaggcttgggttgtgtttgaaaaaaaggagcccttcagcttagggtatgcaaagaagaaattacgatcccatttttttttcttctttgttgattaagcaacaaagaagattaatcttaggatgttgtccaaggcataacccaaaaaatatatattttcatgtatagttttggcatgtttctaatttccttgtggaatttgtacaaaggaaaacatattaagttcataacatggttttcctttttttctttttcatgtatattataaatcaaatccttcttttgcctttggtctttaaaaaaaaaaaaaaaaaaaaaaaaaataaaaaaaaaaaaaaaaaaaaaaaaaaaaaaaataaa

SEQ ID NO: 7412 - DNA, 63 bp, Gossypium hirsutum
  Clone ID: uC-gsronu33B108b03b1
ccaataatataaacaaaaaaaaaaaaaaaaaaaaagggggggattttaaaaaaaaaagggggg

SEQ ID NO: 7413 - DNA, 452 bp, Gossypium hirsutum
  Clone ID: uC-gsronu33B108b04b1
catcttttttgtctctgggtctcgtaagtgggtgaatggggttgtaattagtgccaatgggtgggattgggacctctgcagctcacattgtgttggcaatatttgctgtggccatgtttgttgtgtccgggaccatggcacaggatattgctccttctcctgcaatggctaccggagcaggctctgctttgccggtttccgctgtcttcttatgctttccatgttggtctctttaattgctctcttggtgcattgaattcaaagcttttcaagactatatgacattggctacccttaatttcattctcactggtgatgaggggagtagcctctaatcttcttcgagataatatttgggtgttatcaattttcaatttctctattcctaaagttttagatactttgctttgctttttgtaataataatattttttttgggtggctgaataagt

SEQ ID NO: 7414 - DNA, 502 bp, Gossypium hirsutum
  unsure (1)..(502): unsure at all n locations
  Clone ID: uC-gsronu33B108b05b1
cagataatgtaaaaaatagaagaaatacaatcgttttgtggttgaagtcgggttttagtggttggggagaaaaaaatgttgggagtatttagcagtgcgatagtgtctccgccggacgagctggtggcggccggttgccgaactccatcacctaagataacggcggatgctctggtgaaacggttccttgagacgaactcctccggcgtgtccatgcagatcggagaccatgtccaattcgcttattctcaccataaagagtctcctttacggcccagatcatttgctgtgaaagatgaaatcttctgcttgtttgagggagcccttgataacttggggagtttaaagcagcaatatggtctggcaaagtcggcaaatgaagtgattttggtcattgaagcttacaaggcccttcgtgaccgagcaccttatcctccanaccatgtggttggccatctaattgggagctttgctttcattgtctttgacaaatccacctcca

SEQ ID NO: 7415 - DNA, 416 bp, Gossypium hirsutum
  Clone ID: uC-gsronu33B108b09b1
ctttctcgtacgctacctgctacgaggtcgccgggtggttacttatccatatttggggatggattcacagattaggtgtgctgcgttggcaagaatgattggatggaccctaccaaggagctgggtgactcaggtgagatcactgcatcaagcatgatcagagctcgccaatcaattaagaacgcatatggtccgttcaggtacgaacatatcttcatcaatgtggtgtgtatcctgaaatctctgaggttatgctgacacactagactctatctccctttcgttacaggttgaatggtgatgttgatcaagtatactgcatattcttatttgataagggtattcagagcagcctgcttaaacttggtttgctgtcgactgacaccaatgaatccattgttattatagcatcatct

SEQ ID NO: 7416 - DNA, 565 bp, Gossypium hirsutum
  Clone ID: uC-gsronu33B108c03b1
cccactctaacgcccacgcgtccgcccacgcgtccgacgaggcattcacagtggcaaaggagtgatgatggaggtgaaagttcagaaacagattcaccgagtgattcattgagagatatacatgatatttctttgaacctaaagttttcaatggatggagataggagtggagctagtggaaatgataattctttagattccgaagggaatgaccgaaatagtaagttggagaatgccgctttatcatggtcaaaaggtgttttaaaagatcaaaggaaagctggatccggagacagaattgaccatggttccagcacaggtaagtttccagcattaaggaggaggaaacatatttttgtcattgctgtggactccgactccaatgaagaccttcttgatgctatcagaaaggtttttgaggctgtcgaaaaagaaaggattgaaggctctataggttttatattgtcaacatacatgaccatatctgagatacagtcttttctagtctctggaagcttgaatgctaatgattttgatgctttcatctgcaatagcggtagtgatc

SEQ ID NO: 7417 - DNA, 407 bp, Gossypium hirsutum
  Clone ID: uC-gsronu33B108c06b1
cccattcttccggctatgctataaccccaacaggtacatgggtatattctaacactgaggggagcatcaagatctgggatctggcaagcgcgagcattctgggagacttgactgctgatctgaaagctgaagctaataaatctgatgtcgccgaccatgcaaacaagaggaaggtcatatactgcacacgcttgaactggcgtgcagatggaagcaccttatttagtggttatacagacggtgatgtcagagcctgttgaattggtcaacactaggaccaacattcatgcatgcatgacgcgccttccaacgagtaatcatataggattaaggaacatgtagcgatacttttagctgcttctcttagcatttccataccttcctaaagattatgtttaaaacgttgc

SEQ ID NO: 7418 - DNA, 553 bp, Gossypium hirsutum
  Clone ID: uC-gsronu33B108c07b1
ctattttatgggattccttggccctgagtcgacactggcagaaaaattaggtgtggagcaagacaatcgatcaaacttgaaggcagagtatggccgcttcacgaccaatgtggatggagtctttgcagctggagattgtcgacgtggtcagtcattagtcgtgtgggcaatctcggaaggaaggcaagctgctgcacaagtcgacaaatacctgactaaggaagacaaggacacaagtgtagagggtgagaaccaagattccgtcaagcggcaccaagaccttccccaaaagcagcaaactgtcatgaaatagatgatccatcagattgttattgtttgcgacattgagctgaaatggaacccgaatccaatacattccgaaggaaattggtatttacatggatgaccagagtgggaattaaagcatgaatcttttgcggttaaaccagcaagggggatatatgctataatctcccaacaaagacctacaagcaaaatcaataacattcatgggctgagctgatatcagtagatttagggatatttgtctttt

SEQ ID NO: 7419 - DNA, 547 bp, Gossypium hirsutum
  Clone ID: uC-gsronu33B108c09b1
ctttttcgtccgcccacgcgtccggatcctgagaatttcccgtttgttgttttggggaacaaaattgatgttgatggtggaaacagtagagtggtgtctgagaaaaaggcccgagcatggtgtgcctcaaaaggaaatatcccctatttcgagacatctgccaaggaaggagttaacgtggaagaagctttccaatgcatagcggaggatgctctaaagagtggggaagaggaagacatatacttgcccgataccatagatgttgggagcagcagcagccaaccaaggtcaagcggatgcgaatgttgaaagataccatgcatgttcattattttttcctgttccgccaataagtacggttaaaatgtttcgaatgatttggtgtttcccaaccattttatgggattcatagtgttggtgtgagaaacaaaaaggaaaaaaaaaaaagtctgttaatgcttttggtttggctggattttagttctgtaatgttctcatttgtaaacattgttttttgttcagcactgcctacgcattgtttttaaac

SEQ ID NO: 7420 - DNA, 532 bp, Gossypium hirsutum
  Clone ID: uC-gsronu33B108c10b1
gtttttctgtaaaaggattggcaccaatgtcgaaggtgggcggatatgatctcagtggggatgcaatgatggaggattggttcaagcagtttgaggagcttgccgggtctcaggacatggaatcgattgtagagactgtgatgcaaaaacttttttccaaagagattcttcatggaccgatgaaggaaatcgaagaaagatacccacagtggttagatgagcacaaaaccagtttgagcaaagaagaacacgaacgatactccctccaatacgagctgataaaggaacttaatggagtttatgaaaatgatcctcgtaacttcacctggatcgttgacctcatgcagaaaatgcaagaatgtggccagccaccaaatgatatcctgcaagatcttgctcctgaattcggtttatggaatcttgactagctatccccagagatggtggattcacagcagaaaccgtgaggcaattttctaatgcggattatgtgtgccttatatttccatagattgagggaataaaagaaatg

SEQ ID NO: 7421 - DNA, 487 bp, Gossypium hirsutum
  Clone ID: uC-gsronu33B108c11b1
ccggctatccactcctttttctcagagtgcgaaacttcaacgtcttagtggggaccactgcgatccacaatgtcttctactttcagcggcgatgaaacggcaccgttcttcggcttcctcggcgccactgctgctctcgtcttctcctgtatgggagctgcatatgggacggctaacagtggtgttggtgtggcttcaatgggtgtgatgaggcctgaattggtgatgaaatctattgtaccagttgttatggctggtgttttgggtatttatggcttgattatcgctgtcattattagtactgggatcaatcctaaggccaaatcgtattaccttttcgatggttacgcccatctttcttctggtcttgcttgtggccttgctgggctttctgctggaatggcaatttggaattgtccgcgatgctggtgtcagagctaacgcacagcaaccaaagcttttttgttggaatgatccttatcctcat

SEQ ID NO: 7422 - DNA, 513 bp, Gossypium hirsutum
  Clone ID: uC-gsronu33B108c12b1
attttatttgaccttgtggaacagtgttcattccagaagcaactaaagatgcatcgggggatgagtactagggatgagaaggtggtttctcgagcaattgaattgaatgagcaactccagaatgttcttatcagacatgatgctcttctctctgggaggacaactgtttctagtaggccggcatcaactcttaatcatttcaaccatgaagaagaggaagaggagcctgagcaactttttagaaggatacgaaaagggaaagcatgtgcaagaccggaagatgaagagtgctctatagaacagccacacttgggtttgtatggatcaaacattctgggagaaaaagaacggctaaaccgtccacttattcgaccattgccctcagaaccatcatatgaaaacaatgcacatccttcagctgttgcaattcctccccctcctgcataacacatcgagagagaaagatactttcaggagaaaaaggctgacggctctgctgtggctggtcatatg

SEQ ID NO: 7423 - DNA, 549 bp, Gossypium hirsutum
  Clone ID: uC-gsronu33B108d03b1
cagtgaaagcgaagtctagggggagtatatcactgcgcacggtggggcagcctatgtcacttggtgagatagcaaggacttgggatgtttgtgcccgagcagttatttctgatcacgcaaaactgagtgggggaggcagctttagttcaaaatacgggacttgggagaattgcttgagtgctgcatagtcatctatacagactctagtagaacacctagatcagctttattttgtcacagctgcgatcttgaggactgcataagcagttttcggatgcatatatttataataaagtcggttcaagggagcagcctcagttgatgtttgtcggcttgagagaactctccaggagagttcaaacttgtgtcattaggtaatatattgttatagacttgtagggtctggaacatgcttagcattttgataaattcttctgttcaaaacaaggctacatacattatcatatttctggagaaatgcggactcgaattatgatagttatcaaaacaagtttgttcctgttgtgggtaataaataaaaagtgcaga

SEQ ID NO: 7424 - DNA, 538 bp, Gossypium hirsutum
  Clone ID: uC-gsronu33B108d05b1
tgccaatatgctgatccggctagagacgggattagcttgctcaagatttggaatgtaaacaagtgctccggtgtggtgggtgttttcaactgccaaggtgctggttggtgcaaggtcaccaagaaaacccgaattcatgatgcatcacctggtacacttacaggttctgtttgtgccaacgatgttgatttgatcgctcaggttgccggtgcggactggaatggggagagtgtggtttatgctcatagatcaggagagctggtacggttacctaaaggtgcttcagtgccggtaacacttaaggttctcgagtatgaactattccacttctgtcccgtcaaggaaatttcccacaccatttcatttgcaccaataggccttcttgacatgttcaacagcagcggtgccgttgagaagttcgaagtacaaacgacatccgatgagaaactgcagttttttgatggcgaggtttccttcgagttgacaacttcactcagcaccaaccggaatcaacagcaacgatcagtcttaaagtccg

SEQ ID NO: 7425 - DNA, 518 bp, Gossypium hirsutum
  Clone ID: uC-gsronu33B108e01b1
gtggtttttaccttttcttcagcactgatgtacagaagcatgtgcgtgaggctgatatagtctttgtttctgtcaacactcccaccaagactcgggggctcggagctggcaaagctgcagaccttacatattgggaaagtgctgcccgcatgatcgcggacgtatcgaaatctgacaagattgttgttgagaaatcaacagtccctgtcaaaactgctgaggcaattgaaaagattctcacccacaacagcaagggaatcaaattccaaatcctttcgaaccctgaatttcttgctgagggaactgcaattcaagatctttttaaccctgatcgtgttcttatcggaggccgggaaaccccagaaggcaataaggctgtccaagcattgaaggaggtttatgctcattgggttcctgaggagagaattcttaccaccaatctttggtctgcagagctttccaagcttgctgccaatgctttcttggctcagaggatctcatccgtgaatgccatgtct

SEQ ID NO: 7426 - DNA, 564 bp, Gossypium hirsutum
  Clone ID: uC-gsronu33B108e02b1
gacctttttatcgatatatagactccgccataagcattcgtaacttcgccgccgttgattattatcttcaaaaatacgctgcggcaactaagtgagttggtgcgaagatgagtcgtggtgcagcagtgggacccaaggggaagaagaaaggagcgacctttactatcgactgtgctaagccggttgaagataagatcatggacattgcctcactcgaaaagttcctccaggaacggatcaaggtaggcggcaaagccggtgctcttggcgactccgtcaccgtcacccgcgacaagaccaaaatcaccgtcacgtctgactccaacttctccaagcgttatcttaagtacttgaccaagaagtacttgaagaagcacaatgtccgggattggcttcgagtgattgcttccaacaaggacagatctgtttacgaactccgctacttcaatattgccgagaatgaaggggaggaggaagaatgaagaatcagttccacatcttttttctagtttactgctttattatttcttagaacgtcttttatctatttaagggtcatgttct

SEQ ID NO: 7427 - DNA, 553 bp, Gossypium hirsutum
  unsure (1)..(553): unsure at all n locations
  Clone ID: uC-gsronu33B108e03b1
ctaaattctctgcttacattggaacccctggaaagggtatccttgctgctgatgaatccactggcaccatcggcaagcgtctttcaagtattaatgtagagaatgttgaagacaacaggcgtgctctccgtgagctcctattcacaactcctggagctcttcagcacctcagtggtgttattctctttgaggaaaccctttatcaaaaaaccgcttcgggcaagcccttcgttgatgttttgaaggaaggtggtgtcctccctggcatcaaggttgacaagggtacggttgagcttaatggaacccatggcgaaactttcacccagggtctaaatggccttgcacagcgatgccagaagtactatgaagctggtgcccgctttgctaaatggcgtgctgtccttaagattagtgctaatgaaccaaccgagcttgcaatccaagataatgccaacggnctagctatgtatgctgncatctgccagcaatgtggcctttgtcccattgtgagcctgaaatcttgttgacggatcacatgacattaaaaagtgtg

SEQ ID NO: 7428 - DNA, 557 bp, Gossypium hirsutum
  unsure (1)..(557): unsure at all n locations
  Clone ID: uC-gsronu33B108e04b1
gcaacttttaaggagatataatctgcgagatatgtcatgggtcttatcaacctgattatgctggtccacctcgcccccagacggacgaaacagctatcgatattggtggaggctggacaatctctggcacccctctggatttgcgtgattctcgccttttggccattgcagaggcagaacgccaatttttggaaactgggtatgacgaatatgctgcatcaaatgccactggagctgcattttgccgttcagctgctgtaattttaatggcacttctgctattgcggcatgcagtgactgttccagatgccgattcagatgatgatgtctcttctttcttctcttttttcttgcttcgagctgctgggtttctcttgccatgctacatcatggcttgggccatcagtatattacagcaacgaaggcaaagacaggaagcagcagcgttggctgccacccaagttgcttttgtactacaatctgggcaaagtagggctatgcatttcgcaatagcatcaggacctgcagcgacacttcaccccngaaatgtttaaact

SEQ ID NO: 7429 - DNA, 576 bp, Gossypium hirsutum
  Clone ID: uC-gsronu33B108e11b1
ctcctataaagattgaagccacctacacaacaacagggggggattcacaaaaccaggcggggttttaacatcgggatggtggtgtttggctcgtcatttccattatgtgccagaaatattagctgcattcttttggactgttccggctttattcaaccattttctgccatacttctacgtcgtgtttcttaccatcctcttattcgaccgagccaagagggatgatgaccggtgccggtccaaatatggtaagtactggaaactatactgcaccaaggttccctataagatcgttcctggaatttactgagagatggatgtttggggaatccagtgcaccgcctgcattttgtttgcaatgtgctttgtaacatcgtctcctttactaattgccagcaaaacaccttttagtttttttttttttttgagagagtgtagaggattaaaagctttgcttggcaaatgctgcttgtattgaaatcctaggatatcttccaagtaccagtgataatggtaaaataaattttgccattcttattttcagtccgttttagaattattatttaaacttaaatg

SEQ ID NO: 7430 - DNA, 316 bp, Gossypium hirsutum
  Clone ID: uC-gsronu33B108f07b1
cctattcgtccgcccacgcgtccgcccacgcgtgcgcggacgcgtgggtctagtatgttgcatagctatcagcaggttatgcttatgattgatgatattcacgatttacatccctgttttttagatgaggtcaataaaaagatgcacttggaccgtcatgccttgataatggtatagtccaaatctgtcaattatacagttacgatgatccattggggcatctctgcataaaaaaaaaaacgacagaaaaaagatagaaaacacaaaaaaaagcacaagcatagacatcaagcgaaaaaacaacaaatgaaaacgg

SEQ ID NO: 7431 - DNA, 497 bp, Gossypium hirsutum
  Clone ID: uC-gsronu33B108f12b1
gtctgtctccattcttgtctgtcccttatggttacattataattgaaataggtgagaaccttatcttcttcttttattttccctttcttttccaataactctcatttgtttaggttagatctgcgagagaaaaaaagagagcgagaaatggggagaatgcgacagtatttggcaatgaaaacggatcctgttgctcaagaattgatcagttccgatatcaaagaactcaagctggctgcgattaaattgatggatgatgcaactaaacttggaggtcttggttttggaacttcttttcttaaatgggtcgcctcattttctgctatttatttattaatcctggaccgaacaaactggagaacaaacatgttgacctcacttttggtaccttacatcttctttagtcttccttcaggattgttcagatttctaaggggggatgttggaaaatggattgccttcattgcttgtcgtctaagactgttcttccccagaca

SEQ ID NO: 7432 - DNA, 531 bp, Gossypium hirsutum
  Clone ID: uC-gsronu33B108g01b1
acgagttctggacgtgtgtgtttagttcagtctgggggttgggtgtttgagaaaaatccgggaggaatttaggaggcggatctctcttctgcaattgggagctcttcgttgcgaatttgatggataccaataactggatgtctactcctcccagtggagagcccaccatggacacaggtgattggagaacccagttgctgccagtttcacgacagagaatcgtcaataaggtaatggatacactgaagaggcaccttccattttctggtcaagagggtttaaatgaactcaggaaaatagctgtaaggtttgaggaaaagatttttactgcagcaaccagccagtctgactacctaaagagaatatctttgaagatgcttacaatggagaacaggtctcagagtactgtacccaagacaaggaataaaagcataccgcctgatccaggttctcagggcatgcagaaccaagttcacagtcaaaggcaaccaattcctatttctttacaagtaatcaatctcaagcacaact

SEQ ID NO: 7433 - DNA, 499 bp, Gossypium hirsutum
  Clone ID: uC-gsronu33B108g02b1
aaacgtctttctctgtggccattgccatatgtatgggggtcgctatcaaatatttattggtagttgcattatttattctcattcctcattctggccaatttcagcgctggtcagatttcggcttgtgtgccgagtgctgatttctccctgctgatttattaattggttgtcggacacgccaccaattgcatacctctaaccgtaccttaccggtatcgctcgaatttgattatcttccgagtggcccaacactggactctcactgtctcactccttgcagctaccattaccatcgccattagcaccattagagcacattaccggccattagagatgtaacctgcatgtaagcaagtcatgtatacatagccatacttcacatttcactccatgctcattgtctcatctgtgctatacaccttatacacaaattattcttattctatattcgcattgaatacatccatgtcacaatcaatatacgctcgacaatatcgac

SEQ ID NO: 7434 - DNA, 561 bp, Gossypium hirsutum
  Clone ID: uC-gsronu33B108g05b1
tatctttttaggacacatcaacccggcggtgacgtttggactgttcgtggggcggaaggtgtcactgatccgagccctgttgtacatggtggctcagtgcttgggtgcaatctgtgggtgtgggttggtgaaggctttccaaaagacttactacaatagctatggaggtggtgccaacgagctccaagatgggttcaacaagggcaccggcttgggtgctgagatcattggcaccttcgttcttgtctacactgtcttctcagccactgatcccaagaggagtgcaagggattcccatgttcctgtgttggcaccacttcccattggatttgccgtgttcatggttcaccttgccactatccctatcactggcactggcatcaatccagcaaggagctttggagctgctgtgatttacaaccaagaaaaagcttgggatgatcaatggatattctgggttggacccttcattggtgctttcgttgcagccttttaccaccaatacatcctaagagcagcagccattaaagcccttggatcttcaggagcaatgcttaaaac

SEQ ID NO: 7435 - DNA, 560 bp, Gossypium hirsutum
  Clone ID: uC-gsronu33B108g07b1
cggatgtttggtgcttttggggaaattaaagaaataagggaggttccaaacaagcataatcacaaagtcattgagttttatgatgttagagccgcagaagctgcccttaatgctctgaataggagtaacagtgctgggaaacagatcaaacttgaaccaagccgtccagggggtcttaggcgctttattcagcctgagcaggaacaagatgaacctaatatatgtggaagtccttttgatgagttatcagggcatattggagtaattgcatctggtggcatggagaatgcatctaaccaggtgttacattcagttatccagtcacctgttaatacatttgttgaacctcgtcggagttctactgttcctattaacttagcctctccagcaagagtggcacctataggccaaaaattaagtcttcgggagcccaaccactctatggatgaaatgaaatatgctaaccatgggataccgagtttccatcctcattccttacccgagtaccatgatagcttagccaatggtattgcattcactccccagcaccataacaacat

SEQ ID NO: 7436 - DNA, 554 bp, Gossypium hirsutum
  Clone ID: uC-gsronu33B108g11b1
cccttgcgtccgcccacgcgtccggacactgtaagagtctttcttcaaagtatgagggggcagcatctatattgagtaaacatgatcctccgatccttctagctaaagttgatgccaatgaggaatcaaataaagatttagcaaatgaatatgaagtcaggggtttcccgactcttaaaattttgagaaatggaggaaagaatgttcaagaatacaaaggtccacgtgaagctgatggtattgtggaatatttgaagaaacaaagtggtcctgcttctgctgatatcaagtctgctgaagatgccagtaattttattgatgaaaagaagatagtaattgttggggtgttccccaaattctccggtcaagagtttgacaactatatggctcttgctgagaaattgcgttctgattatgaatttggtcatactttggatgctaagtaccttccccgtggcgagtcatcagtgactggccctgtcgtcagacttttcaagccttttgatgaactctttgttgacttcaaggattttaatgtggaagctctagagaag

SEQ ID NO: 7437 - DNA, 353 bp, Gossypium hirsutum
  Clone ID: uC-gsronu33B108g12b1
cttatcgtccgggttctttgctttctgtaccgtggggtctagtttaaaagcaactggtgggaaagacaaaatcatgggtccaaactatgtacctggggagaagaaagacttgtatctaaagagtgtacagagaactgcgatttggatggtaaagaaccatgtgacagttgaggacgttccttgtggtaatacaagtgccatggttggattgtatcatgtcatcaccaagaatgctacattgaccaatgagaaggaaggtgatgcccacccaattcatgccatgaagttttctgtctaccctgatgtgcgtgttgctgatcattgcaaggttgtatcaaatcttcccaaacttg

SEQ ID NO: 7438 - DNA, 504 bp, Gossypium hirsutum
  Clone ID: uC-gsronu33B108h03b1
tttccgcccacttgttctattgcaagagtcttgaaggtaaaaagcgggtcttcttaaactctctctgggggtgaatccaatcaaatcgaagatgttgagagtggcaacgaggcggctcacttcttattcgtctgcgtggaggtcgcaccaggccacctccgctatcgcctctcgtcctttcatcgacggcgccgattcttctgattgtctcagatccaattcctcctcctcctcctcttccttttccttctctttcgcttctcaattccttcttcccaccagaggttttgcttctgagtcactcaccccaaaaagtgaccacagtgtgattcctgatgttccagcaacagtggctgccattaagaaccccagttctaaaatagtttatgatgaatacaaccatgaacgttttcctcctggtgaccccagcaagcgggcatttgcctattttgtcctgacaagtggtaagtttgtgtacgcatctgttatccgtctgctcatcct

SEQ ID NO: 7439 - DNA, 571 bp, Gossypium hirsutum
  unsure (1)..(571): unsure at all n locations
  Clone ID: uC-gsronu33B108h04b1
attcttatcccaccatgtcacctgcaaccaccgccctggtnttcctatatacaactattggtggagctcaaatgcacacaacatcacacgcatactcgccaaaaaccctgagttctccaccttcaaccactacctcaccctcactcatttggcttccgagatcaaccgacgcgaaaccattactgttctggccctcaacaatgctgccatgtcatctctcttgtctaaacaactctccctctacaccctcaagaacgtcctctctctccatgtcctcgtcgactacttcggttccaagaagcttcaccagattaccaatggaactgctttgacgtccaccatgttccaggctagtggcgccgctcctggttcctctggctacatcaacatcactgatcttaaaggcggaaaagtcggcttcggggctgaaaacaacgatggaaatctcgatgctgcttacgttaagtcccgtgcagagattccttacaacatctctgtcttacaaatcagtcaggtttttgattcagctgaagctgaagcccccaccgcggagccaagcaagcttaatcta

SEQ ID NO: 7440 - DNA, 548 bp, Gossypium hirsutum
  unsure (1)..(548): unsure at all n locations
  Clone ID: uC-gsronu33B108h05b1
actggtttcaactggtacgttatattccatggccaggtgtgccgttttcaccgatgaaggcggggatttcgagggtcaatatttcgctttcatgtccgacgccatgtcaatcatcgtgggatcgttgctcgggacatcaccggtaacagctttcatcgaatcatcaacagggatacgagaaggtggacgaacaggactcacagctttaacagtggcgggatattttctgctagctttcttcttcacaccgcttttggcgtcgataccagcatgggcggtggggccgccgctaatactggtgggagtgttgatgatgagagcagtggtggaaattgagtgggatgatatgaggcaggcaatccctgcttttgtgacattgatattgatgcctttaagctattcgatagcatatgggctaattggtgggattgggacttacattgtcttacacattgnggactgggcaagggatgtgctggtaaagtatggcgtcgtaaaaagaagacagattgcggccaatggggcacatattcagcaacatgcaagtg

SEQ ID NO: 7441 - DNA, 488 bp, Gossypium hirsutum
  Clone ID: uC-gsronu33B108h07b1
ataccgtaactggcaaatgtgggatcgggggggatgcctaaaatccgggggaggcaggagaaaatccccccaatcccggaccgtctccaccatctcctataaagcctccgaccgtgtgcgatagttattattcctgtcccgagagcaatacctgctgctgcatatacgagtactataactactgctttgcttggggatgctgcccactcgaggctgccacttgctgcgaagatcgctacagctgctgccctcatgactaccctgtctgcaacatacatgaaggcacctgcttgatgagcaagggcaatcctttggcagtgaaggcactgaagcgcactccagctaaaccgttctgggcacattgaaagcctgggattgtaatgcagtagatgatgggttacaagggagaagatgaaagcttgacagtgcttagcaatctccttgggtctaatatcagtagatggatggtgacaattatgtatataaga

SEQ ID NO: 7442 - DNA, 432 bp, Gossypium hirsutum
  Clone ID: uC-gsronu33B109a01b1
cactatcttatacaaacaaagagaaaaaaaaaaaaaaaggggatttaaacaaaaaataagaggcagaaaaactgaactacaaagatgcttcaacagcggccgcattatagtgggtgtcgccctccttttccccgatctggcagatgggtcatcatttttgactacctgcttcttgacgggacaccacccaaccctctttgggttgcccttcatgtgccgtccttcaaagccttcatcttttgatgtctccgacgacctcctctttattcaattttggctcatcttgttcgtcttcaccatcctccatgaattgtttccagttctgggcacccccctatcttgtgtacatggatgagcacactttttttactgcagatgaagcttgcctttacttctctgatgagcttgcttcaagtcttttatggtgtttcc

SEQ ID NO: 7443 - DNA, 437 bp, Gossypium hirsutum
  Clone ID: uC-gsronu33B109a04b1
gaaattgatgccttctaagggaaatcagcaaattcctaaggtccatgtgaggaaacagtggcaaaactatgtaaaaacatggttggaccaatcaggaagaaagaagcgacgaatagaagcacgtaaagcaaaagccattagagtatttcctcgtcctttgggtctcttgagacctgttgtacatgctccaactattcgctacaatgcaaagatcagagctggtcgcggttttactttggaggaattaaaggcagcaggagtgaacagccttgttgcaagaactattggaattgctgttgatcacagaagaagaaatagaagtgatattagtctcagagccaacgtacaaagacttaaggaatacaaggccaaattagtattgttccctaagaatcctaagaagcctcaacatggagaagcttctacatctgagaaag

SEQ ID NO: 7444 - DNA, 386 bp, Gossypium hirsutum
  Clone ID: uC-gsronu33B109a05b1
gtggttcctttttgtaactgggattcctctgctgttaatgggttctggcgccagtgcaggtgttggaggttatgcacttccaaaggttgctcagctcaccgtcacttcctattatgctgcctctagtgcctcgcattatggaatttcactgctcacgcgacacattgaagatgcatatgctactccttctcaacaagaaaggctaagatgaatccttaataatgcatttactcaagattctactttcatcagttctgaaatagccatatgatgcctatgggtataggacctttgggaggattcggttttttcattttaaatgagttcctttctgatttttacatttgggtccttctaaagttaatatataatatagtaatattcat

SEQ ID NO: 7445 - DNA, 447 bp, Gossypium hirsutum
  Clone ID: uC-gsronu33B109a06b1
gacgttcaattctgtgagagggcctagaaactttaccctgggagcaccaggtccaggatatacttgtggacctgctaagattgtgcaagacactaagttcataacgggggattgatggagaataactcaagctatgatgacatggaatgtgacatgcacatattcccaattcctggctcaaaagactactacatgtggcgtctcgctctcttgcttctataataacactatcgtgaattgcccgacatgtgcttgtggctgtcagaataactcaactgaatctgggagttgtgtaagcgaaaggtcttcacatttagcttcagctgctccgggcaaatctaccaatgcaccacctttgcttcagtgtacgagccatatgtgtccagttagaattcactggcatgttaagctcaactacaaggaatactggcgtgtgaagatcacgat

SEQ ID NO: 7446 - DNA, 98 bp, Gossypium hirsutum
  Clone ID: uC-gsronu33B109b03b1
aaatttattaaaaaaaaaaaaaaaaaaaaaaaaaaaaaagaaaaaaaaattaaaaaaaaaagaaaaaaaaaaaaaaaaaaaaaaaaaaaaaaaaaaaa

SEQ ID NO: 7447 - DNA, 478 bp, Gossypium hirsutum
  Clone ID: uC-gsronu33B109b04b1
ggaggtcacccatcctagtactactctcgcccaagcgcgcttaactacgaagttctgatgggatccggtgcattagtgctggtatgatcgcacccatcaattcttgcgcattctatttatataaaggctacccctgatcgcgcttgagcctcgaatttgaatttaaatacgtccaaataacgtttcgagtgatttattccgtaaataactaattagttatacgatgagatataaaaaaaataaaaaaaaatttaatgagatataaaattggaagggtgcaacacgaggacttcccaggaggtcacccatcctagtactactttcgcccaagcacgcttaattgcgaagttctgatgggatccggtgcattagtgctggtatgatcgcacccatcaattcttgcgcattctatttatttaaaggctacccctgatcgcgcttgagcctcgaatttgaatttaaatacaaccaaataacg

SEQ ID NO: 7448 - DNA, 64 bp, Gossypium hirsutum
  Clone ID: uC-gsronu33B109b05b1
ccctctcgttcgaaaaaaaaaaaaaaaaaaaaaaaggggggttttataaaaaaaaaaagggaaa

SEQ ID NO: 7449 - DNA, 318 bp, Gossypium hirsutum
  Clone ID: uC-gsronu33B109b10b1
tgctgctcctcctgcacgtagctcgtccttccttcccggatccacccagcgcgtccgctcgttcgtacaaaaaaaaaaaaaaaaaaaaagggagggatttattttaaatctattgtgggggtatccaagactctcaaacaatttacatgctacaaaataactcttgtctcgtgcctcctagattcaatttctctggccttctcgttacatcgtggggcctgggtttacccggccccttctcctccttcgcgggcttgcatttcatccgctcttttttttgttcccctatttgctattcggcccctttcgttcttccct

SEQ ID NO: 7450 - DNA, 465 bp, Gossypium hirsutum
  Clone ID: uC-gsronu33B109b11b1
ataatttcaaaaaaaagaaaaaaaaaaaaaaaagggggaaatataataaaaaaaagggggagaaaactttactatttataaaaaaaaaaaagggtgttggggttggggtatccatggggactgaaattttacggccctcggattgtttgattgtacagctcccgtgtttcttcgacggctcgttctcgtcggagatattggacatgggaagctcttagtcctacctataattatcctaattgtaatagcaatacctttagccggttcgtgtccttggcacaggggcccttagcggaccgtccttcccatttttatgggaatcgggaatggtcaaggggacacgccctgtacgtggtgtttatgcccccttagcggtgggggttaccgggaagggtgcccccctacccctggcccttcgcctttggcggcccgtttcttatcccctttttttcccctttttttttc

SEQ ID NO: 7451 - DNA, 477 bp, Gossypium hirsutum
  Clone ID: uC-gsronu33B109b12b1
ttcacgcgtccgcaacagaggcctttgcgctattgggcaggccgagtctcttcgctgcaagctactcggaggtcttgccgttcgcagggcctgctatggtgtactgagattcatcatggagagtggtgccaagggatgcgaggttattgttagtggaaagctaagagcacagcgtgccaaatctatgaaattcaaggatggatatatgatctcttctggtcatcctgtcaatgagtatattgactctgctgtcagacatgttcttttgagacagggggtgcttggtatcaaggtcaagatcatgctagactgggatcctaagggtaagcaaggccctactactcccctacccgatctagtcacaatccaccctcccaaggaggatgaagaaatcaggagagtagagcctgagccaactaatattgaggttccagttatggcttaaatactgttttggttgacatctttttgattttt

SEQ ID NO: 7452 - DNA, 479 bp, Gossypium hirsutum
  Clone ID: uC-gsronu33B109c03b1
agctctgttattgtaagtgacaaagtgcagaggaatacatctgatctgccactggagttaggtgtggatagcaagtgtacaattaaacaggtctcatggtaggatccgtccacttgtttccctattgccttcttgggctgcagttttgatgtttcctaaacctggaccccctctctctgatctgcctgacaaataacatttgctatgcatgtatgattctctctgttctatgggtatgcaaagattgctaatttgtgtgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaataaaaaaaaaaaaaaaggggcgccctttttaggggtccaaattttcctcccccggtattgaaagcaaatattttttttttggggcccctaaatttaatttaatg

SEQ ID NO: 7453 - DNA, 86 bp, Gossypium hirsutum
  Clone ID: uC-gsronu33B109c05b1
aaaatttataaaaaaaaaaaaaaaaaaaaaaaaaaagaaaaaaaaaaaaaaaaaaaaaaaaaaaaaaaaaaaaaaaaaaaaaaaaa

SEQ ID NO: 7454 - DNA, 495 bp, Gossypium hirsutum
  Clone ID: uC-gsronu33B109c09b1
catggttactagctgagcagatagctaaagatccttcattcacccaaatggcagaacggctcactaagacatttcaaggggcagcaactgaagatagtatgccgcagtttgatccacagcagtactattcaactatgcaacaggttatgcagaacccccagtttatgaccatggctgagcgccttggtaatgcactaatgcaggatccagctatgtctagcatgcttgacagtttcactaatcctcaacacaaagaccagattgagcaaaggatggcacttatcaaagaagatccatcactgaagcatattctagatgaaatagagactggtggtcctgcagcaatgatgaagtattggaatgataaagatgttctgaagaagttgggtgaagcaatgggtcttgcagtttcaggggatgcagccacttctgccgacaactctgcggcagatgaaggtgatgaagtaggatatgaggatgaatcaattgtacaca

SEQ ID NO: 7455 - DNA, 325 bp, Gossypium hirsutum
  Clone ID: uC-gsronu33B109d01b1
tgttgtaccatcatttacacagccaaagatgggggggatttttaaaaaaacatttggggggactccacaaatcccgaaacacgttgttggagtctgggcaggtgacagatgacgacattggttatataaatcagaaggtcacaacaactattaatgaaccattatagtccagcaaagattatgttcccaaaagacgggactggctttctgcttactggacgggattcaagtcacctgaacaaatttcacgtgttcggaacactggggttaaaccccgagatattgaaaaatgttggcaaagcaatcacaaccctttcagataatt

SEQ ID NO: 7456 - DNA, 516 bp, Gossypium hirsutum
  unsure (1)..(516): unsure at all n locations
  Clone ID: uC-gsronu33B109d02b1
ccggaccgttttcccgggtcttcctaccccccggatatacccccgaaanacggcgagaactggngggattttataaaaaattttggggtggaaacaactcatttccagaaacatccattcaggttatcgttttaggtttgcaacactgtctggcacccaatatgcgaagccgaaccttaactatgcaacgagcattttcagtgtccaaaaaagatgggcttctcaagctaagacatctgaggatgacgacaaaatcagcatcggtcctcgtaaaagcaaagaagacgaccaagatgagaaggatgccggggttgttttactacggtccgatttcttctacaatcaagaaagtaaagatgctttcacttttcgacctgctgcctctcggtatcgttaggccctgtcattacattcatgacttttcctgatatgaatgtgattgtgaaaggtgcggttgcatcctctgtgatattctttagtgctacaacaactgccgcactttactggttcgtgagc

SEQ ID NO: 7457 - DNA, 432 bp, Gossypium hirsutum
  Clone ID: uC-gsronu33B109d03b1
ttttttttttgtgtttttttttttttttttttggtttatgaaattttattttttaaatattatatttttaaattaattttttttaaaaaatattttaaaaaaaaaaaattttgtggaggggggaaagagaaaataaaaaataaaaatggaaaaaaaaaaaaattttaaaaaaaaaaaaaaaaaaaaaaaggttgggggaaaaaaaaaagacaaattcaatttttttaaagggcgggaaaaaaaaaaaaaaaagggggggtgttttaaaaaaaaaaaagggttaaaacttaaaaaaaaggcaaaaattttttaaaaaaaaaaaggtttaaaaaaagggaaaaaaaatatgggggggggaaaaacccccaataaaaaaatttaaaacaacccctcttttttaaaaaaaaaaacaaattggctttgggggcattt

SEQ ID NO: 7458 - DNA, 495 bp, Gossypium hirsutum
  Clone ID: uC-gsronu33B109d07b1
tgtctaaccatcatttacacagccaaagatgtgtaggatcattcggaatcacccctcagcacttcagatataccgaaacaagttgttggagtctgggcaggtgacagatgacgacattggtaatataagtcagaaggtcagtacaattcttaatgaagaattcttggccagcaaagattatgttcccaaaagacgggactggctttctgcttactggacgggattcaagtcacctgaacaaatttcacgtgttcggaacactggggttaaacccgagatattgaagaatgttggcaaagcaatcacaacccttccagataattttaagcctcatagagcggtgaagaaggtttatgaacaacgtgcacagatgattgagacaggggagggccttgactgggctatgggtgaagcacttgcatttgcgaccttgctggtggaaggtaaccatgttaggttgagtggtcaggatgttgaaaggggtacattcagtca

SEQ ID NO: 7459 - DNA, 523 bp, Gossypium hirsutum
  Clone ID: uC-gsronu33B109d08b1
gttttatccgatagaaatatggcgagaactgctctcttccacttgcttcgatcccaatccaagcaactcatttccagaaacatccattcaggttatcgttttaggtttgcaacactgtctggcacccaatatgcgaagccgaacctcaactatgcaacgagcattttcagtgtccaaaaaagatgggcttctcaagctaagacatctgaggatgacgacaaaatcagcatcggtcctcgtaaaagcaaagaagacgacgaagatgagaaggatgccggggttgtttactacggtccgatttcttctacaatcaagaaagtaaagatgctttcactttcgacctgctgcctctcggtatcgttaggccctgtcattacattcatgacttttcctgatatgaatgtgattgtgaaaggtgcggtagcatcctctgtgatattctttagtgctacaacaactgccgcacttcactggttcgtgagcccttacatccacaaaatccggtggcagcctggttcagaca

SEQ ID NO: 7460 - DNA, 453 bp, Gossypium hirsutum
  Clone ID: uC-gsronu33B109d11b1
cttttataatctcatcccaatttcctccccagcatcactctgttttgtttcttggtcagtttccgttattaaacaatggaaaagattcagcacagccatgtccaagcgcgaggattaaagcttcacgtagcccaaagtggaacaggtcctaaggtggtgcttttcctgcatggcttcccggagatttggtattcatggaggcaccagatgattgctgtggctaatgctggtttccgagcaattgcttttgatttcaggggctacggactctccgaccacccaccggagcccgaaaaagctagtttcaaggaccttgtcgacgatgttgttgcccttcttgatttgttgggaatcaataaggtttttcttgttgggaaggattttggagcagtgcctgcatttatggtagctgttatccaccctgaaagggtgttaggtgtcataacactaggc

SEQ ID NO: 7461 - DNA, 502 bp, Gossypium hirsutum
  Clone ID: uC-gsronu33B109e02b1
ttcccttgtctacttacctcaggacctacaagatcggggactacgtagacgtcaaggtaaacggtgccgttcacaagggtatgccccacaagttctaccatggtcgtactggtcgagtttggaatgtcacaaaacgtgccatcggtgtcgaagtcaacaagcaggtgggaaacaggattatcaggaagaggattcatgtacgtgttgagcatgtacagtcttcgaggtgcgctgaggaattcaagctcaggaaggtgaagaatgatcaactcaaggcagaggctaaagcaaagggtgaggtcattagcacaaagaggcagccagaagggcctagacctggtttcatggtggatggtgctacacttgaaactgttacgcccatcccatacgatgtcgttaatgatctcaagggtggttactaaatctactctgttttttgtttgcggcattggtttgggttttctttatttttttttttggcaaaacatcaatggtgaactga

SEQ ID NO: 7462 - DNA, 490 bp, Gossypium hirsutum
  Clone ID: uC-gsronu33B109e09b1
tcgttcacgcgtccgcccacgcgtccggccttatcatcttttttagccttattttattcgtcgaataagcgatttctgtttttcgattttctctctctttctccggaaaaaaaaaaagaaaattttttagatctagaatctgcgatcatggagatggagcgcgtgacggggttccctcatacgcatatggatcgccgaccaagaaagcgtccgcgattgggctgggacgtaactcagctgccaccgcaggctcaggtaggaatgttttgtgcacaagaagttgggagagtgacaggctttgcttcttccactgcaaaagcacctgcagattatgctagtactattactactagttcttctgtagttctaaagggaggagtggctcaaaatggttctcccccatggcgagacgatgacaaagatggacattacatgtttgagcttggagataatttaacctctcgctataagatacagagtaaaatgggcg

SEQ ID NO: 7463 - DNA, 488 bp, Gossypium hirsutum
  Clone ID: uC-gsronu33B109f05b1
aatatttttaggaagaaatgagtgctttcaataaggggaaagcaagtgttcctgttgcgtggagcccgaacctctatataacccttgtgaggggaattcctggcacacgaaggcttcataggcacaccttagaggcactaaggttacgtaaatgtaaccgcactgtcatgcgttggaacactcccaccgtccggggaatgctacagcaggtgaaaagattggttgtggttgagacagaagaaatgttcaaggcacgcaaagagaacgaagccaaacaccgagctctacgtccccttatcgttattaatcatctcctggcttctgcaactgactccactaagtagccttataaagacgacaatagtaagtttttgaacctctattttagtagggattgttcgggttttttcgacataatttctctatgtttgaagaaaataatcggagtaaaaatggtgaactcgaaataacactgtattgaactctgc

SEQ ID NO: 7464 - DNA, 501 bp, Gossypium hirsutum
  Clone ID: uC-gsronu33B109g03b1
atagtgttgtaattagtgccaatggctcggattgggacctctgcagctcacattgtgttggcaatatttgctgtggccatgtttgttgtgtccgggaccatggcacaggatattgctccttctcctgcaatggctaccggagcaggctctgctttgccggtttccgctgtcttcttatgctcttccatgttggtctctttaattgctctcttggtgcattgaattcaaagcttttcaagactttatgacattggctacccttaatttcactctcactggtgatgaggggagtagcctctaatcttctccgagataatatttgggtgttatcaattttcaatttctctaaagttttaaatatctctatatatatcatgttacattagtgacataaatttgattttgtaatgtaattggtgtgattttcttatatatcatagatatataagggtattgatcctatttcttttgtattcatattatgcagtttgctttgctttg

SEQ ID NO: 7465 - DNA, 496 bp, Gossypium hirsutum
  Clone ID: uC-gsronu33B109g04b1
ccgtgattattgtccatgggaaatctggtttcaacatggatccttaccatggtgatcaagctgctgacatactcgtcgatttctttgaaaagtgtaagaaagatccatctcactgggataagatctcccatggaggcttgaaacgaatagaggagaagtatacatggaagatttactcggagagactattgaccctgacaggagtgtatggattctggaagcatgtttccaaccttgaacgccgtgagagtcgtcgttaccttgagatgttttatgctcttaagtaccgtaagctggctgaatcagttccattggcagaggagtaaattgaagctgttaaataacattgggccggtttttcttggagaataatattctgttttgtaatttcaattggagaagctcctttgtatttcatcttgtcttttccttttccttttttcgccggcattgtttgaaccatgggttgtgcgcccgtcaattccagttaaatatg

SEQ ID NO: 7466 - DNA, 525 bp, Gossypium hirsutum
  Clone ID: uC-gsronu33B109g07b1
cccactcgtccgctgggaatgaaattgaagagggggaagctcacgagggaggagctgtttgggacattttccggaggcaagatgttccaaagctgcaagattaccttaaaaagcactttagggagtttagatatgttcattgttgcccagtatcacaggtttttcatcctctacatgatcagtccttttatctgaccatggatcataaggcaaagcttaagcaggaatatggaattgaaccttggacttttgttcagaaacttggggaagctgttttaatacctgctggttgtcctcatcaagtccggaacattaagtcatgcataaaggttgctctcgattttgtttcgcctgaaaatgtcggtgagtgtgttcgcttgactgaggaatttcgtctgcttccccgtgatcatagggaaaaagaggataaactagaggtgaagaaaatgactgtacatgcagtccagcaagctgtgaaatacttggatccaaatgcagaggttgaacttgcttataaagttaatt

SEQ ID NO: 7467 - DNA, 448 bp, Gossypium hirsutum
  Clone ID: uC-gsronu33B109g12b1
ttctacaaatactttgctgcaaattctcctaattttggcagaaaatctaacacaagggaaaaaatgagagagatccttcatgttcaaggtggacaatgtgggaaccaaatcggttccaagttttgggaggttgtttgcgatgagcacggcatagatccaactggaaggtacattggttcctcggatctgcagttggagcgtgttaatgtttactataacgaggcttcatgtggtcgctttgttcctcgtgctgtgctcatggacttggagcctggtacgatggacagtgtccgaactggtccttacggccagattttcaggccagacaactttgtttttggacaatccggtgctggaaacaattgggccaagggccattacactgaaggagccgagcttatcgatgccgttcttgatgttgtgaggaaagaagctgaaaactgtgact

SEQ ID NO: 7468 - DNA, 64 bp, Gossypium hirsutum
  Clone ID: uC-gsronu33B109h04b1
cccattcgtccgaaaaaaaaaaaaaaaaaaaaatggggggaaaataaaaaaaaaaaaggggtaa

SEQ ID NO: 7469 - DNA, 522 bp, Gossypium hirsutum
  Clone ID: uC-gsronu33B109h07b1
gtcatgaaggtgaatcaggttgctgacaaatgttgggatctctattcaagtgagtcacttgagcgagacttgcctggacacctactccgctaccccatcggtgtttctagtgatggatctgtcactgaattgcctggcatcgagttcttccctgacacaaaggctcgtgttcttggtgccaaatctgattatctgccacctatcctcactacttaggggatctttactttgttcttaagcaataataacttgtctagtttggtgctactggctttggtagtaacaataaaacttgtttttgtgcttgtgtcatagtctgcagagctgcagtgttgtgttggtattgcttttccgtcagctgtgataccgtgttgtgattttagtgctgactggtataataaaacttgtagcctccgtgtatgtgttctgcggttattgttaattatctgttagttgttaccactttgcggaagcatttgagctgcagtttttggttgttgtgttagagactcttcatgatct

SEQ ID NO: 7470 - DNA, 496 bp, Gossypium hirsutum
  Clone ID: uC-gsronu33B109h09b1
aattgtttcaatttgcatcttccaatcactttgaaagcagttttttgaggtaaaaatcccccaataagaaggggaaaagaaacagttagttgctccggaaatggcggacgcgttttgttcggactgcaagcggaacacagaggtcgttttcgaccattccgccggcgacaccgtctgttcggagtgcggcttggtcttagagtcgcattctatcgacgagacatcggagtggagaaccttcgccaacgagtccggcgataatgatcccgtccgtgtcggcggtcccaccaatccgcttttggcggatggcggtttatccaccgttatcgctaagcctaatggtgcttccggggagttcctctcgtcctcgctgggtcggtggcagaatcgcgggtcgaatccggatcgggggttgattctcgcttttaagactattgctacaatgtctgataggttgggtcttgtcgcgaccattcaggatcgagcccatgagata

SEQ ID NO: 7471 - DNA, 516 bp, Gossypium hirsutum
  unsure (1)..(516): unsure at all n locations
  Clone ID: uC-gsronu33B110a04b1
ccttctcgtccgggcttcaacattgatccttaccacggcgaccaagctgctgtgatccttgtcgacttcttcgagaaatgcaagacagactcatcttactggaccaaaatctctgagggaggtttgaaacgtatcgaagagaagtacacatggaaaatttactctgagagactattaaccttgaccggtgtctacgggttctggaagcatgtgtccaacctcgaccgcctcgagagccgtcgttaccttgagatgttttacgctcttaagtaccgtaagctggccgaatcggtacctttggcagttgaagagtaaattgaagttgccggggaaagaattgggagggatttccgagttcttgagaataatctttgttgctttggcattttgatccaactcttttgttttctctggntctttatgtgcatttgtctttgctcatgttttgggcattggttcaacatctgggcgtngagcccatcaactctagtaaagaaaacatgggcactttgcttc

SEQ ID NO: 7472 - DNA, 287 bp, Gossypium hirsutum
  Clone ID: uC-gsronu33B110a06b1
gtctatttggtaacttattagtattgttgtgtttcaagtgttgtcttccaatgcaattggatttagtgaagtgtgtggggtccggtatgagaagagttcctccacctcctcattttcagtgtttccattgtgtaataaaaatctgctatcttcttcaaaaaaaatataaccaaaaaaaaaaaataaaaatatgaaataaaaaaaaaaaaccaatatctggtatttaaaaaacaaaaaaaaaattaaactggacccaggcaattttgggggggccgttttaagggatc

SEQ ID NO: 7473 - DNA, 426 bp, Gossypium hirsutum
  Clone ID: uC-gsronu33B110a07b1
cattatggtggtgccactggaaacaatgagaatgatgcttccggacatcctgtgggacaaaatgcatatgaagatagttatggtattcaccagagacatggtgctctaccacctgctgctactggtgcaaatgcaggtgccgcttctgtttacggtggaactcagtctgggtctggacctgcatctatgaggtccacctacgagatgtctagagggcctgcctatgatttgtcaagagtgagtggttatgaatcacaaagggtgcctgcttacaatgcacagaaaggacccagttatgacggtcaaagaacccatgtctatgatgcacaaagaggagctggctatgacactcaaagaggacctgtaaatgatccatcccggtgtgcaacctatgatgcagcaactagaagtcttggcatgccacac

SEQ ID NO: 7474 - DNA, 537 bp, Gossypium hirsutum
  unsure (1)..(537): unsure at all n locations
  Clone ID: uC-gsronu33B110b07b1
ctgtctctagacggggacaacattattgctgtgtgtagcagcccgatagatgttcctcaaatcaaatatggctgccttgtggacaaagtgactaatacaaccgcttggcattggttaaatgtctcaagccccatttttaaatgttcagagaaggttatgtctctgctttcacatcttcagtttggtatcacgcaaattccagtgaaagatgtttctgattgcttgacaaaaggagctgctaagtcttttgaggcaatatttgtatcttccaaggtaaacaatgcacctgatccgctaatagtggtccttcatggagggcctcattccgtctctttgtcaagcttctcaaagtcattggcatttctttcttcacttggtttcagcctattaattgtaaattatagaggttcactgggatttggcgaggaagcattgcaatctcttcctgggaaaattgggtctcaggatgtcaatgatgtactcacagctatagatcatgtcattgagaaaggactnngtcacccatctaaaataact

SEQ ID NO: 7475 - DNA, 357 bp, Gossypium hirsutum
  Clone ID: uC-gsronu33B110b09b1
aattttggcatataaattctgatctaaggaatcaaccactttcatttgaggtcactaatagtgatggtcttacacttacatcttacaatgttgctcctaaaaattggaactttggccaaacttttgaaggaaagcaattcgaggtctaagatgaaagaaaagcatcatcatcaacacaatgtaatgttgggtattatttattttatatatatagaccagactgtcctattcttttctttctttttgtttatctgttgttttgtactgattggggatggaaatggaagggtagaattggcgacttttttattgtgtgtaaggacttaaaatagcaggatatatcaattttgcccaaaa

SEQ ID NO: 7476 - DNA, 485 bp, Gossypium hirsutum
  Clone ID: uC-gsronu33B110b12b1
tctccacgcgtccgcggacgcgtgggggatgatgaagaggaggatggatttttgaaggcattcaaggtagctaattttgaatataaggacgaagcagaaactgttgtggaggaagaagctcaaaaagtggccgtggaggaaaaaaataccatgaataattctgaaagaacaagttactgggaagagttgttacgagaccgatatgaagttcataaagttgaggagttcaatgctctgggaaaaggaaagagaagccgtaagcagatggtatctgttgaagaagatgaccttgctggtttggaagatgtaagctctgatggtgaggacgataactttgaagctgaactgactgatggtgacacaacttcatctggaactcaatctggtagaaggccttacaggaagaggaatcgtgtggatagtacggagccaattcctctaatggaaggtgaaagaaagtcatttcgggtgcttggtttcaatca

SEQ ID NO: 7477 - DNA, 533 bp, Gossypium hirsutum
  Clone ID: uC-gsronu33B110c02b1
tgccaacttattcgctatgcaacttgccagtgcatcagttctccccatggtcctcaaatcagccattgaacttgacttgctggagatcatggccaaagctggtccaggtgctttcttgtccccaaaagaagtggcttccaagctccccaccaccaaccctgatgcacccgtcatgctggaccgtatcttgcgtctcctggctagctacaacgtcctcacttgctccttgcgtacccttcctgatggcaaagtggaaagactctatggccttggccctgtctgcaaattcttgaccaagaacgaagatggtgtcactctttccgcccttagtctcatgaatcaagacaaggtccttatggagagctggtactacttgaaagatgctgtgctggatggtggaattccattcaacatggcctatggtatgactgcatttgagtaccatggcactgatactagattcaacaggttttcaacaggggaatgtctgatcactctaccatcaccatgaagaagattctcgatacatatga

SEQ ID NO: 7478 - DNA, 388 bp, Gossypium hirsutum
  Clone ID: uC-gsronu33B110c05b1
tttttctcgtccgcccacgcgtccgcacaaacccaaatgtccaattgatctgtttcatttttcagcaaagctagaaaaacaatgactaaggatatcgagactgcagagcaacatggaggggagttctcggccaaggactaccatgatccaccacctgctccattgattgatgctgaagagttaaccaaatggtcgttttacagggcagtgattgccgagttcattgctacacttctcttcctgtatgtcactgtgttgaccgagattggttacaaggtccaaaccgaccctgctaagaacactgttgaccccgattgcagtggcgttggcattctcggtattgctagggctttcggtggcatgatctgtattctagtttactgcatcg

SEQ ID NO: 7479 - DNA, 543 bp, Gossypium hirsutum
  Clone ID: uC-gsronu33B110c06b1
ctgctggttccggtccggttttcccttgtcgtccctcgcgtccgtctaattttcaacaaaaaaaaaaaaaaaaaaagggggggttttttttaggtttttttttgtttccccccccaaaggggtctccgtttttgggggcggccgttttttgggtggcctgctttcgtgggccccccttgtctcggccctggtttgtttttagggtctctctttttttttttcccggccttcgtttttccgggtcgggtttgtccttcccttggcgggccgaccctctttggttttttcccctcttttcccttgtgggcgtttgcgctttttccttttttggctctttcctcttgcgccccttccccattgtcctcttccctccttgtggtctggccccttccctgcttttggcgcctctctcttgggggctttggcccctccttctggggggtccttttcccttgctgtcgtcttttttcccgcggttctcttcctggccttttcgttttttttccctgtctctttttcccgggtttcttttttctcggggtt

SEQ ID NO: 7480 - DNA, 490 bp, Gossypium hirsutum
  Clone ID: uC-gsronu33B110c09b1
ggttttatctaatagaaagccaagacggttccccaatatttcttcttcttgaaaacccagcaactgtttatcaaaaagattttatatattgccttgtttctttctttgtttttggggttttgcaaaaatggcaacaagtaggatcttttttggttcaaaaccacgatatatctacccaactatggaatttgatgatgggaatctcatcaacaacccttcatttgatcatcatcatcatcatcatctgctggagttcgatgaggtggatgtatggaacaattcaaatgatcaagcaacaaccaacttagaagccaaaaaaccattgccaagttaccgagcttcctctaagaaagctttcaaaaagaaggagtttcagattagcgataataataaccataggagtgcccaaatgactgctgcttctgcttcattgccggtcaacatccctgactggtccacgattctcatagctgagtacagggaacatggg

SEQ ID NO: 7481 - DNA, 399 bp, Gossypium hirsutum
  unsure (1)..(399): unsure at all n locations
  Clone ID: uC-gsronu33B110c12b1
tctatacaaccacttggtgaagaagtactggaacaggagccagaaatgttaccctgttacgcttcagcgacccctctctctccacaactatcttccttgggtactcctaggatgggtccttctatcaaagtgtgggacccatataatgttttagctccacctcctccgctgcctccgcctcctgttttctcccgttctttctctttccaccatgatcgattgctgcttgaggtttatttcatttgccatggcgagtctgatttgaatttgaggcctgatattgtcggtggaagatgcgacggtgccgccttaacctctaatggcaagcgccatgccagngctttggctgtcttcctaaaatctcaaggggtcacctttattgccgtttattgctctccc

SEQ ID NO: 7482 - DNA, 512 bp, Gossypium hirsutum
  unsure (1)..(512): unsure at all n locations
  Clone ID: uC-gsronu33B110d06b1
tttccggacatcaagatccaatcccggcttctggaattccgggagttcaatcccatcccatgaccatccatcatcatatgcgtcatcaaccatatatcccccacaacttatcacgaattccctccgctccgatacccgggcaatggacttccggtctttgtcattgtttcgacgaccccgtaaactgtgcaatcacttgcgtatgcccatgtatcactttcggacaaataaccgaaatcatcaaccgaggatccaaatcttgtgtttcgaggggatttttatttggaatgttgtctatggtgggagctgcatgtttttattcatgtttttcccgatcaaagctacggtgacaatacgatttgccggaggaaccctgtacggattgctcggttcattcttgctgttctgcttgtgctctctgtcaagaatatagagagctcnaaaatcgtggacttgacatgggaatnggttgggaagcccacatggacagacagaagcgcggagtaacaatg

SEQ ID NO: 7483 - DNA, 358 bp, Gossypium hirsutum
  Clone ID: uC-gsronu33B110d09b1
ataataaaaaaaaaaaaaaaaaaaaaaaaaaagggggggaattaaaaaaagaatccgcgaaaaaccccccaagggaaaaagggcagaccggccagggcgccccagctgcgcaagccgcaaaggcccacagaaaacccaaagaaacaggacaaaaggggggggggcccctatagggggcccacccccggccccccgggctggccccctaccatcccgcacttgggggccccgaaataaacccccgggcccggggtctaccccccaggcgggggggaccccccggggcccccccaccaaacgcccccaaacaaaaatgggcttggggtctgggggaggcaaggacccgaacccccgcggg

SEQ ID NO: 7484 - DNA, 439 bp, Gossypium hirsutum
  Clone ID: uC-gsronu33B110d12b1
ttcatccatgttctcgatggaaaagtccgatgcctacagaaaaggctttggttcaagcatgaaatgggatggtggtccaggaggacctggaagtggaccatatggtggtggtggtggcccacgacgaccaccacggggaatggacaatgttcggggaattgaccatagttcccttcctgcctgtggctcctgctgcggtggctaattgctgcaagcatacatcttgtgcatgtacaatgttatatagctaaagtcctctaattataagtaaggatgttccacatgtttttaatgccaatagattgcctgtgaaacaggcaactttgaacctctataaaaccagagatgcttttatgtactttcaaacttttgctaaatggtgggctgatactgctctgtttctacaacatgtcgattagattcgagaaacatgttccat

SEQ ID NO: 7485 - DNA, 314 bp, Gossypium hirsutum
  Clone ID: uC-gsronu33B110e01b1
tccatgcgtccgcccacgcgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaagtaatgatgattaaaaaaaaaaaaaaaaaataaaaaaaaaaaaaaggggggggcctttttggggggtcaaaattatctgccgggggggggcagtgttttttttttttatgggggaaccaaaaaataatttctggggggggtttttaaaattggaagaaggggaaaacccgggggtttcccaaa

SEQ ID NO: 7486 - DNA, 462 bp, Gossypium hirsutum
  Clone ID: uC-gsronu33B110e02b1
attctttccacccgcctcctttgttccacctctttctttctttttctccaaagccatcatgaatctcattaataggctcagccccaagcgtctctttcgatctaataaaaaagatagatccatcgtctccaagttcgacccctcctcctatagttccggttccgccgtttcctcctcttcctcctccgaatccgtctcttccaccctcaaagaacatcagtacccttccacggctaccgctggcttcgtaacgcccaccagtgttttgccccaaacatcaggtgactggtccgattttcccgctaatttttatctagaactttgccaggcgtttaaaatgttagacaaagataacgacggggttatatcgagatgcgagctcgaggctttgcttggcacggtcgcaaggcagccgcccagcccggacgaggtttccttgatgttgagcgaagtggacggtga

SEQ ID NO: 7487 - DNA, 201 bp, Gossypium hirsutum
  Clone ID: uC-gsronu33B110e03b1
cctattcgtgcgtcttgtacagtttcctgtacagtaagctgtttcttttcaattcccttagttatatactttcttttttacctttggtttgagtactcgattatttgagtttctattaaggggtcccttcccctctcttgccttgttgactgatttttttttctaatgcattaagtgtgtgaccaaagtcgttccaggtaa

SEQ ID NO: 7488 - DNA, 434 bp, Gossypium hirsutum
  Clone ID: uC-gsronu33B110e04b1
atttatgtatcgccttcgaatatggaaaaggacgcttggatgatcgtacatttctcagtgcagatattcaaaatataacgccgacccatgtgtccaatgctgctggcgttaccggcagacctaatgtagatgggtgtgaatctcacaaaacagaaacaatcattgccaatggggctggtactctaaccttggcagatggttgcagagaccatgggctagggatgatgaatttcgctaccgggagcatatctgaggatgatactgcacattctcagggctctggcattggatgtaaagaggcagattaacccaatttcatcgggtacttatattcaaaatccaatgccgtggttgaagagctgttgaaagagtatgacggcggctgcacccttagagttcgaatgccaatctcatctgacctaaacaatccacgc

SEQ ID NO: 7489 - DNA, 459 bp, Gossypium hirsutum
  Clone ID: uC-gsronu33B110e06b1
tttgcttctgtttacattcggtagaggaaggagagggtgccctggagtggtgcttggaagcttgatgactaccatgctgttagcgaggctattgcaaggattcgattggagcatcccgactaaccagggaaccattgatctttgtccaggaaggggagttccctttctggctaaaccactgcttgctgttgcaaagccacgattgctaccgcatgtctactctttctcaactgaaagtgaaatacagtgattaactccttgacgaagatgggggttgacaagggagacctgtttgtggcttggttctaatgaaattgtttttatccctagtatgtatttcctgttgtagcttatttcggtgtttgtatggggtgtactcacttcagcaacttcttatgtattgttttctcattaataaaaatggataagcagttagtagctgatgtattgctttccatg

SEQ ID NO: 7490 - DNA, 479 bp, Gossypium hirsutum
  unsure (1)..(479): unsure at all n locations
  Clone ID: uC-gsronu33B110e09b1
aaataaccggaagctgggagttaacttcaaaatttgaagggagaaaaatggctatgtacatccgtgtgaagcgtagcaagacaacatactttatccagtgtgatccaactgaaactaccctagacattaagcaaaagttgcataccctcattgatcaacctgttaatgatcagcgtttgatccttatgagtaatggggatatattagaggattcaaaaactttggcagaccagaaggttgaaaatgatgctgttgtggcactgaccttgagaaaagatgacaacgagttcgaggatgtcaacatagtaaaaccaaacgatttctaccaatctcgtgacacagatagtggaaattggtaagaccacaacggattctagaagaggttaaagctgataacancgagaaggagtctcagcgaccagatgtatgtaagcctgatatttcgacgttccatgatctttgtgcatggactgtttaac

SEQ ID NO: 7491 - DNA, 477 bp, Gossypium hirsutum
  unsure (1)..(477): unsure at all n locations
  Clone ID: uC-gsronu33B110e10b1
gtgaaaagaaattttgaagaaaaaaaaatccatcaccgatctaagttccccaaattctgttcaaatcgccggcgaaattttgatctgaaaatctaaaaatgtcgtccacattcagcggcgatgaaactgctcctttttttggcttcctcggtgccgctgctgccctcgttttctcctttatgggagctgcgtatgggacggctaagagcggtgttggtgtggcgtcgatgggagtgatgaggccggagctggtgatgaaatcgatcgttcccgttgttatggctggcgttttgggtatttatggtttgattattgcggttattatcagtactgggattaacccaaaggctaaatcttattaccttttcgatggctatgctcatctttcctctggccttgcttgtggtcttgctggtctctccgcccgcatggctattgggatcgtcngcgatgctggccgtagagccaatgcccaac

SEQ ID NO: 7492 - DNA, 548 bp, Gossypium hirsutum
  unsure (1)..(548): unsure at all n locations
  Clone ID: uC-gsronu33B110f11b1
tgtctcgttgagagtggcgatgccacattctctgatgtttttcaagttttctttgctttgacaatggcaactgttggcatttctcaatcaagcacccttgctcctgattccagcaaagccaggtcagctgctgcttccatattcgcaattatcgaccgtaagtctaagatagacccgagtgacgagtccggaacaacattagaaaacgtgaagggtgatatcgaactttctcatgtcagtttcaagtatccattaagaccagacattcaaattttccaagacttgaatttatctatccctgctggcaagactgttgcattggtaggagaaagtgggagtgggaaatccaccgtgatatcattattacagagattttacgatcccaattcgggacgtatcactatcgatggagtcgaaatccaaacactccaattgaaatggttgaggcaacaaatggngcttgttagccaagaacctatttttgttaatgaaacaatccgtgctaacatcgcatacggtaagggagggtaacgcaccgangctgaaat

SEQ ID NO: 7493 - DNA, 526 bp, Gossypium hirsutum
  Clone ID: uC-gsronu33B110f12b1
tcaaagattttccaggcttggaacaggaattaaagaaaacgtgttgggggaaaattccagactacctcgaatctattgcaatccaaatcgaaaaagatcgtggaaaaactactgatatttttcatatccccactcaagttctgctctgcgctgctatcagagagatgaaagatttttcggttggggatttggatttgggtaccttgaaaaagtggagcgcgacacttaattacgctaagaaatatggttttcaagtgggatttgctgataatctgttgaagaagaatttgcttgcctattttgcaattcaatgtctgcccaaatcgataaaaatatagcttcccaagagcaaatggttgttttgttgttgctggcttgctgcagtctacataaatattggctttaacgatatctacatttacttttctgtatgtgtgaaagttatcttatttgagattaactgctttgtaaactgagaaaatatgtatcaaaaaaaataagagttgaatttaagtcttaaatttta

SEQ ID NO: 7494 - DNA, 341 bp, Gossypium hirsutum
  Clone ID: uC-gsronu33B110g01b1
ccttcgtgtccgtccacgcgtccgggatgttttatttaaaataaaaaaaaaaataaaaaaaaaaaaaaaaagaaaaaaaaaaaaaaaaaaaaaaaaaaaaaaaaaaaaaaaaaaaaaaaaagctaaagaagagcccttagcatgacatcaaatctggggggggccgttttaagggacccaagtttacccccgggtgctgggaacgtaaaagtttttttatagggcaacataaattcaattcaagggcggcgtttttacaacttgggagcgggaaaaaccttggggttccccaacttaaaagcgtgtagaaaaacccccttttatgcggctggtggtacaag

SEQ ID NO: 7495 - DNA, 212 bp, Gossypium hirsutum
  Clone ID: uC-gsronu33B110g04b1
actttttcatctgaagtggtcaattccacgctcacccgtattcccgggagtgcgatttctgatttcacttctgatctgtgctggtttggctctttgtagaaaatatggtgttgacgcagttatttagctgtgccaccaaaaaatggaaataataaccccacaatgaaaaaaaagaaaaaaatgataaaaaaatatttgaaagatagccatat

SEQ ID NO: 7496 - DNA, 511 bp, Gossypium hirsutum
  unsure (1)..(511): unsure at all n locations
  Clone ID: uC-gsronu33B110g05b1
gagctcacagtgtcggcagaactcactgtgtgaagctggtgcatcgtttgtacccagaggttgaccctgccctcaaccccgaccatgttccacacatactccataaatgccctgatcagatcccagaccccaaggccgtccagtatgtgagaaacgaccgtgggacacccatggttttggataacaactactacaggaacatactggacaacaagggtttgttgattgtggatcaccaactggcgtacgacaaaaggaccagaccttatgtgaagaaaatggccaagagccaagactatttcttcaaggagttctcaagggccattactctcctctctgagaacaatcctctcactggtagcaagggtgagatcaggaagcaatgcaatcttgcaaacaagcttcactaaaatgcctcgccaaagagaaagccgagtgtggccgaataaaatgtttggttactcattttcttttccaagagacgagttttgtaatgtgcangtgagtaatg

SEQ ID NO: 7497 - DNA, 396 bp, Gossypium hirsutum
  unsure (1)..(396): unsure at all n locations
  Clone ID: uC-gsronu33B110g07b1
tccttcgcgtccgatttgttcttaatcaacaacaacaaagaaaagaatgttcaagaaggcagtagaagctaaggctcagcagaggctatcaggtgccgacaggaagaagctaaaacgcaccatcagagaccgatttcccagagcttccgatgccgatatcgatgctttgcttccgcccaaggctgagattactgtttccaagtttcaaaatcgagtccatgtgtatggtgtagaagggggttttcctttgtttttcaatgttgatggccgtggctctgaaatataccctaccgtttttgctctctgggagctccctgaaatgttaccttattttatgcttaagggnggtgaagtttctcgatctgtcattggaggggcagatttgatgttccctgg

SEQ ID NO: 7498 - DNA, 358 bp, Gossypium hirsutum
  unsure (1)..(358): unsure at all n locations
  Clone ID: uC-gsronu33B110g10b1
ttttaactcttgggttttaataatcaaattataaatattaaattatgaaacacctgtatgagagattttggttgaatggtgatgtataaatattgaaaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaacaaaaaaggggcccaatttttaaaaataaactaactttatttaaccctttcncaaaacaaaaatttttttttttgnnaaaaaaaaaaaaaataa

SEQ ID NO: 7499 - DNA, 403 bp, Gossypium hirsutum
  Clone ID: uC-gsronu33B110g12b1
tcttttaaataaataaaacatatactactataaatagttttttacaaaattttattttcttctcctccactcaaatattttaaccttaaatttttttttaatttactttaactctcttattgggccgtcccctttatatgtcccatctttccttccccctccttccaacgtatatctttttttttatggccccctaatttcatttccttgcccctctttttccaccctcttacctggaaaaccctctttttcccccaatttattcctctttgatcatttccccctttccccatctttatttttttcaaaaaggcccgtccagtccgcctttccaaaaatttcctcatccttattgccatttgtacccccccttttatggtctctttaccccccagtttttttt

SEQ ID NO: 7500 - DNA, 445 bp, Gossypium hirsutum
  Clone ID: uC-gsronu33B111a02b1
cccttgcttttcggtgtttgtctattgaattctttgcctgactttatcgaaaaaggggatgggttcaagctacaattgcggatctaactgcagctgcggtgacaactgctcatgcagcaggaaccttaaccttggatattcggagaagacaaccagcactcaaaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcatcaaaaataacaggcctctgtaatgatatattgtcaaggatggatgcctgcaaggtctataattatgtctctgtctgtgtcttgtgtaatagaagctttgtttgtggtgaaaataatg

SEQ ID NO: 7501 - DNA, 474 bp, Gossypium hirsutum
  unsure (1)..(474): unsure at all n locations
  Clone ID: uC-gsronu33B111a03b1
ccttcgcttccgatcccggaactttgtggtcacgggaagggccaacacaagtggcgaggggtgcgcaaaagtatttcattcggttgaactccatgaacaaagataggaggcgatctagcatccacgatatcaccagcgttggcaatgcagatatttcagcacctcaagggccaatcactggtcaaacaaatggtgctgctgctggaggttcatccggaaaatcagccaaacagccccctcaacatcctgctgcactggctggtgtaggtgtgtatggtgctccaactatggggcagccgataggaggcggccccctcgtctcagcagttggcacaccagttaatcttcctgcccaggcacatatggcttatggagtgagagcttctgtaccaggagcggtagttcatggtgcaccgatgaacatgggtcctgcgacatacccaattncgcatacatctgctcataggtaacatg

SEQ ID NO: 7502 - DNA, 351 bp, Gossypium hirsutum
  Clone ID: uC-gsronu33B111a06b1
atataattttttaaaaaaaaaaaaaaaaaaaaaaagaaaagattaatttaaaaaaacggttgggactacaaattctgaaaaaaccttcttctcctccctgaacctccaccctgtatttttttctaaaatcatccctcactctaattcttcttactccctaattttccacactcaaaattttccttccccttcccctacctaaacacttctgatttcacgccaatcccccttttcccatccagacttctctttttatccatccacctgttttaatttttcataaactccctattttttttaaaaaatatagcccccaatttacagtcctcttttatcatatatttttcaacc

SEQ ID NO: 7503 - DNA, 405 bp, Gossypium hirsutum
  Clone ID: uC-gsronu33B111a08b1
gttttctcgtccggtgaatacccagtaacaggacggcttacatgaaatattccgtgagacattctaaagtcctataccaaggcatgaacccatgctggattaccttatggctgcacatacggatgcaaggacgtctgaagagaactcaagtgacgccccgaccgacataccgacctttatcacggataacatgcaagatatcatgaacagtctatcttacatgcgtacgattatgggtatcattggtggagttataggtggaacaggatggatcacaggcatcatggagtttatcgtcaaggcacttgctatggcagtaactataataggactcatagcataagcacagttatcagtccatagatataacgatagcttgcaccggggtatactggacggtctcat

SEQ ID NO: 7504 - DNA, 449 bp, Gossypium hirsutum
  Clone ID: uC-gsronu33B111b01b1
cttctgctgttctctttcgaaaaaaaaaaacagggcgggctttaattgaaaggagggtccttacaaaaagagaaaaatatccaccttgtagtctaaatccacggggggcctgctctcccttgttccgtgctctttccgctttggcgcccactcttgagttcgcggggtgggtccctaacgacaacccgcttgccggcgttgttcacctgggtgtcttgctctcccttgccgcccccctctttatttgccttgtgcgacttcccgccctcttcgcctttagatccggccttatcgctctcttcctgccttctagaaggtcgtctgatcgcctgattgtgattctagatgtgggcctagcgttgccactgacttcgagcatcttagcttgctttggcagtcgctcagataggcacgaaaggggacactcatgcaggttggctgccccgttg

SEQ ID NO: 7505 - DNA, 112 bp, Gossypium hirsutum
  Clone ID: uC-gsronu33B111b07b1
gacacgccacgcaccgtgtcattaagcactaagcgcgtggtgtgtactcgcaacgcgaccggtgcacttgacagtggcctagggcctagtgcttgcgctttctgccctttct

SEQ ID NO: 7506 - DNA, 345 bp, Gossypium hirsutum
  Clone ID: uC-gsronu33B111c01b1
ctatggctgaaaacacctcgagggcggccttaaattgtgcgggggcgacatacacaaggagtcaactattcatctggcccttcagctgcgcggtggcatgcaaatcttcgtcaggactcttaccagaaagacgatcactctcgatgtctagagctatgacacgatcgacaacaggaaagccaaagctcatgacatggaatgtataccgtcagaccagcgcctgttaatattaccctgaaagcatctcctagacaggcgctatttaaccaacaacaatattgataatgaaaagactctttatctggttttacatctttaccaccatatgcacatacacttcaaaac

SEQ ID NO: 7507 - DNA, 549 bp, Gossypium hirsutum
  Clone ID: uC-gsronu33B111c06b1
tggccggcccgccggcccggcccggacgcccgggccgcccacgcgcgcgccctcgcttcacggaatcgatccgcttgtcctctttgaactcagaagactgcattaacaattaaaagtcatggcgtgctaacagttgtgattatgaaactacctccccagtcgccccagctaggctcttcaaggcttttactgttgaagctccaaaggtttggcccacggctgctcctaatgcagtcaagagtattgaggttgaagctaatcctagctctggaagtatcgtaaaaatcaactttgttgaaggctttccattccaatatatgaagcaccagatcggaggacacgatgaaaataatttttcatacagttacagtttaattgaaggtgggcctttgggggataagcttgaaaagattagctatgagaacaagtttgaggcaactgcaggtggaggaagtatttgcaagagctcaatgaaattctacactgttggcgataatgttatcactgaagatgaaatcaaggctcgcattaaagggagtgagacagttt

SEQ ID NO: 7508 - DNA, 346 bp, Gossypium hirsutum
  Clone ID: uC-gsronu33B111d01b1
gagtttccgttcgacatatacagggctattaagttcttcttgcgccccttattaaaggaaccctttctggtgtggggaactccaaggtgtaaaagcttgatgcacttaaatttgggcctaatgagactgttttgaaacttctacgtgatcaaatcatattggtcaaaaattctaagaacttccaaatgctcagatgaggagtctaagccccttctcgaccaacttttcagagcagagcctgttggtttagacacctgaatgagactgttatagaaaacagcgtaattttttttgaaaaagaccagtctttgaagagacttatcagagaatggactgttcctctctt

SEQ ID NO: 7509 - DNA, 549 bp, Gossypium hirsutum
  Clone ID: uC-gsronu33B111d05b1
tctggtacccctccctgttcctctcctctcttccctgctcgtccctcccctcccttttatttttccttttatacttcctccaacaacgagaggctttttttaatatttctcccttcttctcctcctcctactaaaactttcctacctttttccctcttttcttcttcttttctccttttttcttttttttaatataatgtgccccccctttttattcctccctttttcctctcccctttcctccccccctttttttttttttttttccccccctttttttttcccctccccccctttttcccccttttttctttttattaccccttctcttcccccttttttttccttttcctctcctcccctttttcccctcttcctttttttccctaatcccccccccctttccccttttcccctttttttccctccttttttccctttttttcccccctcttttccccccttttcccccctttctttttgttttttccccccattttcccctttcctttttccctcccctttccccccttctttttattttttccc

SEQ ID NO: 7510 - DNA, 458 bp, Gossypium hirsutum
  Clone ID: uC-gsronu33B111d12b1
tttttatacaataattaacaaaagcacataataacgggggtatttttaaaaacattgggcgccttacccctaatggaatccctttttgggcccctaccttgcgacctcctttcgggcctcccgctttgaggtttccagttctccctccccttgcttccgcggccttttttcttgttttcggtccctcttatccccttttttggccccctctttcctcccttcttgctgcgttgcccttgcctttccccttctttgctccctctgctgacatcctcctttgtccctttggtttttcacgcacaggccccctccagttcgtccttcccaccagtgtctctgcccgtttttccattgggtccccccctctttgctccccttaatccctcctgttgttttggctctccccccttgtggccccttccctggtttgcctccttcggccccttcttttccctttt

SEQ ID NO: 7511 - DNA, 383 bp, Gossypium hirsutum
  Clone ID: uC-gsronu33B111e01b1
tccttctgcctacgaaattatagagaataatttggtggcacttgggcaaatttctgcattcatagaccaggagtggacattcttccgattgtggagtggataaggaaagctcgctttcataagagaaagaactattatgtgtacaaggagtaatcctactgaaaaagcaattgcatgatcaagcactctctttctatttgtgcgtatttcacaatgattgaacgaatgcattttgccaataaaagaatttgctgcttttgtgtgtaatgacctacttgcttttatgttcgagtgaaaaaataaattaactcattgtactcttaaataaaatggttattaagttatcaatgagtttttccataaaaaaaagaagacactcttat

SEQ ID NO: 7512 - DNA, 379 bp, Gossypium hirsutum
  unsure (1)..(379): unsure at all n locations
  Clone ID: uC-gsronu33B111e07b1
tcttttcccgcccgatattttagagcaaaatctggtggccctgcaaatttccgcattcatagcaccggactggacatttctccaattgcaggattgttaaggaaagcttgccttcatgagacaaactactttcctttgtccaaggtgtcattgcccaatatcagcaagataatgctcaggccttatctctctcaatgagcgtctttcacaatgattgtcgcatgcattttgccatttttgtatttgctgcttttgtgtgtaatgacctacttgcttttatgttcgagtgaaaaaataaattaactcattgtactcttaaataaaattggttattaagttatcaatgagtttttccatannaaaaaaaaaaaaaaaatac

SEQ ID NO: 7513 - DNA, 470 bp, Gossypium hirsutum
  Clone ID: uC-gsronu33B111e12b1
gttctgtgtttcttctatttacaaagcaatctaatccttgtgatatagtaacagcactcattggcctgtccctcatggaatcccatcttgagaaacaaaatggagatgtgcttcaaaaatctttcaaagagatgatttctactctccctaataagagttgttggggttttcctgaagatcaatatcaatatcaaagtttttggttcagcccgccttttctacaaggagcattgtctgctcaacaacaattccaagctcagccaactgatatcatcctttgtagctttccaagaacaggcacagcctggttaaaatccctcactttcgccactattacaagaacttcatacaatgattccaccacccctttactttccaagatgcctcatgatgttgtgccttacatggagtttgatcatgcccagatttccattaatcgacatcttggaattcctttttagccactcatc

SEQ ID NO: 7514 - DNA, 314 bp, Gossypium hirsutum
  Clone ID: uC-gsronu33B111f01b1
cgcctgacttaatgaagtgtgatccatttttttatgcagtacatgaaatgacgccttacagggggacatggtaccttactatgcgcaataaattgtgctactgtgtcattgaaaacgctaaggcatatattaacaattgaccgttacactacatgaaatccaactataccaatgatatattttccttaatgaaaagccagaaaaaaaaaactttgtgagacctacatactttatccagctgaagaaggcaacatgcattgcttcactgctgtcacagtatgcacggtccaggatgtcctacgccctcattactc

SEQ ID NO: 7515 - DNA, 490 bp, Gossypium hirsutum
  Clone ID: uC-gsronu33B111f02b1
ttattttaggctgtgttttaagattacccccaaaaatgtgtggaggtgcatttgggtccgatttcgtcgccgcgaaacatgacccgaaattgaccggcgatgacctttggtctgaaattgacatattctccgacctcctaggattcgacaacaatggctaaagctttgtcaatcatcatgtttcatagcaacaacaggatgctgatcaatccaaaagacaatcatcttaacaaagagagaatcgagacgattcataagacatgccgtgtcactaaaaatgttgaaaagactcagcgaactcggaaaaacttttaccgaggaatctagacaacaagggccgggaccagcaaggataaagaataaaggtgtacgaagcatcgacatgtttacagtttcgcacatcacacttagggtaagcaaactgatcatagacaagacctcatccaaatatacaattggcttttgagacagttcaaactcatttacaatt

SEQ ID NO: 7516 - DNA, 460 bp, Gossypium hirsutum
  Clone ID: uC-gsronu33B111f04b1
cttcacatctgattccagctgctccaagtcctctttagaggtaggctccgattcagctcgtcgactgtcgatgcaggtcttaaaggcgacggtttgaaattgcttgttttgtctttcttttggaaggacgttagggttttgtaatttgagaactcgaatcgagcttagacgaaagtcttgtcaattttagaggctaaggctgcatgtgttctgattgatctatgttgtggtgtgctagccccttggataactcaggtcattgcaaaggttgatttaacggtggaactcatggaggaccttttgggtataatccagggagcctgccactcaacagctcgtgctcgtgctcgtgctgcacttaagtacatagtgataggtctgtctagtcacatggatgatatacttgggaagtattatgtgctagattatccttttcttactgtgtatttgacatgtgttt

SEQ ID NO: 7517 - DNA, 277 bp, Gossypium hirsutum
  Clone ID: uC-gsronu33B111g01b1
ttctctttcgtgcggcagatcaccatcctgaggggaggactagaggaagttttggccaggaattacaaatatctaccatgttcactcatcaccagaagattgttgtagtggatgctgcaatgcctaatggagatccagagaaaaggagaattgtgagctctgttggaggtattgatctttgtgatgggagatatgacacacctttccattccctgttcaggaccttggacaccgctcaccatgatgattttcattagacaaacttcacttgtgcttc

SEQ ID NO: 7518 - DNA, 518 bp, Gossypium hirsutum
  Clone ID: uC-gsronu33B111h09b1
tagtactcgaccacactcgatcaggcactccggagggctagaaactatctgagctggtctccgatgagtgggcttacttttggcttttcaaagctgcctacttcactctgtttttcatcttctcgctcctctcaacagccgcagttgtttacaccatcgcctgcatatacacagctcgggaacttaccttcaacaaagtcatcagcgtcgttcccaaggtctggaagcggctgatggttactttcttatgtattttcatcgccatgtttttataccacgtcgcagcattggctatcttgattggttgcgtggtttcaatcggaggaagcaattttggtttcgcggtgttcgttggtttagcgaatttgtacttagtgggggtttttgtatttgaccgcaatctggcacttggccagcgtcgtctctgttttagaagaggcctacggtttcaacgccatggtcaaaggtaaaaacctgctaaaagggaaccagtggctggcgatggtcattttcctgac

SEQ ID NO: 7519 - DNA, 484 bp, Gossypium hirsutum
  Clone ID: uC-gsronu33B111h12b1
tcccacgcgtccggtgctacctacttcctcgggacggtctaactcagaaagctgaggggaaaaaaagatggctttggagatctgtgtcaaggctgctgttggtgcccctaatgttcttggagactgtccattctcccagagagctcttcttactttggaggaaaagaagatttcctacaaaatgcaccttatcaatatcactgacaaacctcaatggtttttggagataagtccacaagggaaagtaccagtggtgaagtttgatgacaaatgggtggctgattctgatgtaattgttggaatccttgaagaaaaataccctcagccttgtctcaaaacccctcctcaatttgcctatgttggatcaaacatatttggaacttttgtcacatttttgaagagcaaagatgctaatgatggatctgagcaggctttgcttaatgaactcaaggcattggatgaacatcttaaggcacatggccca

SEQ ID NO: 7520 - DNA, 391 bp, Gossypium hirsutum
  Clone ID: uC-gsronu33B113a01b1
tgtttgtctattgaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgg

SEQ ID NO: 7521 - DNA, 255 bp, Gossypium hirsutum
  Clone ID: uC-gsronu33B113a05b1
gtatccaaaaaggaacaatgagccgaatggaagagttgtatattcaacatttgttgaccctgccaaacacattttcttcaccaagaaacacaagaaaattttcttggcactatctgcatctttagtcattgtcgctgctataatcggcattgttgctggagtgagctcacggaataactccgatgagtccgatacttcccatcatgccattgtgaaatcagcttgtagtgggtccattttaccctgatttatgtt

SEQ ID NO: 7522 - DNA, 423 bp, Gossypium hirsutum
  Clone ID: uC-gsronu33B113a09b1
cccacgcgtccgcccacgcgtccgcggcatctttgtgggagatgataaagcctggtgcattggctatcatatcaccaatagtagttggttttttgttccgtgttttgggacactatactggacatcctctacttggagcaaaagttgtagctgctatgttgatgtttgcaacagtttctggcattttaatggctctctttcttaacactgccggaggtgcatgggataatgcgaagaagtttattgagacaggagctcttggtggaaaaggcagtgattctcataaagcagctattaccggagataccggtggagatccattcaaagacacggctggaccatcacttcacgtgctaattaaaatgctagctacaataacgcttgatatggcaccagtgtttctatgaaagggtatgtctatta

SEQ ID NO: 7523 - DNA, 356 bp, Gossypium hirsutum
  Clone ID: uC-gsronu33B113a10b1
tcggtctgcttttcgttatccgccgggctcagcgaaagggctctttctataggatgagggtttaaagaacaatactgtgcttatagtacgaattttaactctaaattgatcgtgacagattaaaaaaaaaattgagtacgattcgctgaaaattgtcgaaaagaaaaaagcaaaaacatatcgttgagactggaaaaacccgaaaaatcctaatacaagagaaacaataaacaggggggtatcgtttaaggggatcaaatttttctgacgtcattaagatgtcaaaaaattctttatatgggtctcataaacaaatttagctgcccgatttttaaacacagacctgtgggaaaaac

SEQ ID NO: 7524 - DNA, 383 bp, Gossypium hirsutum
  Clone ID: uC-gsronu33B113a12b1
atgcaggagtgactgctggtgaagaactggggcgctatctgcagagtataaagggtttatccacacacatcttcttggtcacctgatgattgatgaacatacaaagaaggcatataggctcttcttttgttcaaattgatggcttgtattcagtattactattattatattttaaattaaaagttatttttatgatcattatgatgtaaatatcaaatcaaaaacccattattaagtcaagtcagtcaaactaataaaccatgtgctaattgtttcatcactggaactctcattcccttataaatgaaatgcgaatcaaatttctcatggaaagaacttaagttttggcccttgaggatgttgtcttcaaagttgatattttt

SEQ ID NO: 7525 - DNA, 390 bp, Gossypium hirsutum
  Clone ID: uC-gsronu33B113b03b1
cccacgcgtccggggacctggcatcctttccatggcgaacgctggacccggaacaaacggatctcaattcttcatctgcacgaccaagacggagtggctggacggaaagcacgtggtgttcggacaggtagttgaaggcatggatgtggttaaagcgattgagaaggtggggtctagcggtgggaggactttcaagcctgttgttattgctgactgtggacagctttgaaaaagggcttattgaattgtgtttccttcataatatctggtctttttaggctccttttttttatgctatgctgcttctatggctactgggttttggtgttttttaagaagttgcttgatgtagctctttcattaactgccataaataagataggctttatt

SEQ ID NO: 7526 - DNA, 164 bp, Gossypium hirsutum
  unsure (1)..(164): unsure at all n locations
  Clone ID: uC-gsronu33B113b06b1
acccacgcgtccggcctcgcgtccttccacgcgtccgcacgcttggagtgagccgtgcctatgaaaaaaggaacgaggggaagaatcgacaaggaatccataacaaaaaaaatatgtgtgagttgcctatggagcttttgctaaaaaaattnttcagctttttt

SEQ ID NO: 7527 - DNA, 105 bp, Gossypium hirsutum
  Clone ID: uC-gsronu33B113b08b1
aaaataaaaaaaaaaaaaaaaaaaaaaaggaaaaattaaaaaaaaaaaaaaaaaaaaaaaaaaaaaaaaaaaaaaaaaaaaaaaaaaggaaaaaaaaacaaaaag

SEQ ID NO: 7528 - DNA, 419 bp, Gossypium hirsutum
  Clone ID: uC-gsronu33B113c07b1
ctttgaagtctgtgatgtggttctccatgctgatgctatccatagaggtggtggtcaaatcattccgactgccaggagggttttctatgcttctcagtttacggccaaaccaaggcttctggagcctgtatacttggttgagattcaagcccctgagcaggcacttggtggtatttacagtgttgttaaccagaagcgtggacatgtgtttgaggagatgcagaggcctgggactccactttacaacattaaggcctacctttcagttattgagtcttatggattctccaacactctggaggctgcaaccttcggacaggctttcccacaatgtgtgattgatcactgcgatatgatggaatcaaatccattggaacctgtgtcccaagcagtagcccatgttgctgagatcccgaaga

SEQ ID NO: 7529 - DNA, 435 bp, Gossypium hirsutum
  Clone ID: uC-gsronu33B113d08b1
tcgcccacgcgtccggttctcggaacccggcacccaatcgtcattaacgaggctgttgatcttgcgaaacgattctgtgatggggcggctccacgaataatcaacgggtgcccacggctcagacctcaaactcaaaactggaagtgccacttcaagtatgaaagttagttcatttaaggctatttcttgttttttatagatctctgggttgccacatcacaatggtttagtctctgagtaatgtaatcttcagctcatttgagtgcttataaaggactgagttatagcatagaaagatgcagagaattaaaaaaacagataaattgtggcaacgatcaaaatatttgacagctgaagaattttgtatctgatattctggtttggatatttggcattgtaaatagacgagaaggaaagagagatcagagaagtctc

SEQ ID NO: 7530 - DNA, 440 bp, Gossypium hirsutum
  Clone ID: uC-gsronu33B113e02b1
ccgaattccataatgggatcgtcagtcaccgacggcgagatcgtgtgcgtaacaggcggctctgggttcattggttcatggctcatcaagctgctcttggaacgcggttatgtcgtccgagccactgtgcgcgaccctggcaactcgaagaaggtgaagcatttactagagctacctaaagcagagacgcacttgactctttggaaagcagatttagctgaagagggaagctttgatgatgcaattcaagcttgtacgggtgtgttccatgtggccacgcctatggacttcgagtccgaggaccctgagaatgaagtcataaaaccaacaatcaatggagtgctaagcatcatgaaagcttgcgccaaagccaaaactgttagaaggttagtgttcacatcatcagctggaactattgatgttgcagaacaacaaaagcc

SEQ ID NO: 7531 - DNA, 259 bp, Gossypium hirsutum
  Clone ID: uC-gsronu33B113e05b1
aaattaaaaattaaaaaaaaaaaaaaaaaaaaaaggaaaaagggaaaaattaaaaaaaaatttccgaccaaacaaacaaacgcgtgcacgctacaaaataatccatttatagtgcccccttaaattccatgccttgccccgttttttcaccgccccccttgcctgggaaaccccccgtgcactacccaaccttaatcgcccgtgcaaacaccctcccctttcccccagcttttaaaactcttgcaagaccaggccccct

SEQ ID NO: 7532 - DNA, 311 bp, Gossypium hirsutum
  Clone ID: uC-gsronu33B113e10b1
aaataaaaaaaaaaaaaaaaaaaaaaaaaaaaaaggaaaaatttaaaaaaaaaatataaaataaaaaaaaaataaaaatataaaaaaaaaaaaaaaaaaaaaaataaaaataaaaaaaaaaaaaaataaaatttaaaaattatgaaaaaaaaaaaaatataaaaattttaaaaaatattaaaaatatttgaagggtgctttttttatttttaaaaaaattagtttcgggtttaaaaaaattttaatttttttttttggtgaaatttaaaataaaattgtagctgggcattaatccaaagtttttatatgtg

SEQ ID NO: 7533 - DNA, 234 bp, Gossypium hirsutum
  Clone ID: uC-gsronu33B113g01b1
tcgtccttgcgtacggttcaccacaatgggggaacaggggccattttaacaggaaataaccaggtcagagacctgaaaccaatccaccacgcgattaccttggacatcaacttggtttctggaccaaatggggtggcccgcggggattatttatacgacaagcaatacgtattcacagactgagagggtttcttcttacataaacattctgcccgaaaaaaatgaagtgtaaaa

SEQ ID NO: 7534 - DNA, 423 bp, Gossypium hirsutum
  Clone ID: uC-gsronu33B113g02b1
gcgttcgattaaaccaaaggctaaccacatggtgggtgcgcgatgaaatagactctagtttatccttctttgagctgtgagtgttgccgacgccatgaccttatacagacaactgctacccgaacaggtgggccactcataacagctactattgtcgaggaggctcttatactaccggcgtgggggttgctgtcggtgtattaatagttatcttggagctgatagtgatttattatttcggaaggtaaggcaaacttgagcgtaccagttgcatgatagagattggctggtggcaacactcaccatggtgcctgcaagtgttgatatttaaaagacatacgcacattcagagggccatatatgtgtgtaatccgactgggttatgttatctgaagggaaaattatactttagagctttatttt

SEQ ID NO: 7535 - DNA, 91 bp, Gossypium hirsutum
  Clone ID: uC-gsronu33B113g06b1
aaatttaaaattaaaaaaaaaaaaaaaaaaaaaaggggaaatttaaaaaaaaaataaacataaaaaaaaaaaaaaaaaaaaaaaaaaaaaa

SEQ ID NO: 7536 - DNA, 485 bp, Gossypium hirsutum
  Clone ID: uC-gsronu33B113g09b1
gctggacgcccgcgggcccggttccgggttcccggcacgacccacgcgatccgttatgatggctggagagactcaccgtcttaatccgactgtccatattccaccatggcctaaccttgacgatgatcaaacggccgagatttactcttcactgaactacaatgcaaccgacagtcactcaaacaacaacggcggcaacccggttcatctccatgaagcgttggcagcgttacaacgttacttgccgtcgaacgaaccggacgttctctacccggattccgatcttccggttctcgaaaacccggattctccggtcgacgcttactcgtgcgatcatttcaggatgttcgagttcaaaatccggaagtgtccacgtggccgagcccatgactggaccgagtgtccgtacgcacatcccggcgagaaagctcgccggagggatcctgggaagtatcattactccggcactgcttgtgctgatttca

SEQ ID NO: 7537 - DNA, 341 bp, Gossypium hirsutum
  Clone ID: uC-gsronu33B113h06b1
ccctcgcgtccgaattcttgcttgattgttttggtgacgaggtctctgagattgtaatcatgtttgaatggttttttttttattggaaaataattatacatccctttagtttcagtttcaattcagcccttcagtttgtaatatgttgccatatagtccatttggtgacacccatccattgaaattctttcacccttctgtacatgttgaacttctagtgtttctttttttctcactacaataataaggcccagtatttctcttaaaaagcataatgccctgaccgagaagagtattggaaaaaccctttaaaaggcctgccgttctaaggaccaaaatat

SEQ ID NO: 7538 - DNA, 458 bp, Gossypium hirsutum
  Clone ID: uC-gsronu33B113h09b1
aggcctcccgttcgtctattaaagaaatggaatgcgttgaggcgggtttgttgaccagttttagaagggaaatggctttgaaaccaagcccccaggcgtttttggaggatatttgggttgttaatggacaaaatggggtgtcttgcgatgatttttcagttgacgacctctttgacttcagtaacgaagagggtttccttcaacagaaacgtgcggatgaagaagatgaggaggaagaagaagtaccagcttcttcttctttgcctaagagacaaaagctaagccaagacaacggccacttctctaacgacagtactacaaatttcgattatggttccttgtccaccaacgaactcgctgttccggcggatgacgttgagaaccttcgatggctgtctcatttcgtggaggattccttctcggagcactctacggcgtatccgaccgggacgttaatg

SEQ ID NO: 7539 - DNA, 443 bp, Gossypium hirsutum
  Clone ID: uC-gsronu33B114a01b1
aatttaattaaaaaaaaaaaaaaaaaaaaaaaaaggggaaattaaaaaaaaaaaagggggaaaaaaaaaaaaaaaaaagaaggcaagacaacaaaaacaaaggggggagccacatgtgttataaggggggccccctcttttctgccgccggagggggtgccctttggggggccgttatttcctttcctttgggcgccctttttgcccctttttgttggggcaccccttgcctgtcggccccggtaagctccctggggggccccgcccttttatcccgctcgggtgttcccccttatggccggctgggacgcccctcgcaatcggtggctcaatctgtagtggcagtgggggcgcccccttgctggccatttcgatccgcccgcccggtgggttttccggccccctggcttttgttttttccctggccttgcttgccggttttt

SEQ ID NO: 7540 - DNA, 464 bp, Gossypium hirsutum
  Clone ID: uC-gsronu33B114a02b1
gttgttgttcatgatgctactttaccgtgctttacggccagcttcatttaggtaccgtttctttttaaacaaagactatggaagcctcttttcatcactaatgacagggttgtacttaaccttcaagctgacatctgttgttgagaaggtacaatccttctttgctgcattgaaggcattatctcgtaaagaggtacattatggtgcttatgcaacatcagagcaggtgaatgctgctggggacctgtgtgccatctgccaagagaagatgcatgctcctatactactgcgttgtaaacacatcttttgtgaagattgtgtgtctgagtggtttgagagggaaagaacatgtcctttgtgcagggcgttggttaaacctgcagatctgagatcatatggtgatggatctactagtttgttttttcagatattctaatatcattgctaaaatacgatcagaatca

SEQ ID NO: 7541 - DNA, 440 bp, Gossypium hirsutum
  Clone ID: uC-gsronu33B114a05b1
ccctcgcgtccgcccacgcgtccgaggaatgtatgatgagctagcatgccatgctctcatttcagatgaaactgcaaatgggattgaaaaacactgtaatttcgcacccaaggatgactcggagtctagtagcgagtgtgatgcagccactgatgaggcaggccagaatatttactatgttgatatatataatatctatgcccctttatgccataatttcagtctcacgatccgttccaaggagcccttcgtggcaaaatttcgatccatgcagcgactactatgtatatgcttatctaaacagggttgatgttcaagaggccatgcatgccaatgtaacaaaacttgaccatgattgggaaccctgcagcgacatcatcagacgatggggagatagcccttcaacaatcattccccttctacaagagttaatggctaac

SEQ ID NO: 7542 - DNA, 475 bp, Gossypium hirsutum
  Clone ID: uC-gsronu33B114a10b1
tggctacgccagttgcaccagccaatcaaggggaggggttttatccagctggggcatcatcaccgacgtttcaccatcaggcggttcctttttacgggtactctcctgcctacgttgccacaaacatcagctacaaccataagctaggctacaatggaggatcctacatgaatgggcatttgtctcaagtatatccagcggggcaaactattgtaggtgccaacacattgatgccagtgtaccctttttatcactaccatcaatcacaaacattgggatttccatcatcaccagcatcagcggctctcaccttcccatcaccaacagcatggcccatcagcaattgctcctagttcaggtacaattggaggagctggtgacagttttaagaaggttgggtgaagaaagatggaaatctggcagcgacattattctctgatttttttttcccttttttttcaatatgtatctaagt

SEQ ID NO: 7543 - DNA, 458 bp, Gossypium hirsutum
  Clone ID: uC-gsronu33B114b03b1
ctagatcgcgagcggccgccctattggttctgagagagggggatgctcgaatgttcttttgcctacaccaacaataaagaagcaaggtgctgaattccctgagaatacatacaagtatatcaaaaatagtcaggaggacacaatgaaagatcctcgcggaaagaggaggatcaatgggggtgtaaagaaccaaagttttattctaaagcaaatgagaacggttgccactacagcatgtccaagcatgatgtacatcatggtcgtcaagccatcggaagaaaaagtacaggctattggattggaggacttatcatatcatgactcataacacgatcattaaggcaccagttgcaaggtgtgagatgccattaattgatgcaacctggatggacacatacattggcattgtaaagttcgctggaattgctatatgagatttgcaacagttagaaccacct

SEQ ID NO: 7544 - DNA, 468 bp, Gossypium hirsutum
  Clone ID: uC-gsronu33B114b12b1
tcgtttcttgtgatctcctgaaaaccgaggtttcggaaatggttagaaagaaagggaaagcaagaggtcatgtgcggcactctcgacctgagtgctctcccactaggttgtatcaccctcattatttcctttacctcccctcgagatgcctgtagattgccgcttgtttcaactgcttttaattctgctgctgaatccgatgctgtttggggaagcttcttgccatcccaataccaggcattaattccctcatcgctctctttctcgtccaagaaacaactttatcttagcctctgtgaaaatccccttctcattgaagctggacgaaagagtttctggtaggaaagaatgagtggcaacaaacgctacatgctgtcatacagggacctatccattatagggagtgaccccccagagtatcggagatggatttctacgcgtggagctaggtttgacgaggtagcatat

SEQ ID NO: 7545 - DNA, 466 bp, Gossypium hirsutum
  Clone ID: uC-gsronu33B114c12b1
tcttttcgcgtccggcgacttataaaagatcagaatgtgctctctgaccttgtggtgggtttcagacgcttggtactttgttccggaaaggtctactatgagcttgatgatgagcgaaagaagaacaatgctaccgacgttgctatctgtcgtgtggaacagctttgcccatttccttatgacctaatccagcgggagcttaagcgatatccaaacgcatagattgattggtgccaggaagaaccgatgaacatgggtgcatacaactacatagcacctcgtcttgccactgcaatgactgctttgggcagaggaacctttgatgatatcagatacattggccgttctccatctgtttccactgctactggcttgtattctgtgtatgcgaaggaacatactaagcttgtgctaactgacagttaacctgaaccgatcaagaccaatactactatctgaagatttt

SEQ ID NO: 7546 - DNA, 213 bp, Gossypium hirsutum
  unsure (1)..(213): unsure at all n locations
  Clone ID: uC-gsronu33B114d01b1
aaaaaaaaaaaaaaaaaaagggaaagggtctagaataaaaaaaattcccgtcccnaaaacacccccaaaananaaagagggaaaaaaacaacaacagacccaacacacccaaaacaaaaaaaacaaacccacaaaaaaaacccaacacaaacaaaaacccccaacaaaaaaaaaaaaacaaaaaacaaaaccaaacgcccaaaaccccaccca

SEQ ID NO: 7547 - DNA, 299 bp, Gossypium hirsutum
  Clone ID: uC-gsronu33B114d03b1
gcctaattaagagccgctggcgctgctgctgaaatgcattattacaaaaattagcacatcttggatggaactaatgaatatattatctctgtttcttcactttgtgatgatgaacaaagatatatatatatattccagtaataaacccttttctttggctattggattaattggcatttgaagttgattttcagtaagtttggaattaatactctattctcttaaaaaaaaaaaaaaaaaaaaaaaaaaaaaaaaaaaaaaaaaaaaaaaaaaagggctgacactataaaaaaaccaaa

SEQ ID NO: 7548 - DNA, 376 bp, Gossypium hirsutum
  Clone ID: uC-gsronu33B114d11b1
gtctctcaaaaaaaaaaaaaaaaaaaaaaggagagggttattttgaaaggacacttggtttaccaccccaaaaaaaaagaacaaaagcaagcagcgggcaagctgcttggggggcggccctctagggggcgggccggcctgggggccccagcgttccgcccgcgggcggccctggcctcacccctcctatggggggcccaactcctccccccgtggcccgcgggaccccgctcttgagggggaaaccccgggggtcccccacctgatcggccgggccggctggccccctgtgccccgggcggggccaccacagagggcccgcccgtgtgggcccttcccaccggtggtggcccccgccgggcgggggggcccgccc

SEQ ID NO: 7549 - DNA, 451 bp, Gossypium hirsutum
  Clone ID: uC-gsronu33B114e06b1
ttttctttttgcccccttgccttctctgtttattgacggatttagcttacaggttatgatagcttctagcgaccggaaacctgagagccgtcgcaccgctcccgctctcggtttccctcgcgttaggttcttccgtttccggcgcttgaggcaatcgtcgactccgctccacccgtattcccaacaagaaaaaaaaaacggagaagagaagttcatttattacttttttttttattttcttctttatatttctcgtttgaattattgtataatatgacacttggaatatgccgaattccaaaaataatcgtaaggagcaggagaagaaccggaagggtaagttatctgaaaggcgtcgtcgtttcacgggaaattcccgacggtggctccgtctgatctgaggcggccgaagacgctgtccgacctattctcagagaggactacttccgtc

SEQ ID NO: 7550 - DNA, 306 bp, Gossypium hirsutum
  Clone ID: uC-gsronu33B114f01b1
ccctcgcttccgcgaaaaagtgaggtagtttacagggctgttgtaaacttatcttttggcaaaccccgatgcctgcaactaaagatatagcttcctttgaattctcatgcatgcttttaaagggtggtgtgattataatggtgtggttttgatattttattttcgtcttgaactctaaactgtctttggagtattccaataaaagtgatggtgatcagactttggtcatcttaattcatttttaatatagagtttgagtctgatgctaatacaaacatatgccagcaatacaatctaatacccaat

SEQ ID NO: 7551 - DNA, 148 bp, Gossypium hirsutum
  Clone ID: uC-gsronu33B114f02b1
cggacgcttgggtcgcccacgcgtccgcccacgcgggcgccctcacgtgcgattttctctgtatgaatgaatgtatgcatgtatggatgggctctggaggtgcctaatatgattttctaaaaaaaaaaaggaaaaaaaaaatgacaag

SEQ ID NO: 7552 - DNA, 479 bp, Gossypium hirsutum
  Clone ID: uC-gsronu33B114f07b1
ccttaggtaagtcatggttaagcataacaacggggggcctaatgggcacttcaaaaagcactggcagaactatgtgaaaacctggttcaatcagccagcaagaaaggctagaagaaggattgcaaggcaaaagaaggcggtaaggatctttccaagaccaacttctggacctcttcgcccaatcgtccatggccaaactttgaagtacaacatgaagttgagagctggcaagggtttcactcttgaagagcttaaggctgctggtatttcaaagaaacttgcacctaccattggtattgcagtcgatcaccgtcgtaagaacaagtcccttgaaggtcttcaagccaatgttcagaggcttaaaacttacaaggccaaacttgttgtcttcccaagacgagctcgcaggtttaaggctggtgattcaattgctgaggagcttgcaactggaacccaagtccagggatcatacatgccta

SEQ ID NO: 7553 - DNA, 211 bp, Gossypium hirsutum
  Clone ID: uC-gsronu33B114g02b1
gcttagttccttcatgtcaaggactacaaatattaagaaattttgcttgtggtctaatatgtgatgtctagcagagtaaattccggtattgatattagggttctagtgtttttttcttcttcttttgagtttctgccgttgctcatcgactttagtctgtggaatcagacaaattacaaataaggtttgggagcctttgtgctcgttgagt

SEQ ID NO: 7554 - DNA, 458 bp, Gossypium hirsutum
  Clone ID: uC-gsronu33B114g12b1
tcggtgatgcaagttcgtccacagcagcgggatcaggtcatgtttaaaatcgctcttggttcacaagaccattcttcaaaggctaacatcagggaggagcataaaaaggaatctaaaatggatcaagcccaatcaccaagttctgactcaggaattgatgctggtctcaaccgtggtataaccgcggaggaaatttcttcagaatctagttatcaagatgtgccttatagagaaggttcttcaccagaatcagataaacagctgttgtggtatgatacagatatggatgaacatgataagatcaagatgcttttcttggactcgtaagatcaagttctccctgcctttttctttcttctttgcgagctcagagtttggtaggagcaaaatgataatctatccttcccctcccccttatttttctgtttctttctttatctacaaaagaagtgatggct

SEQ ID NO: 7555 - DNA, 485 bp, Gossypium hirsutum
  unsure (1)..(485): unsure at all n locations
  Clone ID: uC-gsronu33B114h02b1
ccctcgcgtccggtcctggtggttttcccataactggtgctgttactggaggtttgatgcctgtaatgccgggaactcggagaatgcctggtatgcctggaatggaaaatgataactgggaggttcctagaacacgatcaatgccaaggggtgatggactgngtatgctacctggagggcgtgttccttcaccttcaatcaataaaccaacttcagtgaatccaaggttgttgcctcaaggtagtggtgccctaatgagtggtaggacaagtgccctgttgcagggaagctcatcgcctcatgtggcacaaccttctcttcctgccaaacctgttcctgcgtctccagttttggagaaactagttacaccagcttcaagactgaatcaagatgaacttagtagaaaaacgaaggcactgttggaggaatatttcagtgttaggctgctggatgatgcattgcagtgtgtggaggaactaaaatct

SEQ ID NO: 7556 - DNA, 432 bp, Gossypium hirsutum
  unsure (1)..(432): unsure at all n locations
  Clone ID: uC-gsronu33B114h03b1
ccctctcttccgcccacgcgtccgggttgtttggaggtgtagtaaattaattcctttttcttcttggcttttctttgttgtttctggttgagttttagctttttctttttattggtattctttatggtcacagggctttggtgtgaggtttgcatttttgcattttttaaatttattttttatttatttttaatttggttttccaaaatgattaaaaaattagaacaaatattgggagcttgaaaatgccagacaattttaggtgtattttgtatttaacttttgaggatgaaaagtttgtacagctgagtgtaagaactaagaactagttcattttgccttttgttttggataataaaagtgtgatcttctatttttcttcttctctctaatttaangngaaaacccaaaaattcccctcaaatttagtcg

SEQ ID NO: 7557 - DNA, 58 bp, Gossypium hirsutum
  Clone ID: uC-gsronu33B114h09b1
gacttgcacctccctccagttgcccaacttactaacatgcccgcacctaccccccttc

SEQ ID NO: 7558 - DNA, 347 bp, Gossypium hirsutum
  unsure (1)..(347): unsure at all n locations
  Clone ID: uC-gsronu33B114h10b1
tatatataaatctagcacgcccggatggaccaacccttacttccctccccgacccacccacccgggcttattttccgtgcatataacaacaatctaaaggggnggcttttattaaaacatggtttacaaaaacaagacaatagcaaattatcaaatcgatcacaatccccaaccaacgcaaacaaccacacctaggcctaccaactccagcacccgcaccagcaaaatccaacaataagaaggctaccaccaatcctgataccccccatattaccccaactgataaccccaaaacggccacctcacaaaacgtaacatagaccccagccgctgctccaacaattgca

SEQ ID NO: 7559 - DNA, 440 bp, Gossypium hirsutum
  Clone ID: uC-gsronu33B116a03b1
ccctttcttttggggatttcaactttccttctcctgagaaggtcctaataaaaaatctggtggaaaaagaaaaggttccagagaaaaaagcaatacacaaccttccacacgaccaaccagcactgatggatgggattatgatgatgaaggtgaagcaagtactgctgaagaatgaattccaattcggtgcagctgccacctccattgccacttgttcatcttaatttggtgctatcctacctgagcttctttttttattttaatttcttagtatttttttctttcttttttaaatataaaatattaatcttcttgaccttgtaagaccttttcttgaccttgtaagacccagtccagtatttccaactttttttttccttccttgcctatccctcctgagctgtttgtaactttgaaatggtcaaatcatatgccaattc

SEQ ID NO: 7560 - DNA, 368 bp, Gossypium hirsutum
  Clone ID: uC-gsronu33B116a04b1
gcatatgttctctcgccgtctttgttcagaacaactgctaccaaatccttggttctcagaactttcaacttccaaatgatatttgaaaatcaagggtttaaccaaatcgattcatacagtcggtggtgtccgatagatttaggactcgaatcctggtatttacacccctttctcttgtgcctagattaaagcatcttttgtataaaaaagatcttgaattattgtgatatgagtacaaatttttaggcaattttcatatataggatgtgttctggtttgggattgaattgttttcttatttcctgcttttatggtttaggatatggagattggagagagacatttgcattctaaataaattaaatttc

SEQ ID NO: 7561 - DNA, 422 bp, Gossypium hirsutum
  Clone ID: uC-gsronu33B116a09b1
acgagtcctttccattattatcccatggaacatcatcaacggcaaggttcaaattgtggagatgattacccaaataattctcaatgatgtggttagtaggcaaaaactttaattcccatagttgagatgcttttgaatttttttttcccttcaagaaaatacatttagttttattaaaaaaaaaaaaatcaaaagactaaacaatacggaagaaaaaaaaaaaagtaaaaaaaacaaaaggaaaagtaaataagcataaaatagatttataagaaaaaaactagggggggccctttttaaggacccaagttttcttccccttggttgcaacgtctaaccttttttttagggggccctaattttaattacctggccccggttttacaaaaccggtactggaaaaacccgggggttccccaaat

SEQ ID NO: 7562 - DNA, 462 bp, Gossypium hirsutum
  Clone ID: uC-gsronu33B116a11b1
ttccacgcgtccgcctctctcaaaatctcaaacccagggttgttctctctctctctctctctctatttccaatcaattaattcctccattggaggagcttagggtttgttggtgttctggtctttgctttgtctgaaaaataaacagaattataaacgaacaccaacgccatgggaagatttgaagagagaggattcgattcagtggtttgccctaagcctatccgaacctttagatggtctaccaacagctgttatcagactgagatggctgattcaaaaactggtgcagagcttcttgatataatcctccccgagggagggtatggggccgagaatcccaccaaccaaatggcttcatcaccaccgtatttctgtggatcaccgccgagcagggcgtcgaatccggtaatccaagatgcccgattcaacgacgagcagccggtgctacctccactaacat

SEQ ID NO: 7563 - DNA, 448 bp, Gossypium hirsutum
  Clone ID: uC-gsronu33B116b07b1
tccacgcgtccgcccacgcgtccggaaaggtgtcctcgagaagatcaaggagaaactccctggacaacacaagaaagctgaagaggccagtagcccggctccagccccagcagctgagccccatcacgaagaggagtcaaaggaaaagaagggaattttggagaaaatcaaggagaagcttcctggttaccactccaaatcagatgaagaaaaagaaaaggcttgagattcaagttcacataaaaatactgatgggattgcgtgttttttaaattgttcaaaaattatctgcttttgtttttgaggttgtatttgttgtatatttcatatttaagtttcttcttttcccagcatttttagtacaaatcataaggaaaaaaaaagtttgctttcggtatgtaagaaatgacatgtttccattctgtctttttgtgattcgaacagtatt

SEQ ID NO: 7564 - DNA, 428 bp, Gossypium hirsutum
  Clone ID: uC-gsronu33B116b08b1
tgctcttggagaaaacctcttcaagcaaagcgactacaacaccttccacataataaaatgctcgtttgtcctccaaattcatcctccttccactgctgaaacaacccttaacacaccgcgccaccgccaatactatagcgtagcagctagctaccctttatatttccatttctccatgctttaccaaaagcggtaccctataacatacaccatgccagtcccagacgccgttgctcgccaccacacccaccctgttggtcccagccagtgttgctcagccgtagtccagcagatcgctgccccagtttccaccgtctggtccgtcgtccgtcggtttgacaacccccaggcttacaagcacttcgtcaagagctgtcatgtaatcgttggggacggtgatgtcggtacccttcgtgaagtccacgtca

SEQ ID NO: 7565 - DNA, 293 bp, Gossypium hirsutum
  Clone ID: uC-gsronu33B116b12b1
tttttaaaaaaacaaaaaaaaaaaaaaaaaagggagggattattttgaaaaatatgtgcgttaaaaccaccccagcgattgggaactcaagggttgggccgggggggcccattcaggcgatcctagttctccgggcccgggaacgcgaaccctgggctgtagacccacgtcacctgagcctagaggacggggggtcgcctctcaaggaggggacggggcaacgcgagccgagacccaactaactggcgaggcagccaatccccccgtggcggggttgggaaaaagggaggggg

SEQ ID NO: 7566 - DNA, 451 bp, Gossypium hirsutum
  Clone ID: uC-gsronu33B116c02b1
gtaaaaacttggcccctcctgagcccccagggattcagtgcatgcccgttaggtgaaactgggtcccatttcccaccctgttcctcttttattattacctttgaaaacacgtcatgtttgatattttaatctttgttacaagcatgaagacaaaagtttctagggtggggatgtacatgtacatgcatgcagtgaactgaagagagattatttagtttcttcttttcttttcttcttttcaatgttccaccttccatcaaatcctgtagtaaaaaaagttcggtctttttctttttctggttcatgtacaagttatatgtgtgtttccttctttatggctcatgcagggtctttgtttgtattcataattggagcatgactctgttgagtttaaagctccaaactatggcttgtttgtttgttgtactctcgttttcagttttaatgtaat

SEQ ID NO: 7567 - DNA, 436 bp, Gossypium hirsutum
  Clone ID: uC-gsronu33B116c07b1
tcgatgttcagaacaagaactcctcatactttgtggagtggatcccgaacaatgtgaaatcgaccgtttgtgacatcccacccactgggctgaagatggcatcaacatttattggcaattcaacatccatacaggagatgttcaggcgtgtgagtgagcagttcacagctatgtttaggaggaaggccttcttgcattggtacacaggggaaggcatggatgagatggagttcactgaagctgagagcaacatgaatgatctggtctccgagtatcagcagtaccaagatgcaacagctgatgatgaagagtacgaagaagaagaagaggaacgcgaatatgaagactaaggagaaggaaagatattgccattttggcaatttaaaatctcaactcccaattgctggtgctttttttttttcctgttttggatgtg

SEQ ID NO: 7568 - DNA, 423 bp, Gossypium hirsutum
  Clone ID: uC-gsronu33B116c08b1
ctcttccccccacaaaaaaaaaaactccaaatctaaagagagactttcctctcctccgatcctttattcgtcttggtttatgagctcgaaggagaaacccactctcggtggtacgcggattaagacccgcaaacggaatattgctgcgcctctggaccctgcagcatttgctgatgcagttgtccagatctatttggataatgctggtgatctggaacttgttgccaagaaccttgaatcttctgatcttaacttctcaagatacggtgacactttctttgaggttgttttcaccgggggccgcacacaaccaggcacaatcaaacctgatgagggggagcgccacccttactctgtaatagagtgtgaggctaaacgtgaagccattttgccatctgtgatctacatacagaaaatcttgcg

SEQ ID NO: 7569 - DNA, 152 bp, Gossypium hirsutum
  Clone ID: uC-gsronu33B116c11b1
ccggaacggaatgggccgggccacgcgacgcgtccaggacgctaatgacaaaacagcgtgtcaatttggtgtgggagagatgaaaaaacagtcttgttcatgaaagaaaaaagataaaaaggaaaaaaaaaaacgaaagagaaaaaaaggaa

SEQ ID NO: 7570 - DNA, 448 bp, Gossypium hirsutum
  Clone ID: uC-gsronu33B116c12b1
taatgattgatccacaggctcctttggacagagggggccttcttggttgtggtgttccaactggacttggagcagtttggaacacagccaaagttgaaccaggggccattgttgctatttttggccttgggactgttggtcttgctgttgcagagggtgcaaagtcagctggtgcttcaagaataattggcgttgatattgatagcaaaaagtttgatgtagcaaagaattttggagttacagagtttgtgaatccaaaggactatgataaaccaattcagctggtccttgttgatctcacagatggtggtgttgattacagcttcgagtgtatcggaaatgtctctgtcatgagggctgctttggaatgctgtcacaagggctggagaacatcagttatcataggtgttgtcggatcaagtcaggagatatctacacgaccttttca

SEQ ID NO: 7571 - DNA, 111 bp, Gossypium hirsutum
  Clone ID: uC-gsronu33B116d02b1
gtcgacaatccgaacccccacgcgaacaaaaagggggggggttgaagccccatttccggggggcccccacaaacccgacaccggaaaaccaccaacacggaaaaaacaaaa

SEQ ID NO: 7572 - DNA, 448 bp, Gossypium hirsutum
  Clone ID: uC-gsronu33B116d06b1
cttcatttgcaccatggattccatcggagccaaggagcttgcgaaagattttgttgtagctggcactgcctcggagtctctctatggtgcctgtgaatcaatgttcaaggagggcatggaacctgaggaattgtttgagacggtttcccaagctctcctttcatcagtagatcgcgactgtctgagtggttggggaggacatgtctatgttgtgacgcctacggaagtaaaggaaaggatcttgaagggaaggatggattgaatgccggcaactggttcattcgtaaactccttttaaactatttcagtcaatttgtgtctctagagtgttgctggatttgatgtactctttataaatttgatagaccaagttcgacattattgagagcaatgatggatttgtagtgcatttcgcgagttaaatttgtttttttgtattgcttcttta

SEQ ID NO: 7573 - DNA, 194 bp, Gossypium hirsutum
  Clone ID: uC-gsronu33B116d09b1
tatttataaaaaaaaaaaaaaaaaaaaaaaaaaaaaggaaaaaattaaaaaaattatttaggttaaaaaaaaaaaaaaaacaaacatgcgacgaaataatttttaaatagtgtttcctatctttggttgcctggccattatatttaaaactggtgtgactggaaataaccctgtcgttacccaatttattcttt

SEQ ID NO: 7574 - DNA, 456 bp, Gossypium hirsutum
  Clone ID: uC-gsronu33B116e02b1
ctttattattatatagattcccattctttcatgtgggtaaatgtgaaagagccttgcgagtttctgtcacaaacgcccgcccaaccccagcctaacctatcccgtgtcgacaagaaacgcacccgccaagacaaccactccccgtttcgtggggtacgtatgaggaggtgggggcgttacgtttgcgagatacggttaccgggtcaaaagacacggatatggctggggtcgtttgggtcaccggagatggcagctcgggcatatgactcggcagctttcttcttgaaaggcgactctgctatcctcaactttccggagttagtggggtcacttcctcggccagaggtcttgctcgaggagggatatacaattcgcggcggccaaagcggctttgcaggaatcggtgggcagggtaaaagatgaggaggggtcggaaagctttcggtggtgggatgc

SEQ ID NO: 7575 - DNA, 443 bp, Gossypium hirsutum
  Clone ID: uC-gsronu33B116e06b1
cccacgcgttcgtgcaagaaactaaggcggctttagagaagatagttaatgtgagattgagcgctgcacagcctaagaatgttccgaaacagtcttcggattcaaagtatattaagtataagccttcacagcaatcggctgcgtttaattcaggtgctaaggagaggataattagaatggtagagatgcctgttgatcctcttgagcctcccaagctcaagcataagagggtacctaaggcttcggggtctccacctgtgccagtgatgcattcccctgcacgtcctgttactgtgaaggatcagcaggactggaaaattccaccttgtatttcaaactggaagaatccaaaagggtatactattccgctggataagcgtcttgctgctgatggaagaggcttacaggaggttcagattaacgataactttgcaaagctgtct

SEQ ID NO: 7576 - DNA, 71 bp, Gossypium hirsutum
  Clone ID: uC-gsronu33B116e09b1
aaataaaaaaaaaaaaaaaaaaaaaaaaaaaaggggggtaaaaaaaaaaaaaaaaaaaaaaaacaaacaaa

SEQ ID NO: 7577 - DNA, 413 bp, Gossypium hirsutum
  Clone ID: uC-gsronu33B116f06b1
gttttatttttctacgatgagggaaaacgagtggcggaggggttgatataagattgcctttggcatcatgacatacagatccgaaacgctcggatcttgaacacttatggaccacgcatgagcattgaagaaggcgtgttgggagactttcatagctcaagggctccaaggtgagcctttgactgttcaattaaccaggaacacaaacaaggagattttgtaatgtctttcgcaagggttgacggttaaatccgactaatggaaggagagaacaccggaccaatgaagatcgggaatgcaggcgaattcaccatgctcgagcttgcagaatccgtgaaggagcttatcaatccttaagggaagatatcgatggtggaaaacactacggcagatccccgtcattggaagccgga

SEQ ID NO: 7578 - DNA, 462 bp, Gossypium hirsutum
  Clone ID: uC-gsronu33B116f07b1
tccacgcgttcgagtgcacctcgtatattgagaataaataaggttgttaattatgtcgtagaaaagatggtgcttgacaaaccaattgatactggaagtaccgatgggtcacttgctcctggacatggaggacaattgcagcattcagctgtcgctgatggttcttttaaatctggattgaagccttggccgaagcctaggccttctgttgagattttatgcaataatcaggtcttatctacagacatgagcttagccactgtgcgggcctacatatggaagaaacctgaggatttggtacttaattacagagtggttcaaggcaggtgattttatcaactgctgggagcaggctgcagtgtctgtttcgggaaatcgagatggaaatctcatactgttgtaaagtgttgggaaatgtatttgttcgtcagaggtttgcctatatcagaagcaaatgttgga

SEQ ID NO: 7579 - DNA, 297 bp, Gossypium hirsutum
  Clone ID: uC-gsronu33B116f09b1
tcctcgcgtccggtaatccacgagaatctcggtcgatcactgatgtctgcgcgctgatggagccaacgccggattctggcgtgtcttgcgcgtcgatggtggcgtgatatatgatggcagagtcgagaaatcacggcatacttggtggtgacgattgagatgaaaggccacgtcgtttgaagtgcccgaagcttctagaaattccttgcagcacgaggagagggctagggtttctaaccctagccgaatgcttctaaattttgggccactgaaagtttgggtcaattgggccacttt

SEQ ID NO: 7580 - DNA, 390 bp, Gossypium hirsutum
  Clone ID: uC-gsronu33B116f12b1
gtttatcagagctttcttcgacgagcagccatttgggatcaatcatgggtcattctaacgtctggaactctcaccccaaaacctacggccctggctctcgcgcatgccgagtgtgtggaaaccctcatgccatcatcaggaagtacgggctcatgtgttgcagacagtgcttccgtagcaatgccaaggaaattggattcattaagtaccgctgaggaatgtttatatggctagaagttggaaacactttttagctagtatgaacctttgtttcgaaattgtagcaacttttaagataacattgctgtttttttttaatttagtttaaaagcttgaaggtttgtttctgcaaaggataatttggtgctttctcaatgaagtaatcatact

SEQ ID NO: 7581 - DNA, 313 bp, Gossypium hirsutum
  Clone ID: uC-gsronu33B116g01b1
ggactgcactatttaaccctatccttataaatgccggcaaggttatcattgaatttaacgttactgtaattcattactaagatgttatttacagagtcaatcgtcttgggttgtgtgaaagtcatatgattatgctccacttgttagaataaatgtatgagaaatatataggtttgtagtattaaaaattaaaattctcatacttggtcattgtactttatcattatacgagaaataaatattaaatccttagctacaaaaaaaaaaagccaaaaaagttaaatgtgaagcagaaaaaacaaacataagaaat

SEQ ID NO: 7582 - DNA, 418 bp, Gossypium hirsutum
  Clone ID: uC-gsronu33B116g02b1
cttttgtctgctctactgcaacttcagggagataaggcttgggttgataacttcgatctgtcccactacaacttcaggtggatatgatttatagccttaatctgttctactgcaacttcagagagattaggtttgttttgatctgctctactgcaacttcagagggataagatctgtttgtccacagcttcagtctgttccactgcaacttcagggagacaagattcgctgtattcgatctgttccactgcaattttagagatacaagatctgtaattttcagcctattaccctactgcttagggggttaaggcttggtggcttgaatctgcttcactgcaacttcaggaaggcaagatctgtaatttccagcctattaccctactgcttaggggtttaggcttggtggcttaaatct

SEQ ID NO: 7583 - DNA, 460 bp, Gossypium hirsutum
  Clone ID: uC-gsronu33B116g03b1
aatgctggagccatgatgagtgtggatgagactttaatgtgctcctttcaaatattgaagcctgctgataaaaaaaccccgatttaactttgggggcacggccacagccaggcctggtagcgcttctgccagtgtctttggcagcacgacaacagcaaagcccggaaatactccagcgggagtcaagtcgttcctcggcacaaggatatgagaggcccatatgcattgtggaaggcagagccaggttatgacatgaacaaaccacaattgcagtaaagacaactttgaggtccttttgatttccatatattatgctcaaatttgtaaaaaagattggaagagaaacaatcattagaaactaattcaaatgatctggtctcttattatataaaattgggtttgaagatagaaagccataattttccttctctcccgcttgtacactatctgctacccttgg

SEQ ID NO: 7584 - DNA, 400 bp, Gossypium hirsutum
  Clone ID: uC-gsronu33B116g08b1
tggtgagatagtctatgcaatgtgatatgagggaagagagcttctctgcaatggtgcagttgttccaggcaatcaaaagtgtgaagacatatagctgcaaagaatttatggtagagttgcgcaatactggtctgaaattgtcatggtccattgagtccattatgttcatagcatgaagcttttatacaaatctgtggaagaaattgatatttaatactactttacaagggatgatccacagggataaaaggttcaatgtcggatgatcatctcccaaacttccacatcccggtaaccatcgttgaacccggttcatttgtattttggcattgctcgtgtactttttgcttggttctgttttatgcagttgaatatatataatatatggctacttaatatt

SEQ ID NO: 7585 - DNA, 305 bp, Gossypium hirsutum
  Clone ID: uC-gsronu33B116g11b1
tagtttacaacccgcgtccagacccaacactggggaagggtgaaaaaggctgttcttttaaaaccccctcccgcgaggctcttatgcttatgtaaaaaaaaaaacaccccccaaatcaggccccacgaaacctccctcccacggcccacccccctgcgttccccctccttgcccccgaacacccccgccccgtggcaaccccgccaagaccccacaaaataccacctttcaccaaaatcacctggtccccggacaagccccccccccccccccgggtacccccccccatgtccacccacccccaa

SEQ ID NO: 7586 - DNA, 449 bp, Gossypium hirsutum
  Clone ID: uC-gsronu33B116h02b1
cgcctgggggtaccggaccgccggttccgcctacgcgtacgcccacgcgtatttcaacacatactagaaaccctactggcaaagggaactttgatagagctctctgatggcgtaaactactcgtctcctctacaaatgtcgccagctttatggtaatcaagctgctctgcgggaggaggttgccattcctgtccggttttactctaaagaggcttctccccctggtttcaaaggcgatgagatattgaaaaatatctgtgaggaggtcaagaacaaactcgagacagcattgggaatatttaggaaggagaaaatcaccattgacccagatgacccagctgctgtctctcagtatgcaaatgttatgaagactgctcgagaaaaggctggcttgttttcagagtcttaacggattaaatacaccattcgaacacgaactcagggcattc

SEQ ID NO: 7587 - DNA, 410 bp, Gossypium hirsutum
  Clone ID: uC-gsronu33B116h03b1
cccacgcgttcgtccacgcgtccgcttttcttcactggcggggtagcctttcggagggttatcagaaatggacggctctcaccttttcatcactttgtcttcgttttgatcttatctacaggcgttgactggaagtcgtcgtctgtttttttgaatctttgatccattccctatgcaagttttttgaaagattcaatcaattgtttggaatcgaaagtagtgtgtagtacaaattccgggtaatcaagtacagaggcagctttattcttgtaatctagtttgatggtgaaaagaaagcagcagccgtctcaagaaatggggggtacgggcggcgctgaagcggcagtggaggctgagaccgaaatccaagccaaacgaagggggaccaaatctctgaaaacgcaagctca

SEQ ID NO: 7588 - DNA, 423 bp, Gossypium hirsutum
  unsure (1)..(423): unsure at all n locations
  Clone ID: uC-gsronu33B117a07b1
cccactcgtccgcccacgcgtccggttggattgtcggggctggttatagggatattatcaaacaacaaatccaagggttcgtgtgggttgacgcaccaccatttcctttcgattggaggaattttgtgtttcgtacatgggctgttttctgttgcttattatgtttcagccactgctgctagtgatgaaggaaagtaagcaatatatataatctttaaagtaacttttgtttgtttgtttaatttttaaaacccaaaaagctttaaggatcattgatcaactatcactttcctcctacatgtaaaatcattttgtaaacatcttttgatgccattatcaaatcttgtaggacagctgatcatcntncaataaaaaaaaataaaattaaatcaaatttaaattatcattaataacactaattat

SEQ ID NO: 7589 - DNA, 495 bp, Gossypium hirsutum
  Clone ID: uC-gsronu33B117a08b1
ttctttcgtccgttccacttgctttcccgctccgagtgccacatttgaatttagggtttaggtttttatccagcgctttccaaatacagccactccaattgaatttagggtttaggatctctggggttttcacaatgatgtacggtgatccgcaacagcagcagaaccagccgcacccgcaagctggggagtttcagagaggtcctccgcctccgcaaatgatgcggcagccatctgcttcttccactactcttaactcagagtaccaccaccctggtgctcctcctcctcagatgccgtcttatgacgctcatggtgacaattttgctgcgaaaagaatgagaaagctgacccaaaggagagctgttgattatactagtactgttgtgcgatatatgcagattcaaatgtcacagcgggattcacgggacaggacaacattgcagcctacaccagcagcagcaattgatatgttgccgacagctgcttatttag

SEQ ID NO: 7590 - DNA, 597 bp, Gossypium hirsutum
  unsure (1)..(597): unsure at all n locations
  Clone ID: uC-gsronu33B117b02b1
cccacgcgtccgcccacgcgtccggccgatccaaaatgtcgaagcgaggaaggggaggtagtgcggggaacaagttcagaatgtcgctgggtttaccggtggcggctacggtgaactgcgcggacaacactggggccaagaacctttacatcatttctgtcaaaggaatcaaagggcgtctcaacaggctcccatcggcttgcgtcggtgacatggtcatggccaccgtaaaaaaaggaaagcccgatttgaggaagaaggtgttgcccgccgtcatcgtccgacaacgcaaaccttggcgtagaaaggacggcgtctacatgtacttcgaagataatgctggtgtcattgtcaatcccaagggagaaatgaaaggatctgctatcactggtcccattggaaaagagtgtgctgacctgtggcctagaattgcaagtgctgccaatgctattgtttgaaaggtttccatggttttgtttgctactgttgatgttatctttcaattacttacaaacattttgagaagatttgatcagacaatgttacatctagttgtctaaaacttaattctggnttctttttatggaattacaacag

SEQ ID NO: 7591 - DNA, 576 bp, Gossypium hirsutum
  unsure (1)..(576): unsure at all n locations
  Clone ID: uC-gsronu33B117b07b1
ggatgtcgcggcttttcttgcacatgtcggcgccaagacatcttgtggagatggtgtcatagacggaggaccgttggcatggggtctttgcttcaagagagaaatgagtcctagccaggattactgtgatgattactacaaatacatgtatccatgtgcccctggagctcaatactatggccgtggtgctttgccaatttactggaactacaactatggagctgctggcgatggtataaaagttgatttgttgcaccaccctgagtatctcgagcagaacgcaactattgctttccaggccgctatctggaggtggatgaccccaatcaagaagaaccaaccttcagcacacgacattttcgtgggcaactggaaaccaaccaagaacgacacagaggaaaaacggngtcctacttttggctccaccatgaacgttctctacggagattacacttgcgggcaaggcgatattgatcccatgaacatcatcatctcccattaccttcattaccttgacttactaggtgtcggncgagaggaagcagggccacacgaggagcttagctgtgccgagca

SEQ ID NO: 7592 - DNA, 550 bp, Gossypium hirsutum
  unsure (1)..(550): unsure at all n locations
  Clone ID: uC-gsronu33B117b09b1
cccattcgtccgcccacgcgtccgggtatttccatgtggtaaacaatgactacactcattgggaaatgtatgctattgggggaagtgcaaatcctaccataaacagccagggtaacagatacgcagctccaagaaacccgtttgcaaaggaggtgaccaagagagtggacacagctgaaagccactggaagagctggaactggaggtcggaaggagatttgctgctgaatggtgcatatttcactccatctggagccggagcctcagcaagctatgccagggcctcaagcttgggagccaagtcctcctccatggttggatccatgacttccaatgctggagctctaccctgccgaagaggcaggcaatgctagatagtatatcccccacccaatcaattaaaatggttgaaaagccagccatttactagctctttcccatcattcaaaaagcactaccaatcaaatatccatattctctgtagtctatccttcccatctaccagcatcatcgcatattctgattntaaagtgtaattattcattttaca

SEQ ID NO: 7593 - DNA, 463 bp, Gossypium hirsutum
  Clone ID: uC-gsronu33B117b10b1
taaatatagaaaagaacgctcaaaggatttgcagcaatgggtctctcaaaggcttctctaatccttgttctcgtcgctgttcgtactcttatgggttcagccatcgctgctgaatccccagcaccgagtcccacctcaggaaccggctccatctccccctcattcgtctctgttttctttgccgctgtcacggctctgctttttggctctactcacaggatctgaagggtgttggctattgatggtgtagagagggtgtttgatttctcatttatatagatttgattttgggggggtgaattttatatggagttttagtatatctaggagtccctatatatataaatatgcgagagtcgagagaggtagttttgttatctactgtacagattattcatggtggatgatgtttggacttttgtttcagtattattatggattgatatcattttcattagtacgt

SEQ ID NO: 7594 - DNA, 508 bp, Gossypium hirsutum
  Clone ID: uC-gsronu33B117b11b1
tataatattgttagtgaaacaatggcgtcttcagctctgataagtaagcttgaggcagatgtagagattaaggcttctcctaagcagttccatgaaatgtttgcccacaaaccgcaccatgtgcaccatacttgttatgacaagattcaaggatgcgatttacatgaaggtgaatgggggaaagtcggtaccattgtccattggagttatgtgcatgatggaaaggctaaaaaggcaaaggaagtagtggaagcagtagaccctgataagaatttggtcactttcagagtgatcgaaggagatctaatggaagagtataagagctttgtaatcacgattcaagtttcgcccaagagcgagggtagtggcagcgtagtgcactggactttggaatacgagaagctgcacggtgggattgcgcattctgagactctgctgcaattcgttcaagatatctctaaagacattgacgcccacctcacccaagcaagctaaacagtatcacatg

SEQ ID NO: 7595 - DNA, 483 bp, Gossypium hirsutum
  Clone ID: uC-gsronu33B117b12b1
tccacgcgtccgctagccgcccctttctcttaagagcaggcccgacaatgccgcccaagttcgacccgacccaagtcgtcgacgtattcgtccgcgtcaccggcggcgaagtcggcgcggctagttccttagccccgaagatcggtccgctgggtctttcccccaaaaagatcggtgaagacatcgccaaagaaacggccaaggaatggaaaggcctccgcatcaccgtcaagctcacggtgcagaaccgtcaggcgaaggtcacggtggtcccttccgcggcggcgctagtaatcaaggcgttgaaggaaccggagagggataggaagaagaccaagaacatcaagcacaacggtaacattagcctcgacgacgtcatcgagatcgctaaggtaatgagaccaaagtcaatggctaaggatatgaaaggtaccgttaaggagattctgggcacgtgtgtttcagttgggtgtaccgttgatg

SEQ ID NO: 7596 - DNA, 562 bp, Gossypium hirsutum
  Clone ID: uC-gsronu33B117c01b1
cccatgcgttcgcaaacctgctaccaaatcaagttccgaggtcccatttccgagtgagcactgagcatgaagcattcataagtcatcaaattttggccaccgcacaagcatgaagcaggagagaggcatggagtttccaaaggtatacagtaatagcagagctgtagaatcatcagaaaaaggagaggcgtttggggtaatactgagcaggagccgttcggtttcgaatgcgtcgaccgtagccctcagaactgagaaacagagctcggcacttgagacggcggtgagaagggcattctccatgaggagatccagatccacctcctcctcttcttgtgtttccaagggcaggagaggatattacaaaatattccattatttcgatgatcctcacccttttgctctcactgaatttcataatgttgcaatccaacccagaaaaagcaagaagtcttcttccagaatatttgaagcctgcaagcgactaatcggcttttaactgaatctcatccatatttcagcccaccgacccgaactgactctcaactttggaccctgaact

SEQ ID NO: 7597 - DNA, 303 bp, Gossypium hirsutum
  Clone ID: uC-gsronu33B117d04b1
cccattcttccgatcggatttcttttgccccatttggctggatttgggttatggtatgttgtgtttttaggcctccgttccatagactagttattatggccatttcttagtaataccaggggattgcgattcacatatgttgcttatttcacaggttaatgtatgttagtagaggaagaacaatctaaaatgccctgtactctgttgttttttatttaatttttatgtcttcttcaaaaaaaaaaaaagaagtgaaaaaaataaaaaaaaaaataaaataaaaaaaaaaaaaaaaaaaataaa

SEQ ID NO: 7598 - DNA, 472 bp, Gossypium hirsutum
  Clone ID: uC-gsronu33B117e03b1
ggcgcttttgaagaccgggttgcacagagagcggctggcttgaccaaatttcgcctgatatggaaagaaagatgttttgaaaagaaggtacggtatcagagcaggaagaagttggcagagcaacgacctcgtgtgaaggggcaatttgtgcggcgaaccatttctgattgggaaggaggaaaagataattcgagttacgatttcacatctgaagacagatattctgatagtttaagataacacaggcaaggtttgctgattactaactttacccttttccccttcccatgcctataaaatattgcgtacataagatgagcagtggctgtatgtcttgggaattaatacgttgacgtagtttctatatcgcatgaaaaacaaacaatagattttagaacttatatccgacttgcccggaactcaaaataattgaactgaaaggaaattcaaacatgctttcccacgtttagat

SEQ ID NO: 7599 - DNA, 268 bp, Gossypium hirsutum
  Clone ID: uC-gsronu33B117e09b1
tacctatagaagagcacctaggtttagaagcaaagttgcatgggtgttgggatgaatggatttcccaagaaactgaagccattgaaagattgatgagttactaaagctttggattgtcattataatggagggttcagtatttatgatgttgttgtgtcatattttgtatcgtgttatttttagttgtttgaaataatcaagtctaattgtgtacttggacgaatagagttgtagctgttgtttaatcaatgtatgtttttattgttct

SEQ ID NO: 7600 - DNA, 506 bp, Gossypium hirsutum
  Clone ID: uC-gsronu33B117e11b1
tctaatttgaatccccatactgaagaagaagaagaagaaagaacaccaaaaagaaaaaaaaaacttcagtaaatcgtaaaaacagatactttagagaagagggagaggcaaagaggtgcatcaaaatggggaattcatttgggtgctcagcttcaggggagagattagtgtcggcggcgagagatggggatttagaagaagctaagatgcttttgaattgcaatccatgtctcgctaaatattccactttcggtggccttaattctcctcttcatttcgctgctgctaaaggccacaatgagattgttgctttattgctcgagaatggagctgatgttaactccaggaattactgtggacagacggcattgatgcaagcatgtagatacgggcgctgggaagttgtacaaacccttctgcttttcagatgcaatgttacgagagcagattatctaagtgggagaacggctctacattttgctgccgtaaatggacatgttagatgc

SEQ ID NO: 7601 - DNA, 560 bp, Gossypium hirsutum
  Clone ID: uC-gsronu33B117f01b1
cccactcgttcgctcttcttggagaaggccctcctgggccttttcgtggcggtggtactagccatcaccatctctaagcttcgtggcaagcggttcaagctccctcctggaccattacccgtgccggtgttcggcaactggctccaagtgggtgatgacttgaaccaccgcaacttgacagatttggccaagaaatacggtgacatatttttacttcgaatgggacagcgtaatctagtggtggtgtcttcacctgagctagccaaagaggtgctccactcgcagggagtggagttcggctcaagaactaggaacgtagtgtttgatatattcacgggtaagggtcaagacatggttttcacggtgtacggagagcattggaggaaaatgaggcggatcatgacggtaccattttttaccaacaaggttgtgcaacagtacaggtttggatgggaggaccaggctgctcgtgtagtggaggacgtgaggaaaaatcccgaggcagtcaccaacggaatcgttttgaggaggagattgcagctgatgatgtacaacacatg

SEQ ID NO: 7602 - DNA, 513 bp, Gossypium hirsutum
  Clone ID: uC-gsronu33B117f09b1
ttctttgggtgatttcgttaccgagacagtgtcgttgggaaacttcggtaacatgaatggagtggctttgggttgtggccatgataatgaaggcttgtttgttggagcggcggggttgcttggactcgggggtggacccttgtctttaacatcccagattaaagcgacatcgttctcttactgcttagtggatcgtgattcgaccggctcgtcgactttggacttcaactcgggtttaccggccgactcggtgatcgctccattaatgaagagccggaaggtgaatacgttttattacatcggtctcaccgggttcagcgtaggtgggcaagcggtaaacatttccccggggctttttgaaatcaacgagtcaggagagggaggagtgatcatagactgcgggactgccatcactcggctgcaaactcaggcatataacgcgctgcgagacgcgtttgtgaaacagacacaggggttgccgagcgcgagtggtgtggcgttgttcgacacgtg

SEQ ID NO: 7603 - DNA, 207 bp, Gossypium hirsutum
  Clone ID: uC-gsronu33B117f12b1
ttcacgcgtccggatttaatagctttgtttgcataaaggttgtatgtcttgagttgaagtattgctagggaacttatttggcattatcaatatagtggttgtaagaacaaagacgaggacttcaggttatgtctgtaatagcccaaattttaactttttctattgttagtgttacagaatttactatttattaaaataagagatgat

SEQ ID NO: 7604 - DNA, 552 bp, Gossypium hirsutum
  unsure (1)..(552): unsure at all n locations
  Clone ID: uC-gsronu33B117g02b1
cccactcgttcgcccacgcgtccgcccagattccaaatgaacaaattcaaacttgaaaaggatctttctgattctcgaagaatgaggggcaaagggattgatcgagaaagatctcttgttcttattataagatcgtgtgattggatccgcagatgtttggtaaaaaaaatcttctcttttgagaataatcaaaaatggaaagtgttcaattggaacatgaaaacgtgactgaatttgtcctagttactcttcgggacagagtggaagaagggaggagattctcgaacgaggaaaaggacccaatgacttcgaaagaattgaacgaggagccgtatgaggtgaaaatctcatgtacggttctgtagagtggcagtaagggtgacttatctgtcaacttttccactatcacccccaaaaaaccaaactctgccttacngtaagttgccagagtacgattaacctctgggtttgaaatcactgcttatatacctggtattggccataattnacaagaacattctgtagtcttagtaagagggggaagggttagga

SEQ ID NO: 7605 - DNA, 510 bp, Gossypium hirsutum
  unsure (1)..(510): unsure at all n locations
  Clone ID: uC-gsronu33B117h07b1
gtcgttcaaagaatcaaatctctgctactgcatagtaaaagatagaaagagcgacaatggaggcagcaagaacagttaaggacgtttcccctcacgatttcgtcaaggcttacgccgcccatctcaagcgctgcggcaagattgagctttcttcatggactgatattgtcaagaccggcaaactcaaggaacttcctccatatgatcctgattggtactatatcagagccgcttacatggcgaggaaaatatacctgaggggaggtcttggcgttggtgcctttagaaggatttacggtggggctaagagaaatggaagccgtcctcgccatttctgtaagagcagtggatctgatgctcgccacattcttcaacaattgcagaacgttaacatcattgatattgatcctaaaggtggtaggagaatcacatcgaacggccaacgcgacctgnaccaagtagccggaaagattgcggttgccatctgagtaacttttaatacccaaattt

SEQ ID NO: 7606 - DNA, 390 bp, Gossypium hirsutum
  unsure (1)..(390): unsure at all n locations
  Clone ID: uC-gsronu33B117h09b1
gtgaattgttagtggagaattggcatgaattatacttcggaggtggtaaaggttccaggaaattgcagagccaaattccgagcttgaagaacacacttcaaacccctcataaaaggagtaaaggtaaggttaagaaatgttgtgaaatggctgctttggctttgcaattcataatctcagctgtacttggtgatccaaccgctcttattgctggggttattggaactttgatgtctagagcctgaaaacattgtctggttgatgcactataatgttggtgcctgtaaaactaaaaccaaatatgacatccacaatgtttattttagtttctgttgtgaataaattctattttcttcaaaanaaaannnnannaaaaaaaaaaaaaatatt

SEQ ID NO: 7607 - DNA, 143 bp, Gossypium hirsutum
  Clone ID: uC-gsronu33B117h11b1
atggatccacgcttggtatgtagccaagcccaagaaaaaaggaacgaggggaagaatcgacaaggaatccataacaaaaaaaaaaaaaaaaaaaaaaaaaaaaaaaaaaaaaaaaaaaaaaaaaaaaaaaaaaaaaaggagaa

SEQ ID NO: 7608 - DNA, 313 bp, Gossypium hirsutum
  Clone ID: uC-gsronu33B121a01b1
gttaaactagagagatcatcccttcagtcatggcggggcttcattttactgcaaccatcctacttctgactctgatactggaagtaaataaagcaaaatcccaatcatttattggcgtaaataatggacaagtggccgacaatcataccatcaccggtagccacggcaaagctgtttcaatccacttcaatccaaaaggatcgactatacggctccgacgccgcaatgatcaaagcgctagccaacaccggaattgagatcgacatcggcactggcaacggtgacaatcctgtctcggcctccgacccaaatt

SEQ ID NO: 7609 - DNA, 615 bp, Gossypium hirsutum
  unsure (1)..(615): unsure at all n locations
  Clone ID: uC-gsronu33B121a03b1
cccacgcttccgaaaattcctatttttttaataaaattgtcctcgtttaagggccccggggctccccccccnnccccccccccctcctctccccctccctcccccccccccccctcccccctcccccccccccccccctcccccccttccccccccccccccctcccccttccctctccccctccccccccccctcttctctcccccccccccctccctcccccccccctcttcccccctccccctatccctcccccattcctctcccccccccccccctccccccccccccctccctcccccccccccttcccccccccccctcctccccctccccccctccctccccccccctctaccccccccctccctccccccctcccctccccccctccccccccccctctccccccctctctcccctcccccccccctccccttttccttccccacctccctcctccccctcccccctcccccccttcttccctccctgtcccctcccctccccctccccctccatcttccccccccctcttcccccctccaccttctccccacccccttcacccccccgcccccaccctcccggtctccctccatccacctctcccc

SEQ ID NO: 7610 - DNA, 101 bp, Gossypium hirsutum
  Clone ID: uC-gsronu33B121a12b1
tcccgggtcgatcccacagcgtccgattcgttatggatttaggaatcagagatgaagctgcccgttttcaatttctctgaggataatctaaagccaggaac

SEQ ID NO: 7611 - DNA, 278 bp, Gossypium hirsutum
  Clone ID: uC-gsronu33B121b02b1
tatattttttcgttaattgatataagtaaagttgagggtttttttattgaaatgccgggttttttgcttcggaggagaatggtcggggtctgtcgcctgtgtcctttctctcgttttgtgctcttttctcccctcctctgcggggggggggggggggggcggcgggcgggcttctccttcctctgggggggtgcggtttcctcctcctgccgttcctccctccttccccttctgctttttgtgcggctcgtgtccgctcttttttgtcctcgtctcgt

SEQ ID NO: 7612 - DNA, 322 bp, Gossypium hirsutum
  Clone ID: uC-gsronu33B121b04b1
ttcccggttcgtcccacagcgttctatcttattttaggagaaatagttcacaacacgtcgatgacttcaccaattgattatgtcctttgagttggacatttcctggggaaggatgatgatgtttactcattttttgatccttttttcccttattttttttttttttattatttcatttttaatatatttttttcaatcttttttttagttatattatattctgatttcatcaagtatgctctttttatattttttcttttatattttttatttattattttaattctctttctgtctctttcttatattttttttatttctt

SEQ ID NO: 7613 - DNA, 238 bp, Gossypium hirsutum
  Clone ID: uC-gsronu33B121b06b1
ttctatttcaccctttaatggctcctcctctagtgattggtattcttcaccgtcaccaaatatgtgatttccccttttgactctctttgtaatccataaccaatgctgcttcgaaattccatttcctacaccaaaaggttctttcagaaaaccttacaaagtttcaaggctcttttttttggtactgatgcttaaccttaccatagtctacccattgccctttacatatcaattcctt

SEQ ID NO: 7614 - DNA, 264 bp, Gossypium hirsutum
  Clone ID: uC-gsronu33B121b07b1
ccaccatagtaatggggcgcaccggctgtctaccatccgcaacgctgatcttatagcagttttccaaaatggccaggttatagaaattggatcacatgatgagctgatagaaaatcaaaatggtcactacacttcattagtccaccttcaacaaacagagaaagaaaagaaccctgaagaagctaactcaactttacctacttgtgcttcatcttcaatcacaaatatggatatcaacaacacaagtagtagaagactttcatt

SEQ ID NO: 7615 - DNA, 447 bp, Gossypium hirsutum
  Clone ID: uC-gsronu33B121b08b1
ttcccggttcgtccctcagcagttttgctgatagaccaatctgtagaaggttagttagacattgttttcactttcaggcttcaggagcaaccccctttcgacaagaagcagtttgtcgtgttcatgttgaagttcatcatgaatcttgtctccttattctgtttgcctgttatgttagtactccttttaagaaattacattgtttgtagcttccatttttttttgttttatttcttatctcgccctatatctctctttcttatctttgcgcttgtttttatgtttttatttttgtttttatccttcttttaactatttttatatttttttactcttccacttttcttctcactcttttaattttctctattttattttacctattcattatattatttctttttttatattctcactttcttattcattttttctcatttttaactc

SEQ ID NO: 7616 - DNA, 117 bp, Gossypium hirsutum
  Clone ID: uC-gsronu33B121b09b1
agcagtcctgctgccacagtcagcgctggtcacggacgtattggtatgcataggaagcatcctggaggtcgcggaaacgccggaggcatgcaccaccactggatcctctttgacaaa

SEQ ID NO: 7617 - DNA, 121 bp, Gossypium hirsutum
  Clone ID: uC-gsronu33B121b10b1
tatccaagtccagaattcccagtgtcagacccacagcagtccagctcccttttctttataaggaaataaagttctctatacctgccaataaagaaaaaagataatcttcgcctccctataa

SEQ ID NO: 7618 - DNA, 415 bp, Gossypium hirsutum
  Clone ID: uC-gsronu33B121b12b1
ccctcgcttccgctttttctttctcaataatatcacactaccatttcattaaaggttcttttttttcccttgaagtttttatttttttttgctaaattgaaaccgatttttatggcactgactcgatcgaaacaattggtcctactcaagtcaccctaaaccaacaaccccattatatggggccaactccctagtctagctcctcctcacaagctcacccagtgcaccccactcttaattttttccttgtagaaataggaatggttcaaggaagatgcagtgcagtggcagccacagtgctgctctgctgcttgttgctccactttgaggaggctcaatcagcaagtttcactgttggaggaagaggggaggttggaccttttaacgccgttgttttggtcttatacgcaagcgc

SEQ ID NO: 7619 - DNA, 143 bp, Gossypium hirsutum
  Clone ID: uC-gsronu33B121c02b1
ggatcctgagtttatattcttgctggaacagttgcgagagtgcattcagggccagctcttgccatttcctttctaatagctggaactagctgctgcactctttgcttttctgctttgtcaaacctctgctgtttttttccctc

SEQ ID NO: 7620 - DNA, 398 bp, Gossypium hirsutum
  Clone ID: uC-gsronu33B121c07b1
ttggttttgctcccatttctttcttcaactatcttttctcttcaaagatttcaactcttttctcagaatgggaagtaccgatgggaccagctatggtgcttacacctatgatgccctggagagggagccttactggccatccgagaaacttcgaatttccatcaccggtgctggtggcttcattgcttcgcacatcgctcgacgtctaaagagtgaaggacattacatcattgcttctgattggaagaagaatgagcacatgacagaagatatgttctgtcacgaattccatcttgtcgatcttcgagtgatggaaaattgcttgaaggttaccaatggagtcggatcatgttttcaacctcgtcgctgatatgggtggcatgggcttcatccagtcc

SEQ ID NO: 7621 - DNA, 263 bp, Gossypium hirsutum
  Clone ID: uC-gsronu33B121c12b1
cctaaacctctcaaatctttttcagttttcatttccccatccaaacgacgccctaaaccaattgtcatggccaccccttccgcacgtgacgaaaacgtttacctggcgaaactcgccgagcaagccgagcgctacgaggagatggtcaagttcatggagaacgtcgtcttcgtcgtccctgcccccgtcgaacttaccgttgaggaacggaacctccttttttgcgtctacatgaacagtgatccggcgcattgtttgccttt

SEQ ID NO: 7622 - DNA, 390 bp, Gossypium hirsutum
  Clone ID: uC-gsronu33B121e01b1
aatgccttataacatttgaagccaagcaaagttcagatttttatttagggttttcctttttttcccctacttattaatattatttttttttctttttttcttctaatttttctaattcttttttttttttttctctttttcattttatttctttttcttcttcttttttcatctctttttatttttcatcatatttctttctttttttttttctttttctactttcatttctctttttttttttttctttttttccattttttttttaatttcctcttctcttttttatcttttattttttaatattttttatattctacattattcctcatttcctttcccattcctttttttatttttctttcttcctcctattttatttctttctct

SEQ ID NO: 7623 - DNA, 57 bp, Gossypium hirsutum
  Clone ID: uC-gsronu33B121e03b1
ccatcagcagtccagcctttacgctacccagattaggaatctagtccctagttagag

SEQ ID NO: 7624 - DNA, 242 bp, Gossypium hirsutum
  Clone ID: uC-gsronu33B121e10b1
cctacgcgtccgcccacgcgtccgaaattaaaataaaaaaaataccaaagacctattccccatttactcggccgtacctatggcacctttccactgccgctttgcctccatattcggctgacggccatcaagcataggccaagtctggtcccgttcgaccacaaatccgagagccttgctcacaagcttcaaatcttcgccttgacttcgattacgacgaagcaatcaaggatctcgaagcc

SEQ ID NO: 7625 - DNA, 236 bp, Gossypium hirsutum
  Clone ID: uC-gsronu33B121e11b1
agatcccacagcgtctctctctctctctcctatactaacttcttccacttaaaagcaagttagctaagctagggttttttagagccagagagatgggtccgaaaagaacagtatttctaacccttctctttgcactcaacatcctctaatttttccctgaagagtgcctgtaggtcctattctatatcaaaccctaaaccttaaccttaaaccttaatccaaatcttaaccccact

SEQ ID NO: 7626 - DNA, 337 bp, Gossypium hirsutum
  Clone ID: uC-gsronu33B121f03b1
ccctctctaccgcccacgcgtccgggaaattagggtagagctaaaatggcgagaacatcatccagcaaagaaaatgctcaagctttattccattctcttcgctctgcttatgctgccactccagtcaatctcaagatcattgatctgtatgtgggttccttctctcttctttttctccttccttctatctcatttccctcccctgctttatatacttctcttttttttctcctttttattttcttccttttatcccctcattccccgtattttcccttttttcttcttcttccctttctctcattatcccttctctcctcctacttttctcccctta

SEQ ID NO: 7627 - DNA, 173 bp, Gossypium hirsutum
  Clone ID: uC-gsronu33B121f04b1
tccctgtttcttcccacagcagtccgtattaatttaatctcaaatatttactagcaacacaataagatacttatttgagaggatcaattggtcaaagatattgcaatgatagctatctttttaagcccatttctttcagaaaactgttttgtcactcttttctacaagatccg

SEQ ID NO: 7628 - DNA, 125 bp, Gossypium hirsutum
  Clone ID: uC-gsronu33B121f05b1
agatccctcagcgtccgcattggctagagaaaagcaatgaaaaagacggccaaggaattggatgatctacttgaaggctggcttaaggagcatcgtcagagaaggatttctggtggaatcaaggc

SEQ ID NO: 7629 - DNA, 141 bp, Gossypium hirsutum
  Clone ID: uC-gsronu33B121f09b1
agcgctgctttcgcgtccgctaggacttattttagccatgaaagttatggataaagctctttcggcacgtagaaagaagctccttagagcccaaactgagagagagattcttcatacttttaatcattcatttttgccatc

SEQ ID NO: 7630 - DNA, 237 bp, Gossypium hirsutum
  Clone ID: uC-gsronu33B121f12b1
ccctcgcgtccgctcattctaccctaacgtgaatgtctttctagttaaaaggggaagtgaatactcagaggttcatatggaacgtgtagtgaagaatctgctaatggttgaaaccaatgagtagcctaaggttgtgctaatggacatgcctggctcttaccttgatgtccatagtttccccagccaagatgacctttgcgggaccaaagataaccactactgtaccaggacttggct

SEQ ID NO: 7631 - DNA, 452 bp, Gossypium hirsutum
  Clone ID: uC-gsronu33B121g04b1
gattaacctgtctctctttctttcacactcctatggtgtaaaactctctctctctctctcacacacagtagcccacacgacgtcgtcctcacctttcctttcttccttctttccttcgaaacttcccaaacccaaatagcttctccattccttccctctgccattaattgaataaactccaaactatataacttttaaaaaaaaaaaaagagattaaataaatcaaagaggaagaggaatctctatggttataatttataaattagtcgtctgagtcaactcaccccgagttatgggctgctgcgaatccacctttctgagttgacccgattcactgcacataaccaatcaccaccaccacccttacaacaacaataccaacaccaacaccaattgagtcactcaaaccaaataatgggccttcctcactttccaatgctggaaaagattcc

SEQ ID NO: 7632 - DNA, 136 bp, Gossypium hirsutum
  Clone ID: uC-gsronu33B121g05b1
cctgtttttaatacacccactgtaaaaaaaaagagagaaatttgatcagacggcgaaaatgggtggccttgaaactgtgagaacatcatcaggatgggctgccagagatccttcaggagcatagcctcctatactt

SEQ ID NO: 7633 - DNA, 294 bp, Gossypium hirsutum
  Clone ID: uC-gsronu33B121g07b1
tgtctcgcgtccgcaatcatagttcgggttgtaggatcataaggagaagacatttaaatccctgaactgcctctagatatgaagaacctgggactattagatgtttttatgttttttttctttatttatctttctttttttttttttctcttttttattattatttaatattctttcatttttttcttttctctttccttattttttttttctatttttttttttatttctttttttattatcttttttctactttttttttttttttttttaacttattatttattttttcta

SEQ ID NO: 7634 - DNA, 147 bp, Gossypium hirsutum
  Clone ID: uC-gsronu33B121g09b1
acaaacacaaacatacaacggggtggcccttctatagggtcaccgtattcctacgcactggtccggagtttaacacctttctttagggtaacccaatttcatttcactgcccgttgttttacactctacatgcctggtatacccccg

SEQ ID NO: 7635 - DNA, 121 bp, Gossypium hirsutum
  Clone ID: uC-gsronu33B121h05b1
tgttcctttccggttttcccgggtcgtccctcgcgtccgctggtcgtgtgggtcgtcccgggtttaaattaaggggggggttttttttttttatggggtttgtttttttccaaaatataat

SEQ ID NO: 7636 - DNA, 261 bp, Gossypium hirsutum
  Clone ID: uC-gsronu33B121h09b1
gtgtcggagactttgaggcctgctttataaagggtatacatgacaagggcttctgcatatagagatgctcttaagagtttcatagaaggatatcaagaaggtatccagcagatcatgggtaaaaaggaagattcttctaaagcacagcaagaaggcaatactgataaaaattcaacttgatagctgataagtgcataattggagatgcatgtgagtacttctccagcatacctattgtagatacaaggttagagatttggt

SEQ ID NO: 7637 - DNA, 55 bp, Gossypium hirsutum
  Clone ID: uC-gsronu33B121h10b1
ttcccagggtcagacccacagcagtcctggtaccttgacactctgcatctctaat

SEQ ID NO: 7638 - DNA, 124 bp, Gossypium hirsutum
  Clone ID: uC-gsronu33B121h11b1
ttcccgggtcagtcccacagcagtctttgtcgatgctatcctggcttgcattggtggatagtttttttttcaaaaccttgtcagtttaaattctgatggaaggctttttattattggcttccag

SEQ ID NO: 7639 - DNA, 455 bp, Gossypium hirsutum
  Clone ID: uC-gsronu33B124g10b1
ttctcgcgtccgtgaattcattatagacttgagaggttttaagaatactgctggaatagagcctgaagatgttgccaaacgtcttatggactatggattccatgctcctacaatgtcgtggcctgttccgggcacgctcatgattgaacctactgaaagtgaaagcaaggcggagctggaccggttctgtgatactcttatctccattagggaagaaattgctgaaatcgagaatggaaaggctgatatccacaacaatgttcttaagggagctcctcatccaccatctttgctcatggccgatgcatggacaaagccgtattctcgggaatacgctgccttccctgcttcctggcttcgaactgctaagttctggcctactacaggacgtgttgacaacgtatatggtgatcgcaatgtcatctgcacccttttttcagtatcgcaaatggttg

SEQ ID NO: 7640 - DNA, 575 bp, Gossypium hirsutum
  unsure (1)..(575): unsure at all n locations
  Clone ID: uC-gsronu33B125a10b1
gcgtttacgcgttcgatgggcgcaaagcggtgatcggtagatccttcgacgatggaacacgtgaccgcccctatggccactgtttggttgcagggataaagaagtacccgagcaaggtcatccgcaaggattccgccaagaaaacagaaaagaaattgcggcgtaagtgcttcgtcaagatcgacaactaccaacacctgatgcccaccccctacacccttgacgtagacttgaaagacatggttaccgtcgatgcactttaaaccaaggacatgatagtggcggcttgcaaggcgaccaacgagaggttcgaagagaggttcaagactgggaaaaacacgtggttttttactaaacttagttttgagggtatttacctttattatagtatctttttttgggaaaaaaaaagttgaaattggatctagtgtttcaagcatttttgaatttaaagacngattatgaatctgatccgatgggatattttatgagctcttttgtgatatatgatgctatgttgttactcattttcttagacattatggttattatctctcaaaaagaatctttagtat

SEQ ID NO: 7641 - DNA, 484 bp, Gossypium hirsutum
  Clone ID: uC-gsronu33B125d01b1
tctcttacgcgtccgagcagaatcatacgttaggggggctttgttaggagcttgctgtatacctcacactggctgtgtcccctttctgcatagcgtaagctgttgtaagggcatgatacagcacggtatcctttgcttggacaggtcaagatatactcggaattgcattgagaatcacagttctggaaattgcccatgaacctaagcctcaaggtgggaacagttctactcagttgcgctatcttatataacattgtctgggtttttgtttcaaagaagttgttccatgaaagcgtgatgatcgtggttgctcgtggtgataaaagtgggcaggaatggcataccgatgctactgaatagaaaacgtatgttggatacatggggtggttatagcataataggatttggtgatatccttttacctggattgctggaagcattctcactcaagaatgattggttggcaaacaagtctcttggacct

SEQ ID NO: 7642 - DNA, 513 bp, Gossypium hirsutum
  Clone ID: uC-gsronu33B125d10b1
tgtttgatttcggatgatggtaccttggtccgtgcagaggagaggttatgtggtatggcaaccgactactttcagcatctgtttacttttcaaggattagggatccatgacgcattctaaagggggttgattcgtgtgttactacggctatgaatgccttgttagtggtgccttttacgtatgatgacatccatgaggcattacaggcaatggcttcaaccaaaacctcaagccctgatgggcttccggtgctgttctataaaaagtattggcatattattggtcaggacattaatatttactggcttaatgttttacatggtgggacgtctctggctgatataaataacaccaacattatgctgattcttaaaattacgaatcccatacggataacttagtttcaccctattagcctttgttccatcctttataagatcatttccaagttccagtctgtattgaactttggtgtggataaagcacagatcacttttgttttgagtccgttga

SEQ ID NO: 7643 - DNA, 500 bp, Gossypium hirsutum
  Clone ID: uC-gsronu33B125g01b1
attattctgacagacatgcttatgttcgtttcaagcgacataattgctcgatgtatggcttagtcacaaaaatgaagaagaagatgggtgcagcatgtttggggagttagcaaaaaggttgttgattctcttcaactagttcctgtattggcgatatgttttcttacttgaggtgggttgatgtgcttactggatatattccaagtatgaaagcagtctctacggaattggatgcattccttgatcaagtaattgaggagcataaagctattgaaagtaatgaccaagttttcaataaaaaggactttgtatctatcattatgcaactccaaaaggatggcatgtacgagatggacctcactcatgacaacatcaaagctatgttactggacatgtttgtaggaggaactgatacctttacaacaacaaaagagtggatgatggcagagcttttaaagcatccaaatgcatgaaaaaggtccaagaagaggtgagaaatg

SEQ ID NO: 7644 - DNA, 331 bp, Gossypium hirsutum
  Clone ID: uC-gsronu33B126a03b1
cgtttaccagcctagcgtttccatcacgacagaagggcggttcgaatgctgtcggggattattaccaaaaagcgtgttaagaagttcaagaggccccaaagtgatcgcaagatctctgtcaagacaaactggcgaaggcccaagggtattgacttccgtgttaggaggaagttcaagggatgcactttgatgcccaacatcggttactggtcagacaagaaaacacgccactatcttcccaatgggtttaagaaatttgtggcgcacaatgtccaagagctagagcttttcatgatgcacaacaggacatactgtgctgagatagcacatg

SEQ ID NO: 7645 - DNA, 414 bp, Gossypium hirsutum
  unsure (1)..(414): unsure at all n locations
  Clone ID: uC-gsronu33B126a04b1
tatataaaaaaaaacaaaaaaatatgttgttngggtcattttgagtaacattaggggtttataactcaagggcaatgaccttgtgtgacatgaatgataagggacttgacgtgcgcaacccaatctttagacaagtgtacccgggctacccatctcccgagtgtttcaaggctgaaaggagctgacttaccctgcttgtgcccatataagaattcatcgaggctaagtagtttggggattgatccaaaacttgcgatggattttgcctccaaagtgcattccaccaatttacatattttgatagtttcagcaaagctccatttgtcacatataactaaacctgaaggattacaggacattttgggcataacatttcacttcccaacgctttatacaaaatacccattataacca

SEQ ID NO: 7646 - DNA, 497 bp, Gossypium hirsutum
  unsure (1)..(497): unsure at all n locations
  Clone ID: uC-gsronu33B126a08b1
gttcccttcgcgctgcttataataacccagagggggctgttgaatatttgtattgtggcatccctgagcaagctgaagctccacctgtggcccatgctcctgtagttgggcaaaccactagccctgcagcaccacctcaacagcctgcacaaatggcagctattcctactagtggacctaatgcaaatccattagacctctttccccagggccttccgaacatgggtgcaagtggtgctggggctggctctcttgattttttacggaacagtccacagtttcaagctttgcgagcgatggtgcaagccaacccacaaatattgcagcctatgcttcaagagttggggaaacaaaatcctaatctaatgagacttatccaagagcatcagggtgactttcttcgcctgatcaatgaacctgctgaaggtggagagggaaacattttggggcaattagctgaggcgatgccacaagctgtgcangtcacacctgaagaa

SEQ ID NO: 7647 - DNA, 420 bp, Gossypium hirsutum
  Clone ID: uC-gsronu33B126a12b1
ccttcgcgtccgcccacgcgtccggtagccgggggctgcgtctctctcttcatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgaaggttgttgacattgttgacactttcaggcttcaggagcaaccccctttcgacaagaagcagtttgtcgtgttcatcaagaagttcatcaagaacttgacaccaaaactggatgcggaaaagcaag

SEQ ID NO: 7648 - DNA, 477 bp, Gossypium hirsutum
  Clone ID: uC-gsronu33B126b01b1
agcgtgcgcgtttaccaactgggtcccttacccaagaatacggggcatgctttcttcatacgctccagtcatctctgctgagaaggcttaccatgagcagctatcagttgctgaaatcaccaatagtgcctttgagccctcatctatgatggccaagtgtgatccttgccatggcaagtatatggcttgctgtttgatgtaccgcggtgatgttgtgcccaaggatgtcaatgctgctgttgccaccatcaagaccaagagaactattcagttcgttgactggtgcccaactggattcaagtgtggtatcaactaccagccacccactgtcgttcctggaggtgatcttgctaaggtccaaagagccgtttgcatgatttccaactcaaccagcgttgctgaggtgtttttccgcattgaccacaagtttgatctcatgtatggcaagcgtgcctttgttcactggtacctgggtga

SEQ ID NO: 7649 - DNA, 553 bp, Gossypium hirsutum
  unsure (1)..(553): unsure at all n locations
  Clone ID: uC-gsronu33B126b06b1
tcggtttatcaagaaggaaaaaaaacccttaaaatcaggaccctaatcctatttttttttcctttttgattgtagaaaacaaagcaagccctcaactggacaacatggggtctgaacagaatcaaggaaccagctttcccccgtcggagccgaagctttgcgctaacggttgcgggtttttcggaacggcggcgaacatgaacctctgctccaagtgttaccgggacctccgtgctggggaggagcaagcggcgaaggcgaaagctgccatggagaaatcccttagcgtcaaaccgaaagaagatgttgttgtggagacgtttaagcccgttgagaagctgcctcatgcgggttcatcatcagcggcggttgagcaaccggcggtggctctctccggtgatgaacagcccgagccaaaattgtcgagcaggtgctttatctgcagaaagaagattggattgactgggtttaagtgccgatgcgggagtacgttctgtggnngagcaccgtacccagaataacacgagtgctccttcgatttcaagggtactgg

SEQ ID NO: 7650 - DNA, 315 bp, Gossypium hirsutum
  Clone ID: uC-gsronu33B126b07b1
tttttgtggaggttcatattaaccgctgcggggggttttttaggtttactgaggcgtaacaactgtaaatgtggtaacgaataaggtttgagcaggcgagaaatacaatcgaagagcaaaaggtgataccagctaaggctggtgtctttcaccttcgcttagactagctctacttacgatgaacatggagattataacgttcactgcaggcgagggtttgaggcggagaaccagggaattgagtcaagtggaatacgacgaggatcacgaatgaacgctgctggtgtcgacaagatatcttgggaagcgacgatt

SEQ ID NO: 7651 - DNA, 504 bp, Gossypium hirsutum
  Clone ID: uC-gsronu33B126b11b1
ttttgttcttctggatcagaatttgattgaagcgatgccgacttctccaatttttgttggaagcaaggcaaaacggttgttggagagggctgtctggaatgacacttcctttcttgcattaatcgacgtaatggactactcattacttgttggtgtggatgaggaaaaacacgagcttattcttggaataatcgatttcatgaggcaatacacatgggacaaacaccttgaaacatgggtgaagacctcaggcatcctcggagggcaaaacacctcaccgacagtgatatcaccccaacaatacaagaaacgattcagaaaagccatgacagcttattttctcatggtgccagatcagtggtctcctccaacgattgttccaagcggatcacagacagacctttgtgaagaaaataataacaggtcacaaagtggtcttcttcaacaatgatgtgcaatccttctgcctgtgtgtcaagactcgatatgtaaagtcaatacctt

SEQ ID NO: 7652 - DNA, 520 bp, Gossypium hirsutum
  Clone ID: uC-gsronu33B126b12b1
cttcgatccaatcaatcgcctcaactacctgggggaacacatatccaatggctgcgatcgctgtcggcgacgtgttaccggacggtactctctcctacttcgacgccgatgataagctccagcaggtgtccgtacattccctggctgccggtaaaaaggttatcatctttggcgttcccggtgcctttacccctacttgcagcttgaagcatgttcctggattcatcgagaaagcgggggagcttaaatccaagggcgttgatgaaattatttgcattagcgtgaatgacccctttgtgatgaaggcatgggccaaaacttaccctgagaacaaagatgtcaagtttctagctgatggttcagcaacatacacccatgcccttggtcttgagctcaaccttggcgataaaggtctcggcactcgttctaggaggttcgcactcttggtcgatgacctcaaggtgaaggcggcaaatgtcgaatctggaggggaggttaccgtgtcaagcgctgatgatat

SEQ ID NO: 7653 - DNA, 545 bp, Gossypium hirsutum
  Clone ID: uC-gsronu33B126c01b1
gctttgtatattgaagtttcctttctcgatttgggatttagccaaacaagatgcggatcttcgttaagactctaaccggcaagacgatcactctcgaggtcgagagctccgatacgatcgacaacgtgaaggccaaaatccaagataaggaaggcatccctccagaccagcagcgtctgatcttcgccggaaaacagctcgaagacggccggaccttggccgattacaacatccaaaaggagtcaactctccacctcgtcctccgtctgcgcggtgggatgcaaatcttcgtgaaaaccttgactggcaagacaatcactctcgaggtcgagagctccgacacgatcgacaacgttaaagcgaagatccaagacaaggaaggcatcctcccagaccagcaacgtctcatctttggccgaaaacaactcgaagacggccgtaccttggccgactacaacattcagaaggagtcaactctccaccctggccttccgttgcgcggcgggatgcatatcttcgttagacgcttaccggaagacaatcac

SEQ ID NO: 7654 - DNA, 450 bp, Gossypium hirsutum
  unsure (1)..(450): unsure at all n locations
  Clone ID: uC-gsronu33B126c04b1
aataannnnttttgttcatcaccactgccaacaagttgatgggcaaattcttaaaaaaaggagacattttcgcgttccctaaaggtttggttcatttccagcagaacaacggcaaagaaccggcatcggtcatctccggcttcaacagccaattgccgggaactcagtcgattgccgttaccttgtttggttcaacaccagcagtgccggaccatgtgttgaccaaggcattccaaattggtaccaaagaagtcaacaagatcaaaagcagactttcccctaagtaagaaaaaaaaaaagaagaagaaggtaatttgagttttgaggtgaaaaatcataaaattgtttctttggagttgaataatgtaatttaaattaccaaaataagttcactttgaggcaatataatcaacatactatcatgtattgaatatttgaagtatttcacac

SEQ ID NO: 7655 - DNA, 405 bp, Gossypium hirsutum
  Clone ID: uC-gsronu33B126d10b1
ttcttacgtgtctgaagctgaaggcatctatggggcacttgaaaagttggggggtgactggggcaaagtcggttcacagctggaagacgagggagtggagtctttcaagaagagctttgacagccttctcgacacattgcaagagaaggcaaacactcttaaatttgtgatttcttagatttgctgtcactgcaaacacaataaaaacaagcgggtgttggttcctgctgtaaaagaaagttggtgagcgagcgttatgtgagacgttgaatattatgtaatatgaagcattgagtgtttgtttaatggaactttttgttttgcgctttgctttatggctcctgctgatcaatgaagttgcagatgtggttctaaagcaacaggaaaccttaataaggataaggt

SEQ ID NO: 7656 - DNA, 167 bp, Gossypium hirsutum
  Clone ID: uC-gsronu33B126e07b1
ttcggttccttgtttgacttttcaatggcattgctcattgcttacggtaggtgttggatgagaggttgtttgcatggtgtgccctcctccttccctttcgattttcttttatgttggtctgacacttgatattttttggtatccgatacttgtgccaactgtcaatc

SEQ ID NO: 7657 - DNA, 335 bp, Gossypium hirsutum
  Clone ID: uC-gsronu33B126e11b1
atctaacaaacaaaaacacataaaaaaacaaggggaaatttaaaaaaaaggggggggtttttcaatgttccaggttctacttcacatacccgccaggtcatcgattttgctatagggaaacggaaccccaattcaatgggctgggttgtacaataacaggactggaaaagcccaagcaatccccgtctcaatcgctgctgctgacagaccccattgcaacaggtgctgataccactaacactcccaggccagtcgcctttaccatcactgacacacccggaatggaaaatgagaccagccctatagcggcagaagaggcgcattccttaagggtt

SEQ ID NO: 7658 - DNA, 347 bp, Gossypium hirsutum
  Clone ID: uC-gsronu33B126e12b1
tttatacaatacaaaaaaaaaaaaaaaaatagggggatattttaaaaaaatttgggggtttttaaaaaaaaatataataacgggcgccccttctaaaggttccattctttcttccgcgggcgcgcgctcctttatattctcctatatactcccccatctcccacccactgtccctctttacaccacgcccttactggtaataccctggcgttccccaaccaaggcggcttttgccaaacccccttctctccactttgcatatttcttaaaaggcccacccctctcgcccttcccaacaattcctcaaccccaatgggcaatggcacaccccctctatgtagggcctt

SEQ ID NO: 7659 - DNA, 576 bp, Gossypium hirsutum
  Clone ID: uC-gsronu33B126f02b1
gcgaatccctaaaagctcttgccaaatttggttgaggggaaatggagaattcaactcaagaatcccacctgagatccgataattcggtgacctacgaatcagcttacacagtttatgccatggccttatcttccacgccttcctccaccaatatcaaccatcaacgcatcgctctcggcagcttcctcgaagattacactaacagagtcgacataatctcatttgatccagaaaccctctccttcaagacccacccaaagcttgccttcgaccacccttatccacccaccaagctcatgttccaacccaatcgaaaatccgcttcatcctcttcttcttgttccgatcttctcgcttcaaccggcgatttcctgcgtctctgggaagttcgagaatcttccattgaacctgtcactgttctaaacaatagcaaaaccagcgagttttgtgccccgttacttccttcgattggaacgatgttgaacccaagagaattgggacttcagcatcgcacaacttgcaccatttgggacatcgagaaatgcggttgtgaaacccaattgatcgctcatgata

SEQ ID NO: 7660 - DNA, 555 bp, Gossypium hirsutum
  unsure (1)..(555): unsure at all n locations
  Clone ID: uC-gsronu33B126f06b1
aggttcctgcacttccgcaacatctagccatgcacggtttttcccaacctacactggcattgggacactttgccaacatgattagttatcctttcttacctcagagttacacctatatgccatcagctttccagcaaacatttactggtaataataactatcctcagtccctggcagcaatgctcccccaatacaagaacagtgtttctgtaagtagcttgcctcaatctgctgcaattccatctggctatgggtttgggagctctaccaacatccctggaggacttcctctgaatccacctactgcacctgcggggacaactattggctacgaggatgttcttagttctcagtacaaggacaacaatcatttaatgtcactccagcagaatgagaattcaggcatgtggattcatggccccggctcacgaacgatgtctgctgttcctgcaagcacatattacagcttccaggggcagaaccagcaggctggtgggtttcgacangggcagcaaccaccttcacagcattttgggtcacttggatacccaaatt

SEQ ID NO: 7661 - DNA, 549 bp, Gossypium hirsutum
  Clone ID: uC-gsronu33B126g01b1
cgcgctttttctagatctctcatggcttcctgcatcggggccgttttcatctcaggtggggctcatcttcaggcaagtgaaatttgtttcgctaagtccagcacctttggcaaaacaccaagtttggcagttcagaggaaaccaatggcatccaaccatcggatttctgtttgtgcagagtaccgtgatggcaccaagggtggaggaaacgattttgctgctggttttcttttaggaggtgctttatttggaactctgggatatatttttgcaccacagattagaagatccctgttaaatgaagatgaatatggattccggaaggcaaagcgaccaatttactatgatggaggtttagagaaaacgaggcagaccctgaatgcaaaaatccgccaactcaattctgcgattgacaatgtatcctcgcgtttgagaggtggaaacatttcaccaagtgtgccggttgagacagaccctgagtagaagctctatgtagacatatttcaatgtgatagccatgaagttccaagttacagtgattgatggatt

SEQ ID NO: 7662 - DNA, 373 bp, Gossypium hirsutum
  unsure (1)..(373): unsure at all n locations
  Clone ID: uC-gsronu33B126g03b1
cggaatatccggggcgacccacacgcgcgcatttctttgggcatttggcatgctggaaagttggtctatgcgttgtcaacctggggacttgcactggttgggttatatagagcccgtagtgtggtaaaagttgctgcaatgggcatccacacgaccagcaaagttgtaatgagggctctatgaatttattgctccaatatcagataaaaagataaggtctgtttgaactgtattattctttcaattctcggttggtttgtttaaaatccttcttgttgctgtaaaatgtacatgttgtaaatatatttgaaatactcttttaatgaatcaattgtattgcttcngaaaaaaaaaaaacagaaaaaaaattgaa

SEQ ID NO: 7663 - DNA, 530 bp, Gossypium hirsutum
  Clone ID: uC-gsronu33B126g06b1
gtttgtcagtcttttcaaagataatgcgccatacggcagtacaacaaaggttgccaaaggaaaagaaaaagaaaaaaaataaattacagaagatgaccgagactggtaaaaattggcataagaaactaccgcttactctctatgcttacgctggggcaaacaccttcaattccagtagtttcaaaggttccaaccatcatccttggaatgggtacatagtttggttctcctgagcagtctgatgtgctgtcaatagctgcgatggttagctcgaggcggtggccattgattttcagctatggggcatcaggccgtacatagtctctgaagcttaaaatgatagattctttcttcaaaactagtttctgacaaagtggatgacggtatcatgaaggaagctctcttagacttctatacaaagaggaaacatgatcaaatcattatttttagggatggagttagcgagtctcaattcaatcaagtttggatcaagttattgaggcatgtaggtcccttgacgagaagtggga

SEQ ID NO: 7664 - DNA, 291 bp, Gossypium hirsutum
  unsure (1)..(291): unsure at all n locations
  Clone ID: uC-gsronu33B126h04b1
gctattcgtccgcataaacttgaatgttattngggatattttaaaacaatatggggttaattacactttcccagcagacattgtttaacctccctatcctcacactggagacaatgacttacacctgcaccaagatcatctctcctataatttcacacaagggtgattactcaaatgaagagcatacattggcacttacttccgccctttgagactattcaattcattaccgactcacttagaaggttaacatcttctcattaaaacccaaactgaccaaagacccaaccc

SEQ ID NO: 7665 - DNA, 462 bp, Gossypium hirsutum
  Clone ID: uC-gsronu33B126h10b1
ttttcgcgtccggatagtcttgaaggttattggggataatggtatgcagaatgggcataggattactttcccagtagaaactgatgaaccaccagatacggtcactggtgacattgtcttcatcctgcaacagaaggatcatgctgaatttaaacgaaagggtgatgacttatttgaagagcatacagtggcacttactgcggccctttgtggctatcagttcatactgactcacttagatggcggacagcttctcattaagacccaacctggcgatgtcgttaagcctgatcaattcaaagcaataaacgatgaaggaatgcacttttatcagaggccatttatgagaggtaaactgtacattcagttcactgatgactgccctgactacgtgaccccagaccagtgctaggcactagaggctgtgcatgctcccaaggcatcggcacagatgactgacat

SEQ ID NO: 7666 - DNA, 159 bp, Gossypium hirsutum
  unsure (1)..(159): unsure at all n locations
  Clone ID: uC-gsronu33B126h12b1
ggtatcgatatacatgaaagagaatggtgtanggggcttttcaatggccattggggttatatacatcatggaaaggctaaaaaggccaaagaagatatgtaagcagcataccctgataagaatttggccacttccacagcgatccaaagacatctaatg

SEQ ID NO: 7667 - DNA, 563 bp, Gossypium hirsutum
  unsure (1)..(563): unsure at all n locations
  Clone ID: uC-gsronu33B127a01b1
attatttaaaaactctattccaagaattaaatggagattttaaaaagaaaggaacaggaattccttcatactcatcagctcaaacaagggggattaggtttagggtttcttttggagtaaggtaaaagctcacacaaagatgccgcagccaccgcaaatgattcctgtgatgccttcatatccacctactaatatcactactgaacagattcagaagtaccttgatgagaataagaagttgattttggcaattttggacaatcagaatcttggaaaactcgctgaatgcgcccagtatctagctcagctgcaaaagaatttgatgtatttagctgcaattgcggatgctcaacctcaatcggctccgacaatgtcgcctcagatggcaccgcatccagcaatgcaacccggaggatattttatgcaacaccctcaagctgcagcaatgtcacagcaaccttgcatgtaccctcaaaaggtgccattgcaatcaatagtccacatcaaatgcatgaccctcacacctnctatatcagcagcatcaacaagcaatgcagggtcaa

SEQ ID NO: 7668 - DNA, 426 bp, Gossypium hirsutum
  Clone ID: uC-gsronu33B127a04b1
tgtgtgtttaagcggaatgaggtaacaagcgatggtgtgttcttagatggagaaatgggatgtatgggatgttgtgtaaatgctcctatgatcacagttgatgattactccaatggatctgaaggatacacatataattactatgaagatattaccccaaaaagagttattgagatagctgagatgctacgaaggggagagaagctaccgcctggcactcaaaatccaaaacgaatcaagagcggaccagaaggtggaaataccactttgctaaccgatcccaaaccttctccatgccgagatcttgatgcctgctaatgttaacatgccaccgcagtctcaaataatgtgaagcttgggtttgccattggctttttggatgtatgttcttgatgaatttgcgaagcttaacctatcatatatttt

SEQ ID NO: 7669 - DNA, 449 bp, Gossypium hirsutum
  Clone ID: uC-gsronu33B127a05b1
tttgtatggatgggacaaagatcttgctaagaggatgttgtgttttggccctgggaccacaagtcctaacatggtggttgatatgtgtaagggagttcagtacctgaacgaaattaaggattctgtagtcgctgggttccaatgggcatcaaaggaaggtgcaatggccgaagagaacatgaggggtatatgctttgaagtttgtgatgtggttcttcatactgatgctatccatagaggtgggggtcagatcattccaactgctaggagggttttctatgcttctcagctgactgccaagccgaggctgcttgagccagtgtacttggtggagatccaagccccaaagcaagcacttggtgggatttacagtgttcttaaccagaagcgaggacatgtgtttgatgagatgcagaggcctggtactccactattccacatcaaagcat

SEQ ID NO: 7670 - DNA, 477 bp, Gossypium hirsutum
  Clone ID: uC-gsronu33B127a06b1
ttggactagtggctgcccagaaggttcctctggtggccattctccggattcagtgagtggccttcctgacaggaaaggatctggttatgggtgcaactccaaatgattccatatagggacctggggagaaagctatagtgttttcccagtggacaaggatgctggatataaatgaagcctgtcttaaaagttcttccatccaatacagaatacttgatggaactatgacatttgctgctagagataaagcacttaaagatttcaacaccgtaccagacgaacttgttatgattatgtccttaaaagctgccagtcttgggatgaacataagcagagcttgccatgtacttctgcttgatctatggtggaaccctactactgaggaccaggcacttgatagggcacatcgaattgggcagacttcgcctgtaactgttttacgattaactgtgaaagatacaggtgaggatcgtattt

SEQ ID NO: 7671 - DNA, 270 bp, Gossypium hirsutum
  unsure (1)..(270): unsure at all n locations
  Clone ID: uC-gsronu33B127a10b1
tttgtttcaagtgttgtcttccaatgcaattnnagttacttaattatgtgggggggggtataaaaagagttcctccacctcctcattttcagtgtttccattgtgtaataaaaatctgctatcttcttcactttcttattattgcagatgcttctactttaaattccagggtaaaagtaaaacactctactaattcatcttaaaaaaaaaaaaaacaataacaataaatcaataaaaaaaaataaagaaaaaaaacaaacaacacacaaa

SEQ ID NO: 7672 - DNA, 456 bp, Gossypium hirsutum
  Clone ID: uC-gsronu33B127b05b1
attatccccagccaaacgagtctttccaaacccaatggattctgtgtttgcctccattgttcaagctcctgaagatcccattcttggggtgacagctgcttataacaaggatccaagcccgaacaagttgaatttaggtgttggtgcttacagaactgaggaaggaaaacctctagttctaaatgttgttcgaaaagcagaacagcttcttgttaatgaccagtcgagagtcaaggagtatcttcctattcttggtctcgcagagttcaataaattgagtgctaagctcattcttggtgatgacagtcctgctattcaagagaacagagtggctactgctcagtgcttgtctggtactggttccttgagggttggagctgagtttttagcaaagcattaccaccaacgtactatatacattccacagccatcatggggaaaccatgtgaaagtttt

SEQ ID NO: 7673 - DNA, 334 bp, Gossypium hirsutum
  unsure (1)..(334): unsure at all n locations
  Clone ID: uC-gsronu33B127b06b1
tttactcgtccgcccacgcgtccgcccacgcgtngggggaagcttctcgatttggcagtacagaacttgttcgcattttattgcagattgcccaacggaatagcttggatgttgatgttgatcttgccttgggttttgcctcgcattactgcaagattgggacaatggagtgtctagtggaagagggtaatgctatggcgtttttgggccctttaatgagagcagctgaaagaggatgcatgcaggttgtccagtggtttgttaaaagaggttgtcgagacatggagctctgtctggccctcactgccgctactttcagcagccaagttggtgt

SEQ ID NO: 7674 - DNA, 355 bp, Gossypium hirsutum
  Clone ID: uC-gsronu33B127b09b1
tttttttttttagggcatagaagaaaggaattagcaacaccatgatcgttgagactgagaagagctacatcaacaatgttgagatggatgctccagctgagaacgatggcaagtgcaattgcggtactggctgcagctgcacagactgcacctgtggccactaagccaacatacaatggtcatgcttcagatcatggcatatatagggatctaaataatgaatttaaggttgaataatttgcgtctgttgtagtttgtgtggtgacttatatctgtcagttaacctttctctcctttactatgatgtaatggctatgcttatggccttatctggttaatgaagtatccttactat

SEQ ID NO: 7675 - DNA, 391 bp, Gossypium hirsutum
  Clone ID: uC-gsronu33B127c01b1
tttattcgtacgggcatcccaacatcatggctgagggtcttaaagaattggactcagtcgttggtcgagaccgcctcgtctccgacttggacttgcccaatctaacctacttgcaagccgtcatcaaagaaaccttccggctccacccgaccaccccgctctccctccctcgtatggcctccgacagctgcgacatcaacggctaccacatccccaagggcgccaccctcttggtcaacgtatgggccatttctcgagaccctaacgagtggaacaacccgcttgagtttcggcccgagaggttcttggccggcggcgaaaggccgaacgctgatgttaggggcaatgattttgagggcattaccgtcggcgcccggcgtagaatctgtgc

SEQ ID NO: 7676 - DNA, 505 bp, Gossypium hirsutum
  unsure (1)..(505): unsure at all n locations
  Clone ID: uC-gsronu33B127c03b1
cttcactcgtccgcccacgcgtccgcccacgcgtgcggcctaaacaaaagcaggcagccagagtggttacatggtacatatccaatatataaacaaaaggcgacggatactgggaaaactctaatcagttgtaataaatatatggtacaattttttaaaaaaaatgaaaataataaattaaaatttttttaacaaagttataggatttacatcacaatttgcttgcacgtcctctataaactaatgccaaaccccaatctgtcaacttgccgctccccccatttttaaaagagccacccttcttggttcttcttcttcttcttcgcctaacaacccctttctctctcttctttgatttgggntgtttctcacctttaaacgctgttgatcatcaagctctaatcagtaatcatggacgctggtgatcctaagttcaacaaagctagtaacccttatgttactgagcaagagttagaagattaacgacacgtttcatcagaaaccg

SEQ ID NO: 7677 - DNA, 484 bp, Gossypium hirsutum
  Clone ID: uC-gsronu33B127c05b1
gtaaagctcctttctgtattccgtgaaggagtgaagtatggtgctggaatcggccctggtgtctatgacatccactctcccagaataccatcaaccgaagagattgctgaccgaattaacaagatgcttgctgtgcttgagacaaacatcttgtgggttaacccagactgtggtctcaagactcgcaagtatgccgaggtgaagccagccctgaacaacatggttgcagctgccaagctgctccgcacccaacttgcgagtgccaagtgagaggcatatccaaggtcggacatcatcctttatatcgaagatgatccagaggaaatttgtcttaaatcatttgaataactgtgtgttggaagtatttgttaggcgtatcatatgcccctctttgaggccaattgttttccttttcttttttgggtatttcccctctaaatattttgtatttttgggaatatatgaattaccttcaattaccttg

SEQ ID NO: 7678 - DNA, 281 bp, Gossypium hirsutum
  Clone ID: uC-gsronu33B127c06b1
gttccgcccttttttttttttttttttttttttttgaaatttgaaatcaaacggcgtcgctcgcggtggaggaagagtgtgaaattggcggggctgatggtggtggtagatcggacagtggtgatgataaccaatggagctcgtgggattcgaataacggaaacgattgtaccgagttgttttattagaaaatgatcgaggttaatcctggaaaattacttcttcttagcaattacccttgatttcttaaaagaggttcgtggggatttcgtgaaagcctt

SEQ ID NO: 7679 - DNA, 244 bp, Gossypium hirsutum
  Clone ID: uC-gsronu33B127c08b1
ttttctcacgcgtccgtgtggtttgaagtttttgcctgttttatgtaggatttttaaagtttgagatgctttggtttgccaaggcatcttagtcaagttttgtgtctgatcttgcggaactatactttgttttttctatatatttgtctgtttcttttttctaaaaaaaaaaaaaaataaaaaataaaaaaaaaaaaatattttaaaaaaaaaataatttaaaaatattatataatataataaa

SEQ ID NO: 7680 - DNA, 564 bp, Gossypium hirsutum
  unsure (1)..(564): unsure at all n locations
  Clone ID: uC-gsronu33B127c09b1
cctcacgcgtccgcccacgcgtccgcggacgcgtgggttaccatcgaatttttctttttaattcatctccttatgatggcgaactcacctactgttatccggccaccgccaccgtcaccacaaccaccgccacccttcttttcatcatcatcaccaccaccactttctctgcctgataacaccactagcagtactattatcccatcaccctcgccgttaccattctctttatcaccccaaatagaccccataggtcaaaacggaaacatttccatagtgagcatcaatccaccaccacctttccctgattcaccgagaagcgttgatttgtccccactcgaattcattcttgctcttatggcagtcataacgatcccagctatagtctacgctttctttttcgccgtcaggtgccctccttggtcttccgacgaacgccaagacaggtccagggacaaccatggaagtgctgtcgaagtaaccgagagaagggagcctgtttaggtcttagtatcgaaagaaactcactctaagataggncagtgattgcccgttggtatctgg

SEQ ID NO: 7681 - DNA, 449 bp, Gossypium hirsutum
  Clone ID: uC-gsronu33B127c10b1
ttttaaaaaaaaaaaaaaaaaaaaaaaaggggggaaattttaaaaaaaaaaaagataaaaaaaaaaaaaaaaaaaaaaataaaaaacctgggggggccctctttaggggttccgttttcctgctcgcgggcttgcgatctttgttttcttctaggggcacctcttttttctttgctgggcccggttttacaccgcgtggtgtgggagatccccgtggtgtccccatttttattcgtttggctgcacccccctttttcgggtggtggtttttcgcatagggccccactctctgcccttttcccaatttgtgcgccccctgtggggattgtgccccgccccttgtcgcgctccttttcgcgcgggtgttgtgggtttcccccgtagggttccttatactttcgccagcgcctcagccccttgtcttttgttctttttcctctccttttcgc

SEQ ID NO: 7682 - DNA, 281 bp, Gossypium hirsutum
  Clone ID: uC-gsronu33B127c12b1
gtaaagaggggttttccccttttccctccgggagggcattgatcgcccatcgtggcggctccaccttccccaaatgcacaccgcggtggccgacgagccagatatctcggaggcgtgggagcgtggcatggagtagcgcacgattcggaagcttggcgcgcatcgtacgctgcttggactcgaagcttgcggcgccgatttccttctgctgctcgggttctaggttggctttatgttctgtgtattgggttgagagatgcgggataggcttatgacaagtt

SEQ ID NO: 7683 - DNA, 367 bp, Gossypium hirsutum
  Clone ID: uC-gsronu33B127d02b1
ctttttccccgcgttgtctgcaggcactaatcggcaaggggggggttggcgatcgctacaactgatgctcaccgcactgaacatgccccttaagacacaccgcatcaaaccagcaggacccccacaaccctcatcttccgactaccgctcataagcgtactcattttgaccaattgctagccaccgatatataagaacccaaggctcagcctcccttgccaattacgccgacctatccgccatcgcctagcatgtgcacgctcctcatccatgaaactcgacaattcacggctttctcttttgaacccaactccgacacacaagcaagctttacaaaagcccgtcctacacataattgaactgaccc

SEQ ID NO: 7684 - DNA, 486 bp, Gossypium hirsutum
  Clone ID: uC-gsronu33B127e07b1
tgctcacgcgtccgcccacgcgtccgcccacgcgtccgctattatcccatccaagaggctccggaacaagattgctgggttctcaacccatttgatgaaacggatccagaagggtccggttcgtggcatttctctgaagcttcaggaagaagagcgtgagcgtcgtatggattttgtccccgatgtatcggctattgctgttgattcaatagaagttgataaggaaaccattgatatgctttcacttcttggaatggccgatcttcctgggattgctaaggttgatccggttgctgttcaggttcctcaagtcgggttcggacgtggtggtggaccctgaaggaggtcttaagtggtgggttttccatggatatgatgggttcttaattttaagtttgatatgttttcttttgggattttgtgtctttgctggaaccattctaggtatgtctaatgctacctgacaattattaagtttgataagac

SEQ ID NO: 7685 - DNA, 523 bp, Gossypium hirsutum
  Clone ID: uC-gsronu33B127e10b1
tgttcacgcgtccggtgctagttgacaaggatcttaagaacaactacgaccggatcgagctcgaagagatggttcaagtagcattgttatgcacacaataccttccaggccataggccgaaaatgtcggaagtggtccgaatgcttgaaggtgacggcttagcggaacgatgggaagcttcacaaagagccgaatcaaccaaatgcaagcctcctcatgaattctcatcgtcggaccgatattccgatctcaccgacgactcatcattactcgttcaagccatggaactgtctggaccaaggtgaagcagaaccaaccccttataaaacgtaactataaatcttttcttcttttctttccggagatttcagtgagacttagaaaattatagctaaaactcctatagttgcataatagtgggatagcataagatcaaagggctttgatttttttggttttggttttttactacaagtgtacagattttatgtctaagaagacattattgaagatctgagagact

SEQ ID NO: 7686 - DNA, 548 bp, Gossypium hirsutum
  Clone ID: uC-gsronu33B127f08b1
gtaaccatactcaagttttttattttgcctctgtagtatatccaatggatcagcagaagaagaccacctctggggctctccaggcaccactgaccgcacctagcaacaatcctactgctgcagctcaggcactcctccataaccctggtgctgctcaagcactcgccaataatccgggtgctgctgcggctgctcaggcattccttggaaaccgaggtgctacttatcagccactccttaataacactcatgtcggtcagcaacacatgggcgttcccggtgctagtatcagcaaacctagtacaggtgaggcactcatgaagggtcatactggttctcatgcactcatccgaagtgaccgtgggagcatgttaagcttgtcagatgacaatgtgatgatgaagcaaatattggcaactcatgctcctgatggtcgagaatttgatgttagacctctactcaatctggttgaggacatcctcaatcgagctacccagcatgttgattttcttggtagggtactactcaagatcaaatcgaaatggaag

SEQ ID NO: 7687 - DNA, 607 bp, Gossypium hirsutum
  unsure (1)..(607): unsure at all n locations
  Clone ID: uC-gsronu33B127g04b1
cccactcgtccgcccacgcgtccgtcttaatcgaaaatgagagagtgcatttcgatccacatcggtcaggccggtatccaggtcggaaacgcttgctgggagctttactgtctcgagcatggaatccagcctgatggtcagatgccaagtgacaaaactgtcggaggaggtgatgatgcttttaacacctttttcagtgaaactggtgctgggaagcacgtccctcgtgccgtcttcgtggatcttgaacccactgttattgatgaagtgagaactggtgcttaccgccagctcttccacccagaacaactcatcagcggcaaggaagacgcagctaacaactttgcccgtggtcactacaccattggcaaggagattgtcgacctctgtttggaccgcatcaggaaacttgctgataactgcactggtcttcaaggattccttgttttcaacgctgttggtggaggtaccggatcaggtctgggttctctccttttggagcgtttgtctgtcgattatggcaagaaatccaagtggngtttcacttgctacccatctcctcaggtctccacttctgttggtgagccttacaacagtgttctctcaa

SEQ ID NO: 7688 - DNA, 394 bp, Gossypium hirsutum
  Clone ID: uC-gsronu33B127g08b1
ttcacgcgtccgcccacgcgtccgcccacgcgtccgcggatgcggatttgattgcggagcaacatatatgggcggcggtggatccgtacgccaaaaacgaagcctttaatgtgactaatggggatgttttcaagtggaagcatttgtggagcgttttggcagagcaatttgggatagaagaatttgggttcgtggaaggggagaaccgggggatggaggagatgatgaaagagaaggaaggagtttgggaagaaatagtgacggagaaccagttggagaggaccagtttgccggtgcggggaaattggcggtttacggaggcgaaatgtttggttttaagcacacacgttagttatggtgtttacaaagcaggtgcatgggcttttgaggttaa

SEQ ID NO: 7689 - DNA, 526 bp, Gossypium hirsutum
  unsure (1)..(526): unsure at all n locations
  Clone ID: uC-gsronu33B127g09b1
attgcttcagcaatcatggagttgatagggctaggggcggtcacaattttggtccctggaaaccttccaattggatgctccccagcatatctcacatactttcatggttccgatatggccgattatgatcctttaactggttgcataacatggctgaaccaattctccgagtttcacaacgaacagcttcagaaaaagctcgatcagattcgcaagcttcatcgaaatgtcaacatcatttacgcagattattacaacattgcaatgcgtttctaccattcccggaatcagtttggatttactgaaacacttagagcatgttgtggagggggaggtcgatacaattacagttcatcaatggcatgcggggatccgccattaacgacaagctgcaaggacccttcttcacatgtgagttgggatggtttacattatactgaggcaacttacagatggatttcaagggtgttttagaagattatatgctattcttacacnatagctgtgttttcatttaccgcggaac

SEQ ID NO: 7690 - DNA, 480 bp, Gossypium hirsutum
  Clone ID: uC-gsronu33B127g11b1
ttcttcacgcgtccggttctggaagcacgtttccaaccttgaccgtcgcgagagccgccgttacctggagatgttttatgctcttaagtaccgcaagctggctgaatcggttcctctggcagaggagtaaaacaaaggaagaggcgggttttccctggaggatttttctgagttcttcacaataaaataataataatcttttgttgttttcatatttatggtcggacaagaaaaagcctcttttgtatctcttttcctttttttttctttttttttgttgttttatttttcccggcattgttagaacatggagggggtactgcgcccctggattccaacaaaagattgtgattcccctcattttcttttttttatttgtacgtgtctcccaagtcccaactagtgacgccacctggtatgactagacctgagttatgtcagtttcggctacgccatgataaattttaagatccttttaat

SEQ ID NO: 7691 - DNA, 507 bp, Gossypium hirsutum
  Clone ID: uC-gsronu33B127h06b1
ttgtgtcaatcaattctgaaagcaagtatggcttgtgacttttaggttggaggtgagttccaagccaaggactaccatgatccttcaccagctccattggtggacggggaggagttgacaaagtggtcattttatagggctgtaatagccgagtttattgccacgctcttatttttatacatcactgtgttgacagtgatcggatacaagagtcaggttgaccctgataagggcagtgacgaatgtggtggtgttggcattcttggcattgcttgagcttttggtgggatgatctttatccttgtttactgcactgctggtatctctggaggacacatcaacccaacattgacctttgggcttttcttggctaggaaggtgtgcttagttctaagccatattttatatgactgctcaatgattgggaaccatttgtggatgttggctagtgaaggcattccaaagtcatatacaacatgtatggaggagagccaccactcgctgatg

SEQ ID NO: 7692 - DNA, 487 bp, Gossypium hirsutum
  Clone ID: uC-gsronu33B127h10b1
cctcacgcgtccgcagtcttccaatgtctccccatctaccttttgggtgcaaaatctgaccaacaataacaccaccaaccactcatcgttatcttattatactcccaggattaatcctgtaatagccaaggcactgcgtactgaagcatctgccacagtacagcccataaaaatggtgaaagctatcagggttcatcaatttggtggatctcaggtccttaaatgggaggatgtggaacttggggaacccaaagagggtgagatacgtattaaaaatatagctattggagtgaatttcatcgatatctattttcggaaaggagtttataaggctactaccatgcccttcactccaagtatggaagctgttggagaggtgactgccgtgggacctggactgactggcaggaaagttggagatattggagcttatgctggtaatcctatgggttcatatgccgaggagcagattcttccagctgacaag

SEQ ID NO: 7693 - DNA, 497 bp, Gossypium hirsutum
  Clone ID: uC-gsronu33B127h12b1
tttcacgcgtccggcagaactcactgtgtgaaggtggtgcatcgtttgtacccagaggttgaccctgccctcaaccccgaccatgttccacacatactccataaatgccctgatcagatcccagaccccaaggccgtccagtatgtgagaaacgaccgtgggacacccatggttttggataacaactactacaggaacatactggacaacaagggtttgttgattgtggatcaccaactggcgtacgacaaaaggaccagaccttatgtgaagaaaatggccaagagccaagactatttcttcaaggagttctcaagggccattactctcctctctgagaacaatcctctcactggtagcaagggtgagatcaggaagcaatgcaatcttgcaaacaagcttcactaaaatgcctcgccaaagagaaagccgagtgtggccgaataaaatgtttgtttactcagtttcttttccaagagacgaagtttgtaatgtgc

SEQ ID NO: 7694 - DNA, 538 bp, Gossypium hirsutum
  unsure (1)..(538): unsure at all n locations
  Clone ID: uC-gsronu33B129a07b1
taacttgcagagccattttccaaaggatgaagaactgtactatctacgcagtttcgagcacgatccgtattgtgttcggatttttgtttatcgctctcatctggaagttcgatttttcgcctttcatggttttgatcattgccattcttaatgatggaaccattatgacaatctcaaaggatcgagtcaagccatcgcccttgcctgatagctggaaactgaaagaaatttttgccactggaatcgtgctcggaggctacttggcattgatgactgtcatattcttctgggccatgcatgataccgacttcttctcggacaaatttggtgttcgatctctacgggaacgagagcatgagatgatgggcgctttatacttacaagtgagcattgtgagccaggctctgatcttcgtgactagatcgcgtagctggtcgtacgctgagcgtnccggactactattggtcactgccttcatcattgcacagcttggtgcaactttgattgctgtatatgcaaactggngatttgcaaggat

SEQ ID NO: 7695 - DNA, 480 bp, Gossypium hirsutum
  unsure (1)..(480): unsure at all n locations
  Clone ID: uC-gsronu33B129b07b1
tttttatttctctcctaatttctctccttagccgactttaatccctccctttgaatgccgatccgccaccataaacgacgtccaacagattcaggcttcgagggtcaacattcttggctattcgtacatgattgagcacgtcactgacgtggcgtggtggagcagcgcacgttgcggagaagtggcattcggcgctcgagggaggtgtgagcagccgacctaggtgcggcgcacctaaggttttctgcttttttgatggttgtcggttagtgctaagtgggctggggttttgggcctaggttttttagtttttgtgttgggtgttttgggctgtaatttagactttgtttttatttgtttttttggtttatgggccccgagctaaattgggctctacacttgaaatttgtggtcgaaccaattgattctattttcaaaaacataaaaaattccatggaagagcaatacaatntgatttgt

SEQ ID NO: 7696 - DNA, 494 bp, Gossypium hirsutum
  Clone ID: uC-gsronu33B129b08b1
gtgtttcccctcgttacgatcagtttcatttcggctttatagccgattcccatattaaaatattgttgttttattctctgctactgcttgtgcttcttgctgccatttttcctcttttccaaatgtttgcaagtcatgggagtgtcagacgcgtggaaggccggtgattggcgccccgagcggtggtggcgcgcgtgagaaggctggtggctgaaggcatgcggctaaaaactttggtggccgctgaaatttttttttaacatactgggcttgggctattagggtttataaattgggtttgggtattgtatttgggctattggactcttatatttggttacttgggttttgttatatcgagcccggttaaagtttgggccaaacagaatcattatacgaatatagaaaaaaaagtttcaaaaatatgatattatagaacccctcaagctgaaaaaaatttaactgaattcaccttaaagtttaaatatatatta

SEQ ID NO: 7697 - DNA, 576 bp, Gossypium hirsutum
  Clone ID: uC-gsronu33B129b10b1
tccactcgtccgctccttgcataaagaaacgtggaggatcaaggaagagaaccagtaagaggaaaaagtctacaagagatgtgattatgagttctcgtagtagtagtagtaggtccttgagttgctcaacttgtccgagtgacagcgacgagagtggatatgagaagagaaagggcagatcagaaaggagggagaaatatggtaggtcggagaaggttaaaggaggaagcaaaaggagtaagggccgatcaaggagttgttcttcttgtagtagatataatgaaggatctgatcattcaattggggagagagtaatggaagagagcaacacgaggcggctgaaatcggttattactgttgttaagcgagaaaatgaaagcagcagagaattgattgctgatgagcctaaagaagatgtatatgattacgatgattacccatcctgtaggagcaatgatagcaatgatggctgtaatccgagggagttacagcaatatccccatgctatatctgagacgaaaaggccttcagatgatgagcaagtagaagtttctaatgtcagaatgagcagcattg

SEQ ID NO: 7698 - DNA, 447 bp, Gossypium hirsutum
  Clone ID: uC-gsronu33B129b11b1
taactccttacaacagttcttccccgtgattgcaggtgggagatcatggcttacttccggtcgctccctcaggttagtacgagcaaggatgcggaaatgtggatcccaactgacacaaaacaatggcaacaacctccgttaataacaccgatcaagtcgatgaacagtgaacctctgggtttgcagttatacttggaacaccctagcccatctgaactggtttctgggtaaactggtatgagttttgggacgttatgttgtttatgttattatacacttcaaaatggagttggggtgacctcaaaacttttggaatgtggaagaagtaggtaaaagtaccatggaggtctttatattaggagtgagattatgttttactttctttacttaaaaaatagacaaattagttcatgtacgttaaatgaaagagcagattgatcttatttt

SEQ ID NO: 7699 - DNA, 524 bp, Gossypium hirsutum
  Clone ID: uC-gsronu33B129b12b1
ttcattcgtccgaggaatccagccaaaagaatgagccagaatgggaagaagaccaggcagatgctacagatattacagtggaaagccttacatcaagtcaagatattgcagaggtgttcctgatgctaagctcaaaatttacgatttgggaaagaagaaggctcatgttgatgaattcccagcttgtgttcatctcatctctcttgaaagagaacaactctccagtgaatctcttgaagcagctcgtatctgcgccaacaagtacatcaccaagacttctggaaaggatggtttccacatgagaatgagagttcacccatggcacgttattagaatcaacaaaatgctttcctgtgccggagctgatagacttcaaactggtatgagaggagcctacggaaagccaactggtcttgttgcccgtgttgatatcgatcaaatcttgatctccatcagaaccaaggaggcccaacgtgccaatgctgttgaagctttgaacagatccagaaacaagttttttggaa

SEQ ID NO: 7700 - DNA, 564 bp, Gossypium hirsutum
  Clone ID: uC-gsronu33B129c05b1
atttgaacttcctgatacgatcaaaactattatacgagcatgtgaagaagcgcgcaggagtggtgccctgatagctgtcaccgcatcagatgtctcctgcattgagagacactatgatgattactgggaaattgtagggaattatgcggatatcttgtttgcaaacagtgacgaagcgagagctctatgccatttttcttcaaaggaaagcccaatttcggcaacaaggtatcttagccactttgttcccttagtgtcagttacggatggacctaaaggatcttacataggtgtaaaaggagaagctgtatatattcctccttctccatgtgtaccagtggacacatgtggtgctggtgatgcatatgcatctggtgttttgtacggcatactacgaggtgtgtcggatttgaaaggtatgggtacattagcagctaggattgcagcgacagttgtggggcaacagggcacacgacttatggttcaagatgctgttgatctggcggagtcattcgcattcaccctaaggggtctagttctagtgtgagttccgatgtaagctcg

SEQ ID NO: 7701 - DNA, 203 bp, Gossypium hirsutum
  Clone ID: uC-gsronu33B129c11b1
ttctttcttccggccggaccgcctcacggtgaggaccggtttgatcgtccctactgccggcgatgcgctcctggccttaattggccgggtcgttcctccggcgctgttactttgaagaaatttgtcttgcacaatgtcggagagcttgaactgttaatgatgcacaacaggacatattgtgccgagattgcccatgatgtttc

SEQ ID NO: 7702 - DNA, 303 bp, Gossypium hirsutum
  unsure (1)..(303): unsure at all n locations
  Clone ID: uC-gsronu33B129d05b1
cgcataccatagaattctatttaattggctgctctgcactcactgtccgtatccctaacaatgggaaaggctctatcccaccatatagtttcaccgctctaccataaaaacagttgtgggaacagacgctacccttactcttcctctaagtgatgtgatgaacacatctaacctacaacaagtggaactggccgtgcacgataacatatccagaacagcctggtggcttaccttaccttcaatgggcgatgggcatatacatacattnaattttaggaactatgctgctcctaccaagaatct

SEQ ID NO: 7703 - DNA, 551 bp, Gossypium hirsutum
  Clone ID: uC-gsronu33B129d06b1
cccacgcgttcgtaataagcacctccccgtaagcaaagcacaaatgaaagcttggagagagacccaaaaacaatgtctaaggaagttagtgaagaaggacagggtcgtaaggactatgtggaccctccaccggcacctctgattgacatggctgaactcaagtcatggtctttttacagagccctcatagctgagttcatagccactctcctcttcctctatgtcactgttgctactgtaattggtcacaagaaacaacaagatgcatgtgatggtgttggtctcttgggtattgcatgggctttcggtggcatgatctttatccttgtttactgcactgccggtatctcaggtggacacattaaccctgcggtgacttttgggttgtttttggcccgtaaagtgtctttcattagggctgtggcttacatggtgtcacagtgcttgggtgctatatgtggagttgggttggttaaagctttcatgaagcatccatacaacttccttggtggtggtgcaaacaccgtggcttctggctacaacaagggaac

SEQ ID NO: 7704 - DNA, 107 bp, Gossypium hirsutum
  Clone ID: uC-gsronu33B129d09b1
ttccatgcgtccgcccacgcgtccgctagatcgggaggggccgttctaaatttttgtgggttttttaaacttttttttttgggaacaggaaaacaagtggttttgat

SEQ ID NO: 7705 - DNA, 536 bp, Gossypium hirsutum
  Clone ID: uC-gsronu33B129d11b1
tgtgttttttctcttaaaccaaaggaacctgagggcttattgcttgattacccaagtcatcaacgacgactcttgcctctccttgcaaagacgtttgctatgagttttggagcaaattacttgaaaatgctgtatgtgaagaggacaccccagtcaaacaaaatcattcatgtagtttcaagttcattcaaggctacttttacatggagtaacatgcaaatacttcaggaatgtcgcgaagcttgtggaggacaaggactaaagacagagaatcgtgttggtcatctaaaagctgaacatgatgtgcaatccacttttgagggggacaataatattttaatgctgcaggtcagcaaagctctgtttgctgaatacatggcagctcagaagccaaacaaggctttcaagggtctgggtttagaacacatgaataaaccctgccctgtcattccatcacagcttactacgactacccttagatgcagccaattccagatagatgccttgtgcttaagggagagagatctttttgaatc

SEQ ID NO: 7706 - DNA, 307 bp, Gossypium hirsutum
  Clone ID: uC-gsronu33B129e06b1
ccaatttttaagttttgccataaagacttttatcaggctggatgatgataaacccgtagttgcgggtatttgtgatgggttatctatagtacctatgttttgagtgcctttctgtagtctttttatctccttcaacgctaatatgcaactgtctgtgagggttagacaacacatttagttcattttcaagttttttttttttgtttaatttcattgaatattgacccttgtttgtttttttttcagtgtgttaaaaagagtatgctttcatgacttataaaaaaaaaaaaaaaataaataaaataaa

SEQ ID NO: 7707 - DNA, 551 bp, Gossypium hirsutum
  Clone ID: uC-gsronu33B129e07b1
cccattcgtccgctaaaagatccctattacccatggggctccttcttaccttcctgtccatatcaaccgcagcaccaactcgaaaaacccgaacccgaaaaccatgcaagagcatggtgttttatttccacgacataatctacaacggccataacgcagagaacgcaacatcagccattgtaggttcaccacaatgggggaacaagaccattttaacaggacaaaaccatttcggagacctggtcgtgttcgacgaccccattaccttggacaacaacttgcattcgaaaccagtgggtcgggcccaagggttttatatctacgacaagaaagacatattcacagcttggttgggtttctccttcgttttcaattctacccaacataaaggaagtataaacttcgccggtgctgatccattgatgaacaagacgagggatatatcagtgattggtggaacaggtgatttcttcatggctagaggagtggctactttgatgactgatgccttttgaaggggaagtatattttcgccttcgaactgatattaa

SEQ ID NO: 7708 - DNA, 435 bp, Gossypium hirsutum
  Clone ID: uC-gsronu33B129e12b1
gttcatgaaaaataattacaaatgttacattatgtggggaatccaagaacttcatcgggcgtcttaaaaaagaaggaggaatctacatggaacaactctatttgatgaccctatagagcatgatcggggctgccgctgtaaaagctccaaccttacttcccctagcatgcgagatgaatgctttttgctaccgactccataattaaaacatgcggccggagtttatacactaagtgactgagaaaacctagccgtaacccaacttaatcctctttcattaaattccctttttatcaatggggatcacatcgaaaaggcaagccacctacgctctttccataagttgggcatgcaaaaaggccaatgtaactctccctttagcggttcactaaacccggcctatagacgaggtactctcatcgtgacggattcaat

SEQ ID NO: 7709 - DNA, 557 bp, Gossypium hirsutum
  Clone ID: uC-gsronu33B129f08b1
caagtatctcatcatactttgtcgaatggattccgaacaatgtgaaatccacagtttgtgacattcctccgagtggattgaaaatggcatccacgtttatagggaactctacttcaatccaggagatgttccggagggtgagcgagcaattcactgccatgttccgaagaaaagctttcttgcattggtacactggagaagggatggatgaaatggagttcacagaagctgagagcaacatgaatgatttggtttcggagtaccaacaataccaggatgccactgcagaagacgaggagtacgaggaatatgaggaatacgaggaagaggcttaaaggatgctccttgttctttttatcatgtaggacattcggttgtgcaatctcggctttgctggttttcagcatttggatcgcttattgctgctgtctttgtgatttacagactagtattgctgctttgttttttatcaataattttcagcagtcagattcgtttctcttacaaatgtagcttacaattgtgagagcaaatgttaggctgcgaatccatttata

SEQ ID NO: 7710 - DNA, 373 bp, Gossypium hirsutum
  Clone ID: uC-gsronu33B129f12b1
aaaaataattacaaatgttacattatgggggaaatgcaagtcttcaatatttgtcttaaaaaaaaaaaaaaggcgagggtacatttattttagggggggcgggacaaatctaatttaatatcggcccccccttttaaaagaaccaacattacttaccccctctatccaaaaacctaacctttttattctctcccctaaattcaatctacttgccctctttttacaactccctaactcaaaaaaccctttcctcccccaactaaatcgcctttcaaaacatccccctttcctctaattccgtaaaatcaaaaaaggcctcacctttccccctttccaaaaatttagcaaccttaatggtcaaagggaccccccc

SEQ ID NO: 7711 - DNA, 398 bp, Gossypium hirsutum
  Clone ID: uC-gsronu33B129g03b1
cccactcgttcgcccacgcgtccgaacatggatccttacgttgttacatcaatgattgctgagaccaccattatctggaagccttaagagggggtggaaattgaaggttgtgaaagacgagaaggaaaaacctcattcagattaataaaaccccctctctcatctttctttgttgggccactggttgaacttgtattttattgctttggtttgctggtttgcaatttaaattgtgcgacttattattattattatcattttagtttatagtcttatgctgctgctgatatgttcacatgaacgaatttatcgtgttttaaataaaattgtagttgattgttcgcacccaaaaattatctaaaagcctttgacaaactttatacttatattctaaacat

SEQ ID NO: 7712 - DNA, 557 bp, Gossypium hirsutum
  Clone ID: uC-gsronu33B129g04b1
cccactcgtccggtgaaactggcacatgtgaagcagaggagaacaataatgatcttatatgggttgatcctgcttcatgctgctatgcattattttcgaaactagatgctaagaagatgctcctgcagcagtcacctttggcccttgctaaagccttaaagaatccagttgagttggatggattaaggaatgcacatatccgggatggtgcagctgttgtgcagtatcttgtctggttggataaacagatgcaagagatttatggggcttctggctacttcttggaggggaagggagcaagcaaaaaaagattagagactatgaaactgactgaggtgactgctagtgataagttggagggatttcgtgcaacaaaagagcactttagaggcctaagtttccctactatttcttcggttggtccaaatgcggccgtcattcattactcacctcagcctgaaacatgtgctgaacttgatccagataagcattatctatttgattcaagagcgcagtatctagatggaacaactgatataactcggacagttcatttt

SEQ ID NO: 7713 - DNA, 251 bp, Gossypium hirsutum
  Clone ID: uC-gsronu33B129g10b1
gacttaacaccacaaacaaacaccgggggcggttttaaaaaatttacccaaggaccggttactccggacaatggcgacgggagacagggggaggagcacaaatacagctagggccaggctattggggagatgaggactaaggggtcctaataagagcagaaccagcacacaatggggggggggaacaaaaggggaagagcctcaatgattctgattcccacctactaattcaaaccctaaaacccagcaca

SEQ ID NO: 7714 - DNA, 233 bp, Gossypium hirsutum
  unsure (1)..(233): unsure at all n locations
  Clone ID: uC-gsronu33B129h01b1
tcccactctttcggaaatgganaaccttgaattcanagggggccatttaaatgtaaatgaatgtttatgaacaaggggggcttattttcttgctttcaatgtattgtatttcggacgtttttggcatctttgtacatccttatcctctcttcttttttcttccggtggtgcttttcatgttatgtttttaatgcataattctacaagtaaaatatattgtttgttttagtgtc

SEQ ID NO: 7715 - DNA, 467 bp, Gossypium hirsutum
  unsure (1)..(467): unsure at all n locations
  Clone ID: uC-gsronu33B129h02b1
cccactctttcncatgggtgttgtcacttataactatgactgtaccttctctgtcgctcccgccaggctttacaagggcttcgttctttaagctgacaaggtctggcccatagctgcccctcatgcaatcaataatattgaggttgaaactaatcctggccctgcaagtatcttaaagatcaactttgttgaatgccttccattccaatatatgaagcaccagattggaggacatgatgaaaacaaattttcatacanntacagtttgattgaaggagggcctttgggggacaagcttganaaaatcaactacgagaataagtttgaggcagctgtaggtggaggaagtgtgtgcaagagctcgatgaaattttacacttttggtgactatgtaatcactgaagatgaaatcaaggctcttattaaagggagtgagggagtctacaaagctatttgaagcttacctc

SEQ ID NO: 7716 - DNA, 563 bp, Gossypium hirsutum
  unsure (1)..(563): unsure at all n locations
  Clone ID: uC-gsronu33B129h03b1
gatcttattatgttcctatctgtnatcgcctncttatgggtgttgtctattgtcggaagggggtgcaacttctgaacactgttttacatagtctttgtacttcttcacacagtacccgtgcttttacaaaaatactatgaccaggtggagccatttgctgaaaaagcaatgcatgagattaacaaacagtattcagtgtttgatgcaaaggttctaagtaagattccaaggggaccattaaaggagaaaaagaacgattacatttaccctccaagagggtttcttacatacattttgtanctgccttccgtgaaaatgtgttatttactatatatccctgtttagttagaaccctgtttgaatattttttcggttttagtacacaatgggttcaaaaaggttgatgaatttggcatctttttttctaaatcttgcttagttgttttttgatatggaaccatatctttgtgaccatatgttatcatattgcatggtgggtggaatacttgagttgaaagttttttaagttgcgttggcaaaaaaattatctctctcttttcccc

SEQ ID NO: 7717 - DNA, 553 bp, Gossypium hirsutum
  Clone ID: uC-gsronu33B129h04b1
atggttctttgaagtgcatttgccgttgctttcattggctgggtggttaccgctgtcggggggcaatctccggcagcctcacctactaaagctccgccggcagcgactactcctgccactgctcccgctactgcccctgttagcaaacctaaatcaccggctccaactgctgcccctaccacttccccaccaacttcttcaccaccggctgcggctccggagaagtctgcggcggttccagccccatctaaatctgctccggcttcttctcctcccgctgctgctccggtgagttctccaccggctccagtacctgtgagctctcctccagccaaatcgcctcccgttgctgcaccgacgactccaccagagagctcggcctctcctccggctcttgttgcggcaccaactactgctgaggttccggccccagctccaagcaagagcaagagcaaaagcaagaaatccaagaaacaccatgctccggctccttcacctgatatgcttggaccttcccctccaccactggagctcctggacctagcctcgatgc

SEQ ID NO: 7718 - DNA, 204 bp, Gossypium hirsutum
  Clone ID: uC-gsronu33B129h08b1
tccattcgtccgttgattcatttgagattgtttgatacgatttgttaattttggtagcctcttggctcccaggttgttcatgctttactgtcttgtataaggattgaacaatttgttgaagttccaaccattttaaagtcagcaaaaagacatactcttctataacaataaataaatttactataaaaagaacaaaaataaatt

SEQ ID NO: 7719 - DNA, 386 bp, Gossypium hirsutum
  unsure (1)..(386): unsure at all n locations
  Clone ID: uC-gsronu33B129h09b1
gccattaccncccgccatgtttcgctctatatagcggcggtttgtttaagtgctttctccgttgtgtcgctgatggggttcttctttatggataaaataaaggcaaggaaatctcagcagtaatgtcatatattatggttttaagaaccctaattaaacctttgaaaaggatttttttagtaatgggttttatttgcaagtcttatttactttcttttgtgtttttaatcctatatgacttaagttgaatggttgtgttttattggcaatggggtgaataaaagagttgggattatctatgatcatatccttgttatatattaaagttgaaaattgcctatttgatattagtgttttcttcttgttgttaaaaacaatttgtgatc

SEQ ID NO: 7720 - DNA, 420 bp, Gossypium hirsutum
  Clone ID: uC-gsronu33B129h12b1
tctcactcgtccggccacacctacctaacttctggggggctttgaatacattagtggttggtgtgaaacaaaccaaacatgccgctcacatggttgaatgggacgctcaaatttctacaactttctttgcatgcgacctggttactgtttttgatgccactgtaaccacataggatatcgtatacggtttcaacaaatgaacagtaagagaggctggactacgcttcaatgctctatatcatgactcttagctacgagaaaattcttatcattgttatcaatgacttttcgtaacaactgaaactttgggaaggacaatgagctcggctttatcattaaactgcaaatatatcatcgtatgaacttgtcgcaattacattataatgccggcctcatgaaaaaagaccaattcaagattca

SEQ ID NO: 7721 - DNA, 346 bp, Gossypium hirsutum
  Clone ID: uC-gsronu33B130a01b1
tcaacaaagtcctggctggaccgctcgctgctcttggctattcacctgaaaggcaatgtgcagggtcaacgcatattgcgaggtgacgctttactcaaacctataaatgcttgtcattggagagaccaaaaccatttgctggtaacggttgttgaatttggaactttttaagcatcagctccactaggcagatggttataactgttgctacaagggtaattccatggccatgatagttgaataatatacacttattgaagcaagtagaccctatatccaaataaaatgacctgtccatttgaaaacacctatgtaaatggtaaacccttggggttgccctctttaa

SEQ ID NO: 7722 - DNA, 81 bp, Gossypium hirsutum
  Clone ID: uC-gsronu33B130a02b1
gaccaaccgcgttctccaacgcgtccgcccacgcgtccgcccacgcgtccgcgaacacttggacgggcatatctactggca

SEQ ID NO: 7723 - DNA, 524 bp, Gossypium hirsutum
  Clone ID: uC-gsronu33B130a03b1
ttttcacgcgtccgcttcacttcacatcttttgggcaatcaattttgtaagcaagtatggctaaggacgttgaggttggtggtgagttccaagccaaggactaccatgatcctccaccagctccattagtggacggggaggagttgacaaagtggtcattttatagggctgtaatagccgagtttattgccacgctcttatttttatacatcactgtgttgacagtgatcggatacaagagtcaggttgaccctgataagggcagtgacgaatgcggtggtgttggcattcttggcattgcttgggcttttggtgggatgatctttatccttgtttactgcactgctggtatctctggaggacacatcaacccagcagtgacctttgggcttttcttggctaggaaggtgtccttagttcgagccatattttatatggctgctcaatgtttgggagccatatgtggatgtgggcttgtgaggcatttcaaagtcatattacaacaagtatggaggaggagccac

SEQ ID NO: 7724 - DNA, 502 bp, Gossypium hirsutum
  unsure (1)..(502): unsure at all n locations
  Clone ID: uC-gsronu33B130a04b1
tttgatgctagcatcttcggagatgtcttgccgatagggtggaagcttttgttagggttaaagaggaaggaaggtcgtgcttctgtatattgccggagatatattagtcccggtgggcggcattttatatcatgtaaagaagtcgctgcatacttgcaatcctgcttcggtctccatgatgcacccttgacaatggataatgatggcgacattgctcagcatatttatcaaatggcttctgaaaatgaaggtgcaatccagaaaggggacgatcaaaggcggactgaacgtgggaaggaactcaacttactgngaatggataacctggcagaagttcaaatacatgatcttttcgaatgtcataaatgcaatatgacttttgatgagaaggatgcatatttacaacatcttttatcatttcaccaaaggactaccaggaggtacaggcttggttcttctgttggagatggtgtgatacttagagatgggaaatttgaatgcc

SEQ ID NO: 7725 - DNA, 476 bp, Gossypium hirsutum
  Clone ID: uC-gsronu33B130a05b1
ttcttggctttatactctaaaaaggtttttctgtatcactttaatggctgcatcctccccccattcacttctcatatcgtcttccttgttctatttggattctttttgggtttttcgttttttcgatcgttgtttaatttcaaacctatctcattctcagattcttagtcaaccttgtagtttctaacatataaaaaccgacggccgagaagtagtcaccaacatgggaaaacgtaaaactcagcgcaataatgccgcgatgttagatagtgacgatgataatagtagtgtaagttcatcgtcgaccatgcgttccgctggaatgtcggtttccggaactgaagaagtagagcttaataaggatagtttacttgatgaagctgtggataatttatacgaaaagaggggttcaacgcgagagaaggctttggcctcgattatcgaggctttcacagcaacttgcagcatgagttcgt

SEQ ID NO: 7726 - DNA, 577 bp, Gossypium hirsutum
  Clone ID: uC-gsronu33B130a06b1
tttttattcactgtcatatgatcggaagtcaatgcctcgatgcaaatgctttccggtgactgccccaacgtggggtcaacctcacacatgcttcaccgacttccctgcacctgacgtatcccttacccgaaagctgggggcagaatttgtgggaacctttatcctaatatttgcggcaacagcgggacctatagtgaaccaaaagtattcgggagccgaaacattgctcggaaacgccacatgcgcaggcctggctgtgatgataataattttatccaccggacacatatctggggctcatcttaacccttccctcaccattgcatttgctgcctgccgtcacttcccctggactcaggttccagcctacatagcagctcaagtttcggcctctatttgcgcttctttcgctctaaagggggtcttccatcccttcatgtctggtggcgttactgtccccttcgtcagccatggacaagctttcgcactcgagttcctcattacttttaatcttctcttcgtcgtcaccgccgttgccaccgacacccgtgccgtgggagagctggctggaatagct

SEQ ID NO: 7727 - DNA, 92 bp, Gossypium hirsutum
  Clone ID: uC-gsronu33B130a07b1
ttgttttcaaattgaataaatgccatgtgcaaggccaatgcatattgatatgttcatgtgcaaggccaatgcatattgatatgttttacttc

SEQ ID NO: 7728 - DNA, 222 bp, Gossypium hirsutum
  Clone ID: uC-gsronu33B130a08b1
tttcgacaaacttcattaggggatggatacaaatagtcatattacttttattttgatatctacttgcattgagatgtttcagtagatgcaattagacatttggaatgcttcagctcgataccgaaattatgagtagaaaaatgcttgctaaagaacattatatagggctgtaatagccgagtttattgccacgctcttatttttaatacatcaactgagttg

SEQ ID NO: 7729 - DNA, 401 bp, Gossypium hirsutum
  Clone ID: uC-gsronu33B130a09b1
tctcccacgcgtccgaccgacctcagtggcaaagtggtgatggtgacgggggcatcttctggtttaggtcgtgacttttgtcttgacttgagtaaagccggctgtcgtatcgtggctgccgcgcgccgcgtcgatcgccttaaatccctctgtgatgaaatcaatcacctcacctttcctttttccggaccccagcctagtggccctcgagctttcgctgtcgagctcgacgtatgtgctgacggatccaccatacagagctctgtgaaagcggcctgggatgcctttgggaggatcgatgctttaataaataacgctggcgttagaggtaatgtgaaggatcctttggaattgactgaggaggaatggaatcaaaacatcataaccaatctaacagggtc

SEQ ID NO: 7730 - DNA, 438 bp, Gossypium hirsutum
  unsure (1)..(438): unsure at all n locations
  Clone ID: uC-gsronu33B130a10b1
ctctgcttattactgtattactggaatccatccgcaatcttctctcgagtgacagtaattttaatcatggaacataattgatcatcaataatagactggcaaggataacgtcatattctgtaaacctttgctgtagaaaattaaacttaaattggcatgtttatttcgttaaggattgctagtgttgcatttcatatcctgtatttgggtcttccccatggcacatggcatccgttgggtgtaacatggagaatattttcctcctcttttgtgtgaaattttgcttctcaaaaaagaaaagaagatgatgagtgggaggtgttagtccaaggtaaagccaaattagcatgtcacatgacattgntgaaagggaaactcaactggccctacttgaactatgcatatttacaacatcttttatcatttcaccaaatgact

SEQ ID NO: 7731 - DNA, 244 bp, Gossypium hirsutum
  Clone ID: uC-gsronu33B130a12b1
tttaaaaaaagaaatatgaacaaaaaaaaatgccaaaatagcaaaaagaaatacaaaaactgacccaacgtggagtcaacctcacacatgcttcaaccgacttacctgcacctgacgggtcccctaccctaaagctcccggcattacttgcgggaacctgcatcctaatatttgtggtatcagcgggccctatacagaaccaaaagccttctgtaaccgcaacattgctcggaaaccccacatg

SEQ ID NO: 7732 - DNA, 540 bp, Gossypium hirsutum
  Clone ID: uC-gsronu33B130b01b1
ttgggattaaaaaattttccccacctccttaactctttcaaacctaattcctgccgcctcttctttctttttctcggatcttctttctccctttcagcaaagatctttgattttttccgtctccttttcgttcgctctctgaggctggaaacaggctcgtcgaaccccctttgtcagtcgctgagctcatccctttcctagacgttgatgaagaacctgcaattagaacaaataccaccatattatgaaattttaatgaaagtcgtgaatttcacagcttctttgaatcttcagtactttttcacctttggtttgggaagcaatatttgggaagaaaacctctcagaaagcattctaagtttttttttttgttaggcttctaaaatttgaggtcaatggaatcaaggttcttcaactggaaactgcaactggtgcagcaattagggtataaaattgtaccaattatgttatgatgtataaaaagtaaaaaagatatgtctaacatgtgttttcttacgtgattaatctttgatcatgcta

SEQ ID NO: 7733 - DNA, 484 bp, Gossypium hirsutum
  Clone ID: uC-gsronu33B130b02b1
tttttctctctctccttctctgcctaaacccaaattattaaaacagtcgtcgtctgcaaccgacaccaatgtccaccgcagttccacccgttatccctgtctcctccgtgcaatccgtcgaatcccaaccgcccgctgccagccccgcctttctctctttcgtttcccgtctcaatgaatcccttcgcaacggcctctcccagcgccgtccttgggctgagctcgttgaccgttccgccttctccaagcccgagtcattctctgatgctctcgttcgcgtccgcaagaactactcgtatttccgagtcaattacctgtctgtgatcggtctcatccttgccttttcccttctttccatccgttttcccttctccttctcctcggactcctctgctcctggatcttcctctacctcttccgcccgctgatcagcctctcatcctatttggccgtacattctccgatcgcgagaccctcggctttc

SEQ ID NO: 7734 - DNA, 300 bp, Gossypium hirsutum
  Clone ID: uC-gsronu33B130b03b1
aaggaggtagaaggaggagtactttgccttccaatcttctctacctcctccttggcttgtaaattccaaatttgtaccaaccctttttctcctttgttaggcacaacttacattttagacaattgggaaaaaaaggaaaaggaaaaaaaattaatttggaatttagctccaactgatcatggattttgggaattctggtttcttttccttaaatcagtgttgttcatttggttcatctgattatgcttgctttaattcgtcttcaaggccgtatatgtttgtgttttacatttggaagta

SEQ ID NO: 7735 - DNA, 419 bp, Gossypium hirsutum
  unsure (1)..(419): unsure at all n locations
  Clone ID: uC-gsronu33B130b04b1
tgtgaagtgaaaaagctgtttgagcgatctcatgatggacagattactgagataatatacaaaggtacacatgatcatcctaaacctcagcctagccgccgatattcttctggtaatatcatgtctggccaagaagaaagatctgacaaggtctcatctttgaatgatagagatgacaagtcatattgcggttatggccagatggctcatagtattgagccaaatagtactgcagatatatctcctgtcacagctaatggatgataatttagatgaggttgaagatgatgatccattctcgaaacggaggaagatggatgtgngaattgatatcactcctgtgggtgaagccaatccgngaaccacgtgttggtgttcagactgtgagtgaaagttgatatactggatggatgggtatc

SEQ ID NO: 7736 - DNA, 403 bp, Gossypium hirsutum
  unsure (1)..(403): unsure at all n locations
  Clone ID: uC-gsronu33B130b05b1
tttttcttcttccttaaacaagcaaaacaaaaaaaaaaaattatgggtggcgaaggaaaggtctatactttggctgaggtttctcaacacaacaatgccaaagactgttggcttatcattgagggcaaggtatatgatgtgactaaattcttggaggatcatcctggtggtgatgaggtcctgttgtctgcaacagggaaagatgcaagtgatgattttgaggatgttggtcatagtagcagtgctcgggcaatgatggatgagttttacgntgggtgacgtcgatacatcaactatcccaactaagaccaagtacacccctcccaagcagcctcactatgagcaggacaagacctcggactttgttataaagcttctccaaatcctcgttccctgctgatct

SEQ ID NO: 7737 - DNA, 608 bp, Gossypium hirsutum
  unsure (1)..(608): unsure at all n locations
  Clone ID: uC-gsronu33B130b06b1
ttttataaagcctgacaagctggtccacggngggttgatagtaaaagatattntncagctagtatacaaagtatgacttataatgagccgtgatagaatggaagttattgactgtcaatgggcaccgtgtgtccaaggacacctagaatgtagcgacacggttgatttgatacttccacggctgacgcaagcgtaacgatatgtgatccaacacttaacatcggtcagtgctgttattacgggcagaaggaaaacattaaaattcactgttcttactgccaccaggtggaagcaggaaatactatctgattaggacatatgttacgttggttggatgacaaagtatgcatgttgtgtaacatgtgctttgagttcagtggatgattatgatatgtgggaagttttgtttggctatgttgcttatgatagacctctatatgtggtggaatattctggggtttggtgcttattttggcaattagtatgggtggagaaacatgtgatataagaattagagatggtattagccgagctgtatctctacaatcacaagcttgatactggttggattgactagtgaaatgataaaagattggccttgatgatat

SEQ ID NO: 7738 - DNA, 103 bp, Gossypium hirsutum
  Clone ID: uC-gsronu33B130b07b1
ttgaggagttccggcgacgcgattcggtaagttcctgttcccctccttttttatttatttcaaacctcttttttataaagaaaaagatttgcaaaataactaa

SEQ ID NO: 7739 - DNA, 374 bp, Gossypium hirsutum
  Clone ID: uC-gsronu33B130b08b1
tcttcaagattaggatatatgatgtggcaatgaaaaagaagggtgtggacgagctccctgtctgggtacactcagactcttgccaagacggaaatatgctttagtgaagctctggacgctgctcacattgcttgcaacaagtatataggtaagtatgctggaaaggatgcctttcactcgcgagatcgagttcacccattccatgtcttgcgtactaacaaaatgcttgcaagtgctggagctgataggctccaaactgatatgcgaggtgctgccggcaagcctgagggaacatgtgctagagtagccattggacacgtactcttttagcttccacgcaaggacagcaacactcatcatgctcaagaggccct

SEQ ID NO: 7740 - DNA, 382 bp, Gossypium hirsutum
  Clone ID: uC-gsronu33B130b09b1
ttttccacgcgtgcgatccccttctcataaattctctctcttgatggaagagacgcgatgtgcagtttgactgatacaagttccttcccaacgttcaattaaaaccctaccctctaccttttgctcctatcggagggggggggaaaggaaaaaagattaatttggaatttagctccaactgatcatggattttgggaattctggtttcttttccttaaatcagtgatgatcatttggttcatctgattatgcttgctttaattcgtcttcaaggccgcatatgttgtgttttacaattggaagtagttatgtagattctaagcattcgtacttacactcagtactgagctccagatgtggcagtgcaattttgcttagcata

SEQ ID NO: 7741 - DNA, 446 bp, Gossypium hirsutum
  Clone ID: uC-gsronu33B130b10b1
tctgctttccaagacaaagcttcatattatcttttttagttccgacaaaagaaaacgaaaaaaaagaagaagaaatacaatcgttttctttttgaagtcgggttttagtttttggggtgaaaaaaatgttgggagtatttagcagtgcgatagtgtctccgccggacgagctggtggcggccggttgccgaactccatcacctaagataacggcggacgctctggtgaaacggttccttgagacgaactcctccggcgtgtccatgcacatcggagaccatgtccaattcgcttattctcaccataaagagtctcctttacagcccagatcatttgctgtgaaagacgaaatcttctgcttgtttgagggagcccttgataacttggggagtttaaagcagcaatatggtctggcaaagtcagcaaatgaagtgatattggtcatt

SEQ ID NO: 7742 - DNA, 325 bp, Gossypium hirsutum
  Clone ID: uC-gsronu33B130b11b1
ttaacgattgcatggatatgcatgctgatgatagtccacaccaagattctcctttctgaaattcctatggtcattcatttgctgctttcttctctttttcttgtaaaatatcttgaaaggctaggaatctcaaaagtatctcgaaatgtattgcaagttcactcgttcatgacaagctggcatagagaaaaaaagaaaaacatcaaaatccacagattctaagcctgcacggtggaagcaggaaatactaatctgattaggacatggccgacccttttagggtgaccaagtttacatgccctggcacacgagcttttcagttttt

SEQ ID NO: 7743 - DNA, 454 bp, Gossypium hirsutum
  unsure (1)..(454): unsure at all n locations
  Clone ID: uC-gsronu33B130b12b1
tcggatcatcaatggctgaatccttgggtccacgattgtatagctgctctaattgtctaaatcgcgtttctctccacgatgatataatttccacgtgttttcagggaagaaatggccgtgcatttttgttctcccacgcaatgaacattacattaggaccaaaagaagacaggcatctcttatccggtctccataccgtggctgatatttactgtgctgactgccaccaggttttaggctggaaatacgagcgagcttacgaggtgtcacagaagtacaaggaagggaaatttatactcgagaaggcgaagattgttaaggaggattggtaacaagcaagcctcatagtttttttaaggttttcttattccatttattncccgtgtttgatgtaattgttatcggtgcccgatgttcgtcttgttcagaaaaagacgtcgccctcatttcggaa

SEQ ID NO: 7744 - DNA, 469 bp, Gossypium hirsutum
  Clone ID: uC-gsronu33B130c01b1
tcttccacgcgtccgggaaacttcgggtccggactgacgcagctaatattcttctcaacctcaagattttccacagcggcaggtcttacttggatgggagccatgatcgtggcttgcactcttcccgtgagcctggttcatttcccccagtggggtagcatgttccttccgccttcaaaagatgaaaacaaatccaccgaagaacattactactcctcagagtggaacgaggacgaaaagaaacagggcaagcactccgcaagtctcaagtttgccgagaacagcaagtctgagcgtggaaagcgcgtggccttagcaccaactccgcccaatgcaacaccgtcccaggtttaacctatcaggcgtggaacagtagatattacaaattaatctttcttgttgaataagggaagggtttattgacccgtgttgtattcttgatctgaacctttgccttttcatctctttt

SEQ ID NO: 7745 - DNA, 541 bp, Gossypium hirsutum
  Clone ID: uC-gsronu33B130c02b1
aggtttgcaaaacccctagccagccacttccccgccgccgttccgaaccatgggccgagtccgcaccaagacggtaaagaaatcctctcgccaagtgattgagaggtactactctcgcatgacccttgatttccacaccaacaagaagatcatcgaagaagtggctatcatcccttccaagcgtctccgcaacaagatcgccggcttttccacccatctcatgaagcggatccagaagggtcccgttcgtggcatctctttgaagctccaagaagaagagcgtgagcgtcgcatggatttcgttcccgacgaatccgccatcaaggttgatcaaatcgaagtcgataaggaaactctcgatatgctttcggttctcgggatggctgatattcccggccttgttaaggtcgatccggttgctgttgcggttccccaatcgggttcggtcgcggtggtggacccggaaggagattttaagtggtgggtatccatggatttgatgggttcttaaatcttaagtttggtatgcttaattttggag

SEQ ID NO: 7746 - DNA, 294 bp, Gossypium hirsutum
  unsure (1)..(294): unsure at all n locations
  Clone ID: uC-gsronu33B130c03b1
tctcacgcgtccgcccacgcgtccgtaataaagagcttattgctactggtggtggagttcctcttgttctgaaactaatgttctctccccatgtgtgtacaattcttatagtcagatgctccgagattgttgagaaactttcttctgaaagcaatggggttaaattttttgttgatgaaaaaggggttcaacttgaattggagccaatcatccgtgaattgttggctttgcaacanaattccaaatcatcgaacaaatttccggaggcctgctttacgtgcactgttaggaaat

SEQ ID NO: 7747 - DNA, 562 bp, Gossypium hirsutum
  Clone ID: uC-gsronu33B130c04b1
tgaggagcagctgcaattgctatgctaatagggcctgatgctcctattgcatttgaaagcaaatttagggggagtcacatgtcccatgcctacgacttttacaagcccaaccttgctagtgaatatccggttgttgatggaaaactctctcaaacgtgctatctcatggctcttgatacttgctataaatacttctgtcacaagtacgagaaactagagagcaagcaattttccctttccgatgctgactactttgtatttcattctccatataataagcttgtgcaaaaaagctttgctcgtttggtgttcaatgactttgtgaggaatgccagttctgttgatgacattgctaaagaaaaattggctccattttcaactttgaccggtgatgaaagctaccaaagcagggatcttgagaaggcatcccaacaagtttcaaagcccctttatgatgccaaggtgcaaccaaccaccttgataccaaagcaagttggcaacatgtacacagcatctctgtacgctgcgtttgcatctcttcttcacaacaaaacagtgaact

SEQ ID NO: 7748 - DNA, 174 bp, Gossypium hirsutum
  Clone ID: uC-gsronu33B130c05b1
tgtaattttgattttattgcttttaaggtacttctttattgtacttcaactttgaactgtgaaccttatgttccataaagcaactttccgatgtcctaaaagctttcatacttgaaaaaaagaaaaaaaaaaagaaaaatatagaaggaataagaagaaaaaaaaaaaaaaaga

SEQ ID NO: 7749 - DNA, 539 bp, Gossypium hirsutum
  unsure (1)..(539): unsure at all n locations
  Clone ID: uC-gsronu33B130c06b1
tttgcgtattttaatggtgggtcttgatgcagctggtaaaaccaccattttgtacaagctcaagctcggcgaaatcgtcaccacaatccccaccattggattcaatgttgagactgtggaatacaagaacatcagcttcactgtttgggatgttggtggtcaggacaagattcgtcctttatggaggcactatttccagaatactcagggtctcattttcgtggtggatagcaacgacagggaccgtgttgttgaggcaagagatgagttgcacaggatgttgaatgaggatgaactgagagatgctgttttgcttgtatttgccaacaagcaagatctttccaatgcaatgaatgctgccgaaataactgataagcttggtcttcattctctccgtcagcgccactggtatatccagagtacgtgtgcaacttctggggaaggcctctatgagggcctngattggcttttcagcaacattgctagttaggcatgaganaggatcagtgtattggttgttagttagacttgttgaaact

SEQ ID NO: 7750 - DNA, 532 bp, Gossypium hirsutum
  Clone ID: uC-gsronu33B130c07b1
tctgattgttctaaggctccgagatgatgttttgaaagaaaaagatggtggtcataacccttctgtaggtgctgatgctctctactcgggtggtgcaagtctttcagtatcatctctcttgtcttctgttcctccagttgctactttggcttttgatcaaagggctgaaagtggaagtgaccttggtgttctttcttcaagcagcctctatggatatggaaccctgccaatgggggaaaacggctatgggtccatgccctcatattcatcgaagctctatggaggcttgcctgcatcttcaactcttgaaatattgatcccttcaaatgcagtcggtaaagtgatgggcaaaggagggctcaatttagccaacataagaaagttatccggggcaatgattgaaatttctgaatccaaatcctctcgaggggaacgtgtggctcttataactggcactccacagcagaagcgtgaagctgaaaacttgattcaagcatttataatggctacttgaatcttaaagatcttggta

SEQ ID NO: 7751 - DNA, 468 bp, Gossypium hirsutum
  Clone ID: uC-gsronu33B130c08b1
tttggattatcatatcggtaatgatgaggaagttgatgatgatgatgatgatgatgatgacgatgatgctgaaagctaatgctgtctgccgatctgagagcaagacgaatggtcagatgctccgagattagggagaaactttcttctgaaagcaataggggtgtaaatttttacgttgatgaaatagggggtcaactcgtattggagccaatcatccgtgaattgccggctttgcaacaaaactccaaatcatcgaacaatctccggaggcctgctttacgtgcactgttaggaatgtgcaggtcgtgagctcagctggttaaaactgctgctgtaactgccaatggtgtatcgatagaccttcctcttctcgatgatccagactcggaaataagagaagttgccagaaaccttctcttcttattttctcaacacgaatcacaaggagttgtagaataccttcttatg

SEQ ID NO: 7752 - DNA, 407 bp, Gossypium hirsutum
  Clone ID: uC-gsronu33B130c09b1
tttgtttgtctattgaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcacgtgtggatcaaactgctctcgtgatccatgcaactgttgaaaagcttgatgaaagccatagattatgaaaaaaagaaagcagcaaaaataacaggcctctgtaatgatatattgtcaaggatggatgcctgcaaggtctatacttatgcctctgtctgagtcttgtgtaatag

SEQ ID NO: 7753 - DNA, 380 bp, Gossypium hirsutum
  Clone ID: uC-gsronu33B130c10b1
tcggccagcccctttcggaattattgatgtttctacgtccgttaaaatgttttggtttttcatgttcttttgtttcttgcaaactttgtcatttgttgcttcttgtagtttaagaataattggtaaaattttcggtttctattgttggtcttggtagttggaaaaaaaaatgtattgttttccccaatctcgaggtcattccattcttgatggaaattaacaggttaagtcggtttctttaatctttaaatataaagataccagatttctttggattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataagg

SEQ ID NO: 7754 - DNA, 397 bp, Gossypium hirsutum
  Clone ID: uC-gsronu33B130c11b1
tcggtttgatatgaatcctcaattgagagaaataatgcacaaccctgaagtactacgtcagatgttttcccccgagacaatgcagcaaatgctagctttacagcagtcgcttctgtctctcaatcggcagcaatcaaccctggactcagcacagactggcggtactacagcggcaccgggaactgccaatctagacttgttgatgaatatgttaggcggtctgggcgctggtggccttggtgtccccaaccaacctgatgttcccccggaagaactttacgctacacagttatcacaactgcaagaaatgggtttgtacgatacacaagagaatatcagagcattacgagctactgccggaaacgtacatgctgcggtcgagagacttctgggaaat

SEQ ID NO: 7755 - DNA, 556 bp, Gossypium hirsutum
  Clone ID: uC-gsronu33B130c12b1
ctctgtatatccatggctgacatggaaacaactggagtaccccccttttagcacactctcaagctgagaggaagtcgtcaacacaatacgcagcatgagtttcaacgtagggactgggcgagccatggacatcagcctcactgtacgggttgtaggcgggccggacaaggtacggcctgtatgatcgcactgttttcagaatgctgaagttcatattgtcgtggtggatcgcaacgacagggaccgtgctgttgaggcaagagatgagttgcacaggatgttgaatgaggatgaactgagagatgctgttttgcttgtatttgccaacaagcaagatcttcccaatgcaatgaatgctgccgaaataactgataagcttggtcttcattctctccgtcagcgccactggtatattcagagtacgtgtgcaacttctggggaaggcctctatgagggccttgattggctttccagcaacattgctagtaaggcatgagaaaggatcagtgtattggttgttagttagacttggtgaaactctggcaacttttgaaga

SEQ ID NO: 7756 - DNA, 530 bp, Gossypium hirsutum
  unsure (1)..(530): unsure at all n locations
  Clone ID: uC-gsronu33B130d01b1
ttttaaatcctctttctcatttcctttcaagttcttctctcttacaaatccaatctcatttcttattctctctgtcgattgaaaaataaatggcctcttcactctcaacaacaccctccgctgccttcgcttccgttgctaaaacaaccactgccttgcctaattccactaaccttcagctctccaccgtctcctttcgcttttcttcgaggctaaaccttcgattcttctccaagagtttgcaacatggtcagaactctaaagcagtggtgaaagcccaacttaatgaggttgccatagatggatcatcaaatgcttctgctgcacctacaatcaaatcaggggcaccaacagcagaagcaaaggatgctaagacatcaagcgatgtatctcctccagctatggccacagaagagtcaattgcagaattccttatcaagtttcaagtctattaagctagttgattcacgagatattgtggagttgcagcttaaacaanctgactgtgaactgggtaatttcgaaaaagg

SEQ ID NO: 7757 - DNA, 458 bp, Gossypium hirsutum
  unsure (1)..(458): unsure at all n locations
  Clone ID: uC-gsronu33B130d02b1
ttttccacgcgtncgcttctttgctttgctttccttttcagctgtgtcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttggttcttgtgctgatatccttgttctgtctgctagagaaggcatcggttcgttgggaggcccttacattcctctaaaactggaaagagagaccgtagaaggag

SEQ ID NO: 7758 - DNA, 115 bp, Gossypium hirsutum
  Clone ID: uC-gsronu33B130d03b1
tccacgcgtccgaaaaaaaaaaaaaaatttttaaaaattaaaaaaaataatgtgtatttcatataaataattatggtttttttattttatgggtactgctcaaaaaggaattaaa

SEQ ID NO: 7759 - DNA, 462 bp, Gossypium hirsutum
  Clone ID: uC-gsronu33B130d04b1
ttctccacgcgtccggtccaccctccacttggttctccgtctccgtggtgggatgcaaattttcgtgaagaccctgactggaaagaccatcaccctggaagttgagagctcagacacgattgataatgttaaggccaagatccaggataaggaaggaatcccaccagaccagcagaggctgatttttgctgggaagcaacttgaagatgggaggacccttgcagattacaacatccagaaggaatccactttgcacctggtccttcgcctccgcggtggttttaaagtgttgtgccgaacacctgtccagttattgttgatgtgttaagtttgttatgtttgtggggtcggatgctgatgtgagctggccactaggcaggggaagcttacaagtaaaaattattgcgttttataaacgcttttagttgcttttttaggttgaataagttcttttttgattca

SEQ ID NO: 7760 - DNA, 398 bp, Gossypium hirsutum
  Clone ID: uC-gsronu33B130d05b1
ttttagagaacaggggctgaatgaaatactactgcctgggtgatgtagatgcatggtcaactaagggagacgagactgagacacagcattccagtcggactctgtgcaaacaaacagggctgaaccggcaccatggccctgaccaattctaactgtaccagtacgatcgtgtgtgagttccgatcactcctctaggcatttgagaagacatgtacaggcttacctaaacgcatacatgccgattgtggcgcggtgcatctttgctggaccggactactctggggggatggcaccaaccacttgatgacactgagaatgaacagtcctttcgaccaccgtccgccggttgggatgaggcgaaccatgaggcattgatatctgaagtgcgctgcgagtta

SEQ ID NO: 7761 - DNA, 497 bp, Gossypium hirsutum
  Clone ID: uC-gsronu33B130d06b1
gttcccactcgtccgggcaaaacagggagactggaatgtgtgccggcgctcacacaaattacagtacgaagcccatgataagtgatggaggctgacaggttatcaagaaagcaattgcacaggtcgtgctaaggcacaaagaacacattgctgcctatggagaaggcaacgagcgccgtctcaccggccggcatgagactgccgacatcaacactttcttatggggtgttgcaaatcgtggggcatcaattcgtgttgggcgagacacagagaaagccggaaaagggtatttcgaagacaggaggcccgcatcgaacatggatccatacgttgtcacatccatgattgcagaaaccaccatcctgtggaaaccatgaggggaagcccatgtttggaatgcctgttccatggtagaaagaaaggaaagagccaaagtgtttgttttgtccccttcagtgggatacactcatttcattgcacttagtaattaggtcatg

SEQ ID NO: 7762 - DNA, 308 bp, Gossypium hirsutum
  Clone ID: uC-gsronu33B130d07b1
tcgttttttttaaaccaacaatagaagtaatagtttcattacatcaaatgtactacaagatgtgaccctgattgcataaccggaactcaattgtttgcaagaacacgaaaacataagtagaaaccctagctatttagtcgatttctctatgcttggaacaatatctaaatgggaatacaaacacatataccatatgcatatgagaggaaacttttatgttagataagccctgataaaacagtcttaaaggagggtattcgtgaactgaacatttagggtcttgctataagaacactgcaagcgtgggg

SEQ ID NO: 7763 - DNA, 529 bp, Gossypium hirsutum
  Clone ID: uC-gsronu33B130d08b1
tgtctattgaattctttccttcactttctcgaaaaaaaaaaaaatgtcttcaggttgcaattgcggatctggctgcaattgcggtgagaactgctcaatgaaccttaaccttggatactcggagaagacaaccagcactcagaccatcatctccggagttgcgccagtgaagatgacctttgagggaccagagatgggcactactgaatcaggacatggatgcagctgtggatcaagctgcaaatgtaatccatgcacctgttgaaaagcttgatgaaagccatagattatgaaaaaagaaagcagcaaaataacaggcctctgtaatgatttattttcaaggatggatgcctgcaaggtctataattatgtctctctctgtcttgggtaatagaagctttgtttgtggtgaaaataatgtataagccatttggttgggagcaaattttccttttgtccaaggatttttgctgctcattcatggtgacttgggttatggttttatctggtgttgttaaaatcttataaa

SEQ ID NO: 7764 - DNA, 274 bp, Gossypium hirsutum
  Clone ID: uC-gsronu33B130d09b1
tctctggatggtcattttactttaagaaagttgaaaaatcagccatggagattgaacaagttgttcatatttagagtgaaagcaatcattctgcatgaactagtagttattatataatattagcttcaagtaaataatgctgagagaactgattgttaagattgccttgtttgaagcagcagcatgtatatatatgcttgcttacaaggtttgtctctcagagtccttctctttgtactcttttcagcttaatgaataaactctttacttattt

SEQ ID NO: 7765 - DNA, 429 bp, Gossypium hirsutum
  Clone ID: uC-gsronu33B130d11b1
tcgctggatgcttgtttttgacgaccttttctccaatggcacgcttactaaaactattgactttataggaggagagttgaattcaattaccattttcaaacttcaatttcaaatgttcttctttctcttcatcgctctttttctttataataattgaacccttcattggatttgaactcttgatgacatacacagtaatattaggatctttcttctttgttctatatatttatggatttttattgtttttaaaagaagaagcgaacacaaaaaaaagccagaaaagggtatttcgaagacaggaggccagcatcgaacatggatccatacgttgtcacatccatgattgcaagaaccaccatcctgtggaaaccatgaagggaagcccgtgtgggggttgctgttaccatggtgaaagaaaggaacgag

SEQ ID NO: 7766 - DNA, 466 bp, Gossypium hirsutum
  Clone ID: uC-gsronu33B130d12b1
ttgagctggccaatgctcacaagttcattagttcactacaacagggttacgatacagtggtaggggagcgaggagttcagatgtcaggaggacagaagcaacgcatagccatcgcacgtgccatcgttaaaagcccgcagatactgctattagacgaggcgacgagtgcattggatgctgaatcggagagggtggttcaggctgcactagatagagtgagtggtgaaccgaacaacggtggtggtggctcataggctatccacaatcaagaacgcggacgttatagccgtggttaaaaaggggtctgctgtagagaaaggaaagcatgataccttgatcaacatcaaagatggcttctatgcttccttagttgcacttcatatgagtgcttccactgcataaaacttctttaattatataaatatatataatgtgttttaagtttttgatattaccataaatttca

SEQ ID NO: 7767 - DNA, 397 bp, Gossypium hirsutum
  Clone ID: uC-gsronu33B130e02b1
tctgcactatcaccttcggcctccagcccaccgtctccatcaaatgaggcccctactcccagcctcggcgcttcttcaccaggccctgctggaaccgatacgagtggagtagagaaaacatggtccataagaaagatggtgtggagcttggtgattggatggggtatcctcagtttaatgctttaaaccaagaagtcttttcttcaccatttgtgtcttagctatggtttttgttttcagtgttttaatttccattatatattgttactggcttaagtctctttgatggggctttttactatgcatatttgagcttacatttatttatatatatttgtattctttgggagattttttttgaggggagcttttatattttccatttgaattggaggga

SEQ ID NO: 7768 - DNA, 454 bp, Gossypium hirsutum
  Clone ID: uC-gsronu33B130e03b1
ttgttcccagctaatattagaatcatgggtgttgtcacttatgactatgagaatacctccccagtcgcccctgccaggcttttcaaggcctttactgttgaagctccgaaagtttggcccacggctgcaccaaatgcagtcaagagcattgaggttgaagctaatcctagctctggaagtatagtaaaaatcaactttgttgaaggccttccattccaatatatgaagcaccagatcggaggacatgatgaaagtaatttttcatacagttacgatttaatcgaaggtgggcctttgggggataagcttgaaaaaattagctatgagaacaagtttgaggcatttgctttcttccccattgtggacattaattaaatttcatattagctcttcatcatttaaactttaaagattatcaaatttaacttaaacaagttaaggatgtttctttgag

SEQ ID NO: 7769 - DNA, 479 bp, Gossypium hirsutum
  unsure (1)..(479): unsure at all n locations
  Clone ID: uC-gsronu33B130e04b1
ttttggggttgctttttttgtagtttaaacttctctcagtctacgacatgtcaaaggtcacgcaaatggaaagtctgacccgaaacgatgggttctacttctcggacagtttattgggctttgcactgcaagctatggttgtggagtccgccattattgctacaaaatctgtcgcttggttactcatgatgatgggaagtctgcctgatggaattgatagccatatcaaagagcctgaagcatatacagggtttccgcttgctcagcttcatgcagtgagaaaacctagtcctgagaacaaggatgcctgtgacactgaggatgatgaggatagngatgagaatagatgaagcaggagatgatcaagatgaagatgcagatgaggaggatgcatctggtgaagatgaaggagatccagaagatgaaccccgggccaaaggggatggtgccagtggagacgaggatgatgatgacgagga

SEQ ID NO: 7770 - DNA, 523 bp, Gossypium hirsutum
  Clone ID: uC-gsronu33B130e05b1
ttttccacgcgtccgtgggattaactgggcatgtgggcaaggccaggccaattgcagtgctatacaatcagggcagccgtgctatctcccgaataacatcaagaaccacgcatcttatgcttacaatgattattatcaaaaaatgcatactgttggtgggacatgtgattttgatggtacagccacaactactacaatcgacccaagttatggatcctgcatatttactggaagttctaattcgagcacgggtagagagtctttgcctcctacagcacttggtccaataagtcccggagggagtacaaagcttccgctgtacaagattcaatttctaatctcagcaacttgtcttcttgtagtcttgctatgacactcgatttacgcctcggtggtggactcaaactgcgatgaatcattccatttgataggcaagattaagtgtgatagagaatgtaatgaaatccacttaagttcaataatgaccgatggttatttctttcaggcggtgttcgcacgttca

SEQ ID NO: 7771 - DNA, 531 bp, Gossypium hirsutum
  Clone ID: uC-gsronu33B130e06b1
ttctccacgcgtccgcccacgcgtccgcttcaactctcttcttcttcttcttcttcttcttcttcaaatctcatgttctagattctcattggcattgcaagagaactcatcagccacggttcgctcgggtcagatcaattccaactcagtcctggtggctttgttagactcacattacactgagcttgccgagttggtggagaaagctttgttgttgcagacccttgaggaaactgtcggcaaacacaatatcaccattttcgctcctaaaaatgaagctcttgagcgggatctcgaccctgagttcaagcggtttttgcttgaacctggtaatctcaagtccctccaaactctcttgctataccacattgtccctgctaggatcgatcgtcattcatggcccaaatcgacttcggcgttaacccatcattttactttatcaaatgaacgagttgaactcttcggcgacgattccttcggtggaaaattcattgggtcggccaaagtcatttcccccaacgctgttgaccg

SEQ ID NO: 7772 - DNA, 540 bp, Gossypium hirsutum
  Clone ID: uC-gsronu33B130e07b1
tcgcccacgcgtccgtataacttagggatttctatggatcaagtcaaatgaataaattgtctgattcagagtcaaataacaagtgaagcctaagtggatttttccttaggtattgtcttaatcaatcgaattttccaaaaagtattttcccaaattttctttctatgcattcttagtttagtaattagtttagataaacaaaactcttaatttttagtctagataataaaaagggagtaaatactagtacttgtggttcctttggttcaacaattcggtcttgctaaactatactactgttcgatagatacacttgccttaatcgtgataataaattagtctcaagaaccattcattcataaatctttaaaaacttgtcacgaatatcagataccaagcttttggtgtcgttgccggggaactaggatattaggagcactcaatttttattactttagccattttattttgcaattcaaatttttatttttatttttaatttttaattttcttttctaattcttcatttattctcttttg

SEQ ID NO: 7773 - DNA, 475 bp, Gossypium hirsutum
  Clone ID: uC-gsronu33B130e08b1
tgcccacgcgtccggacgattacacccactgtcctgcttctgaccggagtcggcttcttttccttgatattattcggagatccattcgcacccactcttgcaaagtttgggatgactactgttgttgcagctgcatatgtaggcgccttgcaaaacattttcagtaagagtgcaaagtacagtttatttgatccttgcaaagaaatggcctatatttcattggacgaggacaccaaggttaaagggaaggcgtgacattgatgacgtctgcaacccaagcgagaagtcgccctgttgctggataaccatgaaaaaatgatgctgtgacaacgaatcacgtggcatttgcaccctttcccatggagggcattcaaaagagatcatattagctctgcatcatttaaactgtaaagattatcaaacttaacttaaacaagttaaggatgtttctttgtgataaggaaattgaaagagc

SEQ ID NO: 7774 - DNA, 455 bp, Gossypium hirsutum
  Clone ID: uC-gsronu33B130e09b1
ctcgaaaaaataaaaaaaaaataataaatgttgaaacttataaatataaaaaaaaaaaacacagactaccatgacaagctttacaaggactttactgatgaaagctacgaaagttaggcccacgggtgcaccaaatgcagtcaagagcattgaggttgaagctaatactagctctggacgtttcgtaaaaatcaactttgttgaaggccttccattccaatatatgaagcaccagatcggaggacatgatgaaagtaatttttcatacagttacgatttaatcgaaggtgggccattgggggataagcttgaaaaaattagctatgagaacaagtttgaggcatttgctttctttcccattgtggacattaattaaatttcatattagctcttcatcatttaaactttaaagattatcaaatttaacttaaacaagttaaggatgtttctttgag

SEQ ID NO: 7775 - DNA, 500 bp, Gossypium hirsutum
  Clone ID: uC-gsronu33B130e10b1
tcgggctatccttgtacttgattcacatctatataaccgagcttaaacgcacccttcaagcgttttgggtcctcggtgttgttggatcattggcaacctacttagtccttgctcaaccagccggagagaacttggttcagtatgttatcgagaaccccatggcagtctggtttgttggccctctgtttgccgcattgattggactcgttttcaaagaaggcctttgctatggaaaattggaagctggtattcttacattcattatacctacacttcttcttgggcacctgaccggtttgatggacgatggaacgaaacttactttactcggttcatggatggctctctttgttatttttgccggaaggaagtttactcagccgattaaggatgatatcggtgacaatccgtgttcgtgttcaattctctacccaaggacaaaaaggaagctttgattgagaaacttgagaagcaaaaattacaatcagatagccattttt

SEQ ID NO: 7776 - DNA, 499 bp, Gossypium hirsutum
  Clone ID: uC-gsronu33B130e11b1
ttggtgaccagggccatatgtttgggtatgccactgatgagaccccagaactcatgccccttagccatgtccttgcaactaagcttggggctcgtcttactgaggttaggaagaatggcacctgcccctggctaaggcctgatggtaaaacccaggttactgttgagtactacaatgacaagggtgccatggttcccgttcgtgttcacactgtcctcatttccacccaacatgacgaaactgttacaaatgatgaaattgctgctgacctcaaagagcatgtcatcaagcctgtcatccctgaaaagtacctagatgagaaaacaatcttccaccttaacccatctggccgctttgcattggtggtcctcacggcgatgcaggtctcactggtcgtaagatcattattgacacctatggtggctggggagcccatggcgacggagctttctctggaaaggaccctacaaggtggacaggagtggtgcttacattgtta

SEQ ID NO: 7777 - DNA, 456 bp, Gossypium hirsutum
  Clone ID: uC-gsronu33B130e12b1
tttagacgatccttcttcagatgatgagcagcaagagtcaaaacgggggcgctccaaattggaacgttggacaagccataaggaaagggattacagtatcaatagcaagtcatctgcttcctcaaagttcaaggagattgagaagattgataatgtggatgccgcagaatcaaacaaaactctagatgaacctggtaagttggtcgagcctgctgagaaccatcaccctttgtctgacaataaaactgctggtgcgccagagaccaaggagaccgatacatggccattggacgaccggcatcttgacactgtcgagaagctgaagaagcgaagtgagagattcaaacttccaatgcccaaggaaaaagatgccatggcaataaagaaaatggagagcgaggcattgcctttagccaagaatgaaactcctgcggatccgaagttaagccagagaga

SEQ ID NO: 7778 - DNA, 189 bp, Gossypium hirsutum
  Clone ID: uC-gsronu33B130f01b1
ttttccaagtccaagatcacccaccttgtcttttgcaccactagcggtgtggacatgcctggggctgactaccagctcaccaagcttttaggcctccgcccctccgttaagcgcctcatgatgtaccaacaaggttgcttcgcaggggggacggtgctccgagtggctaaggacttagctgagaacaac

SEQ ID NO: 7779 - DNA, 466 bp, Gossypium hirsutum
  unsure (1)..(466): unsure at all n locations
  Clone ID: uC-gsronu33B130f02b1
ttttccacgcgtccggattgggatcagatttgatgcaaattggttattatgaaatgagtatcccacatggaaatgaagtccaaagagattccgagaaaaaaaatgtttcagtggaggaattggaagtcatcaattaatggatctttaactcagttacttctaagatattaaatactgatgatagaatattagctccattggttttttaaacatgtacctgctaactactgtaattgttttcttagaattttcgtctttaatctggtagcatcattaagctaaacgttgtttatagaacggcaggttcgccttagtactgtatatttggacggccaccggtcggtattactcgtncgttattgtgatttgattattgccgacaaattgcccgcgaccgtccctgttgttatcctatgccgacaaaggctcgcttttgatatttatgtttgagtaagatattgcttac

SEQ ID NO: 7780 - DNA, 505 bp, Gossypium hirsutum
  Clone ID: uC-gsronu33B130f03b1
ttctttaacaggaacattataagctttggtaacaagtcatgggcttccaccttggcttttgatttgaaatcacgaaatgcacagaagaacaaaccgtacatagtatgcctgtcagtgcaacaagccagcaaatccaagattgcagtttcacctttggagttggaaattgcaaaagagcccccactaaatacattcaagcccaaggagccttacacagctaccatcgtttctgttgagagacttgtcggtccaaaagctccaggcgagacttgtcatattgtcattgatcatggcggtaatgttccatactgggaagggcagagctatggtgttatccctcctggtgaaaatccaaagaaaccaggttctccccacaatgttcgtctgtattccatagcatcatccaagtatggagattctttttgatggcaagacaaccaagttgtgtgtccgtcgtgctgtctattatgacactgagactggaaaggaggatccgtcgaaaagt

SEQ ID NO: 7781 - DNA, 274 bp, Gossypium hirsutum
  Clone ID: uC-gsronu33B130f04b1
ttttgaggatggaaatgatgatgtgtatgtgaaagcagaaggagataggagaaacgaggcgtggtaatggacgatagaggaggttcatttgttgctgttaggaggatttctcaaggtctcgagcggggcaatacctgccattctacttctgctgaggttgtggcaggatcaacagcatggttgggtcgaggtctttcttgtgtatgtgctcaaagcagagagagtgatgctcgtccatcatttgatttaactccttcccaggaggaatgcttgc

SEQ ID NO: 7782 - DNA, 408 bp, Gossypium hirsutum
  Clone ID: uC-gsronu33B130f05b1
tttgtggtctgaaagtattattctcatccgacaccctgtttgaagttcatgatagctccatcaatgttgttgatattgtcaaacaacactgcagttgtgctatgtggaaaccaactgggcttccttgccatcatgcaattgctgtctttaactgcacaggtaggagtgtgtatgattattgttcaaaatactacacagctgaaagcttccggatagcctttgctgagagcataaatcctgcttcgaccattgctcacccttgtggaaatgaagaagattccgaggaagacgaggatcagataatgcctccaagcatctcacgacctgtagcagctcaacaaccaaagaaaataagacgaaacataagccagggaaatattgggagatctgtgtgttgtaccccgtgca

SEQ ID NO: 7783 - DNA, 367 bp, Gossypium hirsutum
  Clone ID: uC-gsronu33B130f06b1
ttttccacgcgtccgtggttgaactccgtcccacaccatacacacagagttgtaagctgaggcttgccagccatatttaacaagacttctgaaatacaatcagattcagttggttatatgtgtccaacctgcaaggccaaatttctaggcagctcactacaataagcatgcagttcatttcccatgtataaaaggataaaaacaacagtgattcagctatgaatgatctccacctttggtaagcctttcatgtacaaagttacagagatagaaccccctaatgttggtaacttaaattaaattgatatttgtatattgcagagcctacctctggtataattttttaatctaagattttttttcctaa

SEQ ID NO: 7784 - DNA, 340 bp, Gossypium hirsutum
  Clone ID: uC-gsronu33B130f09b1
tcgcttagagctggtttcctccttttctcgcaatcctgctttcagcttttctgggttggtggttcagttgaatattgagagattggatttggcatgcttataaaagatgtcattgaagagtattatgcgagagttaaaggaaatgaaggaggggattgggagcatatcaaagagaggaggggaaagccaggtttggcgtagtaggactagatcccatgctgctcctgatcgagcaccaactgaatctgaatccgtacaacaaagcccttgggctaacctaccgactgaattgctcttggatatcatccagagagttgaagagagcgagacagctcgtcct

SEQ ID NO: 7785 - DNA, 498 bp, Gossypium hirsutum
  Clone ID: uC-gsronu33B130f10b1
tctgcggtgcttctacgtcttctacctttaaatttcaaagaaacaagtgacattgaaatcgatttggcttaccttagcttcctttcccaaaatagattgacgatgggattaccaaatgcaagcggtgacttgtcaactgaagttgaggtggatgctttcagacgcctctttccccttcgtttctacgagaaacatcttttagagtctatacgtcctgatgctcgtccgcttggaagagcaagagaaaccaccattgcccttggggctgttgcatctgctaatggttcagcacttgcaaaaattggttcaactactatgttggctgctatcaaaatggaggtcatgaccccttcattggaaacaccggatgagggtttgtatagctaattgatttccacatgccttcaatttgttcttcaattgttagggctggcaaaccggcttgggcagcaccagtcgttgcaaagcaattggcagacactattttaagctctggca

SEQ ID NO: 7786 - DNA, 528 bp, Gossypium hirsutum
  unsure (1)..(528): unsure at all n locations
  Clone ID: uC-gsronu33B130f11b1
tcgcacacgcgcgcggccacgcttccgcttataccttacacgcttgcacggatgctcatgcttgacgcgcatagggagcgcgagttttaaggtacaccatggttcacaatatgatgcgtaatcatccggcaaggccattatcatatgcggttcgctacgatgagcatgcagttcattgcccatgtattaatagatataaacatcagtgatcaagctctcaatgatctccaccttcggtaagtcttacatgtacacagactccgagatcgaacccactaatgacagctacttaaacgaaaccagatttctgttattgtagtagcctacctccgctattagtttccactcctagtactgtgtctctcccgaccgttagctccccaccaccagcttctcctcccccggctacttcacctcccgcaacttccccaccggcttctgcaacttcggctaccccaccacctgcttttccccttctgctactcctnctncagctaccccaccaccggttcttttggtttttctcct

SEQ ID NO: 7787 - DNA, 325 bp, Gossypium hirsutum
  Clone ID: uC-gsronu33B130f12b1
tctggagggaagcaaaatgagcatgattttgattgcctacatcacacttgttgcgagcggagcgatgggtttgagggaggaccaaggagcggttgcaccctcaccaatggaaagtggcggagtggctctgggtgttccggccgcacttgctactgccttagcttctatgcttgcatttggctgcttcttttgattttaattcctttggtgaatactgttatccagtttccatttcctttcatttgccaactagattcgtttcttgtaaatatcattgatatttttaagctaattgaatgttaataaaatcttgatgtaatttaaa

SEQ ID NO: 7788 - DNA, 286 bp, Gossypium hirsutum
  Clone ID: uC-gsronu33B130g02b1
ttatttgatggaccagagcctgataattattggtatagagtatgtgaagggcaagctgctaagtacattcacagaccgtggcatacaatatggaaatcgaaacgattgatgaacatcgtaaccgagataagcggtcgtatggattgggatttcgacgctattcacgtcatccgtggtgaaaaagcacaaaacaaacaactttggccgaatctggattctgagacctcccctaacgcaatcttaaccaagcttcaacaaatggttcaaccgtggaggaacctttaca

SEQ ID NO: 7789 - DNA, 208 bp, Gossypium hirsutum
  Clone ID: uC-gsronu33B130g03b1
tttttaattgttgtaatttaaacggccttaataatgaaattgtggtatcttaaaatgataaattgagaggagttatagttgtaatttatagtgcttgggtgtcgtggttaaaatgtataactctgggattgatattgatgatgtgctggtaatgaataaatcgagtttaatttgccaaatgacatgttattttagaaatacaaattga

SEQ ID NO: 7790 - DNA, 159 bp, Gossypium hirsutum
  Clone ID: uC-gsronu33B130g04b1
ttttcctccaaagccacctaagcctcccgtggtaaacccaccatatcaccctaaaccaccgaagccaccggtggtgaagccaccgtatcaccctaaaccacctaagcctccgatggtgaaacccccatatcaccctaaaccaccaaaacatccacccga

SEQ ID NO: 7791 - DNA, 295 bp, Gossypium hirsutum
  Clone ID: uC-gsronu33B130g05b1
tcccacgcgtccgaaaaaaaaaaaaaaaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaataaaaaaaagggggggcaatttaaaaggggcccgatttttaattacgtggctttgaaaaccattaattttttttaggggaaccaaaattaaatttatccggccttttgttaaaaaagccatataataaaaaaaaaccgtggttgaaaaaaaattttatattttttg

SEQ ID NO: 7792 - DNA, 352 bp, Gossypium hirsutum
  Clone ID: uC-gsronu33B130g06b1
tctgtgcagtgccagagactctgacgtccctattctggcaccattgccaattgggttcgcagtgttcttggtgcacttagccaccatcccaatcacaggaaccggtattaacccagctcgtagtcttggtgcagccatcattttcaacaaggacaagggctgggatgaccattggatcttctgggtgggtccattcattggagcagcactagcagcactctaccatgttgttgtgatcagagccattcctttcaaatcaaaatgatcaaaataaacggtccatatgatctgaacaaaatgaaaaattccactcatgcaccctttgagtttgtttattttcacaatttttctt

SEQ ID NO: 7793 - DNA, 300 bp, Gossypium hirsutum
  Clone ID: uC-gsronu33B130g07b1
tcgcccacgcgtccgcaagacacccaaagagtttatagatgaccaacatcctcggcttttcaaggacttagatttcatggagttcttcctttatgccttttccgatcctgcaaggcacatcgacaacggggagttgctccatgtctttgctggcctctcaccaccagtttccaattaaaatcatgctcatatagacaagtaaaagtttggttttggttttaaattaatgttacaaataataaattgagtcctatactcgagatctacgttctcgaactgtattaccatgttatattttgg

SEQ ID NO: 7794 - DNA, 212 bp, Gossypium hirsutum
  Clone ID: uC-gsronu33B130g08b1
ttttggacaatctaggaaaagagttgaaaccacattgatactattgatactagaatgatcaatgaagaatgtttatttttgcttctctgaaaaaaagaaagacgagaataaaaagtataactacaaaaatagaaattgatgatgtgctggaaatgaataaatcagagtttaatcttgccaaatgacacgtaattttacaaatacaaattgag

SEQ ID NO: 7795 - DNA, 194 bp, Gossypium hirsutum
  Clone ID: uC-gsronu33B130g09b1
ttgttttgcttcaaggtaagagtcgattgattcttcgaaaaccataaacgaaaccaaatatggcggagaaagcaatcgagtcggttcaatgctttggccggaagaagacggcggtagccgtaacacactgcaagagaggccgtggtttgatcaagatcaatggttgtcccattgagcttgtcgagcccgagatc

SEQ ID NO: 7796 - DNA, 401 bp, Gossypium hirsutum
  Clone ID: uC-gsronu33B130g10b1
tttcggacgcgtgggccgaagcataatggctcagtcatctggtagcaatactgggaagaagcttattcgaattgatgttagttcagacagcgtttgcccatggtgctttgtgggaaaaaggaacctggacaaagcaattgctcaagctaaggatcaatttgattttgagattaaatggcatccattttttcttgatccctcggcacccaaggaaggagtcagcaagagagaatactatgagaagaagtttggatctcgaactcaaggaattttagctcggatgaccgagatatttaggaatgttggattagaatatgacatgtccggactaacggaaaatctcttgacagccctaggctgatctatttggctggaaaacagggtcttgacaggcaacatgc

SEQ ID NO: 7797 - DNA, 482 bp, Gossypium hirsutum
  Clone ID: uC-gsronu33B130g11b1
tttcccacgcgtgcgcccacgcgtccgaaaaaattgtaattgaaatgttagtaaacgcatggttgtttggaaagcattgttcaatactttgaaaatacatttcacctcactggaggcttaattccagactggagctttttgctcgggggaaaatttagcaactccagttgctttttcttttcctcttttacccatatattcttcaggcttttctgtatgtttggttaccgttgttctctcctttccccttccccttcccttgggttgcaaatcagtttggtcaaggacctcttccggttcctccttcatccagatggatttccaagagcaattcttcaaggaacgaatcaaatttatccatgaagcgagggctgagaaagaagagagttttgagaagctgcaacagcagagcgtgagaaggtaaagcagtctaaccccaatccttcaatgcagaggaatacaggcgcagatgaaattgaaaa

SEQ ID NO: 7798 - DNA, 366 bp, Gossypium hirsutum
  Clone ID: uC-gsronu33B130g12b1
tcgtttcaggttacagagaggagaaaaaagatgtctttggtgacagaagagatcaaggccagtgcttgacaagtataccatggagatgagatctgtcaagtgaaatccaagtctttgctggaggagatgggcatgcccagagggcttttgcccttgaaagacattgacgaatgtggatatgtgaaggagacagggttcgtgtggctctaacagaagaagagcataacccacaagtttgaaaagattgggaagcctgcttcgtatgcaactgaagtcactgcagtgattgagaaaaacaggataaagaagcttgatggggttaagagcaaggagctttagatttgggtcacactgagtgatatctat

SEQ ID NO: 7799 - DNA, 244 bp, Gossypium hirsutum
  Clone ID: uC-gsronu33B130h01b1
tgtcaccttctcccattcttcctacgaagcacaattttctcacgggaaaagtgtgacttccaagtgcaattggccacaggatttattcagcaatgatgatgcaagttccagttgctctatgaactccttccagtactctacaatgaattatgaagactttgattcgagtctacatcaaggggagcacccctgcattccaaagggtcttaaatctacacgattttgtccatcagagagcatgact

SEQ ID NO: 7800 - DNA, 51 bp, Gossypium hirsutum
  Clone ID: uC-gsronu33B130h02b1
tccacgcgtccgaaaaataaatacaaagatgaaaaaaaataacgagaaaaa

SEQ ID NO: 7801 - DNA, 209 bp, Gossypium hirsutum
  Clone ID: uC-gsronu33B130h03b1
ttttctcgagagaatcaatgtctactacaatgaagccagttgtggtagattcgttcctcgtgccgtcctcatggatcttgaacccggtaccatggacagcatcagatctggtcccgtcggccagatcttccgacccgataactttgttttcggtcagtccggtgctggtaacaactgggctaaaggccattacactgaaagtgctgagt

SEQ ID NO: 7802 - DNA, 516 bp, Gossypium hirsutum
  unsure (1)..(516): unsure at all n locations
  Clone ID: uC-gsronu33B130h04b1
ttttccacgcgtccgatcgaagcgacaaagggctgaatctcagtggatcgtgggttccatttgatgctgatccttatctaggcatcaatgaagactttcaagtgtttgtaaggcctcaagcggatgtcaaatgttatggattggtttctgataaccaactggcctcttctttgctatcggagttgcgggataaaatagatgaatccaacaacatcttgatggatatcttggttcgaaatttatcgaccattactgagctcgagatagatgatcttacgaagcagttgacagagccattcacacctgatgatgcgttcatgtttggtccacgatctattcttgacttggaccacaatcaaatgactccctactcaaaagagtctctttcttttgatggggatgttcaaacaagtcaattactcgaagatgatgcaagaagtgaagcatctgtcctcgacctgtcccacttcattcctaaagcgcctgcatncccttctatcttcatgntattaacat

SEQ ID NO: 7803 - DNA, 354 bp, Gossypium hirsutum
  Clone ID: uC-gsronu33B130h05b1
ttttcttttagaggaggaaatgcatcatcgggcatgggagtggctgaacacagcaaaagcacgtacctggaactgcagagaaagaaggtgttccgatatgttatcttcaagattgatgagaagaaaaaggaggtcatagttgaaaagactggaggtccgacagagagctatgatgatttcgcagcctcattgccggagagtgactgccgctatgcagtttatgacttcgattttgtgacttccgagaattgtcagaagagcaagatcttttttattgcgtggtctccttctgtttcgaggatccgttccaagatgctttatgcaacatcaaaagacaggttccgaagggaattg

SEQ ID NO: 7804 - DNA, 210 bp, Gossypium hirsutum
  Clone ID: uC-gsronu33B130h07b1
tttcccacgcgtccgctttattctctgcaatctcttctttttagagtttcatcacaccagatattacaatgggttcaatcggtgaaactcaaatgacacccacccaagtctcagatgaggaagccaacttattcgctatgcaacttgccagtgcatcagttctccccatggtcctcaaatcagccattgaacttgacttgcttgagatca

SEQ ID NO: 7805 - DNA, 79 bp, Gossypium hirsutum
  Clone ID: uC-gsronu33B130h08b1
tcttgtgtatgaaaatttgcaataaaaaaaattaagacttatttataataaaattagtaaaagtttatattgttattgg

SEQ ID NO: 7806 - DNA, 147 bp, Gossypium hirsutum
  Clone ID: uC-gsronu33B130h09b1
aaaaggttatattatatatatatctatattcagctcatagcggctcaattggggttgtagcaatggtggatccgctgtatcaccgccctcaccggcttctcctcgacaacactggcaccaaaccccgtagttctttcaccaacgaag

SEQ ID NO: 7807 - DNA, 184 bp, Gossypium hirsutum
  Clone ID: uC-gsronu33B130h10b1
ttttgcttctaattttcctgaaagacctgatcaaccagaatgtaggtattatatgaacaccggaacttgcaaatatggatctgattgcaagtaccatcacccgaaggaaaggattgctaactcagccatgagtagtgttggcccacttgggctttcttcaagacctgggcaacctgtattgtct

SEQ ID NO: 7808 - DNA, 477 bp, Gossypium hirsutum
  Clone ID: uC-gsronu33B130h11b1
ttgcccacgcgtccgcccacgcgtccggaaaaagactccaagtgctaaaaaagccgaacgacaacacaaggtccgaacattaatgtcgatgcggtgatgatgtcgacggaagctggctgatgatcatcctctgatgatgatatgtttgaatagcatagatactttctatcatcattttgtcttcagaaatttgacatattcttgaatgtctattaccatataggttcatgagggcaattttacttcaatccttgctgaaggggtcagtcatggtttaaaaccttggtaagcaagcgaccttaagtttcttgctatccttcattctttgaagggattaaggtaggatagggaggatttcttgtttcaactttcacaatccatgtagataaaaatactttgtttttgagattcggttcttaatgaccaagaattcagatgattcgtctgaacaggttgcttttccacccattctttacg

SEQ ID NO: 7809 - DNA, 160 bp, Gossypium hirsutum
  Clone ID: uC-gsronu33B130h12b1
aaactcaccagttctacctaaaccacccccttacttaaggacattatcttataaatcattcctaaacctatctagattttatagcgaagatatgttcttaacaactatatcagcatacaccctaacacaataactgattaccacaagtgtaaaggcaaca

SEQ ID NO: 7810 - DNA, 450 bp, Gossypium hirsutum
  Clone ID: uC-gsronu33B132a02b1
atcagaacacacaagccttcaaggaagtagccattataaggcacccacgtatcggtgaatatgcatttgccttcatcacttcatctgttactctgcagagtgacgctggtgaagaagagctatgctgtgtgtttgttcccacgaatcatctttaccttggtgatatattcctcatcaacaccaaggatgttatcagactgaatctgtcagtccgtgaaggaattgaaattgttatatctgggggaatgtcaatgcctcagatcctatcaacactagatactcagttggaaagaagcagacctgagagaagctgagatataaggtaacagttgtagagttgtcgttgtttatttgattcacttttttagttttggacttcagtcatcggaccgaccatgcaatcaatatgtctcaataatgcaggattcggaattagattataaaaatttg

SEQ ID NO: 7811 - DNA, 444 bp, Gossypium hirsutum
  Clone ID: uC-gsronu33B132a03b1
gttccttccttcgccgtctattgcttttagttgcctcgatttcaagtgaatcagaatgggtaaggaaaagactcacattaacattgtggtcatcggccacgtcgattctgggaaatcaaccaccactggccacctgatttacaagcttggtggtattgacaagcgtgtgattgaaaggttcgagaaagaagctgctgagatgaacaagaggtcattcaagtatgcttgggtgcttgacaagctcaaggctgagcgtgagcgtggtatcaccattgatattgccttgtggaaatttgagaccaccaaatactactgcactgtgattgatgcacctggacaccgtgactttatcaagaatatgattactggtacgtcacaggctgactgtgctgttttgattattgattccacactggtggttttgaggctggtatctcaaaggat

SEQ ID NO: 7812 - DNA, 496 bp, Gossypium hirsutum
  unsure (1)..(496): unsure at all n locations
  Clone ID: uC-gsronu33B132a05b1
gccgcggttttcccggggcgccccacgcgtgcttacgcgtccgaccgcggcggctttggttctgagagaaacgagagagagagagaagagtagatcttggcttctctccttcgttcgattccgcttaattatagcccgcgtttctctcagacgtgaaaaagggggctgtctttcacaaagctatttagccggcttttcgccaagaaggagatgcgtatactcatggttgggcttgatgctgctggtaaaactaccattctttacaagcttaagttgggagagattgtcactaccattcccaccatcggtttcaatgttgagaccgttgaatacaagaacatcagctttactgttgggatgtttggtggccaggacangatccgaccattgtggagacactacttccaaaacacccaagactatntttgtggttgatagcacgatcgtgatcgtgtggttgagctgagatgagttgacaggatgttgatgaggatga

SEQ ID NO: 7813 - DNA, 364 bp, Gossypium hirsutum
  Clone ID: uC-gsronu33B132a06b1
gcgttgaaaacttgaaatggaagaaatatatggatgacttctttgaactgagtggaaagttcctaatatcagatgcgttgccgtttttgagatggttggacataggtggagatatgaagtacatgaaaaagacagcgaaagaattggaccaagttgtggagggatggctacgagagcacaagcagaagagagctgaaaataaggcaaatagtgaggaagatttcatgggagtgatactgtctattctcagtgatgcggaggaactccatgctgatacaatcaacaaagccacttgtctcggtatcgtcttggcggcggaggatcaacgtcagttactctgacatgggctttgtctttgttactc

SEQ ID NO: 7814 - DNA, 447 bp, Gossypium hirsutum
  Clone ID: uC-gsronu33B132a07b1
tccacgcgtccgtgaaaggccaagccgacacaataggcattgcgatgcgaagagctttgcttggagaactagaaggaacatgcattacacgtgcaaaatttgagaaaataccccacgaatattctaccatagtaggtattcaagaatcagtccatgaaattttaatgaatttgaaagaaattgtattgagagggaatttgtatggaactcgtaacgcctttatttgtgccaagggtcccggatatgtaactgctcaagacatcatcttaccaccttctgtggaaatcgttgataatacacagcatgtagccagcctaaccgaaccaattgatttgtgtattggattacaaatcgagagaaatagaggatacggtataaaaacgccaaagaactttcacacggaagttatcctatagatgctgtatcatgcctgttcgaaatgcgaat

SEQ ID NO: 7815 - DNA, 435 bp, Gossypium hirsutum
  Clone ID: uC-gsronu33B132a09b1
tatgtatctcatatttgggtctcgaaagtgggtgaatacaggtgtaatgagtgccaaagcatgggataggaacctgtgcagtttacattgaggggtaactaatcgctgtgggcatggtcggtgtgcgctggaccatgacgcaggataatgctccttcttctagcaagtgtgctactcgggagcatgggctctgcatatgctcggttaagcactatactgactatatgctttcccatgatggcatttttaatggctatgtggggggatggcattaaaagcttttgaagactatatgacatgggctacccttaaaatcattctaactgtagaggaggagagacgccgctaagcttcttggagataatatttgggtgttagcaagctgcaaagtctgtatgcctaaagaggtagatactttgctttgctttttgggct

SEQ ID NO: 7816 - DNA, 352 bp, Gossypium hirsutum
  unsure (1)..(352): unsure at all n locations
  Clone ID: uC-gsronu33B132a10b1
tagaggccgcggctttcacttcccttctctcacctcttacagaagccagaagtcagtttagtagcaatggcgtatgctgcgatgaagcctaccaagccgggtttggaggagccccaagagcagattcacaagatccggatcactctctcctctaagaatgtgaaaaacctagaaaaagtttgtgctgatttggttcgcggtgcaaaggataagagactgagggttaagggaccagtaagaatgcccaccaaggttcttcacatcacgacagngaagtctccctgtggtgaaggaacaaacacttggatcggtttgagccccgtgttcacagcgagttattgacctattcagc

SEQ ID NO: 7817 - DNA, 305 bp, Gossypium hirsutum
  Clone ID: uC-gsronu33B132a11b1
gcccaacccgaggcggcgcctgcactcggtgagccaatggacatcaacacagccttgccccttgtggttaggaagtcacgagctcacggtgggctcgcacggggattacatgaagctgctaaggcaattgaaaagcacaatgcacatctttgcgttatagctgatgactgtgaccagccggattatgttaagctggtcaaggcactttgtgctgatcataatgttaaagtgctacgtgccccgagcgcaaaatcacttggcgagtgggctggtttgtgtaagatagactctgagggtaaagcacg

SEQ ID NO: 7818 - DNA, 441 bp, Gossypium hirsutum
  unsure (1)..(441): unsure at all n locations
  Clone ID: uC-gsronu33B132b01b1
caaattttgagagagaggtagatccgatggggaggtcgagaaggaaatacaaacaatctcgtgccaaggtcaaagtgggtctccccaggaaaaaccctcacgtctttaagccatgcttcactcttcctcccaagctccgttcactcgccaacgtcgacgatgccctctccaagtgggacgacaaagccagcgtcatccaaaactacaagtcctttgggatcgtttctaaccctaactacctcggcgttcgttctcgtactttccacatcgtggagagcgattcactccaagtccctcattctccgccttctgatgaaccggctgatgaattcgagcccattgattcgggcagcgatctcgaagaggatgacttaaaaacagcactgnggaagaagcgaagagatggaaaaagcagacatttacagccactgaccaccatgc

SEQ ID NO: 7819 - DNA, 448 bp, Gossypium hirsutum
  Clone ID: uC-gsronu33B132b02b1
tttataaatagccccaaagcccaaccccttcccccatcgaatttgatatttataaaaaaggatggggctgtcttttgctaagctgtttagtcggctgtttgccaagaaagagatgcgaattcttatggtgggtcttgatgctgctggtaagactaccattttgtataagctcaagctcggtgagattgtcactaccattcccaccattggctttaacgtggagaccgtagaatataagaacattagcttcactgtttgggatgttggtggtcaggacaagattcgacctttgtggaggcactacttccaaaacactcagggtctaatctttgttgttgatagcaatgaccgcgaccgtgtggttgaggccagggatgagcttcatcgtatgctaaatgaggacgagctgagggatgctgtgcttcttgtgtttgcaaacaagcaagat

SEQ ID NO: 7820 - DNA, 59 bp, Gossypium hirsutum
  Clone ID: uC-gsronu33B132b03b1
attcattaaaaaaaaagttgtaatttgcaaaaagtgaagtgagatgctaaatgagcttc

SEQ ID NO: 7821 - DNA, 463 bp, Gossypium hirsutum
  unsure (1)..(463): unsure at all n locations
  Clone ID: uC-gsronu33B132b04b1
ttgtaaaacaattgagagaagatgtcctggcaagcgtatgtagatgatcacttgatgtgtgatattgagggcaaccatctctctgccgccgctatcattggccaagacggcagcgtttgggcccagagctccaatttccctcagttcaagccagaagaaatcactggcatcatgaatgacttttctgaacctggatcgcttgctccgactggattgtaccttggtggcacaaaatactatggtgatccaaggtgaacccgnagctgttattcgagggaaaaagggccccggaggtgttactgttaaaaagaccaacctgtccttgatcattgggatctatgacgagccaatgactccaggtcagtgcaacatgnattgtggaaaggcttggtgattatctcatagaccagggtctttgatcactttggtgtaaccttaattgntgcaattcttcctggcttct

SEQ ID NO: 7822 - DNA, 361 bp, Gossypium hirsutum
  unsure (1)..(361): unsure at all n locations
  Clone ID: uC-gsronu33B132b05b1
ggctttgctatgttacatttatggaaacatcaaacatgaagaattcctggctcaccggctggcacttctccgggcagctgataactatgatatatcggatttgaaagaggcctgccacgagagtctcctagaagatattgatacaaagaatgtccttgagagactccaaaatgcagctttataccaattgccaaaactcaagtccagttgcatgcgatatcttgtgagatttggcaagatatatgatattcgagatgattttaatgctttcctgcaatgtgcagacgggnagctgataactgatatattctatgaagttctaaatacctggaaaggattctaagatgccaccaatgataaa

SEQ ID NO: 7823 - DNA, 328 bp, Gossypium hirsutum
  Clone ID: uC-gsronu33B132b06b1
gcgtttacgcgtgtgtggtgatcgaattattcgctgtggacgtgccagaagggaacaccaaggatgaaacttgttactttgtggaggctattatcctatgtaatatcaagtgattaagaaatgtttgatagaggatggtttagttcgaccaaacacaatctattgacgggtgctagatgattaggagcaattgtgcggactactaatatcgataggactaacgagattgcacattactttgtgcatccgatgcctttcttagcttttccttgtttaatgccattgtagttaaagtataatctgtgaggtttcaaatacttaatataag

SEQ ID NO: 7824 - DNA, 451 bp, Gossypium hirsutum
  Clone ID: uC-gsronu33B132b07b1
ttaacttcgtttcatctgcttcatttgtttcgaaatctttgaacaaaaatggcctctttcaattgctttgctttagcattcttgattgctttgtcatttgcaggcattgatgttggggtagcagctcgtcaccttctgcagcagcctcgaacgcaaagtttaccatctttccctaatctcccaacgccatcccgaccatcattctcatggcctggggcgcttcctccacttcctaccacattcccaacaggactgccccctctgccaagcattccctcagtccccacaatcccaactgcaattccccctattcctttctcttttccgccattgccatctttccctaatctcccaaaccctggggcgcttcctccacttcctaccacattgccaagaggactgccgcctctgccaagcattccctcaatcccaactgcagttccctctattt

SEQ ID NO: 7825 - DNA, 449 bp, Gossypium hirsutum
  Clone ID: uC-gsronu33B132b08b1
ttttatcttcctctacctcttcttcacttcatttctgctctgcttctcagtgggaaaaaaaaaattcatagagcagagcagtggtgcccattttcgcttctttctctcttttactcatttctgctctcttcattggtgcagactgtggttctattggagtaaactacggaagaatcgccaacagccttccttcagctaccaaagtagtggaactacttatatcccatggtttaaaccgtgtcaaagtctacgacactgacccggctgatctccatgcattatctggatccggaatcaaggtcaccggcgacctgccaaacgagcaactcttcgccgctgctaaaagcacttcctttgctaactcttgggtccagcgaaacgtcgccggttactaccctcacactgaaatagaagccattgccgtcggtaacgaagtcttcagggacccc

SEQ ID NO: 7826 - DNA, 453 bp, Gossypium hirsutum
  Clone ID: uC-gsronu33B132b09b1
ttgttcacgcgtccgcccacgcgtccgagcgtcttgcccagacagctcaggagacctttggtgattttgaagaagcagttgaaaaagatgcaacaaaaactgctgtcctggatggaactgtccatcctttaaccagctatgtgatcaattatgtgaagtttttattcgactaccaatcaacactgacacaacttttccaggaatttgaaactggtgatggtacagtatctcagttagcttctgtaacaatgagaattatgcaggctcttcaaacaaatttggatggaaaatccaagcagtatagagatcctgctttgactcacttatttctcatgaataacattcactatatggtgagaatctgtgcgcaggtctgaagccaaagacctgttaggggatgattgggtccaaatacacaggaggattgtgcaacagcatgcaaatcaatataaa

SEQ ID NO: 7827 - DNA, 349 bp, Gossypium hirsutum
  Clone ID: uC-gsronu33B132b10b1
tcttattagagaagttgcaggacttattgacttcaatgtgctttacagtgtatgctacacaggatgatattgctgtgtggcagaaatcttcagatattggttgctatgagaagctcaccggtccagatgtctacccagccacgtgtgatgacagtatcgaacaggatgcatcatggtacactccgttacgcccatgtgttacatctccaagacaaaagcttatgaggtcatccgtgggttccctgccaaagtggccacagaggttaaacatcgcacctgagcgcatttcagatgttcctggtgggagtggcaatgctttaaagcgcgatgacagcaactggaaagagcg

SEQ ID NO: 7828 - DNA, 411 bp, Gossypium hirsutum
  Clone ID: uC-gsronu33B132b11b1
tctaaaagagagccgggaaaggaagctagaagagcaaagcgaaaatgaagactatactttcctccgagacaatggacatccccgacggggttagcattaaggtcaaggctaaggtgatcgaggttgaaggtccaaggggtaagcttacccgcaacttcaagcacgtcaaccttgatttccatctcatcaaggacgaagagaccggcaagcgtaagctcaggatcgaggcttggtttggctccaggaagaccagcgccgccatccgtacagctcttagccacgttgagaacctcatcaccggtgtcactaaaggataccgttacaagatgaggttcgtctacgctcactttccgattaatgcctccatcactaatggcaacaagtcatcgagatccgtaacttccttggcga

SEQ ID NO: 7829 - DNA, 442 bp, Gossypium hirsutum
  Clone ID: uC-gsronu33B132c02b1
tattcatccacttcttctcttatttgaactcaaagtcccagctaatattagaatcatgggtgttgtcacttatgactatgagaatacctccccagtcgcccctgccaggcttttcaaggcctttactgttgaagctccgaaagtttggcccacggctgcacctaatgcagtaaagagccttgaggttgaagctaatcctagctctggaagtatcgtaaaaatcaactttgttgaaggccttccattccaatatatgaagcaccagatcggaggacatgatgaaagtaatttttcatacagttacgatttaatcgaaggtgggcctttgggggataagcttgaaaaaattagctatgagaacaggtttgaggcagctgcaggtggagggagtatttgcaagagctcaatgaaattctacactataggcgataatgttatcact

SEQ ID NO: 7830 - DNA, 440 bp, Gossypium hirsutum
  Clone ID: uC-gsronu33B132c03b1
taaactttgaattattcatacaaaacaatgaaaacccacttttttcccctggtttttctcctcatttttttcttagcccaaggtctgaaccccaaatgtgccatccaagaccatggctcaaacctgcaagtgttccatgtttacagtccatgctcacccttcaaaccctcaaaaccactctcatgggaagaggatgtgctgcaaacgctagccaaggaccaagccagggtgcagtttttgtccagcctggtggctaagaaatctgtggtgcctatagcttcaggcaggcagattgtgcaaagcccaacttacattgtgaaggccaatattggaaccccacctcagcccatgcttatggccatggatcaagcagtgatgctgcttgggtgccttgcactggctgcattggctgctctttactgcttttgactttgctaaat

SEQ ID NO: 7831 - DNA, 461 bp, Gossypium hirsutum
  unsure (1)..(461): unsure at all n locations
  Clone ID: uC-gsronu33B132c04b1
ttaacttgctagagagctacgagccgttggatgtggtgatttggatgttgaaggtctcacagagtctctattttcatctcacgtggatgaatatcctgaacatgaacaagcatctcttggacaactgtatcaagcaaagttggatgaactgcgtgctgaaaaccagaatgtttctgattcaactggaactatagggcgctctaaagggacttcagtggcttcttcgcatcagcaaatatctgttgcagttgtgacagagtttgtacggtggaatgaagaagcattaaccagatgcactttattttcgtctcagcctgcaacacttgcagccaatgtaaaagcagtgttcacttgcctacttgaccaagtcagccaatatattactgatggactggaacgggctagagatagcttgactgaggctgcagccatgaaggaagggnttgtgctaggtacaaatc

SEQ ID NO: 7832 - DNA, 300 bp, Gossypium hirsutum
  Clone ID: uC-gsronu33B132c06b1
ttacgcgtccgcccacgcgtccggtcagcagccaaaagggttgatcttctgaagggtcaaaaatctgacagggtggaagtcagtttacagccagaggagttggaagttatggacaatgtgttgcctgtatagtatgaagaagctagggaagaggagaagctactcactcagtgagaggactttagtcatatggcggctgatactgagttgatttggactttaaagatttaaggcaaagagggataattggaaaaaggcggggacaaattttccgtccccacaattctgcagcctgcatgg

SEQ ID NO: 7833 - DNA, 350 bp, Gossypium hirsutum
  unsure (1)..(350): unsure at all n locations
  Clone ID: uC-gsronu33B132c07b1
tttttcttttcatctgcaaatctggtcctttttttctgatgctggagagtttgggtattagatttaaattagtttgaagggctttcgagttctgggttttccattttggggtaacacccaggttagtcaaattgtggacatcacggctatacacagagtttaccggcctcttcttattcatgcccgatctgtacgacgtaagagttgtgtgatcgagaggaaccctgcgccgcacggcgggcgtggagctttgccttctgaaggcggtagtccttccgatctcctcttccttgctgngcggcgtgttgtcttttagagtttcagtagttggtataggtagcttttagtat

SEQ ID NO: 7834 - DNA, 373 bp, Gossypium hirsutum
  Clone ID: uC-gsronu33B132c08b1
tttccacgcgtccggaaggatgatcatcacactaagattaatcttcgagttcgcatgaatgaagcggtcgaagcattcataaatcaaaggttaataagtaaccagtctacggattttatcgatgcattggagatttcgaactccaacaaggaattgttgatgaaactcctgcaggatccaaattcactgctggtgaaacatgttcatgaattatgtgattctcaggcaaagaaacagcaaacaaaaacatcatcactgtcccaaccattgaacacaatagttgtcttgaaggctgtcaaacaaaactgtcctaatagaatcagtaattggccatcaccaaagtctcattatagtaaaaaagacaggggtgtta

SEQ ID NO: 7835 - DNA, 445 bp, Gossypium hirsutum
  unsure (1)..(445): unsure at all n locations
  Clone ID: uC-gsronu33B132c09b1
ttgatttagtttaagaaaacatttccttagagcataaaagaaaatttacgaacatgccgggtgtcaatcctgaaattgagttcccagccattgagttccgttcatcggatttgaagcgaggaaccgaagggtggaaccgtttgtgcaagagggttcaacgggcttgtgagactttcggttgtttcgaggtggtatacgaaaaggtatccacgaaacttcgagaggatgcgtttgggttgatgaaagaaatggttgagctcccagtggagacgaagcagaagaataatagtcccatgccttaccatggttgggttggaccttgcaagcaggtttctgtgttgtatgaaggctttggagttggagatgcctccaactatgactctgttaaaagttttgctcaacttatgtggcctaatggtcacccacactnttctgacactattca

SEQ ID NO: 7836 - DNA, 466 bp, Gossypium hirsutum
  Clone ID: uC-gsronu33B132c11b1
taggccacaaaaaaagagagagagagagagagagatttcagattttgttgcagtgtccaatcattcggttttttttccttaattccccccttttttttctttaattcccagcttctctgaatctctttctgtctttcaagctgaaaaaaaaaggcaaaaaaatctgttctttttgaaagccaggtgattcagaatagagatccaggtttgggtttttcttttaaattataaagttttaatctctactttgatcagctaagagggtttattttgggtccctcaaagttgggttttgcctgttctttggttttgattaagaaacaggtccgttttttttggatatggcagctgttatagatattgttatatagtagcagaaactcagctttttatgatcctttaagagaagaggtaatggaagcacttgaacctttttgaaaagtgcttcttcttcttcttctccctt

SEQ ID NO: 7837 - DNA, 445 bp, Gossypium hirsutum
  unsure (1)..(445): unsure at all n locations
  Clone ID: uC-gsronu33B132c12b1
tcgtccacgcgtccgcccacgcgtccggttttccgatatggcttcagctgatgttgagtaccgatgcttcgtcggagggctcgcttgggccaccgatgaccgggctctcgaagaagccttcagtgtgtatggcgagatcgtcgaatcgaagattatcaatgaccgtgaatctggaagatcccgaggctttgggttcgtaactttccgtgacgagaaatctatgagagacgctattgaaggaatgaacggtcagaatcttgacggaaggaacattaccgtaaacgaagcccaatcacgccgaagcggtggaggcggcggtgaaggatacggaggaggaagcggaggctacaaaagaagtggaggaggcggaggatatggtcgccgtgaaggaggctatngaggtggcccgtcggagggtgtattcgggaatggtggaggatatgac

SEQ ID NO: 7838 - DNA, 298 bp, Gossypium hirsutum
  Clone ID: uC-gsronu33B132d01b1
tacggattttgtgaattcgggcctgtgccctaaccagcataggctctgtccacggaaaggtggttctgcttttgaaaaattgaatagccatgtgagatggctctctccctacattatgggcttagagaccgggtagtttaggataaaatttatctttaatttgggaggatttgtatattttttttgcctttattttaacctaaatttgcttatgcaaaaaaaaaaaaaaaaaaaaaaaaatgaaggaagagaaagaaaaagaaaaaaaaaaaaaaaaaaaaaaaaaaaaaaaataaaa

SEQ ID NO: 7839 - DNA, 95 bp, Gossypium hirsutum
  Clone ID: uC-gsronu33B132d02b1
tataaaaaaaaaaaaaaaaaaaaaaaaaaaaaaaaaaaaaaaaaaaaaaaaaaaaaaaaaaaaaaaaaaaaaaaaaaggaaaaaaaaaaaataag

SEQ ID NO: 7840 - DNA, 372 bp, Gossypium hirsutum
  Clone ID: uC-gsronu33B132d04b1
taaagatcatagacaacgttggttaaatttccgtcttcttacgctatttcgagtgccacatttcccgacagagatttggatcgatttattgctttagcatcggctacagccatggcttcgtcggcaccaccagagtcgtcctccaccgtccaaaatgcaaggaagccgcttggatttatgaaaaacgcagtgaaatacaaacacaacttcattcagttcttcgcgatgaccgggattttgcttttgagcgtccgatctttgggccagaagtaccgccttcacgacctacaggaggatacagcagttcttaagcaagagcaacaattttttaatgatcggatgagctacatagaacgtggcctcctcctcgag

SEQ ID NO: 7841 - DNA, 443 bp, Gossypium hirsutum
  Clone ID: uC-gsronu33B132d06b1
ttaatggctacggcagccacatgagcaacgggatggctcacactcaagcatatggctctaaccatcacaacagccctggaaaacaccaaggccctgggtatggcagtggctttgggggctaccctcccaaaaaccatggaatgccgcatagcccaccgcaccacggcggcaaactgtcaggccaaggcaacgggttcctgaagccccaagcatacggccctgggagaagcatggcctacggaatgaccgaaaccgaaagttgcgagtaccgcagcgaagtatacttttccaacgagtcacactacaacgacggccgtggataccaccacgctggcaaaagtgaccaccctgtcaaggggtctgctaaggaaaataaagggtggcatttcacgtaataaaagctgtagtgatagcgacagtggcagcgaccgtgatgatgatgg

SEQ ID NO: 7842 - DNA, 446 bp, Gossypium hirsutum
  Clone ID: uC-gsronu33B132d07b1
tttattaccattctttcattacggcggcggctcagtatcagcctcatggttttggtaccaccggcggtaagctgcagagcatgaaggaagtggcagcttttcttggacatgtcggcagcaaaacttcatgtggttatggagtggcaactgggggaccattggcttggggtctatgctacaacaaggaaatgagtcctagcaaattgtattgtgatgattactacaaatacacctacccttgcactcctggagtttcttaccatggccgtggtgccttgcctatctattggaactacaactatggagaaacaggcgacgcattgaaggtggacttattgaaccaccctgaatacatagaaaacaatgcaaccttagctttccaggcagcactctggagatggatgacaccggtgaagaaacaccaaccgtcggcccacgacgtgttt

SEQ ID NO: 7843 - DNA, 395 bp, Gossypium hirsutum
  Clone ID: uC-gsronu33B132d08b1
taatctctttcagaaacacagtttcaaacctgaaatttccatttgtcgattccaagctctcatcaatgggtctctcagttgagaattcggtaacacaatctcatacccgaacccacaaaaccttcctcatcaccaactacatcctcttgggagctgcttccgcctgtatcttcctcatcctctccctacgcttgttcccgtccttgtgtggattcttccttatcctcctccacgtcgtcaccatagccgccgccgtctcgggttgctccgtcgccacttccgggtccaacaagttctacgcagcttacatggtagtgatggtgctgacatcgatattccagggctcggtttcggagcttatattgacccggacttttgactttttggggtacttg

SEQ ID NO: 7844 - DNA, 418 bp, Gossypium hirsutum
  unsure (1)..(418): unsure at all n locations
  Clone ID: uC-gsronu33B132d09b1
tcgtggacgcgtgggttgttgtgccagctgagatcttcccttcaagattgcgatcaacgtgtcacggaatatcggctgccgctgggaaagccggggccatcgtcggggcatttggattcttatatgcggctcaaagcactgatccggccaagaccgatgctggctacccaccaggcatcggtgtccgatactcacttatcatgctcggggtcatcaatttctttggaatgctattcactctactggtgccagaatcaaagggcaaatcacttgaggaactaacaggtgaaaatggagatgaaaatgatgaaaaacagattcaaatggatccttcaaggactgttcccatctgattttcaccactaatttgaagttcttatcaagtttcatattggttcctagntacttttggatcttt

SEQ ID NO: 7845 - DNA, 372 bp, Gossypium hirsutum
  unsure (1)..(372): unsure at all n locations
  Clone ID: uC-gsronu33B132d10b1
tcttttctttttcctgttcaatcatgtcttgcttcattagcaaatatgctgatgagttggctaaaaacgctgcttacattggaacctctggaaagggtatccttgctgctgatgaatccactggcaccatcggcaagcgtctttcaagtattaatgtagagaatgttgaagacaacaggcgtgctctccgtgagctcctattcacaactcctggagctcttcagcacctcagtggtgttattctctttgaggaaaccctttatcaaaaaaccgcttcgggcaagcccttcgntgatgttttgaaggaggntggtgtcctccctggcattaaggttgacaagggtaccgttgagcttaatggaacccatggcg

SEQ ID NO: 7846 - DNA, 456 bp, Gossypium hirsutum
  unsure (1)..(456): unsure at all n locations
  Clone ID: uC-gsronu33B132d11b1
tccacgcgtccgacgaacttctcctataagcggctaatgattaatctccatcgccctttcataatccacagccctgaaatggtttccaagattatcaagaaacgaactccgccacgatccatcaagcgccatcgccaccaccaccggagaaagacttctccggtgaagaagaatggttcgttctccgtcattgcctccctcaacaagtccatcaagacttgccgtcgtcgcatcgtgaggcttttctcgaggttagcccatatagcaaccccttccaccgccgccaaacgctaccgcaatggcttccaactcctcaagcaagaagaaaacgaagagcaagaagagttctgtgggttcgaaagcaatttcatcgatcctcgtgctttagtgttcgagcggtgcttgcttcaccgntgatttccaagacgaaaagacgatctttcttgacttggacga

SEQ ID NO: 7847 - DNA, 270 bp, Gossypium hirsutum
  Clone ID: uC-gsronu33B132d12b1
ttgtttgagaatcggtcgccatcggcgtccgaattgtagtctggagaagcgtcctcagcgacggaccgggcccaagtcccctggaaaggggcgccggagagggtgagagccccgtcgtgcccggaccctgtcgcaccaagaggcgctgtctacgagtcgggttgtttgggaatgcagccctaatcgggcggtaaattccgtccaaggctaaatacgggcgagagaccgatagcgaacaagtaccgcgagggaaagatgaaaaggactttg

SEQ ID NO: 7848 - DNA, 452 bp, Gossypium hirsutum
  Clone ID: uC-gsronu33B132e01b1
tttcgatttatctccgttgttcgaagagaaaaagagggaagagaaagaggagttgaggttcgccacgacgaggccggcaagcagcgtgatatcgaggctcgaagaggtggccaaatcggggaagttcagcgtcaaaaagagcgagtgtagggtgcggttgcagggtcaagaatgtgggaggaaaggtaaacttgccattgctgccaatatatttgcggtgacgccgtcgttcttggtggtggaagttaaaaaggaccatggcgacaccttcgagtacaatcagttttgcagtaaagagctccggccggcgcttaaagacatcctatggacgtcgccgcccgagaattcgactgtggcttgatttatgtgaggtgggaagtcattgtttgatgatgaaggtatttgttgttattgtaacagtgtgtttatgtgattgtttttagatgggaaat

SEQ ID NO: 7849 - DNA, 448 bp, Gossypium hirsutum
  Clone ID: uC-gsronu33B132e03b1
taaaacagggaaagaaaagcagcgtaatgggtgaagaagtgaaggtttttggatactgggcaagcccttacagctacagggcagagcttgctttgaagttgaaaggtgtttcttatgagtacataaatgaggatatctttggcaacaagagcgatttgcttttgaaatacaatccggttcataagaaagtcccggttcttcttcacaacgggaaaccaattgtagagtctcttgttatacttgaatacattgaggaaacttggaagcataatccctatttgccacaagatccttatgacaaagctaccgctcgattctggatcaagttcatcgacgaaaagtgctttcctaccctttggctagctgcatggagcgccgagaatgagcgagaaaaagtgacgaatgaagcttgcgagtatctgaaaacgcttgaaagtgcgcttaatgg

SEQ ID NO: 7850 - DNA, 239 bp, Gossypium hirsutum
  Clone ID: uC-gsronu33B132e05b1
gtaactaagaaagatctgatgcaagatatatcttcagaggatgtttgtgttgacatgccgggagcaaacgctcgttttgatgggtctgatatacggagtatgcttcaaaggtggtttcaagaaactcatgttcgattttgggatgagaaatcaactaaagattcataggttaacgggggctaagacgacagattgccttaccagatctggactgttaattttgcttatgttagctgttg

SEQ ID NO: 7851 - DNA, 194 bp, Gossypium hirsutum
  Clone ID: uC-gsronu33B132e06b1
tccacgcgtccggaacctcagaaaaaaaaaacagttattaaacaaccaaattcccgtatattcttgctagttttaggaaatttttagccctaaaattcgtttctgtttctcctgaatctgctaatgtctgctacttctgctttctaaggtacgaccaccgcttttttttcgtcaaaaaaaaaaaaaaaaacaag

SEQ ID NO: 7852 - DNA, 373 bp, Gossypium hirsutum
  Clone ID: uC-gsronu33B132e07b1
tttctgtttgaaatccaagccatcaccggccgccatgtttcgctcgatatagcgtcggtttgtttcagtgctttctccgttgtgtcgttgatggggttcttctttatggagaaaagaaaggcatggaaatctcagcagtagtgtgatatattatggttttaagaaccctaattaaacctttgaaaggatttttatagtaatgggtttgatttgcatgtcttatttactttctttgtgtttttaatcctagatgatgggagataaagagttaagttgaatggttgtgttttagtgggaatggggtgaataaaagagttggaattatctgcgatcatctccttgttatatattaaaggttgaaaattgtcttttt

SEQ ID NO: 7853 - DNA, 335 bp, Gossypium hirsutum
  Clone ID: uC-gsronu33B132e08b1
tctgtttttgccttcccaccggcttaacaccgtctttcagttttcatttcctctaagaaaaggattaaaatggcgaagaatatgatgcgagccgttcaatacagtaaatataacggaggcgccgctgatctcaagcatgttgaagttccggtttccagtccaaagaaggatgaagttgtgatcaaagaagaggcagctagtattaacccaatcgactggaaaatacaggagggggtagctcgtccattttaaccttgcaaattcccccacatttttggtaccgatgtagcatgagaaatggcacaagttgtattaggtgtccagagtttcaaaga

SEQ ID NO: 7854 - DNA, 452 bp, Gossypium hirsutum
  Clone ID: uC-gsronu33B132e09b1
tttttcttcttctcatctcagtcgtgcaccctaaatccctaaataaaagtttgtttttcttcagctgaaatcccccaaatttcccatttccaacaacaccagtcaatacacctacaccaatcacacttctttttccttttcatttcactgcactgaattcactcaccatagctactccttttctctcgatctgttagggtttcttttaattttaggctttcaatacagtttccttttaaactggaaggagttgaaagataaaggaaacgaagaggggagtaaggctgttcgctgaaataaagagataaaaaaaaaggttgaagaagatgattttcaggttttttttacggtaaggtgttccacgagcaccttcttggaattaactgtgttaaatggagctgcttccttttcactgtttacttggcatattggttggttacaatgcgtagaga

SEQ ID NO: 7855 - DNA, 373 bp, Gossypium hirsutum
  Clone ID: uC-gsronu33B132e11b1
gcgagcgccgcccttttttttttttttttgtcataataatccaacactgaaattctattaaaaactagtacttgtgcaacaataactactactatctagtacaacatgaacatgatagatcacacacaaacagtcaacgaaccatgacgcccaacatttttttaattttccacagagctaatcttagtgcttaatatatactagaagcagcaaaacgatatatatatatatattccacacaccacaactacataatattaataattataggacttcctctctatccattctgcagtgaaaatagagagaaagaaagccttaagcaaagggtctagcttagcactttggaaaaggagttctacaggtggaagca

SEQ ID NO: 7856 - DNA, 452 bp, Gossypium hirsutum
  Clone ID: uC-gsronu33B132f02b1
cttaaattgactactcctagctttggtgatttgaaccatttgatctctgcaaccatgagtggagttacttgctgtctaagattccccggccaactcaactccgacctccgaaagcttgctgtgaacttgattcccttcccccgtcttcactttttcatggtcggatttgctccactgacctcccgcggttctcagcagtaccgagctctaactgtccctgagttgacacaacaaatgtgggatgcaaagaacatgatgtgtgctgctgacccgaggcacggtcgatacctcacagcatcagccatgttccgaggcaagatgagcaccaaagaagtggatgaacaaatgatcaatgtccaaaacaagaactcttcctacttcgtcgaatggatcccgaacaacgtgaaatccagtgtctgcgacatcccacctagagggctatcaatggcatc

SEQ ID NO: 7857 - DNA, 453 bp, Gossypium hirsutum
  Clone ID: uC-gsronu33B132f03b1
tccacgcgtccggaaagtatttggcatcgtttgaagcaaatggggtttcagtcactgtgcatgaatgcagtttgcttaaaagcttttccacttcattgataatagcaaacttgtatgtagctatatatccctgtgagtacttccaattccagaaaattcgcaattctttttctagttttagggaaatatagctatctgtacacgaccaagataccagcctgttccacagactctacattctgctgcccttgtccaccatggatatttgttgacaggtgacctgtaatggaaccatgaactttctataaagcattttcataattgcttgacttttctgtgtcacttgcaatgcaaactaaaggtctacattatcatcactgatggtacttacctctggaaaattcttctgttcacagattgagattgtttgttagtatggttcaacctgcaact

SEQ ID NO: 7858 - DNA, 417 bp, Gossypium hirsutum
  Clone ID: uC-gsronu33B132f04b1
tccacgcgtccggggcggagcagcaagttgacatgcgttgcctttgctcatataagaactccaagctcttgccttcccttggtattgacccaaaccttgccatgaaattgcctagcttgtgcaagcttcctcatcctgcaaattgttagttcctggttctccatatttgatctcaaatgtgagggaaaatcatgcttattataagcctctacttcacataattgtactgaccttcgggttttctttttcctttatttctttttatgtgttgtgtttcgattggtatcttatagtcgtgtgatttctcaccaataatcatatattagtattgtttccaaagcaaaagcataccttgtgaaaaaaataaaaaaaaataaaacgaagaacaaaccatgcaaacaatgttactataataaa

SEQ ID NO: 7859 - DNA, 449 bp, Gossypium hirsutum
  Clone ID: uC-gsronu33B132f06b1
tccacgcgtccgcccacgcgtccgcccacgcgtccgcccacgcgtccggcgagaatctggctctaccatggctgttgttgctgcacaaaccaaagcaattgctggaaaagtaacaaattgggacaatgttgttttggcttatgaacctgtttgggccattggaacagggaaagttgcaacccctgctcaggctcaggaagttcattgcgagttgaggaaatggcttcatgagaatgttggcggtgacattgctgcatcaactagaattatatatggaggttccgtaaatggagcaaactgcaaggaattggccgcacaacccgatgttgatggctttttggttggtggagcttccctaaagcccgagtttgttgatatcatcaaggccgcgatggtgaaaaagaattagaagttgaaaagcaggaattaaaggtgaaacagaaacaacc

SEQ ID NO: 7860 - DNA, 317 bp, Gossypium hirsutum
  Clone ID: uC-gsronu33B132f07b1
tttttggacaacctgggacctcagcctgggtcaagaaagaaagggaagagaaaggggagaggaatatcggctggacaaggtgggagctgtgggtttggaatgaggggtcagaaatcacgttctggcccaggtgttagaaagggatttgagggtggccaaatgccactctataggcgtatccccaaattgagaggaattgccggaggtatgcatgcgggattaccaaaatacataccggttaactcaaaagacatcgcaacagctggatttcaagagggagatgaggtgccttacggagactttaaaggagaaggggt

SEQ ID NO: 7861 - DNA, 85 bp, Gossypium hirsutum
  Clone ID: uC-gsronu33B132f08b1
tctccctacgcgtccgaaaaaaaaaaaaaaatttgaaacaaataaaaaaaaaaacaaattaaaaaaaaatacaaaaagattaaaa

SEQ ID NO: 7862 - DNA, 453 bp, Gossypium hirsutum
  Clone ID: uC-gsronu33B132f09b1
tcgtccacgcgtccggtagatatcagagggaaaacacaaaaactagggttttagagagaacgggagccaaagtgagagagaagaggcagatatttttaggagtagggttttgttatattgcttctctagggtttagaaaatggtggccgacaaaggaaagaagctgaaagtagcagagaaagtagaggaagagaaccatgaacaaatagatggagacctcgtcatttccattgagaagcttcaagagatccaagatgagcttgaaaagatcaatgaagaggcaagtcagaaagtcttggaagtggagcagaaatacaatgaggtttgcaagccggtctatgataagcggaatgaaatcatcaattcaattcctgatttctggttaacagctttcttgagccatcctgctcttggtgatcttttgactgaagaggaccagaagatattcagata

SEQ ID NO: 7863 - DNA, 445 bp, Gossypium hirsutum
  unsure (1)..(445): unsure at all n locations
  Clone ID: uC-gsronu33B132f10b1
tggacgcgtgggcagaagataatagagcgtttgtctcagatctcagaagatggcccgtaccaagcaaaccgcccgtaagtcgactggtgggaaggctcctaggaagcaacttgctaccaaggccgcccgtaaatctgccccaaccactggtggtgtgaagaagcctcatcgataccgtcctggaactgttgctcttcgtgaaattcgaaagtaccagaagagtactgagcttcttatcaggaaattgcctttccagaggcttgttcgtgaaattgcccaggatttcaagactgatttgcgtttccagagccatgccgttcttgctcttcaggaagctgcagaagcatactcttgtgggtctctttgaagacaccaactctgtgtgcgatccacgcaangcgtgttactataatgcccaaggacattcagttggctcgtaggatca

SEQ ID NO: 7864 - DNA, 422 bp, Gossypium hirsutum
  Clone ID: uC-gsronu33B132f12b1
ttggttgaagtggtggaaggtgatgcaaggaatgttctctgtgacgctgtagaaaaacaccatgcctccgttctcgctgttggtagccatggttatggagctataaagagggctgttcttggcagtgtgagtgattattgttctcaccatgctcattgctctgtgatgattgtgaagaagccgaagatcaaacattaatctcagcaataaaattgaacaaacaactggggttgctgcatatttttagtcgcctaataacactatggtgttgcacactgggactgtaataccaatcatgctgaatattagatattggtgtaaataagcagagtttacacgattcttatgtcttaatgttttttaattagcttgtacaagtattattggaatattctatacttaaatctatcatgcgagtgttg

SEQ ID NO: 7865 - DNA, 339 bp, Gossypium hirsutum
  Clone ID: uC-gsronu33B132g01b1
cttttccatttgaagaagcttgtggctgctgggaagttggtcaaggttaagaattcgtataaacttccttcggctaaggcttcgaagccggctacaactgcttctgctccggctaagaagaagccggctgctaagtccaaacctgcttcgaaggccaaggaagggaaacgtgctaaaacaacttctaaatccccttctaagacaaaggctaaagcggcggctaaaccaaaggctgctcctaaggctaaatccaccgcaacgaagacgaaggctgtggctgctgtgaagccgaaggcgagtgcatctgctaagccaaaaaccgtagctaaatcgaaggcg

SEQ ID NO: 7866 - DNA, 459 bp, Gossypium hirsutum
  Clone ID: uC-gsronu33B132g02b1
ttcacgcgtccgcagagctctctccttctaggccttacatttcgtttggcgttctactatttccagcgtctctttgcggctgagtggtcttttgaattctttggtggaaacttttgaacaaaatcgaagttacagagacttaacgattaaaagagaaagaatggaaacacaaaagagccaggccgagaaacaagcgacgatggcttcatgtagaaagaaaaagaatgaagaagccaccttccttgaagacttgaaggatcacatcgatgagtttggtaatgcatcaatggatgagcataaaacttgctttaagaagaccatccaaaagatgtttggaatgtcaaaatttgtagctgaaaggaatgctgaatcaaaggaaacaacagtatcaaaataaagtatgttcatctttaatagcatgatatgtagtagcatgatttggtttacactatatttaaa

SEQ ID NO: 7867 - DNA, 458 bp, Gossypium hirsutum
  Clone ID: uC-gsronu33B132g03b1
tacgtccttaaagccaccaacttaacctttctggacttacggttcaactccattaaaggtctggttccacaacaagttttcaacttagaccttgatgttctcttcatcaacaacaataatttcgaacaaagactccccgagaatctcggtgacacaccggttttatacctcacttttgcaaacaacaagttcaccggtccgattccgacaagcatcggcaaagcacccaacttgctcgaagtgctttttcttaacaacaaacttactgggtgtttaccatatgagatcggcaacttgagtcaagccaccgtgttcgacgtcgggtcgaataagttaactggtcccataccatactcgtttgggtgtttaaaaaagatcgagcttctcaacttggccggcaatgaattctatggcgaagtaccggaaaccgtttgtcaactcaaaaatctacaaaattt

SEQ ID NO: 7868 - DNA, 439 bp, Gossypium hirsutum
  Clone ID: uC-gsronu33B132g04b1
gtaggtggtggtagtggtggcggcggagctagtgcaggtggatatggtggtggagcttctggatatggtggtggaggtggagaaggaagctgaactggttgtgcatgagcagcaggaaggttatagcacgagactccaaccaaaaatcttggtgacacactcgattatatacaaaactgaatgcaaacaacaagttcgaccggaccgatttgcgacaagtaatcagaaagaaacccaacttgctcgaagtgctttatcttaacaacaaacaaactgggagtttacaatatgagaacggcaacttgagtcaagccaactaaaatcaaaataggtcgaataaagaaacagggactataccatactcagaccgggtgtttaaaaaagaacgatttttttaactaggccattaatgaaatttatgggtaagtaccggaaaacc

SEQ ID NO: 7869 - DNA, 280 bp, Gossypium hirsutum
  Clone ID: uC-gsronu33B132g05b1
ctcacgcgtccgaaatatttatacccaaaacatcaatggttcattacctgatgttgaagttcacaatggtggcaattttactactttaaaacccattaaatttccctttcttgaacaagtggggcttaatgttagtcgctaggtactggcaactaatgccactagggcaccatggtatgcatcggatccacaggagccgtatgtggctgcggggatccgcgctttcaacagtatgtaacttgcgaccaacaaaaactcaccttgacaacacacaccggaa

SEQ ID NO: 7870 - DNA, 454 bp, Gossypium hirsutum
  unsure (1)..(454): unsure at all n locations
  Clone ID: uC-gsronu33B132g08b1
tcgtccacgcgtccgggctgcaaagagcattgttgctaatggactagctaggaggtgcatcgtgcaagtctcctacgccattggtgtacctgaaccattgtctgtatttgtggacacttacggnactggaaagatcccagacaaggaaattctcaagattgtgaaggagacctttgacttcagaccaggaatgattgccatcaatcttgatcttaagagagggggcaatagcaggttcttgaagactgctgcgtatggtcattttggtcgggatgaccaagatttcacttgggaaggttgtcaagccactcaagtgggacaaggtccaggcttaattggagcttcatcacattgggtctatgtctgatttatttgatctgctggctgctaccatatgaggctgcttttcttacaatttcccttaatttcttttttgggtttgaaatttgattaa

SEQ ID NO: 7871 - DNA, 439 bp, Gossypium hirsutum
  Clone ID: uC-gsronu33B132g09b1
tccacgcgtccgcgacagaccctttttccctcaaagatcgaaccggcctttaacgatcccgagagaaccgagtttccgcacagtgaattctaaatgttggagttgcatatcggagaatgagctctattattttcaccatgctcatgcttggaaccccatcaaatgaacacacagttaataaaggttgcacacagtactcaaattagtgtgattgatggactacgtgcgtgcgtgcgtgcatgcatgatccatgtacaatatatcaacatatgtagttgtaggatgttccattctatctcatctcatctcttttgtcatcgccttttgtgttttgtcggcttagacagtgtgagtaaggtagatatataacccctttccactagtcttttagtttcaaaataaagacgtgattggatttatctttttaattttttggcat

SEQ ID NO: 7872 - DNA, 450 bp, Gossypium hirsutum
  Clone ID: uC-gsronu33B132g10b1
tccacgcgtccgcaacgccatccaacaagacccagctcgtctagctcgtgccgccattagtgtcagcctctctaaagctcgtaacatggcagtctacgtctctaacctctcccgggaagccgattacggcgccgacccaagagccagcgcagccttgcacgactgtttctcgaacatgggtgatgcagtggatgaaatccgtgggtcgctgaagcaaatgcaacgggtagtggctccaggttcggagtctttcaggttccaaatggggaatgtccagacatggatgagcgcggctttgacggatgaggagacgtgtacggacgggttcgaggatgtggcgggtgggccaatgaagacggaggtctgcaagagggcggctaaagtgaaagaagtttacgagcaatgctttggcgttggttaatagttacgcagaaaagggcacagtgtaat

SEQ ID NO: 7873 - DNA, 452 bp, Gossypium hirsutum
  Clone ID: uC-gsronu33B132g11b1
aatcccactccaacataaagcatctctagtttccctctccaattctctaagcttagccgaaacaatgaagctaaaacatcactcgtccatcactctcctccccttgctctctttgatctttcttccctccttggtctcatctcaggcctgccagagaacctgtggcaatctccccatcaagttcccctttggaaccggccctggctgcggtgatccgcgctttcaacagtatgtaacttgcgaccaacaaaaactcaccttgacaacacacaccggaaactatcccataaccaacatagactacagcaaccaagtcatatacatctcggatccttcgatgtcgacttgcggttgctctcaaccgagcaaaggcttcggcctagattgggacgcacccttttctttcacggacgacaacgtattcactctccttgactgctccaccacttcgg

SEQ ID NO: 7874 - DNA, 141 bp, Gossypium hirsutum
  Clone ID: uC-gsronu33B132g12b1
taatggatcactagcatcacatctgggatgcatgccttgccaagagttacaacttagcttgaacacacaaggctcccctaggcgtagcccgcaacgtgtgatctgagacgcaacttaaagtggcgtaagtcttcaccatcc

SEQ ID NO: 7875 - DNA, 207 bp, Gossypium hirsutum
  Clone ID: uC-gsronu33B132h02b1
ttttaaaaaaaaaaaaaaaaaaaaaaaaaaaaaaaaaaaaaaaagacaggcctattgcaatatagaaaacaaaaataaccatccaagccatccgatgacatacatatagtggcgggtcacttaaattgacttgccttcacgtcccattacaaggactggactggctatgccgtggcgaacctaattaaattgcctggcgggccattt

SEQ ID NO: 7876 - DNA, 428 bp, Gossypium hirsutum
  unsure (1)..(428): unsure at all n locations
  Clone ID: uC-gsronu33B132h03b1
ttcacgcgtccgctttttagttctcaactctctcaaattcaccatggctgacaagtgtggcaactgcgattgcgctgacaagagccagtgtgtgaagaaaggaaacagcttggtcattgagactgaggagagctacatcagcaccgtagtggtcgagcctctggcagagaacgatggcaagtgcaagtgcggaactagctgcagctgcacaaactgcacatgtggcagtcactaagcagacatatagaatgatgaagtttgggacctaaaaagaataaaagttgggttgaataatttgtgtcttttgttgtagtttgagtgtgttttcttgtctatctgtccgatgattggctatgtctctcattttatacaatgatggaatgaccatgtcaatggcctttgtctgattaatgaactattattagtnt

SEQ ID NO: 7877 - DNA, 450 bp, Gossypium hirsutum
  unsure (1)..(450): unsure at all n locations
  Clone ID: uC-gsronu33B132h04b1
ttcacgcgtccgctttactatctttcctcctcaagaaactctctactacccagtataagccatgagtcgtcatcctgaggtgaaatgggcacaaagaaccgataaggttttcattacggttctattacctgattcaaagaatgcaaaagttaaccttgagccggaaggagtgtttaatttctctgctactgctggaactgacaataacacatatgagttgaagttggatctttttgataaggtcaacgtggaggaaagcaaaattaatattggagttaggagtatattctgcatcttggagaaggctgaaaaagtgtggtggaaaaaattattgcgcggggatggcaaagccccccattacgtcaaagtggactgggacaaatgggtggatgaagatgaagacaagggtcttnggtgatcttgacttaggaggaatggacttctcgaact

SEQ ID NO: 7878 - DNA, 429 bp, Gossypium hirsutum
  unsure (1)..(429): unsure at all n locations
  Clone ID: uC-gsronu33B132h05b1
attgtgggttgtgttgagaataggttgatatacatattttactctctgcccaattatattgtgttaggttttcctggtttgcacgtaattttatataaaaaaaaccatttacaaatggattgttctgtttaaaagactgccatctttttatttgaataagctagttcagcaacagattaagattgagagggaaaaaaagtttaatctgaaaattttgtatttgaataggaaaagaaaaagaaagaaatcctcttaaactgttaaaacttaggtgatagttttttctttatataaaatggtctgtttaatggaaagatgataatgagatagctttataataacaagtttagttgtaaatgtttatacattgtgtttagncgatgtttatttacacaatgcatatttagaagttatagcaatttttttttt

SEQ ID NO: 7879 - DNA, 436 bp, Gossypium hirsutum
  Clone ID: uC-gsronu33B132h06b1
acccatcttgaaattggctggcagtctatcccttgctgtaaaatctgttaggtatactcgtgggagttttatattccctggtgctcagccatttcctcaccgaaacttctctgaagaggttgctgttcttgataactatttcgggaagcttggcgctggtagcaaggcttgtgtaatgggtgggctggataaacagaaatggcatgtgtactctgcatctgcagaacctgtgaccgccactggcccggtttacactctagaaatgtgcttgactggtttggacagggataaagcgtcggttttctacaaagaccaatcaggctccgcagctgtgatgaccattaattctggcataaggaagatccttccagagtctgagatatgtgattttgagtttgaccctgtggttactcgatgaatgcgatgaaggtgctgc

SEQ ID NO: 7880 - DNA, 423 bp, Gossypium hirsutum
  Clone ID: uC-gsronu33B132h07b1
tccacgcgtccgcccacgcgtccgggaaaattccagactacctcgaatctattgcaatccaaatcgaaaaagatcgtggaaaaactactgatgtttttcatatccccactcaagttctgctctgcgctgcgatcaaagagatgaaagatttttcggttggggatttggattggggtaccttgaaaaagtggagcgcgacacttaattatgctaagaaatatggttttcaggtaggatttgctgataatctgttgaggaagaatttgcttgcctattttactattcaaaatctgcccaaatcgaccgtaaaaatgtagcttcgcaagagcaaatggttgtgttgctgttgctggcttgctgcagtctacaaaaatattggctttaaagtgtttgttcttgacttcgggtatctatatttacttt

SEQ ID NO: 7881 - DNA, 462 bp, Gossypium hirsutum
  Clone ID: uC-gsronu33B132h08b1
ttgttttgctctgaccatggcagctataggaatttctcaatcgagctcctttgctcctgattctggcaaagccaagagcgctgccgcttccatatttgcgattattgatcgcgagtctaagatagaccccagcgatgagtccggaatgaaactagaaaacgtgaagggagacatcgaacttcatcatgtcagctttaagtatccatcgaggccggatattcaaattcttcgagacttgagcttgtctattcgttccggcaagactgttgcattggttggagaaagtgggagcgggaaatccacagtaatctcattactgcagagattttatgatcccgattcgggacgtatcagtctcgatggtgtcgacatccaaaagctccaattgaaatggctgaggcaacaaatgggacttgtgagccaagaacctgtattattcaatgatacaatccgtgccaacat

SEQ ID NO: 7882 - DNA, 448 bp, Gossypium hirsutum
  unsure (1)..(448): unsure at all n locations
  Clone ID: uC-gsronu33B132h10b1
tccacgcgtccgattttagggcagtgttgtgagatgccggttggctacgtgcaaattcccgttggaattgccgggcctttgttggttaatggaagagagtactcggttcctatggcaaccacggaagggtgcttggtggctagcactaataggggctgtaaggctattcatttgtctggtggagctacaagtgttctattgaaagatggtatgacaagagctccatgtgtaaggttcggtactgcgaaaagggcagctgatttgaagttgtatttggaggaccctgataatttcgagaccttgtctgttgttttcaacagatcaagtagatttggcaggctccagggtatcaaatgtgcaattgctggaaagaatctgtatattagattcacttgcagtacaggtgatgctatgnggatgaacatggtttccaagggagtgcaaaacg

SEQ ID NO: 7883 - DNA, 373 bp, Gossypium hirsutum
  Clone ID: uC-gsronu33B132h11b1
tccacgcgtacgaataaaagtgaatgaaaatttctctcgtttgagaagtgaatcactacaaaatatatatcttccgcaggtgctcttatttgatgtaataggaggcagaattacttaaggctgtagagtagaaacggaggttgctttctcttttatgaatttctcttcttcttttttcactctttcttttgaagtatattaagataaatctaaatgttcttgctaaagagcaagattattgagcactttaaataaaattcaagcaattatgtgccaaaaagaaaaaaaaaaagaaaagaacttatacaaagaacaaaaaagcttccgaacttttaaaaaaccaacattatgtcaaaagggaaataccttgaaa

SEQ ID NO: 7884 - DNA, 447 bp, Gossypium hirsutum
  Clone ID: uC-gsronu33B132h12b1
tatatgtgggtgtggattggtcaaggctttccagaagacctactacaacaactacgggggtggtgcgaacgagctccaaccagggttcaacaagggcactggactgggtgccgagatcattggtacctttgttcttgtctacactgtcttcgccgccactgatcctaagaggaatgcaagagattcccatgttcctgtgttggcaccactccccattggattcgctgtgttcatggttcaccttgccacaattccagtcactggcactggtatcaaccctgctaggagttttggagctgctgtcatttacaacaaagagaaggcctgggatgaccaatggatcttctgggtcggacccttcattggagctgccgcagctgcattctaccaccaatacattctcagagccgcagccatcaaggctcttggatctttcaggagcaatgc

SEQ ID NO: 7885 - DNA, 521 bp, Gossypium hirsutum
  Clone ID: uC-gsronu33B134a03b1
attctgcaaaggtttttagtgtgttgtcatggagctggtcttctaagtcccttcagcttgcaagagatgcttttcagtgtcgatatagcgaaccatgcaatcctggagctcattgcattactcttgataagctatatgttgcagagcagaagctttacaagcaagtaaaggaggaagaagttaccaaattggagcttgaaaagaaattgatgttgctccaaaagcaagatgaaaaccgtgactggacgaagactcagaaaatcaaatcaagtgttgagaatctggagaatgacatgacacgcttgcaacattcaataagtacagcctgttcatctatattggagctcattgatgaggagctttacccacaactggttgcattaacttcgggtctgatggagatgtggaagatgatgtacaaatctcatcaatttcagaaccatatttcaaagcagttgaatcatctcactgataatttaagcatggatctgactactgaatcccgtcttcaggctacagct

SEQ ID NO: 7886 - DNA, 414 bp, Gossypium hirsutum
  Clone ID: uC-gsronu33B134a05b1
gtctgtctgagatgaggaaagctgttaagatttcaaagtatggatcggttatgccaatttccggatccgattttgtacgggaggtttcgcaagctcctcaggatgtctgggttgttgtcattctctacaaagaaggatttccagagtgtgggctgctcttgcagtgtttggaagaattggcagttaaataccctgcaacaaagtttgtcaagataatatctacagattgcattcctaactacccagatcgtaatcttcccacactcttggtgtataacaacggagcggtgaaagcaaattatgtaggcttgcatagttttggccgcagatgcacgcctgaaggtgtggccttagttctttgtcaatcagatcctgtactgaatgatggtcaaagtgggagcaatgcatctgttc

SEQ ID NO: 7887 - DNA, 365 bp, Gossypium hirsutum
  Clone ID: uC-gsronu33B134a06b1
atctggtttgactgtgatagataatcttggtcagatgagccagtctctggggtatgattatactcacatatttgtatctatgattagcatttggaactatcttggtcgtgttggtgggggttacttctcagagattatcgtgagggactcacgcttatccatggccagtatctatggctgtggctcagcttgctatggctgctggtcatgttttctttgctatgggatggcctggcgcaatgtacgtcggtactttattaatagggcttggctatggtgctcattgttcaattgtcccggctgctgactctgagttgatcggctagaaaaagtttggggctctgcacaatttcctcacgctggca

SEQ ID NO: 7888 - DNA, 430 bp, Gossypium hirsutum
  Clone ID: uC-gsronu33B134a08b1
tcgtccacgcgtccgctttgagaaacacaggtgcaggcctgatatgtccatttggcgattccaagctctcatcaatgggtctctcagttgagaatgcggtaacacaatctcatacccgaacccacaaaacctttctcatcaccaactacatgctcttgggagctgcttgcgcctgtatcttactcatcctgtccctacgcttgataccgtccttgtgtggattcttccttatcctcctccacggggtcaccatagccgccgtcgtctcgggttgctccgtcgtcacttacgggttcaacaagttgtacgcagctcacatggcagtgatggtgttgacatcgatactccagggctaggtgttggtgcttatattgacccgaacttctgacttcttgggggacttgaagtcctacatgagggatgatgatgg

SEQ ID NO: 7889 - DNA, 455 bp, Gossypium hirsutum
  Clone ID: uC-gsronu33B134b02b1
cccactcgtccgcccacgcgtccgcccacgcgtccgcgctttatgttaatgttagctacaatagaatatctggtcagattccagctgaaatgagtaaaatttgcaaatctctcaaatttttggatgtgtctgggaatcaaattactgggtccattccgcctagcattggagacttggtttcacttgtttcgcttaatttgagctggaacctgttacgaggctggattccgagcaattttgggcggatcaagaatctccggtatctttctttgtctgataacaatctgaccggatctattccttccacctttggccggttgcaatctttagaaattttggagatgtcgtcaaattctctttctggtgaaattcctgaaggtctggttaatctgagaaacctgactgttcttctgctcaataacaacaaactctttgggcaaattccctctggtttg

SEQ ID NO: 7890 - DNA, 514 bp, Gossypium hirsutum
  Clone ID: uC-gsronu33B134b04b1
tttgtgggaaaaaggaccctggtgtgattccgttggctcagaatctatctaatttgatgaggcttgttgtgttatacaagtacggaggtgtttacttggatacggatttcatagtgatgaggagttttaaagggttgaagaacacaattggagcacaaagcattgatgtggtatctaagaactggacaagattgaacaatgcagtactggtctttgatatgaaacatccacttgtactcaagtttattgaggaatttgctttaacttttgatgggaacaaatggggacataatgggccctatatggtttccagggtagttcgcagagtagaaggcagacctggttataattttacaatcttaccacctatggctttttatcctgttgattggattaaaataggaggtctgtttaagatgcctaaagacagggcaggctcgagatggatagaggttaaggtgcagcagctaaagaggcatacatatggagtacatctctggaataagcaagtagc

SEQ ID NO: 7891 - DNA, 475 bp, Gossypium hirsutum
  Clone ID: uC-gsronu33B134c04b1
cccactcgtccgcccacgcgtccgaaaaaaaaaaaggggaaaaataaaaaaaaaaaaaggaaaaaaaaaaaaaaaaaaaaaagaaaaaaaaaacaaaataaaaaaaaaaaaaaaaaaaataaaagattgggtaataaagaaagccaaaagggtgtgcaaaaaagaaaggtgatcctgaggttaaagtataagttgatattagagagcggggacccatgggagtgatttggcaagttgccgacaagatcaatgctgatttgctttatattggaaagccatgattatggcctgattaagagggcattcttggggagtgaagcaatcactgggcaccaaaacttaaaatgccctgttttgatagttaagaagcccacatgttcctttttctgcaagtggaaccaaaaggattgaaattttcggattacataggcctactttgttttgtttatgtacaaaatttactttagtgggtatg

SEQ ID NO: 7892 - DNA, 542 bp, Gossypium hirsutum
  unsure (1)..(542): unsure at all n locations
  Clone ID: uC-gsronu33B134c07b1
gtttaccttatgtccaattattcagtcatgcattggtcatcattgtcatgtcatctctctgagatccttaatttctctgggcacgtggcacctactgagaaacatccgggaagtttattagaaggttttacacaaacccaaataagtacactggcggtcaaagacaattttatggttgcaggaggtttccaaggagagcttacttttaagcacttggacagaaaaggggtagcattttgtacgcgaacaacctatgacgataatgcaattacaaatgctattgagatatacgacagcttgaggggtggaatcaattttatggctgccaataatgactgtagcatgagagaatatgatacggagagatttcagcttctaaaccatctccgtttcccttggccagtaaatcatacatcagtcagccctgaccgaaggcttattactgttgttggagatagcttggatgggtngcttgtggatttgcataacggaaagactgtagcaacggtggtaggtcatctagattactccttngcatctgc

SEQ ID NO: 7893 - DNA, 352 bp, Gossypium hirsutum
  Clone ID: uC-gsronu33B134c08b1
tgctttcaaagctgctcccgaacccaaatgaggaccggaaaatggcagatggcttgttctgcgacggctgacagggcggcgacgatcaggacacggaagctcatgaccaacccgctactttccaggaaacacttagcacattgatagcattgcatccagagcggcccactgctgccaatgcggaatcttatgataagctttgtaggatgtctgaggtgaaggacccatattctatctcagtgttcaagcacaggactcattctggtcggggtgattctactgcacttgcgttgacatcatgattctgctcagagagcatgagtaaggacgagcccagacacaggctgatcag

SEQ ID NO: 7894 - DNA, 511 bp, Gossypium hirsutum
  Clone ID: uC-gsronu33B134c11b1
ggttctcataactcctcaaaattcttcttcaatggcgtctcgagttcttgttttggcttcaattcttattttctcttgttttgcagagacatgctatggggcgatctcattctcatcccttcaaagaacacttgttgttactgcttctcatagacaaggacttttgaaagccggggaagacaagatcacagtgagatggggattgaaccagagtttcccggccgggaccgactcgtcttataagaccatcaaggtccagctttgctatgcacccatcagccaagtcgaccgtgcatggcggaaaaccgaggaccatcttaacaaagacaagacatgccagttcaagatagtcaagaaaccctacatcaacgtcaacgaaacccttgaatggaccatcgaaagagacgtgccgacggcgacgttctatatccgagcctacgctgtggactccgacgaccacgaggtggcgtacggtcattacaccgacgctcagaagataccaatctgtttg

SEQ ID NO: 7895 - DNA, 404 bp, Gossypium hirsutum
  Clone ID: uC-gsronu33B134d01b1
cgttttgtttaccggcatattgaataactataccttcacggggctctttaaaaaaaaatgtcttttggtagcaacagcggatctagctgcagctgcggcgacagctgctcatgcagcaggaaccttaaccctggatactcggagaagacaaccagcactcagaccatcatctccggagttgcgccagtgaagatgacctacgagggaccagagatgagcactactgaatcaggacatggatgcaagtgtggatcaaactgctcttgtgatccatgcaactgttgaaaagcttgatgaaagccctagattatgaaaaaagaaagcagccaactaacaggcctctgtaatgatttaatttcaaggatgaatgccctgcaaggactatgactataattatgcctctg

SEQ ID NO: 7896 - DNA, 325 bp, Gossypium hirsutum
  Clone ID: uC-gsronu33B134d02b1
tgcttacccgtgggcggacgcgtggtgaagggcccatttttgggggttgttcttccccataggaccgcaggcatgcgaatggttcggattatagtgcaagtcctaggggaaggagctgaagccctgatgctgaggatggggcttatcggagctctaggaaggaaaatggccacagccgcagccttagtccaccccctaggaatgacaggagccctgtttacaatgatgatgatgataatcatgcgtttcccagacgcagtgaatcaaattaaggcaggcaggcaagcggtggttcaaattcatgttttaagggccatgtgtgttt

SEQ ID NO: 7897 - DNA, 542 bp, Gossypium hirsutum
  unsure (1)..(542): unsure at all n locations
  Clone ID: uC-gsronu33B134d03b1
cttcgtttggctctgtcttcagcagctattgtattgcgcataggtttagtgaggctaccatgagttttgatgtcatggatagatacggtgtagaacaagatgttgttgcagtcaattcacttcttagtgcaatttgccacgaggacaatcagatgtcggttgcaatagagttttttgataagatcaagatgaagatcccacctgatggggatacttttgccattttgctcgaagggtgggagaaagaaggcaatttggctaaggccaagaacacgttcggcgagatggtagtcagagtaggatggagtccgaagcacatttctgcttacgatgcctttttgaccacgcttgttcgtggctctcaagtcgatgaagctctcaaatttttgcaagttatgaagaagaatgactgcttaccaggtttgaaatttttctctaacactctcgatattctcgtcaagcaaaatgattcagcccaaataattncattgtgggatacaatggtgngtggtgggctgggtgccaatttgattatgtacaat

SEQ ID NO: 7898 - DNA, 516 bp, Gossypium hirsutum
  unsure (1)..(516): unsure at all n locations
  Clone ID: uC-gsronu33B134e05b1
ttttgcacttctaaaacctttagcttttctcagagatggctcagggaaggggcagtgcaagtcaagcgaccatgtccgcaattgcattgctattgtgcttaatggtttgcctggaaaccattgatgcagctacttacactgtcggtggctctaatggttggacttttaacacggctacttggccaaaagggaagcggttcagggccggcgacgtgctaggtaactccaaataactaaacaaaatgattaaaatatttcctagtttgtgtctgaagtaaaaaaaactttgtactgtgatgttgcagtgttcaactacaatgggactatccacaatgtggtagcagtgaacagaggagggtacactagttgtaccgcacctgcaggtgcaaaagtgtacaactcagggaaagataagataaaactggccaagggactcaacttctttatgtgccacactgctggtcactgtgagtcctgaatgaagatngcaataatgcagtgtgatacagattattg

SEQ ID NO: 7899 - DNA, 470 bp, Gossypium hirsutum
  Clone ID: uC-gsronu33B134e09b1
ttgtgtttgtctattgaattctttccttcactttctcgagaaaaaaaaatgtcttcaggttgcaattgcggatctagctgcagctgcggcgacagctgctcatgcagcaggaaccttaaccttggatactcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagcaaaataacaggcctctgtaatgatttattttcaaggatgaatgcctgcaaggtctatgactataattatgtctctgcctgtgtcttgtgtaatagaagctttgtttgtggtgaaaataatgtataagccagttggttgggagcaaatttttc

SEQ ID NO: 7900 - DNA, 210 bp, Gossypium hirsutum
  Clone ID: uC-gsronu33B134e11b1
gccggaccgacccacgcgttttgtttttggtccaaggaccacttctaacatgacatgtacatggatgagctgcctatagtgccttccaatacatcctacaatggggcatcggtctgctggcactactatgacgactctaatcctggtctcactctgtgggacaacaacattggccgatgctgcgccactggatacagcctcttacggtcc

SEQ ID NO: 7901 - DNA, 392 bp, Gossypium hirsutum
  Clone ID: uC-gsronu33B134f02b1
tttactcgttcggctagggctgctaggaacactctctacaaagcataccttgaagatttttacaagttttgtcagaaactaggcggtgcaactgcagagataatgtctgacctcttagcctttgaagctgataggagagctgacaatattacaattaacagcattggaactgaacttactcgtgatgatcgtaggaaattatactctaatttcggtctgctttatccttatggtcacgaggaacttgctgtctgtgaagatattgaccaggttcgtggtgcaatggaaaaatatgctccctatcaatcgattttgtctaaattatcatatggagaaagtcaaatgcttgacaaagcattttacgaggaggaagtgaacaggctttgcttagc

SEQ ID NO: 7902 - DNA, 513 bp, Gossypium hirsutum
  Clone ID: uC-gsronu33B134f06b1
ctttccaatacaaagcttcatattatcttttttaggtccgacaaaagaaaacgaaaaaaatagaagaaatacaatcgttttctttttgaagtcgggttttagtttttggggagaaaaaaatgttgggagtatttagcagtgcgatagtgtctccgccggacgagctggtggcggccggttgccgaactccatcacctaagataacggcggatgctctggtgaaacggttccttgagacgaactcctccggcgtgtccatgcagatcggagaccatgtccaattcgcttattctcaccataaagagtctcctttacggcccagatcatttgctgtgaaagatgaaatcttctgcttgtttgagggagcccttgataacttggggagtttaaagcagcaatatggtctggcaaagtcggcaaatgaagtgattttggtcattgaagcttacaaggcccttcgtgaccgagcaccttatcctccaaaccatgtggttggccatctaattgggagct

SEQ ID NO: 7903 - DNA, 158 bp, Gossypium hirsutum
  Clone ID: uC-gsronu33B134f09b1
cgcgtgggcggacgcgtgggcggatttgatgttccaatctatgtttggacaatcttatgtgttttgtcttggaaattttaagaacactgttttagaaatattatttaaaaatgtttgtgcttaataatactagacaggataaaataaatcctaaaatg

SEQ ID NO: 7904 - DNA, 405 bp, Gossypium hirsutum
  unsure (1)..(405): unsure at all n locations
  Clone ID: uC-gsronu33B134f12b1
cttttctttactttcctctcatttctcttcttggccttccattctcaatccggggctcgtctccaatccttcgttgattttcagcataccctgggacccttatttccagatagcccaaaattcataacagaagaggcggctctggtatgaagtaagctgatcaaagatccaggacattcgcgaaaaatatggtcgattgtttcagccatttctccacatcgggggcagcttgtactactaacaagttttcggtgctgcatattaaccctgtcggcaaatagttccatgaaattctccatactgtaactttgattttatttggaagatttaggagtcaaagtttttttgtaaaaattcctgtaatcaatttgtaaagcgtaagctctaggaatttcatcctatang

SEQ ID NO: 7905 - DNA, 110 bp, Gossypium hirsutum
  Clone ID: uC-gsronu33B134g05b1
ctctctcgtccgaaaaaaaaaaaaaaaaaaaaaaaaaaaaaaaaaaaaaaaaaaaaaaaaaaaaataaaagaaagtagaagattttaatataccaagtcaacaaagaaat

SEQ ID NO: 7906 - DNA, 501 bp, Gossypium hirsutum
  Clone ID: uC-gsronu33B134g06b1
cttacgcgtccgctcgaaaccctagtttttttagtttccgtttttgcaagttgtagattttgaggactatacactggtgtttcatatgctgggattttgaagtttgaatacttgaacttttaatcatcttttcaagacctctggatcggcggaatggctaatatctctgcagactcgccgactcctttggcaacggatgcaggaccggataattcttctacggaagatgcaccgtcgaagctgtcatcgtggactagaaatttaaaaattcctcagccttttgctgcctctcaagaggagttaacacctacagggattgctgggaaatcaactttttctcggtttactagcgggctaggattgcggtcgccttcaaaatctactactgcagatggtaacgctgatggagcttcgacaacaacccaacctggttttcttggaacaattacaaaaggcatagttgactcatctaaaaatgctgtgaaagctgtacaggtcaag

SEQ ID NO: 7907 - DNA, 370 bp, Gossypium hirsutum
  Clone ID: uC-gsronu33B134g09b1
tattgcctctactccaaagccttccagcactagtcagggatcacaaagagcagcagctgtagctgctctttcctcggttcttactgctgaaaagaagaaacaatcacctgatgcatcccctataaaatccactagcagcactcctgcagtaaccagtccgcctcctgaagcaaagagtgaagtggacccttctgaactagcagattctcgagaggttcctgaagccaaggagacaggtgtagtatctgaaaccagtggggaggattcagaaccaaaacaagagagagagcaggatgagaatgggaatggaagcactcaaagtactttcagttacgagcaattgaaggcgaaatccgaaaatcctgtaact

SEQ ID NO: 7908 - DNA, 363 bp, Gossypium hirsutum
  Clone ID: uC-gsronu33B134g12b1
acacccacacatactaacatctatggggagtgcatggcagcatgtctcctggaaattgccggatcacccaacactttcaagggggaagacccttgctctcatcgttctcgatggctggggcgtgtacaaacccgatgagtacaattgcattcatgttgctcaaactcccaccatggattctgtcaaacagggcgcccccggaaagtggagattcatcagagctcatggtaaggctgtagggctccccacagaggatgacatgggaaacagcgtatttggtcacaatgctctcggtgcaagccgcattttctgtcaaggggctaagcttgttgatattgaccttgcctctggaaaaatctatga

SEQ ID NO: 7909 - DNA, 365 bp, Gossypium hirsutum
  Clone ID: uC-gsronu33B134h01b1
ttactcgtccgctgctaagagcattgtagcagatggccttgcccgaaggtgcctcgtgcaagtctcctatgcaattggtgtgtccgagcccttgtctgtcttcgttgacagctacggaactggaaagattccagacaaggaaattctccaaattgtgaaggagaacttcgactttaggcctggcatgatcacaaacaacctggacctcaagaggggtggcaataaccggttcttgaagacagctgcctatggacattttggaagggacgaccctgactttcacctgggaagttgtgaagccccttatgtgggacgagtctcaatcttaaaccaagctttgcccatccctcctgctcactgcttac

SEQ ID NO: 7910 - DNA, 364 bp, Gossypium hirsutum
  Clone ID: uC-gsronu33B134h03b1
cttattcgtccgggcttgtcgtatgttttgcctggggccggatagatacttggtgcgtgccaataaatagagtgaagcactaatatttacttgtttttctgtccagcgtgagcatctctgctatctcaggatctattgtgactattacataattaatgtaaggaagtgagtcagattcctaatgaatgagaagaagctcctatttcgttttaaataaaaaaaagtaattttacaatccgaaagcgaatctaaaagatccaacaataacctccttccatttccatgaattgtgaaagctctccttcggccttctggggctgcccttatacaggatccaattttccttacactgattctggaatga

SEQ ID NO: 7911 - DNA, 473 bp, Gossypium hirsutum
  unsure (1)..(473): unsure at all n locations
  Clone ID: uC-gsronu33B134h08b1
tttgtcgcgtgggctactacttcagatagcaggggaaggaaaaatcggcggcggcagaagaagacgatggtggtgcaccccgttcaacggcttttcgatgcttgcaaggacgttttcgcccatgccgggactggatttgtcccaccccctgataaaattgagcagcttagcgctcttttggatgacattaagccggttgatgttggtcttagtccacgaatgtcatttttcagtccgcaagcagctcggcgagctccaacaataacctacctgcatattcatgaatgtgaaaagttttcgatgggcatcttttgcttgcctccatccggtgttcttccccttcacaatcatcctggaatgacngtattcagtaagcttctcttcggaactatgcacataatatcgtacattggngtngttgggtgccctagcaatgcataagctgttgcggaacctttacatacagcacaatg

SEQ ID NO: 7912 - DNA, 450 bp, Gossypium hirsutum
  unsure (1)..(450): unsure at all n locations
  Clone ID: uC-gsronu33B134h09b1
tcttagctctttgtttaaaaattttcaaatttaggtttgcatattaagatctaaccttttcatttgcagacgcactctcagatcccagctctagaacttcaattctctccctaaaagtttgtagacaaatgggagaaacaagagacaacgatgtctacgaggaagatctcctcgattacgatgaagaagaagagaaagcccctgactctgtcactgctaaagtcaatggcgaggctggcaagaagggctatgttgggattcacagttctggattcagagacttccttttgaaaccagagcnttcttcggccattgtcgattctggattcgagcacccttccgaagtgcaacatgaatgtattccccaagctatactggatttggatgttatttgccaagctaaatcaggaatggggaagactgcagtttttgttctatcttcattacagc

SEQ ID NO: 7913 - DNA, 432 bp, Gossypium hirsutum
  Clone ID: uC-gsronu33B134h10b1
tcggtttaccaagaagtgaataccatgcaggacaggggcatctgctaacgttggtatcttaaggcagtggaggggggccctttatatgctgcgattgtgaagagcagggatctggttgggcttaccaatgtctggagtgtgggtacgaggtgcacccaaggtgcatcagagctgtcacccctcaaagctcaattgaagacaggtgactgtcacctcacctcacctcaactggcttttatgctaattgaattctgatcaatccatcatgccatcacctcttaatatctataattctctctctatatcacttgatatgtgggttttctactgagaatactatgttattgtagctaaagccgtgaacatcatttgactgtaacaaataaaatgtgtgttccaactgtttttttaaaaaaatatattcctacaaca

SEQ ID NO: 7914 - DNA, 433 bp, Gossypium hirsutum
  Clone ID: uC-gsronu33B134h11b1
ttttccgcgtccgattggtacaagggtcctactgtccttgtggctcttgaccagatcaccgagcccaagaggccctcggataagccactccgtcttccacttcaggatgtctacaagattggtggtattggaactgtccctgttggtcgtgttgaaactggtgtcctcaaacccggtatggttgttacttttggtcctactggtctgaccactgaagttaagtctgttgagatgcaccatgaatccctcccggaagctttccctggtgacaatgttgggttcaacgttaaaaacgttgctgttaaggatcttaaacgtggttttgttgcttcaaactccaaggatgatccggccaaggaagctgccaacttcacctctgaggttatcatcatgaaccaccctggccaaattggaaatggttatgccccagtcc

SEQ ID NO: 7915 - DNA, 478 bp, Gossypium hirsutum
  unsure (1)..(478): unsure at all n locations
  Clone ID: uC-gsronu33B136a03b1
ctttattcgggaggcaatcatctgagtcgtttaggagacactgtacttcgggtccattgagaacggggagaggcaatcgtttctggcataaaatgcaacaattatcacggggcagcatcagtgaacatagtgctatgatcaagttctggtcagattcacattaaaaccaatgtcacttgccctttgagttttgaatgtcgaatgacaaactgacggcacctgctccgcatgcctgatgaaaaatgttgtgctggtttcggaactgggaatttaacatggtaaactcttgtgctgcgagattcttaacccgaaaccctgagtagctttcgttacgcagctgatcgatgaagcatatagagccaaagtattcttttatttttcgtgttttttttctgatagggggaangagtttcatatgatcatcctcacactccaaatttgtacagttggngtttgtgtttttcacataaggaattaa

SEQ ID NO: 7916 - DNA, 309 bp, Gossypium hirsutum
  Clone ID: uC-gsronu33B136a08b1
tccacgtcgggcgatacacagacacaaccagggggcactgtactccgggagcagagtcaacccacagaggaaatccttcaccgcacgaaacgcaacaaacacaaacggggccgcatccgcgcacatacggccataaacaaaaccaggtcagattcacagcaaaaccaacgtgactcgcccttagagtctcgcaaggctaaagaccgaccgagcgcgagctgctccacatgcctgatgaaaaatgcaccacagccaccgccactggggaattgcaccacgcgaactcccgggctcaacaagtcctacccc

SEQ ID NO: 7917 - DNA, 352 bp, Gossypium hirsutum
  Clone ID: uC-gsronu33B136a12b1
gttaactgtgaataagtgaattgacatccaagcgttccattccatttccgtatagttcaaaaacacttgagtaccttcgatcatattttagtgtcaaaaatggccgaggagcataccagtaaggcccctgagttggagagcaacgttagcggtgaaggagcagtggagagcaaggaccgagggttgttcgatttcatggggaagaaagaagaggagaagcctcaagaggaggtgatcgtaaccgagtttgaaaaggttactatcgaagagacaaaggcagaggaagaaggtgaggagaagaagaagcatggtcctctggagaagcttcaccgatcagatagcagcagcttca

SEQ ID NO: 7918 - DNA, 513 bp, Gossypium hirsutum
  Clone ID: uC-gsronu33B136b01b1
ccgcccacgcgtccgcccacgcgtccgcctggctcgagttccctgtcaaaatctactttcaaagaaatgtgcaagggctttagcattgcctttgaggaggtatacaaaaaccaaacaagttggtgcatcccagatccacagcttcgcgaagatttgcggatttcgacttcacttaaagtagtccatgcataccggacttttcttggaagaaatcctgctcatgttgatgataaatgcattaagcatactgttgaagatgtcgaaaaattgctctttggccttttcgaaggatcgccaagatcgttgcgcaattcacgaagaatgatgaagacataagctgtcaagttttagccatttttgggtattttcttctgaatcaagtctgtattttcgtagatataaaatgtgattgtaattaacatgtttcatttccaaagttttctgtttctgattgcttatgattgactttgcctatgttttctcttggcttgaaataacattgttataaacatg

SEQ ID NO: 7919 - DNA, 399 bp, Gossypium hirsutum
  Clone ID: uC-gsronu33B136b03b1
ttttacgtgattctaactcctactggactccaaagcaaaacaagctatttgaaagggcacttgctgtatatgacaaggacactccagaccgctggcaaaaggtggctgcagctgtgggggagaaatcagtcgaggaagtaagaaggcattatgagatcctagtgagggatctcatgtatatagaatctggtcaaatccctatacccaattacaaaagcactgggagtaacagaagatgaattgctggggtgcaaaggtttatgaagaatctaaggctccaatgaagcacaagtttcagctgcactgtcagagaatctgtaaaaactaaaataaaaagaataaattataaagaactggagaatttgcatcgtgattctccctgtcttattttacttgagt

SEQ ID NO: 7920 - DNA, 526 bp, Gossypium hirsutum
  Clone ID: uC-gsronu33B136b08b1
ccaaagagggtcctctctctctctctctctctttctggaatcagaagaataattcttcggcatctcagaacacttttatttttaattattcaaattatttttttaccttttttttttcatataaaactaaaaaattcttttgttagtttagtttactgtaaatttgaaagcaaaatttttagattcagttaaaaaaaaattcaaaatcatgacttcagctgtcgagatcaacggtgaacaactagttaacgctcttcccgatctctcgattcaagatcagattgaagtgaagaagaaaggggctgttgttgaagaaggttgcgaaaaccacagtggaatatgcgcgatttgtttagataagataatgttgcaggaaactgcactcgtaaaaggttgcgagcatgcttactgtgtgacgtgcatccttcgatgggcaacatacagtcagatgcctacgtgccctcagtgtaaacatccatttgagttccttgatgctcatcgttcgcttgatggcagaatccatgac

SEQ ID NO: 7921 - DNA, 465 bp, Gossypium hirsutum
  unsure (1)..(465): unsure at all n locations
  Clone ID: uC-gsronu33B136b09b1
ttgtcttttccattaaaccaacaacaacaacaaagaaccaatcacccagagttaaccaaaagagaaaatggtcaccaaagtctacattgtatactattccatgtatggacatgttgagaaactggcccaagagatgaagaaaggagctgaatctgtcgagggagtggaagtcaaactttggcaggtagcagaaacactaccagaagaagttcttgggaaaatgggagcaccaccaaagacagatgcccctatcataacaccagatgagctgacggaggcagatggtgtgctatttgggtttccaactagatttgggatgatggctgcacagtttaaagcattcatggatgcaactggtggtctatggagaacacangcccttgctggtaaacctgctggcattttctacagcactggcttccaaggtggtggacaagaaactactccctaactgcatcactcaac

SEQ ID NO: 7922 - DNA, 508 bp, Gossypium hirsutum
  unsure (1)..(508): unsure at all n locations
  Clone ID: uC-gsronu33B136b11b1
ttcttttgggggcgaagagctgctacaaccttgtatgtggaacggtaccagacgaccatgttacctatttgcaaggaaattctatccagaaaccttagataaattggtgacactcctcaatttttgactgaatacattggtcggatcggtcatattttcttcgttccatctcgtttttacgtagaggtttatacatttgtaaatggccttgttttgcaatcacacaattcttgagtgcaagcctgcaagggtaacaggaagagaacaacgaggatgacaattgaacaaggccggagggtaacgagtttgttagggttgcgtccttccggacaggtaatttcttgtccattttctcccccattttgtgccattgatcatatatgaaaaagaacataaggggaaactcttttttcttcttctgtaaaagattgcaaacatgactggtgcacccttttctagaaatataaaggcttaactttaanatncaaaaaaaaaaaaaagggcgggc

SEQ ID NO: 7923 - DNA, 501 bp, Gossypium hirsutum
  unsure (1)..(501): unsure at all n locations
  Clone ID: uC-gsronu33B136c02b1
atttattaattggcttttattttcttttttaggtttgaagctctaagtccagctagattttcacttttcgggtggagaatgccgatttctcgaattgcagtaggctccccagcggaagctagccaatccgatgccctcaaggcagctctagctgagtttatttcaatgctcatctttgttttcgccggcgaaggctccggcatggcttttaacaagctcactgacaatggctcatcaacaccggcgggattagtagcggcatcagtggctcacgccttcgcgttgtttgtggcggtttccgtcggtgctaacatctccggtgggcacgtaaaccctgccgtcacattcggtgcctttgttggtggccatattacattgttcaggagtattttgtactggattgctcagttgctcggatccgttggtgcttgcttgcttctcaagtttcaactggtggactgacacatcagctttagcttgtcatctggngtagagcatgga

SEQ ID NO: 7924 - DNA, 503 bp, Gossypium hirsutum
  Clone ID: uC-gsronu33B136c08b1
actcgtccgcccacgcgtccgcccacgcgtgctaaaaagaaaagaacgctcaaaggatttgcagcaatgggtctctcaaaggcttctctaatccttgttctcgtcgctgtttgtactcttatgggttcagccatcgctgctgaatccccagcaccgagtcccacctcaggaaccggctccatctccccctcattcgtctctgttttctttgccgctgtcacggctctgctttttggctctactcacaggatctgaagggtgttggctattgatggtgtagagagggtgtttgatttctcatttatatagatttgattttgggggggtgaattttatatggagttttagtatatctaggagtccctatatatataaatatgcgagagtcgagagaggtagttttgttatctactgtacagattattcatggtggatgatgcttggacttttgtttcagtatcattatggattgatatcattttcattaaaaaaaaaacaaaggg

SEQ ID NO: 7925 - DNA, 586 bp, Gossypium hirsutum
  Clone ID: uC-gsronu33B136c10b1
cttacgcgtccggcgagacccttgacgatatcaagatgcacctctccgccaccgaatacggtccttacctccaaaatgaaccttcaccattgcatacgactactattgtggagaaatgcactcttaagctcgttgatgagtataagcatatgctatgccaggctaccgagccattgtccaccttcttagagtatatcacatatggtcacatgatagacaatgttgtcttgattgttactggaaccttgcatgagagagatgttcaagagcttttggagaaatgccatcctttgggcatgtttgatagcattgcaaccctggcagttgctcagaacatgcgtgaactctatagattggttctcgttgacactccactggctccatacttttctgaatgtattacatctgaggaccttgatgacatgaacattgaaattatgaggaacactctctacaaagcataccttgaagatttttacaagttttgtcagaaactaggcggtgcaactgcagagataatgtctgacctcttagccttgaagctgataggagagctgtcaatataccatttacagcattggaactg

SEQ ID NO: 7926 - DNA, 549 bp, Gossypium hirsutum
  Clone ID: uC-gsronu33B136d04b1
gtttatttttctaccattcgctgcaaaatcaaatccaaaatctctctgcgattttctgcatagggatcagcaattagggcagagaaatggggctgacgttcacgaagctttgtagccggctttatgctaagaaggagatgcggattttgatggtgggtcttgatgcaaccgggaagactaccatcttgtacaagctcaagctcggagaaattgttaccaccattacaaccatcggatttaatgtggagactgtggaatataagaacatcaatttcactgtgtgggatggtggtgggcaggacaagattcgggcgttgtggaggcattacttccagaatacacagggtctcatcttcgtgggtggcagcaacgacagagaccgtgttgttgaagctagggatgattagcataaaatgttgaatgaggatgagctgcgagatgcaatattgcttgtatgttgcaacaagcatgatcttccaaacgcaatgaatgctgctgaaataactgataagcttggacttaattcccttcgacagagtcactggtaca

SEQ ID NO: 7927 - DNA, 478 bp, Gossypium hirsutum
  Clone ID: uC-gsronu33B136d09b1
ttgctcacgcgtccgcattcatttgtttgggaacttgattattgaatcacacctgaaagcttctacatgggtgaaacttacggtcttattttacagaaagctcaaccattaaaaatcatcgcacattcagtctaaaaatattctgttgaatatttgttgaatgttggcaacaatgcagcagcaaggaaatattcagtgtgtaatttggttgttggaactctttgtaatatgtaaactaagtttagtttggttgtaattttgtttttactaaggttagtgagctacttagctgatttagtagctttttaggttattattaagctgattatacagcttggatacaatcacaagttacgtttgttttctttcaatgtattggagcttttaatgcatattgccttgttactaaaactagtaatgagaattattttttccccttttcttttgtctaatcatatttttggttcccctatgttta

SEQ ID NO: 7928 - DNA, 126 bp, Gossypium hirsutum
  Clone ID: uC-gsronu33B136d10b1
aagatcttgctttttttctctccatagaataatatttgtatgctttgattgggattgtatttgttgtcacaaaacttacattgtttttcttccaagtctaaatcaaatggatttgatatctcgatt

SEQ ID NO: 7929 - DNA, 390 bp, Gossypium hirsutum
  Clone ID: uC-gsronu33B136e02b1
tttatatctatattcagctttataaacatgtgtttgtttttcatgccttttcatttttactttgttcaagatcttgctctttctctctccatagaataatatttgtatgctttgattgggattgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggccccctttaagaaacccaatttttaagcccgggggataaaaattatatctttttttttggggcaccaaaaaaaaaattccggggccgctgttttaacacggggggatgggaaaaacccg

SEQ ID NO: 7930 - DNA, 494 bp, Gossypium hirsutum
  Clone ID: uC-gsronu33B136e03b1
cttactcgtccgcccacgcgtccgcgaaggctctttctctgcccaccgtgccaccatggcaccggcgaccgacggtgcacagacaagggcctttcagccccgtttcgaaacctcctttcccttttttttaaagaactttaaatcagtttttatttttttttcagaaatggagaaaatgattaacaaacgaacatacaaccactccgtcgccttttgggaccctcggacaccgactacgtccgtcgacgaggagggagaccgattcaggcctagacggaagcgatggtgcagaagcttgccatgttggtacaagcgatgtcaggggagctgaccttcgggcgttggacgtgccgacaatgcacgtgggagggggcagtggctagggcggcttctagggtttgattgaaaatgttttaggatagtggctgatgtgtattgcgtaattgggtttggggctttagttaggtattgggttctgatatgggttgtaggtt

SEQ ID NO: 7931 - DNA, 463 bp, Gossypium hirsutum
  unsure (1)..(463): unsure at all n locations
  Clone ID: uC-gsronu33B136e09b1
tttcttacgcgtccgagcagttggaaagattaatatcatagctgaagatctgggagttataactgaggatgtagttcagctcaggaaatatattggagcacctggaatggctgttctccagtttggttttggtagtgactctagcaaccctcatttacctcacaatcacgagcacaatcaagttgtgtaccactggaacacatgacaatgacacgatccaaggttggtggagcaatttgatggaacaagagaggtccaatgtattcaagtatcttcgtatcactgaaagagatgagatctcatgggcactgatccaagctgcagtttcctcaatagctcaaactactatcataaccatgcaggatgttcttgggttggacagttcttccaggatgaacattccttgcacacagcatggaacttgaagttgaggatacctattncacgagtttgatagcctgaa

SEQ ID NO: 7932 - DNA, 516 bp, Gossypium hirsutum
  Clone ID: uC-gsronu33B136e12b1
tcgctttaatttctgattttgggttgtctttactttgaaatcctgttcatgctatagctagattaggtggatatagagctcctgaacaagctgaagtgaaaagactgtctcaaatggctgatgtttatagcttcggggttttattgctagaagtgcttacaggtagagctccatcgcagtatccttcaccgactcggcctcgaatcgaagacgaagaaccggcagttgaccttccgaagtgggttcgatccgttgttaaagaagaatggacagccgaagtgtttgatcaagagcttttgaggtacaaaaacatcgaggaggaactcgtttccatgcttcatgtggggttagcatgtgtggttccccagtctgaaaaacggcccacgatgaccgaagtggctaaaatgatcgaggatatcagggtggaacaatcacctttaggggaagattacgacgaatcgcgcaattcgatctcgcctttcattgctaccactgaagatggaatgctggttacta

SEQ ID NO: 7933 - DNA, 568 bp, Gossypium hirsutum
  Clone ID: uC-gsronu33B136f05b1
ctcactttttttttcatatcaatgtagtgacaacaacaagccacgcatgagaataaaataattgatacaacgtacatgaaatgcagtccagagcatcgccccgcggggtgttgatgctactactgcctttgttgatcccagttgttctatcaggtctggatttgttcataatcattcatgaccatcccaccatttctgataggcaatgtactacttcgcatgactcttttccgcatttaccctgtgtgtgctttcgcttatttctttgctggggttttaatctaggccaccgttgttgtggttcacccactccacacgacacacatataacccccttctctctctgttcaattgcagtgcggatggttcatcttttatcgtttactctctctttgtttccgtttgaagagatttttaagctgtttatcttttctcttgataataagctctaacggcaggaaaaaacaaaaggagggatcttttgaagtggaaaacaagagaatatgatcagattaacatctttgttggttttttttttactttttatttatttgggtttggatatgaa

SEQ ID NO: 7934 - DNA, 507 bp, Gossypium hirsutum
  unsure (1)..(507): unsure at all n locations
  Clone ID: uC-gsronu33B136g04b1
gttaataaaaatgtcttcaggacgcaatcgcggatctaactgcagctgcggtgacaactgctcatgcagcaggaaccttaaccttggatattcggagaagacaaccagcactcagaccatcatctacggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggtgaaaatatatgataagccattgggctgggagcataatgtccttttctccaaggatttttgctgctaatcatggtgacttggttatggnttatctnngtgtgtaaatctataaaaaatata

SEQ ID NO: 7935 - DNA, 385 bp, Gossypium hirsutum
  Clone ID: uC-gsronu33B136g05b1
cctcttgtccgaaaaaaaaaacaataacaccgggacataagtttaattaaagacactttttaaggcaaaaggccatgaaaagataccgcctgtgttccctgcccccttcattcctcaagcttcctttcttcttggggcccccccctttatggttcccaaggttccctccccgggcttccgactacatgattcttttgttcgtgacccctaatttcacttcccgggccccccttttccccccctttggcctgggaaccccctggcctcccccactttattccccttggaccccctccccctttcccccgtttggttttttccacaaggcccccccccgttccccctccccaccagtgccctcccctttttggtcaatggccccccc

SEQ ID NO: 7936 - DNA, 308 bp, Gossypium hirsutum
  Clone ID: uC-gsronu33B136h02b1
cttacttcgtccggttttattgtccttgtaggggaaaggagatggtacctcgattatcacttttggtttcaccggctccttctttgcgtcataataaattattaatggtcggtcggcgctatacgggaaacttgacaattgatggttagatgcgcatatttctcctctataggcctcttcgccgttataaaaaattcaatctctttattatccatcatattttgcagtaatctcttgaactcttcgcaggattgaatttcgtgcccctcaataccatggaattcgcaaaaactttgacattttgtatt

SEQ ID NO: 7937 - DNA, 375 bp, Gossypium hirsutum
  Clone ID: uC-gsronu33B136h03b1
ttttgttttgcctgatagatttagtcaattacactggaagtttggtaatacaccaccaaaggggagcaaggtttcaacctgaaaaaaccatggatgccaagtctgcagcaaaatatgaggttttggatgaatggactgtccaacaactcaaactattgaaaaattgtatcaatgatttagtaagcaatttggttagagtactaatgaagggttgagtgagagtagaagcctgcattaccaaaccaaaacaaataagcagttttgtattgtgtttctgcctgtgatatgtagctagtaatcttccaagttatatagtctgaaaatgaaccaggttgtttgtttatcacctgaatgctgctagtaacagcagtatta

SEQ ID NO: 7938 - DNA, 564 bp, Gossypium hirsutum
  unsure (1)..(564): unsure at all n locations
  Clone ID: uC-gsronu33B136h12b1
tttgttttattcaacaaaacacaacgccactagagggtagtttgatcagcaaccctctgctcttcttcttccttaaacaagcaaaacaaaaaaaaaaaattatgggtggcgaaggaaaggtctatactttggctgaggtttctcaacacaacaatgccaaagactgttggcttatcattgagggcaaggtatatgatgtgactaaattcttggaggatcatcctggtggtgatgaggtcctgttgtctgcaacagggaaagatgcaagtgatgattttgaggatgttggtcatagtagcagtgctcgggcaatgatggatgagttttacgtgggtgacgtcgatacatcaactatcccaactaagaccaagtacacccctcccaagcagcctcactatgagcaggacaagacctcggactttgttataaagcttctccaattcctcgttcccctgctgatcttgggattggccttcggagtccgcttctataccaaatcacctgcttaagcatcaagaccacaacccagaatggaaaagactctcaaatatannttatatgtag

SEQ ID NO: 7939 - DNA, 481 bp, Gossypium hirsutum
  unsure (1)..(481): unsure at all n locations
  Clone ID: uC-gsronu33B137a03b1
gtttaatctgaagaaccttgttggcttggatttgtatggtaaccggttcgaaggagaaattcccaagtctttttccggactgaagtcactgagattccttcgtctgaacaacaataacttgacaggatccattccaagggagcttacttccctctctaaccttaaagtattcgatgtttctaacaatgatctctgtgggactatcccggttgatggccctttcgggatgttctcaatgccaagctatgcaaacaacatgcgcttgaatgggccagagctgaaaggacttgtgccgtataactttggctgctgaagaaaccaatctttgtcgaactcatgagcgcaaaagctctggtgacatccccatgctgattttatgtaggagtggatagtgagatgctctactctgtatctatataatctaaaaaataacatgatgctaggttttaagccttttgattnttttacatgtaaagcatga

SEQ ID NO: 7940 - DNA, 486 bp, Gossypium hirsutum
  unsure (1)..(486): unsure at all n locations
  Clone ID: uC-gsronu33B137a06b1
ctttcgcgtccggtcaatattcaccaattctttagagggtatacagatggtcgttttgatgcaaaatcatggcctcagatactgaagctaaaagattggcctccatctaatgaatttgagaagctccttccacgtcattatgctgagtttctttgttgtttgcctttcaaagaatatactaaccctagaagtgggcttcttaatattgctaccaaattgccgaaaaaatctctaaccccagatatggggccaaagtcatatattgcttatggagtttttcaagagctggggcgtggagactctgtaaccaggcttcattgtgatatgtctgatgcggtgaacgttttaacacacactgttgaggtgaagcttagtcatgaacaactggctagcatcaacaaggcaaaacaaaggcactctatccaagaccagcaggaactntatggaatgaattcaaaagttgacaggaaatagtctagtgataga

SEQ ID NO: 7941 - DNA, 478 bp, Gossypium hirsutum
  Clone ID: uC-gsronu33B137a09b1
gtcttttttgcagacgggccctggctaggggttgtagggtacatctttggttgcggcagccagagcagggaaatccaagttcataattggtgatggcaacaatgtatatgatttcacttatgtcgagaatgcagctcatgctcatatttgtgctgaacgagctctagcatctggaggagaagtttcagaaaaagctgcagggaaggcatattttataaccaatttggagcctatcaagttttgggagtttgtttctctaatactggaaggtcttggctatcagaggccaaaaataaagattcctgccattgttgtaatgccaattgcacatattgtggagtggacatatcggctattaggcccatatggtatgaaggttccacagttgacaccttcaagagttagaaatctgacttgcagcagatcttttgattgttcgagagcaaaggatcagaatggctatcaccaattgccttac

SEQ ID NO: 7942 - DNA, 327 bp, Gossypium hirsutum
  Clone ID: uC-gsronu33B137a10b1
tctttcgcgtccgtctacgcgtccgctaacgcatccgctcgaacaatattcgtcaaaggacttgatgcatcactcgacgaggatacgatcaggaattccttgcaagaacactttggttcctgaggagagatgcttacattggcatctaccaacagatcgggattccggtgctgtgaaaggatttgcgtacttggattgcaaagatgaggggtagtttgaacaaagctctagaacttgatggatcaacacttaataatcaatccttgcacgtggatgaggcaaaacctaaaggcgattttggcagtggaagaggtggtggtaggagtg

SEQ ID NO: 7943 - DNA, 370 bp, Gossypium hirsutum
  Clone ID: uC-gsronu33B137a11b1
tcctatgcgttcgcccacgcgtccggtgaaatcgtgggttttagcagtaacgatagtatgcatgtctattttctggttccacttgtgtaaggccgatgaagatttgcctgaaacaggcagttttggtgatgatccagctcacagagtcgccttggcgttgctctgtaaagaagataaatatatttatagcagctgtgaagaatctagcagattgagtgcaagtggaaatctagacgccagacctgaatacaccgactaatattgcagtggaccttgcctctcagagacccaccttgttctcaactgtctagagtacatgatgaatgacttggtgcgtgaacgtttggcaaccattcacgatatcagagac

SEQ ID NO: 7944 - DNA, 454 bp, Gossypium hirsutum
  Clone ID: uC-gsronu33B137b01b1
aatatatgtccctgttcctgtggtccctcagaatgaaagattctttttcaggcgagtctgccccaaaagttaccatctgtttcggtgtattgctaggtatggttacaaggatgtccgtaaggaaaatcaccaggcatttgagcagctgctgatcgagagtcttgagaagctcattcgtcgggaagctcagcaaaggcaattggaaagtgatggtgacgaagatgcagattccgaggaggatacatctttctcaagagttctcatagatcctaacggaagtgtttactcacttggtgttcctctgctggctgagtttatgggctccagcaattccatttcagaagcaagcatttctgaggagctaaaccccaactcccctgcaagtccatcgatatctgatgccgagcatagtctagaaagggagctatcttttatacgacaggctaaggaatct

SEQ ID NO: 7945 - DNA, 483 bp, Gossypium hirsutum
  Clone ID: uC-gsronu33B137b02b1
aattatcaactattgcatttgttttgaaaatttggccacactacttgtttggtgaaaaatgtcacatattcaccggttagaaaagcttaaagtatttgatatcctagaaagatttgaatctgagacagcataagtggcttgaattattgaaagattatgatttggttatcgactattatctgggaaaagcaaatgtggttgtagatgctttaagtagaaagtctctgttttcttcgtaagtaatgaatacccgattaacattgtttgatgatggctcaatcttggctgaaataaaaggtaaactgacatttctttagcagatcagcaaagctcagaaaagtgatgatgagttacaagctagactggtacagtgtgaaactacttttgattcagaattccaaataggacccgatgatagtctgttattcagaggcagagtttgtgttccaaagaattcatagcttgtatagaagattttacacg

SEQ ID NO: 7946 - DNA, 487 bp, Gossypium hirsutum
  Clone ID: uC-gsronu33B137c06b1
tatttttagattatgaaaataaaagaccaatgagaaaagatcaaagatcaatgaaggaagagagccaaaaaatgcaatccccttgcctagaagaggtttcacaaggatgcctccatggctgctgtccctctcctttcctcaaccaacatgagcctcaaaccaaagcttcgaaaccccgaaactcttcggcagcttgccgccgtgaccttgcgtctaaaactacttcttctattttccccaacacccaattcaccaaccatgaatctcttccatctatgcaagactcatttgccgaattcaccaaggcttaccctcagtattcggatacctatcgagttgaccaaatacgatcacgagagtattaccatctctccttctccgaccatacttgccttgattatcttggcattggtctcttctcctattcacagttaccaaaacaggagtgcccaaaatatcgaattgcctcatcttccttccctgtgcc

SEQ ID NO: 7947 - DNA, 483 bp, Gossypium hirsutum
  Clone ID: uC-gsronu33B137c12b1
tttttgtccgatattctcaagcaaaacagtgtctgcggtgacgggatcttgtttgaccaaggcgctagaactgctcttgccttcgatacgttacgcgccgacggagagcttgagttcatgttctataggaatcctagcgccgacatgctgttgaagccggaggagtggaacgttgatcttatcagatcttccaaggtatttcactatggatcaataagtttgatcgtggagccatgcagatcagctcatttaaaggcaatggaagtagccaaaggagctggtgcattgctctcatatgatccaaaccttcgcttgccactttggccttcagctgatgaggctaggaaacagattttgtccatttgggataaggcagatattgtcaaggttagtgatgtcgagctcgagttcctcaccggtagcaacaaagtcgacgacgaaactgccatgaaactttggcgacccaactttacactgctcttg

SEQ ID NO: 7948 - DNA, 487 bp, Gossypium hirsutum
  Clone ID: uC-gsronu33B137e04b1
tttttctcgtgggcttccaattatcttaaagcctgccatataatcatataaccaggctccgtcgtggtactcttcggccaccacaatgccgaaaatcggcttgggaacaagccaagaggctgctcagcctgactgcatcaaagcccttgtggtcgagtttatcaccactttcctcttcgtattcgctggagtaggagctgccatggccgccgatgagtcgggggcaaatgcgctggtgggattgtttgctgtggcggtggctcatgcccttgtcgtcggcgttatgatatcggccggacacatatcaggcggccatcttaacccagccgtcacgcttgggttgctattcggtggtcacatcacggtggtccgtgcgatcctctactggatcgatcagttgttggcatcttcagctgcttgtatacttctcaagtatctcaccggaggattgaacactccggttcacacattagcaagtggaatgggg

SEQ ID NO: 7949 - DNA, 484 bp, Gossypium hirsutum
  Clone ID: uC-gsronu33B137e06b1
cccactcgtccgctagaactctccattttctcttttgctgtctttggtttctctttatttttcgtctctaaatctctgcatcatcatcgatcatgtctcttttattctccctactgctgttcttagccatgactggccattcaagtgctacttattgcttatgtaaagatgggttaggggatcaagctcttcaaaaggccctcgattatgcttgtggagctggagctgattgttctgcaattctacaaaaaggtggttgctataaccccaacactgtgaaagatcactgcaactatgctgtcaatagttatttccaaaagaaaggtcaagcacaaggaagctgtgatttttcaggcactgctactgttagtgccaatcctccttcaaatattgcttctacttgcagctttccctctagtagcacaggcatgaccgcaccaactgggacaacaaccgggacaccaaccaccactggctcaaccac

SEQ ID NO: 7950 - DNA, 488 bp, Gossypium hirsutum
  Clone ID: uC-gsronu33B137e10b1
tcgtttacgcgtccgggacggaattgggaacctttctaaccttgttgaattgaatatctccttgaatgactttagtggaagtcttccagacgtttttgggagactgagaaagctagaatccttctctgccagctcaaatagattaactggattattgcctgcttctttggtgaattcggctccacttttgaggatcgatctgcacaacaacagtcttgacggtccaatcagaataaattgttctgcaatggcccaagtcacctcacttcatctcggttctaacaatttccaggggccagttcctgctagtctatcctcttgccagagcttgacagttctgcatcttgcacgcaacaaactcggtggtgtagttccatttgagtttagaaatctgcatgcactggaattcctctcgctcggaaacaccagcatcaataatatatccacagcactggatatactacaacactgcaaaaatttgactatat

SEQ ID NO: 7951 - DNA, 509 bp, Gossypium hirsutum
  Clone ID: uC-gsronu33B137f02b1
ctctcgcttccgctgctagtggcgaataaaaagaggggggggtttatttaaaaaatgagggggggttaaaaaaaaaaaaaaaagaatatatattaatatattatatatttgttggggtgttttttaaagttaaaaatgggtgggggctgttttaatgggagggggggggccttttttggggttccaggtttttttccttttttttggcgaggctttagtttttttttggggcgccttattttcaattcccgggccggggtttaccctgggggggctggggtaacccggggggggcccaattttatttggcttggggggcttcctctttttgccggctggcgcttttgcttttgggcccggtccgttcctctttttgaacattggccccccctttttggggatgggtcccccccttggggggggctttttacccgggggggggggggggtttttgccagggggcccgttccttttcctggggctttttcccctttttttttggttttttt

SEQ ID NO: 7952 - DNA, 274 bp, Gossypium hirsutum
  Clone ID: uC-gsronu33B137f08b1
cgcgtccggatgaatgctgtctgcggaaaccgctaaaactatttgttcgacatcctgcaatttgcatctggtttcatattatcacactgaagcttttggtgatcgattcaatggtgttggaatagtttggtgcggcaatgtaacacgctaaagagtggatcaaggtgcacaatctctggtccctatagcatgtggtgtattatttatatgttggggtttgtaatttacaccatttccttttggagtttataaaaaaaaactcaaaaataaacac

SEQ ID NO: 7953 - DNA, 472 bp, Gossypium hirsutum
  Clone ID: uC-gsronu33B137f09b1
ataaaaaaaaaaaaaaaaaaaaaaaaaaaaataaaaataaaaaaaaaaaaaaaaaaaaaaaaaaaaaaaaataataactttattaataaaaattaaaataaaattataatatgggggcggcctttttagaggtcccaagtttccttccccgggcttccaacgtattagtttttttttggggccccctaatttcatttccttgcccgcctttttccaccctcgggcctgggaaacccctgggtttccccactttattccctttgcaaaacttccccttttccccagttggcgttttaccaaaggggccccacccgttcgcctttcccaccagtggcccacccttattggcaattggacccccccttttaccggccctttaaccccggcggttgtggtggtttaccccattgtgcccgttccctttgccggcgcctttgcccccgcttctttcctttttttccttttttttttc

SEQ ID NO: 7954 - DNA, 165 bp, Gossypium hirsutum
  Clone ID: uC-gsronu33B137g02b1
acgcctacgcttttcggtagactatgagaagattgtgcgtgatacatgccggtccattggattggtctctgatgatgttgggcttgatgctgacaattgcaagggcctgggtaacattgagcaccacagccctgatattgcccaaggtgtgcacggacactttac

SEQ ID NO: 7955 - DNA, 550 bp, Gossypium hirsutum
  Clone ID: uC-gsronu33B137g05b1
actcactataggttaagctgagacgcctcgccggaccgtaccggaacggacgggtcggctcacgcgacgcgtttatgcgtgcgcgggaagatgcataagacggtatggattgctgttggtgatataattcttgtcggccttcgcgactatcaagatgacaaggccgatgtgatccttaagtacatgcctgacgaagcaaggctattgaaggcctatggtgagcttccggagaacacccgtctcaatgaaggcattgatgatgaggaagacgaacgcggagtagatgattatgtcgagttcgaagatgaagatatagataaaatctaaggtaactataatggggtcatgcttgaagccttgtgtttaaactgttagaaacagagagatatactggatgctgtggagatatatgactacagtaagtgagatacctgccataagtcataagttagacattctataaatggcgaaggtgacattgttagatgtgtatgttgctaatttcattgaaactgaaagtgtgtttgaattctcaaatttaattttcatg

SEQ ID NO: 7956 - DNA, 440 bp, Gossypium hirsutum
  Clone ID: uC-gsronu33B137g06b1
tttcgtacgcgttggagtcgacttcattaaaaccaagtgctccctctatctctcacctatggggccctactgcaaacaagtgcggaatcaactaccaaccacccactgatgaccctggtggagatctcgccaaggtccagagagctgcttgcatgatgtctaactccaccagcgttgctgaagtcttctctcgcattgaccataagtgcgatcttatgtatgccaaacgtgccttcattcactggtatgttggtgagggtatcgaagacggagaattctcagaggctcgtgaggatcttgctgcattggagaaggattatgaagaacgtggtgctgagaccgctgtgggtgcttagggaatgtatgatgagtactaagaagtacctgggatcgagtgtacagatgatggctttgattgccagtcgattccgtgttatgca

SEQ ID NO: 7957 - DNA, 464 bp, Gossypium hirsutum
  unsure (1)..(464): unsure at all n locations
  Clone ID: uC-gsronu33B137h01b1
cccacgcgtccgcccacgcgtccgtgtttctcgtcctcttaacgatatcctctgtttgcagttaagaaaagcaaatcatggctgctaccacggtcccagccgccgcaaggcagctatctcctaaagaagccgatatccagatgatgttggctgccgaggtccatctcggtaccaagaactgtgatttccaaatggagcgttacgtcttcaagcgtcgcaatgacggaatttacatcttcaaccttggcaagacctgggagaagcttcagcttgctgctcgtgtaattgtcgctatagagaaccctcaagatatcattgtccaatctgcaagaccctatggtcagagggctgtcttgaaatttgctcagtacactggttgtcatgccattgctggaaggcacactcctggtacattcactaaccaactccagacatctntcagtgagccacgccttcttatcctc

SEQ ID NO: 7958 - DNA, 66 bp, Gossypium hirsutum
  Clone ID: uC-gsronu33B137h05b1
aatatcaatgccctcactattcaaatcaaaaaactaaaaaaaaaaaataaaaaaaaaagatgcaaa

SEQ ID NO: 7959 - DNA, 182 bp, Gossypium hirsutum
  Clone ID: uC-gsronu33B138a02b1
tttatcttcatcttcatcttcaaaggttatctttgttttcttgatggtcaattaatagtttgaagttggcttaggtgtcaattctcctttttgcttgtttgattgatgagagttgatgaattataagtcaaaattatgtttgtgggtttttgtgtttaggtaaagttgaagatttagttcag

SEQ ID NO: 7960 - DNA, 281 bp, Gossypium hirsutum
  Clone ID: uC-gsronu33B138a04b1
ttctttctcctgaaaccaattagcggcagagatgccgtcctagtacttaggagcaacgccacttaccagtgcaatggccttctcggcggctgcgttatccgggaagaattggagtcggagctggatttgttgatgatagattctaccgttatcagaatcctcaagcaaggtagcggtcacatatctatcaacacgtttataaagggtaagccagcagtaaatcaaaatgactgcggtcctagttatgggaattgtatttcaaaacccaagccaaatggaca

SEQ ID NO: 7961 - DNA, 231 bp, Gossypium hirsutum
  Clone ID: uC-gsronu33B138a05b1
ttgctgtctcgacccacgcgtgcgctttcgaaaaagagggaaaagaaaaaaagcggtcgagattctcacagccatggcgagcacctatgtactgaagatcatgcaccagcacatggtccataccctcttgtacatgcattcgagtccttgatcaatggcgtttcacacttcggtccatttttcgaccacgttttacagtaactgtacccaatgttgaaaacccccaaccag

SEQ ID NO: 7962 - DNA, 130 bp, Gossypium hirsutum
  Clone ID: uC-gsronu33B138a08b1
cctcacttcttccggtctgaattatcagatattggtactgacctgagttgcttgcgcaacaacaaaaacacaaaaaaaaaaaaacaaagaaagaatcaagaaaagaaataaaaacaaaaaatataatgaa

SEQ ID NO: 7963 - DNA, 437 bp, Gossypium hirsutum
  Clone ID: uC-gsronu33B138b01b1
tcgtcacgcgtccgcagaaattcggtggagagactctctctgttattctttttttcccgattgtttcttccatctttttagggtttaattttatttttttaatcttgaaaataattttgataattttatgaagcttttagacatttcatttcaataaatttatcaaaagattttcaaaaagaagagagacgaaaaagattcataaatatttggatcaaaaaagaagaagaagttgctttgttttctcgagaaaatggagtcaaattcatggagctttcgattctcccattcttcttcttcttcgtcttcgtcaaggcgtcgtcaatcacgatctgatctgtttctaggaggaggatatgaagaaattgacggagatgaggatttcaaggcacagtttttatgtccattttgcgctgaggatttcgacattgctggac

SEQ ID NO: 7964 - DNA, 568 bp, Gossypium hirsutum
  unsure (1)..(568): unsure at all n locations
  Clone ID: uC-gsronu33B138b02b1
ctttttggtcctttatcttcttgggtttgatcttcatcttcttctttcgatctccttcttcgaatcccatccctcaagacccatctcgccgttctctccgtacccacaactggggtggacccgcttgggaaaaacgggtgcgttcatctgcccgtatccgttcccgaaatggaatctccgttttggttaccggagccgccggtttcgtcggtacccatgtttcgaccgctttgaaaaggcgtggggatggcgttcttggacttgataatttcaatgactactatgacccttcattgaaaagagctcgtcaagcgctcctggaccgcactggggtcttcgttgtggaaggagacatcaatgattcgacccttttaaagaaactattcgaggttgttccatttacccacgttatgcatttggctgctcatgctggtgtcaggtatgccatggaaaatcctagctcttatgtgcatagcaatattgctggtctggntagtttactngaagcttgnaatctgctatccacacctgcattgtgtggcttctcgagcttgctacggctaatagc

SEQ ID NO: 7965 - DNA, 497 bp, Gossypium hirsutum
  Clone ID: uC-gsronu33B138b03b1
ttgttttttcgtccgcccacgcgtccgcccacgcgtccgctgaattccttaacctgatggcaagaaaaatgaaggatacagactctgaggaggagcttaaagaggcattcagggtgtttgacaaggatcagaatgggttcatttctgcagccgagctgcgccatgtcatgacaaaccttggtgaaaagcttacagatgaggaagtcgacgagatgatccgcgaagccgatgttgatggtgatgggcagatcaactacgaggagttcgtcaaagtcatgatggccaagtaaaggacctctccaactataaccaggattaaaaaatggggtctaaaaaaaaggaagaaagtaacagggcagataagtttgctaaaatatctattaatgaataggacatcaatgcttttaagttacaagcttttgttggatggctctttggttcatgtttgcattattttgaagaccggaccttagtattatgcttgtttgctctgtttt

SEQ ID NO: 7966 - DNA, 407 bp, Gossypium hirsutum
  unsure (1)..(407): unsure at all n locations
  Clone ID: uC-gsronu33B138b04b1
tttcccacgcgtccgaaatgacactataagccatttaactgaacatgttcttgagctcgagaggcagcaaatcttggaggactaggctatgatatctcaaaagatatgttgcgattgcggtgtgttggtgttcgtaaaatgcttgtttactcatgcaagtgcaagtttgaagttgtaagttatatggcttctttcaacccctcttatcctatccacctcttttaaaatgaagcagtgaagctttgaacaatatagattgtccatcataatttttaaatgacttagctgctttgacgctaactaatcatctggtgttattacatgttggaaattaggggaatttgcataagatgtagttccaaacttagaactctgaacttaacagagaatggatgtgattctntctg

SEQ ID NO: 7967 - DNA, 458 bp, Gossypium hirsutum
  Clone ID: uC-gsronu33B138b10b1
cttacgcgtccgcccacgcgtccgcaaaccccaaaaaggtcaaccaaaaacctttgtcttctgttctgatgaatccacaacaacccagtccatcggaacccgaccttcaggttccatccctcgcttccctccgaatccagccctcttccccacgtttccctttttccacccccatcgccggttctcagcgtcgcatcgccatcgccgttgacttaagcgacgagagtgcttatgccgtccgctgggctgtccagaattaccttcgtccgggagacgccgtcgtcctcctccacgtccgtccgacttccgtcctttacggagccgattggggctctatcaaactccaaatcactcccaactccacgaataatcgcgaaaacgccaccgccatcagtggcgatcactccgacgaggagtcgcagcaaaaactcgagaacgacttcgacgttttcacgaca

SEQ ID NO: 7968 - DNA, 453 bp, Gossypium hirsutum
  Clone ID: uC-gsronu33B138c03b1
ataattactttaatttctcataaatcaaacagattttgtcaaatctcgaaatcatcacatcaatggctcgtacaaagcaaacagctaggaagtcgactggtggaaaagctccaaggaagcagctagccacgaaggccgctcgtaagtccgctccggcgaccggcggagtgaagaagcctcaccgtttcaggccaggaaccgtggctttgagagagatccgtaaataccagaagagcaccgagttgttgatcaggaagcttcctttccagaggctggtgagggaaatcgctcaagatttcaagactgatttaaggttccaaagcagcgccgtcgctgcacttcaagaagcggcggaggcttatctcgttggattgtttgaagacactaacctgtgtgcaattcatgctaagagggttactatcatgcccaaggatatccagcttgctaggagga

SEQ ID NO: 7969 - DNA, 465 bp, Gossypium hirsutum
  Clone ID: uC-gsronu33B138c05b1
cctcacgcgtccgcccacgcgtccggcaaaacccctagccagccacttccccgccgcctctccgaaccatgggccgagtccgtaccaagacggtaaagaaatcctctcgccatgtgatcgagaggtactactctcgcatgacgcttgatttccacaccaacaagaagatcatcgaagaagtggctatcatcccttccaagcgtctccgcaacaagatcgccggcttttccacccatctcatgaagcggatccagaagggtcccgttcgtggcatctctttgaagctccaagaagaagagcgtgaacgtcgcatggatttcgtccccgacgaatccgccatcaagggttgatcaaatcgaagtcgataaggaaactctcgatatgctttcggttctcgggatggctgatattcccggccttgttaaggtcgatcccgttgctgttgcggttccccaaatcggttcg

SEQ ID NO: 7970 - DNA, 537 bp, Gossypium hirsutum
  unsure (1)..(537): unsure at all n locations
  Clone ID: uC-gsronu33B138d06b1
ttgtttttttcaggtaccaaaccccacttgcggcggaagcgcgtgcgcattcaacatgacctacggtggctcaaccatagccggtaacctatcacaggacaccataaccttagccaccgacccaatcccaaactacactttcggttgcctccaaaagacagcaggcagctcagtgccaccacaaggtgtattgggcttgggccggggcccattatccctcctttcccaatcccaaaatttgtaccaatcaacattttcatattgcttgcctagcattaggtcacctaacttttctgggtcattgagacttggaccaagtgggcaacccgtgaggatcaaatacaccccgttgcttaagaaccctaggaggccctcactttattacgtcaatttgattggaattagggttggaagaggattgttgatatcccaccaagtgccattgctttcaatccttccactggtgctggcaccattatngattctggtaacgtgtcttcgtaattggatcagtcaattaatgaattgactaaagct

SEQ ID NO: 7971 - DNA, 513 bp, Gossypium hirsutum
  Clone ID: uC-gsronu33B138e01b1
ttggtttggattcttaaatttttgaaatttgtttgagaatttaggaagaaatgtcaaggtttcgcgggatatggcaagcttccctgaatgcaaccaagaaagctctgacatggaatgttgatgattggatccctcccgctgaaaaatacatattcaatttcagttcaaaagaggagctcaagaaatggcatctttattctgatgcggaatttggagggttgtcgtcggcttcattggagatcaaagacgatgctaataaatcaagtggagttttctctgggaatctttcccgggatgtaaccgaaggtacaaaatggaacataactaggagcggcttttgtggaatgcggtctaagaagtttgatggcttcattgatttggaagcatatgatacaatagcattaaggattaaaggagatgggagatatatatatctacaatctatacagaaaattgggtgaattcacctggacagatggaagattattcatggcactcttttgttttggtccc

SEQ ID NO: 7972 - DNA, 422 bp, Gossypium hirsutum
  Clone ID: uC-gsronu33B138e04b1
gttaaatcctttattcttatatatataatgcaactaatgcattgatacaaacatgaaagtcataagcatatacatatataacaacataataaaaaaccctaattaacacacaaatattgattaacgctaactaatccatgcaagagcaaagcgttaatcctttattctcatatatatatatataatgcatgatagcataaataaaaaaaccctaagtaacacaaaaacattgattaacgctaactattatttaattttcgcccccactaatgaacatgttagcgccgttgcttatactgagttacgaggtcatcaagtgtccaaagctccagtgagtcagtcccaccgttaccactcagctgagtcatagtctcatggttagtctccaaacccaagaatgattccaggctccagatttgttc

SEQ ID NO: 7973 - DNA, 454 bp, Gossypium hirsutum
  Clone ID: uC-gsronu33B138e11b1
tctccctaaagtttatataaagaccagaagaacaaccaagtagagccacagcagcgtcccaagcattgcaatcaaaagagaaagcgaagaggcgagggtctattttcttgacaactataatgagttccgagtcttcaatgatcaagaggctagatgctaaggtggcactgataactggtggtgccagtggcctaggagagtgttcagctaggctatttgttaaacaaggagccaaggttctcattgctgatattcaagacgaattgggccactccctttgccaagagcttggaactgaaaacatcagctatgtccactgtgatgtaacatgtgaatccgatgtcgaaaatgccgtaaacttagcggtatccaagtatggaaaactcgatatcatgttcaacaatgcatgcctcattggtgaccgtgaagtcagagtgacagacgccagcactga

SEQ ID NO: 7974 - DNA, 439 bp, Gossypium hirsutum
  Clone ID: uC-gsronu33B138e12b1
acaggagtcatttgttttgggggaatgcctgtttaaatggcttgttttcaatatatagtagctgctctatgctttgcagttttacttgagggatcgttatcaaaagctcaactgaccccgacattttacgatgaaacatgcccaaacgtgacagccattatccgacatgtgctcgtgaatgcttcgttttcagatccaaggattggtgccagtctcatcaggcttcacttccatgattgttttgttcaaggatgtgatgcgtcgattttattggacgatcctgtgaatggtgagaaagaagctattccaaataataattcagctaggggttatgaagttattgatgccatgaaggctgccttagagagtgcttgccccaacactgtttcctgcgctgatattctcgctattgcatctgagcaatctgtcagcaccctgg

SEQ ID NO: 7975 - DNA, 504 bp, Gossypium hirsutum
  Clone ID: uC-gsronu33B138f07b1
gttatgtttccattctgtcgtgggcactcagagactggcaccattgaccatgagccatggtcatttggtaaagagtgtgaagaagtatgtcgccttgcattaaaaaggcgctatcgcctcataccacatatatacactcttttctatatggctcatactagaggtactcctgtggcaactcctgcattttttgctgatccaaaagatcccaatttaaggacattggagagttgcttccttttgggcccacttttggtctattcaagcataatgccagatctggggtctgataaattacaacccttgttgcctaaaggaatttggttgagctttgactttgacgattcacatccggatttaccagctttatatttgcaaggtggatatattatacctttcggtccttctcatcaacatgttggtgaatctaaccccatggatgatttaacgcttattgtaagcgtagatgagcatgggaaagcaaaggctctctttttgagatga

SEQ ID NO: 7976 - DNA, 439 bp, Gossypium hirsutum
  Clone ID: uC-gsronu33B138f09b1
gcgctcactcgtccgctaaaattcagaaggcatttcggtcttacagggcaagaaaagcagtccgccggctgagagatgcggggagattcaagaacatattgatacagggacatacagtgaagaaacaaacaagaagcacgctaagctatttacattcatggtgcaatgtccagtctcaaatccgagctcggagaatatgtatggttacagaaggcaggcttaagcaaaagaaaatggaaaaccagatgaagcttgaggctaaactccatgaactggaggtagaatggtgtggctgggtctgaaactatggaggaaattctttccagaattcaacagagagaagaggcatgcggtaaacgtgaacgagccatggcatatgccttctacatcagtggagggcaaatgcgagccaatatcttggacaagcattctatggtgc

SEQ ID NO: 7977 - DNA, 426 bp, Gossypium hirsutum
  Clone ID: uC-gsronu33B138f12b1
ttcacgcgtccgattgaattctttccttcactttctcgagaaaaaaaaatgtcttcaggttgcaattgcggatctagctgcagctgcggcgacagctgctcatgcagcaggaaccttaaccttggatactcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagcaaaataacaggcctctgtaatgatttattttcaaggatgaatgcctgcaaggtctatgactataattatgtctctgtctgtgtcttgtgtaatagaaagctttgttgt

SEQ ID NO: 7978 - DNA, 436 bp, Gossypium hirsutum
  Clone ID: uC-gsronu33B138g01b1
tttatataagcaactttgctagcatgtggttcattctccttttcgtctccatttttgccactggaatacttgagcttaggtggagtggtgtcagtatcgaagactggtggagaaatgaacaattctgggtcattggtgggacatcagctcatctctttgctgttttccagggtcttctgaaagtgcttgctggaatagataccaacttcactgtcacttcaaaggcgtctgatgatgatggcgattttgccgaactttatgttttcaaatggacatcacttctcattcctccaaccacagtactcattatcaacctggtgggcattgtggccggcgtgtcgtatgctataaacagtggttaccaatcctggggtcctctttttggcaagcttttctttgccatctgggtgattgctcatttgtatcctttcttgaa

SEQ ID NO: 7979 - DNA, 328 bp, Gossypium hirsutum
  Clone ID: uC-gsronu33B138g03b1
tttatattagaatcatgggtgttgtcacttatgactatgagaatacctccccagtcgcccctgccaggcttttcaaggcctttactgttgaagctccgaaagtttggcccacggctgcacctaatgcagtaaagagccttgaggttgaagctaatcctagctctggaagtatcgtaaaaatcaactttgttgaaggccttccattccaatatatgaagcaccagatcggaggacatgatgaaagtaattattcatacagttacgatttaatcgaaggtgggcctttgggggataagcttgaaaaaattagctatgagaaccaggtttg

SEQ ID NO: 7980 - DNA, 556 bp, Gossypium hirsutum
  Clone ID: uC-gsronu33B138g05b1
tcggtacagcaaggatttctagggtttcgtctgaatcggtaagcgatggcgatggctgctctcagacgcgaagggaggcgtttggcccctctgatctctcctcgtacgataaccgccgtcagatcctctcctctctatcctactcttgaggatgagggtcctcttggagttcgtcatatttcgactcaagttgttagaaaccggatgaagagtgtcaagaatattcagaaaatcacaaaggcaatgaagatggttgcagcctcgaagttgagagcaattcaaacaaaaactgagaattctcgtggcctctggcagccatttactgcacttcttggcgatcttcccagtgctgacgttaagaagaacgttgttgtcaccatctcttcagacaaaggtctttgtggtggaattaactctacatctgtcaagataagcatggggctccataagttgaactctggtcctgaaaaagaaacaaaatatgttattttgggagagaaggcaaggctcaatagttcgtgattctaataggacattgagttaatatactgagctg

SEQ ID NO: 7981 - DNA, 151 bp, Gossypium hirsutum
  Clone ID: uC-gsronu33B138g10b1
gtttcattgtagtattgataacaaacacaaagcgattacagcttattatggaaatctcgtgaatgaattcgaccctagttctagggaagatcttaattccacatcgtatgacattaagtgatctgttatagattgtcatcagtttaatgag

SEQ ID NO: 7982 - DNA, 436 bp, Gossypium hirsutum
  Clone ID: uC-gsronu33B138h07b1
acggctataactttaccagctgcaatgttcttagaacataactgagaatgtcttgacgttcaggataatgaggctgcggcgctgattgccagtgtggcagtggctgtaacggatgcagtatggtccctggcctaattgagaagaactccactgagactattggtcttggtgtggcaactcagaaaatgcactttgagggatctgagatgggagttggggttgagggtgtgatgccccctgtggagacaactgcaaatgcaacccttgcacttgcgggaagtgaacaacatagagaagcagagtggcctttgtcattttaactaaataaattctattactttagtatgtatcagcaaatcttcatgaggatttggctcttaattatgtgtaatgtggcttttctgctatgtcagaatgtattatgatatttaagaaa

SEQ ID NO: 7983 - DNA, 320 bp, Gossypium hirsutum
  Clone ID: uC-gsronu33B138h08b1
tcggtttatcaagtgagaaaacgggagaacgtaatgggcagatacagctaggaatgggcattctctcgccgataggagatggtttttccccatcgctatcaccggccttatagctggtgcgattgttacttccagcttcataaaagccgccgattactcgctgctatgctccgttgccaacaccagatcaccccagggcgttggtaaagggtcggccacgccgatccaactccaagctatcatccactacgccacatcacgcatcacaccgcaaccaaacttaggggagatctccgttacctttgatgtcctcaagaaac

SEQ ID NO: 7984 - DNA, 237 bp, Gossypium hirsutum
  Clone ID: uC-gsronu33B138h09b1
atttcagggagcggctattcaccatttgattcgggggactacaatgcactagcaacgaccagattccatccgcctcgtggccatgcgaggaaaccaggtacggagcatgtgctggcactaggcgtgagggtggcgtacggtctattgacgtagtggcacgagcggcgttggggctgtacagcggctgaaggctacagcgcaagggagagaaaccctagggattgtgactctaaaggc

SEQ ID NO: 7985 - DNA, 509 bp, Gossypium hirsutum
  unsure (1)..(509): unsure at all n locations
  Clone ID: uC-gsronu33B139a03b1
attatctttcagcgtcccagaccctaccttcgaatcgtggctccgagactccggctacctagacgtcatcgacaaccaacagaccgccgctgctgccgctcccaccaccggtacttccacgattagcgacccaacaataaccatcccaatcagcagcttccttttccgatatttggtctcttttttctctcatttatggacgctactctctctactcacgttcaacccattcgccaagctcaccaccaacgatttctccggtgaaactccgtcgtggactaaagggttcttcgcggatttcttgtcctattcgtttccagcttcggcttctcaagcgaggctcagggttcaagagaatgttaagcgttatgctcggaattatgcttcactttttatcctcttcttcgctgggtctctgtatcagctgccacttgcacttgttgggttgatatcaagtttggcactttgggattcattcaggttcttcagtgataaatggngtttgaatc

SEQ ID NO: 7986 - DNA, 439 bp, Gossypium hirsutum
  Clone ID: uC-gsronu33B139a07b1
gtccgttaagacaatggctaccatcagattagcttttcgtaacgtccaccgtatcgttaatacctccgtcgttgccggccgtacaacgaccgttttcaggccacagtatggttgggtttcaacatatttttcaactaatattagtaacactcagccattaaacatcgatctttctaacgaagaaagcaaaaggcgtctttataacagattgttgtataggagcaaacaaagagggtttctggagctggatttggttttgggaaaatgggttgaagaacatatccattccatggatgaaaatggaattaaagctcttgttaatgtcctcgatttggaaaaccccgacctgtggaaatggctaaccggtcaagaacaaccacccgtagcagtgaccgttaatcctgtcttctctgcagtgcaacagaaggttttgaaaaac

SEQ ID NO: 7987 - DNA, 361 bp, Gossypium hirsutum
  Clone ID: uC-gsronu33B139a09b1
gtttctcttccattctctggtggttggataacatagatgctggcctcctagtttgtgatggactattaaatttagttaagaactcataggaactttagactgtttttggtggattctgctccttttccttatctgtaccggattgattgcccttgagcattccgaataggtttaattgaatgtagagaagggtagtaacagtgatacttaccatcttaaatgctcaggtctagagtgaaacttatggtgcatatgttaaagcttgtttctattcaaaaaaaaaaaaaaaaaaaaaaaaaaaaaaaaaaaaaaaaaccaaaatacaaaaaaccaaaaacccaaaaaaataataaaatacccc

SEQ ID NO: 7988 - DNA, 441 bp, Gossypium hirsutum
  Clone ID: uC-gsronu33B139a10b1
ttcgttctgtcaactacaccttaatggtcacctttgtctccttccttcaagtccttctgttaatcagacaaatggaacatagcaacacacaatcgggagctgcaaaagtttcaattttaacgattggtcaacaggctatcatggatgcttatctttgcctcttacatctcactgcaggaatactggttgagtccttgtttaatgcttttgcaactgcggcattcttcaagtttgtagttttctccatttttgagatgaggtaccttcttgcaatatggtaggcatgtagaccgatgaataacggtgaaggttgagagacaatgaggcgtgagctatcagttctatacaagccgtttctatgggatccttttaggaggcattttggtcatgtacgagtttcataatttttgcagcctatacttctccttttgtactcatttt

SEQ ID NO: 7989 - DNA, 444 bp, Gossypium hirsutum
  unsure (1)..(444): unsure at all n locations
  Clone ID: uC-gsronu33B139a12b1
ttctcggttttctttggatctggatcacagaaagaagttctctaatggatactcgtaaaaggggaagacgtgaagctgggttcaatgctaatggcggcatcaagaaatctaaaccagaattggaatctttatcaactggtgtaggaagcaaatcgaagccttgcaccaagtttttcagtactgctggttgtcaatttggtgagagctgccatttcctgcactatgttcctggaggttacaatgcagtgtcccagatgatgaaccttgcaccagctgttcaaccagcttctagaaacgtggcagcgacagctgcaatacctcatggatctgcctttgcggtcaaaactcggttatgcaacaaatntagtagtcccgaaggttgtaagtttggtgataaatgtcattttgcacatggagagtgggaacttggcacacctattggtt

SEQ ID NO: 7990 - DNA, 485 bp, Gossypium hirsutum
  Clone ID: uC-gsronu33B139b09b1
ttttattactggttctcttcacatgaccttccaaaccgccgttcttattgaaacccttaccgccctcggagctgaagtccgttggtgctcttgcaacattttctttacccaagaccacgctgccgctgccatcgctcgtgactccgccgctgttttcgcttggaaaggggagaccctccaggaatactggtggtgtactgagagagcccttgattggggtcctactggtggacctgatctgatcgtcgatgatggtggtgatgctactttgttgatccacgaaggtgttaaagctgaggaagtttatgagaaaactggtcaactcccagatccggcttcgactgataacgctgagtttcaaattgtttaaccattattagagatgggttgaaagccagatcccaagaagtatagaaggatgaatgagagattggtaggtgtttctgaagaaactacaactggagttaagaggctttattagatgc

SEQ ID NO: 7991 - DNA, 455 bp, Gossypium hirsutum
  Clone ID: uC-gsronu33B139b10b1
ttttgatcccaaagattcagcccgtgtcataaactcggagctcgaactcaatcacagagagagaaagagagtcgatttccttttctcaaaacaatttaaaaaagaaatcttttattttctgtgaatttctctttgactctttcggcactctctgcaactgcaatcatgacctcaattgtgcaaggcttttccaagtctttggccatgactgtgctatcggagatcggcgacaagacgttcttcgctgccgcgatcttggcaatgcgccatcccaggaaacttgtcttgttaggatgcctggcagctttaattgtgatgactattctttctgctgttgttggctgggctgctccaaatcttatctctaggaaatggacacatcacattacgactctgcttttctttggatttggcctgtggtctctatgggatgcatttatggagaatggggaggc

SEQ ID NO: 7992 - DNA, 487 bp, Gossypium hirsutum
  Clone ID: uC-gsronu33B139b12b1
ttctgccataaatttccttattgtctagctgttttactttagtttctctatttgtttggtcacttttatggccttgttttcttgtcaggcggatagggaattgcagccatggattgccaaaaatgatgatcaaggtcagaagatgtggagaatcaaccagcggattgtaaagttgatagtggaactaatgagaaatcatgatatcccggaatcattggtaattgtagcaagtgcctctgatttgcttctacgtgccactgatggaatgctcgtagatggggaagcttgcactttaccacaactcgagctgttggaagcaacagctagagcagttcagccagtactagagtggggggaatcaggactggctgttgtggatggactttcaaacctgttaaagtgtcgtctgccagctacaactcgatgtctttctcatccaagtgcacacgttcgtgctctcagcatatcggtacttcgcaatattctg

SEQ ID NO: 7993 - DNA, 402 bp, Gossypium hirsutum
  Clone ID: uC-gsronu33B139c07b1
gttactgacgggtcaggataggagcgatttctcttacaaggtgattaaggacgtgcaggtggtgccgcgtttcataggtgagtggggtgacgttatcataaccttgaaagatgaaactaaggttgatcttaggagcgtccctaggtttagagagattgcaaagtactgtctcgccatggccgagaaacctgttgttttgaaagaaactggacctaaagggttttaggttaaagctggaaaggtatgtaaattctgggttttgctttgataattttttttatacaacgttggtgtcacattgttatagtttaattgagaagataatgtatctcttaaaattttcatttgatcaacaatatgtgttacaattctggggtcctttggttatgcatttagtactaa

SEQ ID NO: 7994 - DNA, 520 bp, Gossypium hirsutum
  Clone ID: uC-gsronu33B139d04b1
ttttatctaaaaaccgcttcgggcaagcccttcgttgatgttttgaaggaaggtggtgtcctccctggcatcaaggttgacaagggtacggttgagcttaatggaacccatggcgaaactttcacccagggtctagatggccttgcacagcgatgccagaagtactatgaagctggtgcccgctttgctaaatggcgtgctgtccttaagattagtgctaatgaaccaaccgagcttgcaatccaagaaaatgccaacgggctagctatgtatgctgccatctgccagcaatgtggccttgtccccattgttgagcctgaaattcttgttgacggatcacatgacattaaaaagtgtgctgcggtgacagagcgtgttcttgctgcttgctacaaggctttgaatgatcaccatgtcatgcttgaaggtactcttttgaagcctaacatggtgaccccccgttctgactccccgaagggtgccccagaggttattgctgaatacactgtccgtgccttgc

SEQ ID NO: 7995 - DNA, 414 bp, Gossypium hirsutum
  Clone ID: uC-gsronu33B139d06b1
ttcttctctccctctcttgttcatttaacatggccaacaacacacagatcctcaacctaatctccatggccttactcctttttgttagcaacagtgaagggtactcagcagctgaagaagaagctgacagaatctcagcacttccaggccaacccaaagtctcttttccacaattctctggctatgttactgttaacaaagcagctggtcgagccctcttttactggctcactgagtctcccaatttcccttcctctaagcctcttgtcatctggctcaatggaggtcctggttgctcctcagtggcatatggggcatcagaagagattgggccattcagaataaacaaggtaaccctaaggttgtatctcaacaagttcttttggaacaatgtggctaaccttttgttcttgg

SEQ ID NO: 7996 - DNA, 597 bp, Gossypium hirsutum
  Clone ID: uC-gsronu33B139d08b1
tcgttcctccatcaaagaagaagccaaacaatgccgtctaaattcgacccatcccaagtcgtcgacgtcttcgtccgcgtcaccggtggtgaggtcggagcagccagttccctcgctccaaagattggtccgttgggtctctctcccaaaaagatcggtgaagacatcgccaaagaaactgccaaagaatggaagggtctccgcgtaactgtcaaactcaccgtccagaaccgtcaggcgaaagtcgctgtggtcccgtcggcggcggctcttgtaatcaaggcgttaaaggagccagagagggataggaaaaagaccaagaacatcaagcacaacgggaacattaacctcgacgacgtcatcgaaatggctaggtaatgaggccgatgtcgatggctaggatttgagagggactgtgaaggagattttggaacgtgcgtctccgttgggtgtactgttgatggaaaagaccctaaggatctgcagcggagaacgatgatggagatgttgatgatcctttggagtgagcaagcctgatctttttgtttttacgcttatcctatgctggctttttagaaaatggtcatttagggtttt

SEQ ID NO: 7997 - DNA, 320 bp, Gossypium hirsutum
  Clone ID: uC-gsronu33B139d09b1
tttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaagaaaaaaagggggggccgttttgggtgttaaaaccttgtctgcaccgccctgaatggccttgcagcatattgtggttacgcacaagtatttaaatgggcctgcggtccacaccgatagtcggtgcaaaccaatgggtagcctgaattaataattttaagcggaatgtctcgtcccattgagcggg

SEQ ID NO: 7998 - DNA, 205 bp, Gossypium hirsutum
  Clone ID: uC-gsronu33B139d10b1
tttacgcgtacgcttattactggtccgaattggttttcgatgggtactcgagttgatgttttgactacaatacttatctggtgttgctctacagagtcacgctgttatgtacacgcattttcaaccttttagtcaactcttgctgtcactgatgctcatttacttggacttagcattgcagcctctgacttgatcacaccctgat

SEQ ID NO: 7999 - DNA, 413 bp, Gossypium hirsutum
  Clone ID: uC-gsronu33B139e03b1
ttttaaaataaaaaaaaaaaaaaaccacccaaacagacaatagactaggacaggaggatctctcagggtttaggtgatggcttcgaagcggatcttgaaggagctcaaggatctccagaaagatcctcctacctcttgcagcgcatgccctgttgctgaagacatgtttcattggcaagcaactattatgggtcctcctgacagtccatatgctggtggagtgtttctagtcaccattcatttccctccggactatccatttaaaccaccaaaggttgcattcaggacaaaggtctttcacccaaatattaacagcaacggtagcatttgccttgatattttgaaggagcagtggagccctgccctcaccatatccaaggtattgctatctatctgctcactcttgacggatc

SEQ ID NO: 8000 - DNA, 81 bp, Gossypium hirsutum
  Clone ID: uC-gsronu33B139e06b1
tacgcgccctgaagacgttcattacgcgcggcagttgtatgggatccgcgccagcgtgaccgttacactgtgtagcaccct

SEQ ID NO: 8001 - DNA, 530 bp, Gossypium hirsutum
  Clone ID: uC-gsronu33B139e08b1
gttgctactgagcaagaaattctttgaaaccattgttactcatccaacatttgagcagatggacttccttttaatactaaacaagtttgatatattcgaggaaaaggtagaacgggtaccattgactcgatgcgagtggtttgatgattttcatcccctgatcagtcgtcatcgtacaaatacaaatagcaacagcattaataataaccctaccctgggacagttagctttccattatgttgctgtcaagttcaagagactttattcttcactcactggccggaagttgtatgtttcacacgtgaagggactggaacccaacagcgttgatgctgcacttaaatttgcaagggagattctaaaatgggatgaagagagaatcaacttcagcttaagtgaacactcattttacagcaccgaagcaagttccttctcttattgatgtctaattatcgggtcagaaaaggtctttttttggttcattaatgccagtgtacagtgtcatgactcatgctatggtgctttattag

SEQ ID NO: 8002 - DNA, 468 bp, Gossypium hirsutum
  Clone ID: uC-gsronu33B139e12b1
ttctgttgtgaacttctcggctcctcgttgtgatccaaacaacattgcaagggatttgattcgttgtggagaaatgaaaggaattcgtattgatcccccatttgatatattcaatgagatgaaccagaatagacgcctttcacccgtcgttagagttgaaaaaatgtttgaacagatacagtctaaacttcctggagctccgcagttccttctttgtctgcttcctgataggaaaaactctgatctttatgggccatggaagcggaagaatctttctgagtatggcatcgtgactcagtgtatggcaccagctagggtgaatgatcaataccttacaaatcttcttctgaagatcaatgctaaacttggaggtcttaattcattgctcactattgagcaaacaccttcaatccctatgatttcaaaggttccaactatcatccttggaatggatgtatctcatggctc

SEQ ID NO: 8003 - DNA, 447 bp, Gossypium hirsutum
  Clone ID: uC-gsronu33B139f04b1
ttcatgttttcggagaagggtatcattaaaccgggtgagagtgttctaatcgagccaaccagtggtaataccgggataggattggcattcatggtagctgctaagggttacaaacttgtaattacgatgcctttttcaatgagtttagaaaggagaatggtcctccgagcttttggagctgaacttgttctcacagatcctgctcgcggcatgaaaggggctgttcataaagctgaggaaattcatgcacagacgccaaattctttcattcttcagcaatttgaaaaccctgccaacccaaagatccattactagacaaccggaccagagatttggaaaggcacaggcgggagggaagatatacttgtctcaggtattgggactggaggtacagtaacaggagcatggaagtttcttacagagcagaatcccaacatttagctcatt

SEQ ID NO: 8004 - DNA, 496 bp, Gossypium hirsutum
  Clone ID: uC-gsronu33B139f06b1
ataccttttgcttagcttaaaaaatcttgaatctgcactctcctacttccctcgttatcgtcaatggcttcggacaagaagattaagatcgggattaacggatttggaagaatcggacgtttagttgccagagttgctcttcagaggaacgatgttgaactcgtcgccgttaacgatcccttcattttcaccgattacatgacatacatgttcaaatacgacagcgttcacggtcaatggaagcaccatgatcttaaggtcaaagactctaaaaccctcctcttcggcgaaaaacccgtcactgttttcggaatcaggaaccctgaggagattccatgggctgaagccggggctgagttcgttgttgagtcaactggagtgttcactgacaaagacaaggctgctgctcacttgaagggtggtgctaagaaagttgtgatctttgcccctagcaaagatgcacccatgtttgtaatgggtgttaactagaaagact

SEQ ID NO: 8005 - DNA, 226 bp, Gossypium hirsutum
  Clone ID: uC-gsronu33B139f08b1
tttgagtgaagaattagaagcctgtagctttagtcttgtttccacacacccattgttcctttttttctttttttttccttttacttttagttttttttgtagcttttgtcaatgtatgatatcgccgttgtcaaaaaaaacaaaaaaaaaaaactaaaaaaaaaaaaaaaaaaatatgataaaaaaaaaaaaaaaataaaaaaatgaaaatataaataaaataaca

SEQ ID NO: 8006 - DNA, 445 bp, Gossypium hirsutum
  Clone ID: uC-gsronu33B139f11b1
tttcaagaagcacgaaaaaaaaatcaaaatcttccaaaagaaaaaaatttaaagatggtttgtatagcttgcctattgccactcttcctcgtaccgatcgtcaatattttgcctctcctcttctatttcatcatgggtaaagtttactggcttcttggatgggaataccggaaaccggagagggcacctgcggcgtgtccgtataagccgcctgcgaaaacggaaaactctagcaaagtttggccagaaactgaacctactgtaccagagtctagttcaaaaccaatgggagtaacagataacaagcaggattgatactgaagtttgtaagtgggtttccatggaacaaaatccaggcataaatgtatgatctttttgaagattaacttcttaagcttgttgatcttatctgaacaaagaaaaaagaatttttgttgatttccag

SEQ ID NO: 8007 - DNA, 276 bp, Gossypium hirsutum
  Clone ID: uC-gsronu33B139g02b1
acgcttgatttcccgctgagtttaagcatatcaataagcggaggaaaagaaacttaccaggattcccctagtaacggcgagcgaaccgggaaaagcccagcttgagaatcggtcgccatcggcgtccgaattgtagtctggagaagcgtcctcagcgacggaccgtgcccaagtccctggaaaggggcgcctgatagggtgaagagccccgtcgggcccgacccctgtgcaccaagaagggcttgctaccaatcgggttgattgggtatgcaagcc

SEQ ID NO: 8008 - DNA, 297 bp, Gossypium hirsutum
  Clone ID: uC-gsronu33B139g06b1
atattattcaaataatcataataaacatgcatttaaatattttataatagctgattaagcattagcttagttggcaacgtttgctgagttcaaacgtacttatgaaagcacatgtatgtatgttattgtcatgaaaattaatgtaacctttgctttgtgtatgaaagtacatgcttctcctatgttatatgattaataacaaaaacttttactgttattattatagaatataatgctcatttaagataactttaatacttaataataatcctatggggcgtccgttctaaaggttcc

SEQ ID NO: 8009 - DNA, 526 bp, Gossypium hirsutum
  Clone ID: uC-gsronu33B139g07b1
ttcacgcgtccgctttctagctatatccttatcagctttcaaagatggcaggaatcgcctttggtcgctttgatgattccttcagtttggggactgtcaaggcctaccttgctgagtttatctcaactttggtgtttgttttcgccggcgttggctctgccattgcttacaacaagttgacaactgatgcagccctagatcccgatgggctagtcgccattgctgtttgccatggatttgctctctttgttgcagtggctatcggtgccaacatctcaggtggccatgtcaaccctgcagtcacttttgggttagctcttggtggccaaatcaccatactaactggcatcttttactggattgcccaacttcttggatccattgttgcttgcttcttgctcaggctgtcactggtggcttgacagttcctatccacggtcttggagcttgagtttgagctattcaggagtggtgatggagatcatcatcacatttgcattggtttacacagtgtttgcaaccgcat

SEQ ID NO: 8010 - DNA, 363 bp, Gossypium hirsutum
  Clone ID: uC-gsronu33B139g11b1
ttatggaagcaactgtgctgagcttgcaaagcaggaagatatcgacgggtttctcgtaggtggcgcttccttgaaggggccggagtttgctacaattgtcaactccgtaacatccaaaaaggtggctgcctaaatatatatgaagctgattgaaagtaagaaataaaggacctaaatgaagaagctatttgaggttgaagcttcacgtgacatatttagtgttatataccccatggagttttttgatcacttattgagttccatttatccggaaaatgataagaaggaaaaaaaagctgtggcgaccatataagttgaaatcgtaaagagggcactatctatgaaaggcaaagtaacagatcc

SEQ ID NO: 8011 - DNA, 311 bp, Gossypium hirsutum
  Clone ID: uC-gsronu33B139h01b1
ctcacgcgtccgcccactcgtccgcccacgcgtccggtttgcgtgtgggatggatggtaagttttggtggaaaagaaatgaggtctctgcttgaagaagaccaaatggggtctgaataaggtgatggggattgtgtgggagatgatatttcgccattggtgcagtccagttttgctgcatctggttttcaattaattaatcaaaaaaaaagatgattttcaaaaaaaaaataaaaaataaaaataaataattttattaaaaaaaaacaaaattctaaaattttttcctcttttaatttttccttttttttt

SEQ ID NO: 8012 - DNA, 399 bp, Gossypium hirsutum
  Clone ID: uC-gsronu33B139h05b1
ttcactcttccggggaatctggagttgcaaggtcacttatggtttgtagggcctgaggagagatttttcacatatcgaggaaatgccttctttctacatgggatcagtcttggacctaagattatctcgtcaaaagctctatgatgttttaaggttatattttggcattcctgattagcaattacatcatgttattcaagtcttgacaatgttttttaaatttagttttattttatttaccattcttgcgaaatatgttgcagtattttaaaaaatgtttcaagacttgaataaccctatttaaaaatataaaaaaatatttaaattttattaaaaaaaaaaaagaacaaaaagcccctgaagagtatgaaatccaaaaaccctaactagaaaatttat

SEQ ID NO: 8013 - DNA, 282 bp, Gossypium hirsutum
  Clone ID: uC-gsronu33B139h09b1
tcgttacgcgtacgcccacgcgtccgcccacgcgttcgcccacgcgtccgttctttctcccctttatcttctccaaatccgtcttttagtttcctttaactatcattgtcaccaagcctttttttattctcagtgtctcaaattcagatctatatcgcattgccttagtgttggcagtttcatttttgagattcgatgagtcgcttcgatgctaaccctttcgcagaggaagaggtcaatcccttttcggatccagcagttaggaaaggatcggggcaaatc

SEQ ID NO: 8014 - DNA, 473 bp, Gossypium hirsutum
  Clone ID: uC-gsronu33B139h12b1
tcgttcacgcgtccgcccacgcgtccggtcatgatttagttatccctgtggttatctgcactggctattattgtactacaatgctggataaaaccgagggaaaagctaggtgggaagggtgtcaaataattgtatttctcaaggttttaaaacttatcctacaattacttcattcagagaacttcatttctttgttgaagaattgatgagaaaatgatgttgtcagcttccagttccagatgtttgctacttaaaacttttatcaagtttgatattagtcattcaatttcgtttcatacatgggttttgtatgttccttctcatgccaatgaaacagagaatgagactaaacatctattgcaactttggtgcagcaacgttgcatgccaatcaaactgaaaatggagctatgaagtctgaagagttccaacggttagacttgtggaaagattgttgtagctgtagctagtatt

SEQ ID NO: 8015 - DNA, 674 bp, Gossypium hirsutum
  unsure (1)..(674): unsure at all n locations
  Clone ID: uC-gsronu33B141a01b1
cccacgcgtccggtatcgacttggtcgccggcggcaagagcaagaagacgaagagaactgctcccaagtccgatgatatctacctcaaactcatcgtcaagctttaccgatttctggtaaggactggcagcaaattcaatgctgtgattttgaagcgtctttttatgtgcaaagtgaacaagcctcctctgcctctatccagattgattgaattcatgaagggcaaggaggataagattgcagtggtagttggaactgtcaccgatgacattcgtatatatgaagttcccgctctgaaggttactgcactaaggttcactaagacagcgagggcgagaattgacaaggctggtggggaatgtttaacatttgaccaacttgctcttcgagcacctcttggacagaacacggttctccttcgaggtccaaagaatgctcgtgaggctgtgaagcacttcggacctgctcctggtgtgccacacagccacaccaagccctatgtgcggtcaaaagncaggaaatttgagagggctagaggcagaaggaacagcacaggctcagggtttgagattccactgcactggaaaaaaaaaaactatcaaccatcatgataatggaatngctcagtttgttttttgcttccaccttctgtcttttttttcatgatgaattgg

SEQ ID NO: 8016 - DNA, 525 bp, Gossypium hirsutum
  Clone ID: uC-gsronu33B141a02b1
attaagcaggagctcgaagccgccaagaagaagaatgtcgagaaccggaagttgattttcaacagggctaagcaatatgcaaaggagtacgaggctcaggaaaaagagttgattcaattgaagcgggaggcaaagttgaaaggaggattctatgttgatccagaagctaagcttttgttcattgttagaatccgcggtatcaatgccatgcacccaaggaccagaaagatcttgcagctcctacgtttgagacagattttcaatggtgtttttcttaaagtgaacaaggcaacaatgaacatgcttcaccttgttgaaccttatgtgacttatggatacccgaatctcaagagtgttagggaactcgtttacaaaagaggttttggaaagttgaacaagcagcgagttgccttgaccgacaacgcaattgttgagcaggcactaggcaagttcggcatcatttgtgttgaagatctcatccacgagataatgacttggggacctcatttcaggaaagccacaact

SEQ ID NO: 8017 - DNA, 241 bp, Gossypium hirsutum
  Clone ID: uC-gsronu33B141a03b1
atcctctgtgtccggttacaggaaagacgagtacagttggaggtatgatgatgataccccagaagatgtgattcgagcttcaactgccttggaaaatcttcaattggacagaaaggcccggaatcttagtacttcttggcggcatgccagtgatggaatgagtgaggatgatggcagggccgatcatatgtagtgccgaacaacatatgttgcattatggcatgtttagtttagccatgta

SEQ ID NO: 8018 - DNA, 530 bp, Gossypium hirsutum
  unsure (1)..(530): unsure at all n locations
  Clone ID: uC-gsronu33B141a04b1
gtaagatccatccggcaaagacattaacgcactggagcagcacataaagaaccttctttgtccatctactccgtttttcttcaacactctctatgacccgtaccgagctggtgcagatttcgttcgtgggtacccattcagtctccgcgaaggtgttcccactgccgtttctcatggcctctggctcaacatcccggattatgatgcaccaactcagcttgtcaagcctcttgagagaaacaccaggtacgttgatgctattatgacaataccgaagggaaccctctttcccatgtgtggtatgaatctggcattcaaccgtgaattgatcggccctgctatgtactttggactcatgggtgatggtcagcctattggtcgatacgatgatatgtgggctggctggtgtaccaaggtcatatgtgatcacctcggactgggagtgaagacaggattgccttacatttggcacagcaaagcgagcaacccgttgtgaatcttangaaagatacaaaggatttactggccag

SEQ ID NO: 8019 - DNA, 489 bp, Gossypium hirsutum
  unsure (1)..(489): unsure at all n locations
  Clone ID: uC-gsronu33B141a05b1
atctccttaagtctttggatgaggaactttcaagtgactttgagcgagctgtggtgctgtttactttggaccctgcagagcgtgatgcatttctggctcatgaagctacaaagaggttcacatcaagccattgggttctcatggaaattgcttgcactaggtcttcacatgaactgttcaatgtgaggaaggcgtatcacgatctttacaagaaatcccttgaagaagatgttgcacaccataccaagggaggctaccgcaagcttttggatccacttgttagtgcattccgataccagggagaggaggtgaacatgacactggcaaggtcggaggcaaagatacttcgagagaagatctcagacaagcagtacagtgatgaggaggtcatcaggattgtaacaacacggagtaaggcacagttaaatgctactctgaatcattacaatactgcatttgggaatgctatcaacnaggatttgaaggccg

SEQ ID NO: 8020 - DNA, 408 bp, Gossypium hirsutum
  Clone ID: uC-gsronu33B141a06b1
cgtagatgaagacttggtatcaactgactttgttggggacagcaggtcaagcatctttgatgccaaggctggcattgcattaaatgacaattttgttaagcttgtcgcgtggtacgataacgaatggggttacagttctcgtgtgatcgacttgatccggcacatggcttctgcctaagtgagtgattttggtgaaccaaactcatttcataatggactttttaataatagcctcgttcttcagctttagcaaaatatggaagagatgctatgggaataataatagaaattgctcgggattctgggagtttctaattttacactgtaattgtgttctgtctgaaacacttgtaatatatataattacaaggaaccaaacaaacaaggcaaggctaaggtaaacttggg

SEQ ID NO: 8021 - DNA, 589 bp, Gossypium hirsutum
  unsure (1)..(589): unsure at all n locations
  Clone ID: uC-gsronu33B141a07b1
aaatccctaaccctttccctccctttttttcccccaaatcggaaatccacctccaccgatccaccattccacctccggtcctccacgactccacctccgctctaacggtgcttctagccttcttcgtcttctacctttgaatttcaaagaaacaatcgacattgaaatcgatttggcttaccttagcttcctttcccgacttgaatttttatgactatggctagttcgaacactcttatacctgtggacgatggatttaatgagtatggaagtgctctcaaacgtcaaaagtctaccacttcaaaggtgtgggatgaaatgacaaagcttgaatgcgagaacaaaaacgaattgaaggcacaatgtaaataactcttccgaatcggcttttagcatgggtaagaaagttatcacacctttgaggagttcacttaagccaaaaacggttcaagccgttgtttgcttggatgattggatgcgagctaagggattttcagcagaaattggttgcaaaaaggacgatgacgacaatgacgacgatgaggacgatgaggatgatgatgtttcttcggtagctntttaagatact

SEQ ID NO: 8022 - DNA, 528 bp, Gossypium hirsutum
  unsure (1)..(528): unsure at all n locations
  Clone ID: uC-gsronu33B141a09b1
gttttcaacagatcaagtagatttggcaggctccagggtatcaaatgtgcaattgctggaaagaatctgtatattagattcacttgcagtacaggtgatgctatggggatgaacatggtttccaagggagtgcaaaacgttttggatttccttcaaactgatttccctgacatggatgtcattggcatctctggaaactattgttccgacaaaaaaccggctgcggtaaattggattgaaggacgaggcaaatctgttgtctgtgaagccaccattaagggtgatgtggttaggaaggtcttgaagacaagtgtggaatctctcgttgagcttaacatgctgaagaaccttactggatcagctatggctggagctctgggtggatttaacgctcacgccagtaacatcgttgctgcaatctacatagctaccggccaagatccggctcaaaaacgtcgagagctcgcattgcatcacgatgatggaagcttgtaatgatggcnaggatctccacatctctgtcacaat

SEQ ID NO: 8023 - DNA, 434 bp, Gossypium hirsutum
  unsure (1)..(434): unsure at all n locations
  Clone ID: uC-gsronu33B141a10b1
cggacgcgtccgcccacgcgtccgcccacgcgtccgctcaacatcctcttcttttccctggtgagtgcttgtggttcctgcccttcccccaaccccaaacctaaacctaaaccaaagccaaaccccactccctccccatcttcttctggcaagtgccctagagatgctcttaaactcggtgtatgtgctgatttgctcggtggcttgctcaacgtcaccattggtacgcctcctgttcaaccctgctgctctctcatccaaggtcttgctgatcttgaagctgccgtttgcctttgcacggcaatcaaagctaatattttgggcatcaaccttaatgtcccactttccctcagcttgcttcttaatgtctgctcatagaaagtaccctctggcttcaatgtccgctaatcagntctctaaatctttctcttctt

SEQ ID NO: 8024 - DNA, 370 bp, Gossypium hirsutum
  Clone ID: uC-gsronu33B141a11b1
gtggcctttgtcattttaactaaataaattctattactttagtatgtatcagcaaatcttcatgaggatttggttcttaattatgtgtaatgtggcttttctgctatgtcagaatgtattatgatatttaagaaagtttgttttctattgaaaaaaaaaaaaaaaaaaaaaaaaaaaaaaaaaaaaaaaaaaaaaggacgggccttccagtgtatccaatccaagcttcccttccctgccacgcgatggcttttctatagtgtagcgtaacctaaattcaatggcctggcgcgtcgcttcacaagcgactggactgaccatgccgtgacgcaacccaatttactcgccttgcagcccattctccttagct

SEQ ID NO: 8025 - DNA, 559 bp, Gossypium hirsutum
  Clone ID: uC-gsronu33B141a12b1
cccacgcgtccgctcctccttactattacaagtctccacccccgccctcacctagtcccccaccaccatactactacaagtcaccacctccaccgtctccctcaccacctcctccttactactacaaatcaccaccaccaccctcacctagtcccccaccaccatactactacaagtcaccacctccaccatctccctcaccacctcctccttactactacaaatcaccaccaccaccttcacctagtcctccaccaccatactactacaagtctccagtacctccaccatctcctagtcccccaccaccatctccctcaccaccacctccttctccatcacccccgccaccttactattataagtcacctcctccaccacctccttatcactactagtcacctctccttgagtgaaatttccacctcattattaccctacatcaccaccagtttcaaagggccactaagctaagttaatatttaatctctttactcaggttgaagatttgataaggagaagaatattgtgaatttcttgatagcttcctgacatgttt

SEQ ID NO: 8026 - DNA, 450 bp, Gossypium hirsutum
  unsure (1)..(450): unsure at all n locations
  Clone ID: uC-gsronu33B141b03b1
ggtcatcgtaaattcgagtacaaagcgctaaccgagatgagagccaagtggaagaagaagcgtatgaggaggctgaagaggaagcgccgaaagatgagacagagatccaagtagatgcgccttggactgaattagttttgccctgacaatcccttgtcttcataattatcctgcatatgttgcatgaagttgtgaagattgaagggtattttcaggcaaccttatctgttttgtcttctatatctcggttaaagttttaagactgtttgagatgtttgtctagtactattagatattatgttggggatttgtggtttgatctgtgtaagcagttatcttaacatcctaaatgtttgaaattgaaacttttggtcttcttatatggnctataatatgcgagatagattgttttctttnaaaaaaatacatnaacaaacnctacaaaaaggg

SEQ ID NO: 8027 - DNA, 123 bp, Gossypium hirsutum
  Clone ID: uC-gsronu33B141b04b1
tttcggtggtgattgatccatgatcatctatgatttatgaggtaactaaaatagatatataaactaggaaaaaatttacctagcgtatattccatagtgtaacaaactaactatgtggtgcat

SEQ ID NO: 8028 - DNA, 530 bp, Gossypium hirsutum
  unsure (1)..(530): unsure at all n locations
  Clone ID: uC-gsronu33B141b05b1
gcgttcgctctcgatccacatcataaaaaaagtaaaggagaaaatgaagggtctgcaggcacttatattggcaatggtaacggctatggcgatcgctacaactgatgctcaaagcatttgcagcatgcccgcttcaggtttgatggcatgcaaaccagcagtgacccctgccaaccctccgccgcccacgtcaacttgctgttccgccctctcccacgctgacatgcgttgcctttgctcatataagaactcaagctgttgccttcccttggtattgacccaaaccttgccatgaaattgcctagcttgtgcaagcttcctcatcctgcaaattgttagttcctggctctccatatttgatctcaaatgtgagggaaaatcatgcttattataagcctctacttcacattattgtactgagctcgggttttctttttcctttatttcttttatgtgttgnngttcgattggtatctatagtcgtgtaatatacatacgtgtgatttctcaccaataatcatatattagta

SEQ ID NO: 8029 - DNA, 589 bp, Gossypium hirsutum
  unsure (1)..(589): unsure at all n locations
  Clone ID: uC-gsronu33B141b06b1
cccacgcgtccgcccacgcgtccggtgaagataagtaaaatggggtcaaagaagcctttcctggtggcgcttctagtgcatgctctttcttctggcatgatcttactgtccaaggcagtattcaatatgggtatgaatatatctgtgtttgtcttctacagacaagttgctggaacaattttcatggtccctttcgccatggttttcgaaggaaaacacgccaagccactttcaatactgacctgtttgaagatttttatgcttgcttcgctggggattaccttaaccttgaatatttacggagtagcactcatttacacatctgcaagccttggtgctgccaccattaattgcattccagtcataacgtttgccttcgcagttttactcaggatggagaaggtgagagtgaagactgtacctggcattgcaaaagttgcaggtatagctggtgtgcatggctggngttgtcactctagccttntacanaggacccgctntgaaacctcccttncatcttcataatttccgtccccatagcggcgcccaggatggtgaccatgaccatgcttcttctgccaaaaattgg

SEQ ID NO: 8030 - DNA, 423 bp, Gossypium hirsutum
  Clone ID: uC-gsronu33B141b07b1
ttcccacgcgttcgcccacgcgttcggccacgagacagcctataccaaaatcgttgaaaagctgtttgagattgatcctgatgaaacagtcctggcatttgctgacatgatgaagaagaaaatcgccatgccggctgagttcatctatgatggcagagattataacttatttgaccactactcagctgttgcccaaagaatcggggtttacactgctaaggactatgttgatatagtagagcacctggtggatcgatggaaggtgaaggagctagctgggctttcagccgaggggcgtaaagctcaggactacttgtgtacacttccttcgagaattataaggttagaggagagagcgctagatagggccagggaagcacccagtgtcccattcaggtggattttttatagagaagagaatct

SEQ ID NO: 8031 - DNA, 472 bp, Gossypium hirsutum
  Clone ID: uC-gsronu33B141b08b1
cccacgcgtccgagtttgggtattagatttaaattagtttgaagggctttcgagttctgggttttccattttggggtaacacccaggttagtcaaattgtggacatcacggctatacacagagtttaccggcctcttcttattcatgcccgatctgtacgacgtaagagttgtgtgatcgagaggaaccctgcgccgcacggcgggcgtggagctttgccttctgaaggcggtagtccttccgatctcctcttccttgctggcggcggtgttgtcttttagagtttcagtagttggtataggtagcttttagtataaaaaaaaaaaaaaaaaggaaaaaaaaaaaaaaaaaaaaaaaaaaaaaaaaaaaaaaaaaaaaaaaacagccaaccaaaaaaaaagaaaacaaaacaaacaaacccttgggggggccccccttttttttttttttttttttttggctttggttgggg

SEQ ID NO: 8032 - DNA, 525 bp, Gossypium hirsutum
  Clone ID: uC-gsronu33B141b09b1
ctggaattgggccaggtagcttcagcagtattcctccagcaggtggtgctgaagcttcagctgagttttcaatgaaaattttgtgcccagctgggaagattggtggtgtaattggcaagggtggctttaatgttaaacagttacagcaggaaacaggagcaggcattcatgttgaagatgcagcaacggagtcagatgagcgagtaatttgtgtctctggaattgaggctcttgggaaccctagatcgcatacaatagatgccattctacagcttcagaataaaactagtgaatcatctgagaaaggtacaattactactaggttgcttgttccatcaagcaaggtcgggtgcattcttgggcaaggaggtcatgtaatcaatgagatgaggaggagaacccaggcagatattcgtgtatgctcgaaggatgataagcctaagtgtgcatatgaagatgaagagctagtacagatatctggcattttggtgtcactaggatgctttggctgagattgcttcaagc

SEQ ID NO: 8033 - DNA, 427 bp, Gossypium hirsutum
  Clone ID: uC-gsronu33B141b10b1
ggtgtagactgtggttgaccatgccctgagccgctaccttggctcacagatgcttcataaataccgagaacaaattctaaacggcagggcccaacaggatgggagaactcgatcacgggacgcctatggatgtggacagcatctactacaggaacactactggacgaccaggactggttgattgaggatcaccaactggtgttacagacagagcgaccggagccttatgctgggaataggggcatgagccaacactatgtgtgagaggagttgttacgggcctttactgtgctctaatggaccaagactctcactggtcgcacgggatagatcaggaggctacgcaatcttgcagacctgcttaagtgaattgcctcgtctaagagccagccgagagtgggcgtgtaaagggatggaacttgtttgt

SEQ ID NO: 8034 - DNA, 557 bp, Gossypium hirsutum
  Clone ID: uC-gsronu33B141b11b1
cccacgcgtccggaagctacaaagaagttcacatcaagcaattggattctcatggagatagcttgcagtaggtcttcgcatgaactactcaatgtgaaaaaggcgtatcatgctcgttataagaaatcccttgaagaagatgttgctcaccacactaccggagagtaccgcaagcttttggtccctcttgttagtgcattccgatatgagggagaggagtgaacatgacattggcaaaatctgaggctaagatacttcatgataaaatctcggacaagcattataccgatgaggaggtgattaggattgtatcaacaaggagtaaggcacagctcaatgcaactctcaaccattacaatacctcattcggcaatgctatcaacaaggatttgaaggctgatcccagtgatgaattcctcaaattactaagagctgtgatcaagtgcttgaccaccccagagcaatatttcgagaaggttctacgtcaagccatcaataagttgggatccgatgaatgggctcttacccgagtcgtcacactcgtgcagaggtcgaca

SEQ ID NO: 8035 - DNA, 563 bp, Gossypium hirsutum
  Clone ID: uC-gsronu33B141c01b1
tcttcgcgtccgcccacgcgtccggcttttgggttgtcatcaggtgtgggcgtgtctaacgcattggttttcgaaatcgtgatgaccttcggattggtgtacacagtgtacgccacagccgttgatcccaaaaagggaagcttgggaacaatcgcaccattggcaattggtttcatcgtgggggccaacattttggcaggaggtgccttcgatggagcctcaatgaacccagctgtttcatttggaccagccttggttagctggacatgggataaccactggatctactgggtcggaccccttatcggtggtgggctcgctggtctcatctacgagttcatcttcatcagcaacacccacgagcagctcccaaccaccgattattaagcctaatcagggtttaattgatttgtctgtcactttgaaaccggattttcttcgatctcatttgagtttgctatctctatccttgttttttgtgtttaatttgaggcccggccaccttgtttactttttttttattccccatcctctatcatgatcatcatgcatggcaaatgttg

SEQ ID NO: 8036 - DNA, 596 bp, Gossypium hirsutum
  unsure (1)..(596): unsure at all n locations
  Clone ID: uC-gsronu33B141c02b1
gtctgcttgatagcgtcaccgaatatcaacatcaacgctctacaatgtccaacaagctagaaggcaaggtagccataatcaccggcggagcaagcggcatcggagaagccaccgtccatcatttcgccgtccatggtgcccgtatgatcgtgatcgctgatatccaagatgaattaggccaaaaagtagtcgaagccatcggttcaaataagtgttcatacatgcaccgtgatgttaccgatgaagaacaagtaaaaaatttagtccaatcgacggttcaaaactacgggagcctcgacatcatgtttagtaacgctgggacagttagcaactcaattcaaaccgtccttgaactagacttcgcagcgtttgaccgccttttcaccgtcaatgtccgcggcatggctgcttgtgtgaaacacgccgcacgagccatggtggaactgaacgtgagaggaagcatcatttgtacggcgagcacgactgctagctgcggtagtgaaagggacactgattataacatgtcgaagcattgcgtgattggattgatgagatcggcaagcaaacaactnggagagcatgggatagggtgaaca

SEQ ID NO: 8037 - DNA, 466 bp, Gossypium hirsutum
  Clone ID: uC-gsronu33B141c03b1
cttaaaacgagacacaaaacgtacaaagaggatcgaggctgctggcatcgattatgaatgcccagaaattgtgggtagcggtcagtctgctccaaagaagataaagttcgacgaagattaggcaccattaagttctactaccaaatgctgactatgaaggtaatggcttacacaatatagtcctcctgagatgctaaaaaattgcaagtttaatgtgtagctgagctggtgacaagctgtattgcctttggctctgcaacaagtaggaaggtttatatttataatgtcggatcctgttaagaccagacctcctgttggaatcaaattttgttatactgaattgcaatcaatgttgtttgttatataaacccggcggtgacgtttggactgttcgtggggcggaaggtgtcactgatccgagccctgttgacctggtggctcagtgcttggttcaatctgtgggtgt

SEQ ID NO: 8038 - DNA, 440 bp, Gossypium hirsutum
  Clone ID: uC-gsronu33B141c04b1
tcttcgccatccaatggttagattgacttgactgggaccgatggattgaccaacattaaatctaccccacttcaagcactggtctcacctcgtcttgctcctgagctttataactaaaatccagttgaagattccagtaatcaagcatgaagaataagaaagtttaaacattttgattgttacgttgtattattatttaatcaatttctctctcttttcggaattaataatggtaaaatagtgaaacaagcaaatacttgttgggtaaaacatctagatttgagtgttgcttatatggtgaacatggaaattcttaagtcaaatttaagttcaatattaaattgtgaaaaaaaaaaaaaaaaggaaagaataataagcacaaaaaagaattcagagtagtggactaaactttttgcaacaaaattctaactttatttgaa

SEQ ID NO: 8039 - DNA, 572 bp, Gossypium hirsutum
  unsure (1)..(572): unsure at all n locations
  Clone ID: uC-gsronu33B141c05b1
cttccgccgttcttaatcacagaaagctttgaagaagaagcgtttggaggtgcaaaacatggggccgaagaaaggtggaaaggtggctgtgcccgccaagaagaaacaagagaaggttgtcaatccgttgtttgagaagcgtccaaagcagttcggcattggaggggctttacctcctaagaaggatttgcatcgatttgtgaagtggcctaaggttgttcgtattcaaaggaagaagaggatcctcaagcagaggttgaaggttccaccagcattgaaccagttcaccaagactcttgacaagaacctcgcaacaagtctgttcaagttgctcctcaagtacaggccagaggacaaagtggccaagaaggaacgtctcttgaaaaaggcccaggccgaggctgaaggaaaagcccccgagtctaagaaaccaattgttgtgaaatacggtcttaaccatgttacttaccttatcgagcagaacaaggctcaattggttgttattgctcatgatgtggatcccatagangtggtagtgtggcttccagctttgtgcaggaaaatgaggtccc

SEQ ID NO: 8040 - DNA, 581 bp, Gossypium hirsutum
  Clone ID: uC-gsronu33B141c07b1
cccacgcgtccgcccacgcgtccgcaaagccggcaagatcacatcccttgagcaaatctacctccattctctccctatcaaggagtaccaaatcatcgaccaactcgtcggcccttcactgaaagacgaggtcatgaagatcactccagttcagaaacaaactcgcgccggtcagcgtacgcgcttcaaggccttcgtcgtcgtcggtgacggaaatggacacgttggactcggtgtcaaatgtagcaaagaagttgcgacggctataagaggggcgatcatattggctaagttgtcagtgataccggttagaagaggttactggggaaataagatcggaaaaccccatactgttccatgcaaggttaccgggaaatgtgggtccgtcaccgttaggatggtgccggctcctagaggtgctggtattgtggctgctagggttcccaaaaggtgcttcagtttgctggaattgaagatgtcttcacttcttaaggggttcaaccaaactctggaaacttgtcaggccacctttgaatgtcttctgaaacataggttctgacaccgatttctgagagagctcg

SEQ ID NO: 8041 - DNA, 533 bp, Gossypium hirsutum
  Clone ID: uC-gsronu33B141c08b1
taccacgcgtacggccacgcgtgcgtcctgcacagttacattccaacctcaaatccatacagttgtacaggaggcagtcgaaactcgtctcagaagcagcttactatctcacaaatcttgtttcagccaagtctttcattctagacttaaacgccaaatcactttctattgaagaaagtgaattcatggagagtatggaagcagcaaggttggttaatagagtgccacaagaaaccgtaaccaccatcgataatagatcaaaattcggaaaactgatggatcctggtccatcaacactgttgcacgtgaaaacacaaactaacattaatggtggatcaaactatccttacatggaagccgaagctggtgaactaacagttggcgatgtggagagattacttagtttgtacaaggatgtagtaacaaaatataccagtttgtgcaacactgttagacacttttctgttttcagaacacagacatgatgatatcgtgagagagcccaatggaacacacaaggacacttgtagcaa

SEQ ID NO: 8042 - DNA, 633 bp, Gossypium hirsutum
  unsure (1)..(633): unsure at all n locations
  Clone ID: uC-gsronu33B141c10b1
gctggtcacggtttacgttctcgaacaagggatttgttcgccagaccctttagaaagaagggttacattcccttgtctacttacctcaggacctacaagatcggcgactacgtcgacgtcaaggtaaacggtgccgttcacaagggtatgccccacaagttctaccatggtcgtactggtcgagtttggaatgtcacaaaacgtgccatcggtgtcgaagtcaacaagcaggtgggaaacaggattatcaggaagaggattcatgtacgtgttgagcatgtacagccttcgaggtgcgctgaggaattcaagctcaggaaggtgaagaatgatcaactcaaggcagaggctaaagcaaagggtgaggtcattagcacaaaaaggcagccagaagggcctagacctggttcatggtggatggtgctacacttgaaactgttacgcccatcccatacgatgtcgttaatgatctcagggcggntactaaatctactctgtatttgtttgcggtattgttttgtttcctttttttttttttggcaaacatcagggtgactgaataacatttgaagtgctgtttcttagttatatgagagtactgatcttaagatttatgtatgattcatttgagat

SEQ ID NO: 8043 - DNA, 428 bp, Gossypium hirsutum
  Clone ID: uC-gsronu33B141c12b1
tctcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggtgaaaataatgtataagccatttggttgggagcaaattgtccttttctccaaaggatttttgctgctcattcatggtgacttggtttatggttttatctgttgttgttaaaatcttataaaaatatatatcggttgctgctcttggtttgt

SEQ ID NO: 8044 - DNA, 585 bp, Gossypium hirsutum
  unsure (1)..(585): unsure at all n locations
  Clone ID: uC-gsronu33B141d01b1
gttaaacccctagccagccacttccccgccgcctctccgaaccatgggccgagtccgtaccaagacggtaaagaaatcctctcgccatgtgatcgagaggtactactctcgcatgacgcttgatttccacaccaacaagaagatcatcgaagaagtggctatcatcccttccaagcgtctccgcaacaagatcgccggcttttccacccatctcatgaagcggatccagaagggtcccgttcgtggcatctctttgaagctccaagaagaagagcgtgaacgtcgcatggatttcgtccccgacgaatccgccatcaaggttgatcaaatcgaagtcgataaggaaactctcgatatgctttcggttctcgggatggctgatattcccggccttgttaaggtcgatccggttgctgttgcggttccccaaatcgggttcggtcgcggtggcggacccggaaggagattttaaggggtgggtatccatggatttgatgggttcttaaaatctaagtttgttatgcttatttttgatagcttttttctctataaatttatgttccatttntgaaccattatagttgt

SEQ ID NO: 8045 - DNA, 518 bp, Gossypium hirsutum
  Clone ID: uC-gsronu33B141d02b1
cccaattcaatctttgtgttcaagtttaggactcattttggaggtggaaaatctactggatttggtttgatttatgattctgtcgagaacgcaaagaagtatgagcccaagtacaggctgatcaggaatggactcgataccaaggtagagaaatcgaggaaacaaatgaaggaaaggaagaacagggctaagaagatccgtggagtaaagaagaccaaggccagtgaagcagcaaagaagaaatgagagctaaaaggcaaaacttgtgcttatcacagagccaatgcttttcaacagtgttttttagggttcttgaatcttttgatttggaaaccagatttttgatgttgttatctgatgtttagttatattattactatctgatttttcctattttgagaattctttcatggcatattttgaaatatcccatgttttgccattgatattgtcaggcagtacttgctctctttctaccaaatcttgaatccaaaaaaaaaaaaaaaaaaattgatgcg

SEQ ID NO: 8046 - DNA, 432 bp, Gossypium hirsutum
  unsure (1)..(432): unsure at all n locations
  Clone ID: uC-gsronu33B141d03b1
atcataacgatccccatgagcatccagatcatattctcctcgacctcgatgatgatcatagtattcatagtgttggtcatctaggtccgaccgtgaccgtgatcgtgatcgtgatcgtgatcgttatgatggaatggaaaaagatgattacaggtgattatggtcataagacaaatcaagctcgggaaattgagcagctactttctctgccagtgctcctagtttagtttagatctcaaggaaactgttttcaatctgctttctattttgatgtcgctggctacttctgagttcagtagtgttttctttggagttggaacgctatatgcttgtttttatattttttgaaaaagtttttttaannaaaaaaaaaaaacccagaaataaccaaaataaatctccttaaaaaaaatccccttttgggcgggggaa

SEQ ID NO: 8047 - DNA, 572 bp, Gossypium hirsutum
  unsure (1)..(572): unsure at all n locations
  Clone ID: uC-gsronu33B141d05b1
ggtacatcatcatggttaaccacatgaggaagatgaagaacaatgccattgtttgcaacatcggtcacttcgacaatgaaattgacatgctcggtctcgagaattatcctggtgtcaagcgcattaccatcaagcctcaaaccgataggtgggtcttccctgaaaccaacaccggcatcattgtgttggctgaaggacgtctcatgaacttgggttgtgctactggccaccctagctttgtcatgtcatgctctttcaccaaccaggtgatcgcccagctcgagctgtggaaggagaaggcaaccggcaagtacgagaagaaggtgtacgttttgcctaagcaccttgatgagaaggtggctgctcttcaccttggaaagcttggggctaacctcaccaagctcaccaggatcaggctgactacattagcgtccncattgagggtccttacagcctnctcactacaggtactgaggagagaataccagagagagagagggagagagtntgactagaaaaaggtaccataccacnggatggtttgattgtttgttttactaaaattattgatg

SEQ ID NO: 8048 - DNA, 571 bp, Gossypium hirsutum
  unsure (1)..(571): unsure at all n locations
  Clone ID: uC-gsronu33B141d06b1
gttgcattaagtgatataacaggggccatcaagaacagcaatggcattgatattccctcattgctcaaacatgtgaaagaaaacaagggtatcaaagggttccatggtggggattccatcgacccgaaatcggttcttgtcgaagactgtgacatactcatcccggcagcacttggaggcgtcatcaacagggaaaatgcaaatgagattaaagcaaagttcattattgaagcagctaaccatccaaccgacccagaggctgatgagattttgtcaaagaaaggagtcattatactgccagacatttatgcaaactctggaggagtcactgttagttactttgagtgggttcagaacattcaaggtttcatgtgggatgaagagaaggtgaacagtgagctaaagacatacatgaccaaagggtttaaagatgttaaggagatgtgccaaacacacaactgcgacctccgaatgggagcctnntaccctcgagttaaccgcgttgctcgggctaccgctcttagaggttgngaagcataagaatgcttagtgctaatgctggttttgaaat

SEQ ID NO: 8049 - DNA, 568 bp, Gossypium hirsutum
  Clone ID: uC-gsronu33B141d07b1
cccaattcagcatctgctcttacaacttgccggttcatatggatggtggcaaggagaagtctagcagtaggaaaaagatgagtgtggtggtaggaccatggggaggcaatggtggaactgcttgggatgatggaatttataatggggtaagagaaatcactcttgtttatgatcgttgcatcgactccatcagagtggtttacgataagaacggtaagcctgtaacggcggagaaacacggcggtgtaggaggaaacaagacagctgagattaaactaaaattcccagaagaattcttgatcagtgtaactggttattactgtcctgtggtttatggtggtagccctgtgattcgatcactgacgtttaagagtaaccgaaggacgtttggtccgtatggagttgaagaaggaacacccttcgctttctccgtagagggagggcgaatcgcggggttcaacgggagaagtggatggtatgttgattcaatcggatttcgattgtgtcgtgttcaatctcctaaactctttcagaaggtgcagaaaggatttcaaagcttactagtagt

SEQ ID NO: 8050 - DNA, 232 bp, Gossypium hirsutum
  Clone ID: uC-gsronu33B141d08b1
ctaatgtgtatgtattatgtgtactactatgcttcactaggagtaaaggcaaatctggtgtgaaactaagtcaattatgatgactagtgagcatggatattgatgaatgttccattagtttttatatataatatctatatgtattctatatatttctctgcttcactggcaataaaggcaaatctggtattgaactaaatattatgaataaaacttgaagcttatattcttc

SEQ ID NO: 8051 - DNA, 476 bp, Gossypium hirsutum
  Clone ID: uC-gsronu33B141d09b1
aaaaaaaaaaaaaaaaaaaaaaaaaaaaaaaaaaaaaaaaaaaaaaaaaaaaaaaggaaaaaaatataaaaaaaaaaaaaaaaaaaaacatgaaaagacgaaaatattatttttttatagctacatatatttaaatggggggggcctttttttttcacaatggggggtgccctctctttgccgccctttttttttttgttggggaaccttatactctttgtctggggggggagttataaggatggggccttgtcacttttttttttatttgctgttttttaattgttggtgggtatcgccctttccctctgttggttaaatattacccgttgcgggtgtgtgttttcttttcaaagggtccctttttgtgtgtggtaattgagcgccccctttttgggttttttaccctttcttcctggtggtgttcctcttcttttggcttttatttttttggggccttcggtcgcggttttttt

SEQ ID NO: 8052 - DNA, 482 bp, Gossypium hirsutum
  Clone ID: uC-gsronu33B141d10b1
tggacactccagaccgctggcaaaaggtggctgcagctgtgggggagaaatcagtcgaggaagtaagaaggcattatgagatcctagtgagggatctcatgtatatagaatctggtcaaatccctatacccaattacaaaagcactgggagtaacagaagatgaattgctggggtgcaaaggtttatgaagaatctaaggctccaatgaagcacaagtttcagctgcactgtcagagaatctgtaaaaactaaaataaaaagaataaattataaagaactggagaatttgcatcgtgattctccctgtcttattttacattgagtgatcgagtcagtttggttttttctttttgtgtgtgtgtgtcagtttgttaatatgacaacaaaagttgaactctacaattattaagtttgtgagtattgtactgaagttaccagttttaaattaaaaaaaaaaggtattactactaaatgctgtata

SEQ ID NO: 8053 - DNA, 604 bp, Gossypium hirsutum
  Clone ID: uC-gsronu33B141d11b1
actgaattaggtaactggggcacattttcttgcccaccacctttacttgagtctgttgatgcttttatccagtcaccaccaccaaccagcatagcagagtcggatagcctttcaccccgtaatagtggcctgctggatgctttacttcatgaggcaaaaactctaagcagtgcaaagaaccatgcatctgagaagagttcatattcagctactcccggtgatatagctgaaagttccaccttcaacatctgtgagacagaatgggaaaactgtggtgagcctctttctccaatgggtcattcagcaacttctcttttaagtgagtgtatcagtgcaagtggcagtacgttggatgaacagccacctgctgaaacctttactgagtctcatgtgaaatcagagccagctgactatgttttcaccccagagatacaaaatgaggctcctattcggttggacagttgtcaccctgatacattacttgcttctaattggcttgagcaagattctggttacgataaggaccaaaccatcatgaccgattccatagctgcccctcttggtgatgattgagtagtgaatacaagatatggcagctggaaca

SEQ ID NO: 8054 - DNA, 553 bp, Gossypium hirsutum
  Clone ID: uC-gsronu33B141d12b1
gcggagttagcatccaagactggtggcgcaatgaacagttctgggtgatcggtggtgtctcggcacatctttttgctgtcttccaaggcctgctcaaagtccttgctggagttgacaccaacttcactgtaacagcaaaagccgctgaagatgccgagtttggagagctttacctctttaaatggaccaccctcctaatcccaccaacaactctaataatattgaacatggtgggagttgttgccggggtttctgatgcaattaataatggttacggttcatggggtcccttatttggcaagctattcttcgccttctgggtcattgttcacctctatcctttcctcaaaggtttgatgggaaggcaaaacaggactccaaccattgttgtgttgtggtctatacttcttgcatcaattttctcactggtctgggttcggatcgatcctttcttgcccaagcaacaggtccagtcctcaaacatgtggagtggagtgctgatcatgccaacttcttattatatcaccattcattgtttgagtccccaaatctc

SEQ ID NO: 8055 - DNA, 621 bp, Gossypium hirsutum
  Clone ID: uC-gsronu33B141e01b1
gatattggtttaggttttagggtttcttcgcttcttgtggtgaaccagttgtagctgccgctgtcacttccccgcttccatcttaccgaagctctcccgtcgacgacaatggttgccgccaagaaaaccaagaagactcatgagagcattaacaacagattgactctcgttatgaagagtgggaaatacactttgggttacaaaactgttctcaagtctcttagaagctccaaaggtaagttgattatcattgccaacaactgccctcctcttaggaagtcggagattgagtattatgccatgttgtgcaaggttggagttcaccactacaatggaaacaacgtagacttgggcactgcttgcggcaaatactttagagtgtgctgcctcagcattattgaccctggtgactctgatattataaagagcatgcccggtgatcactaagctatggggggataacttcctaggtgctgatttagtttcaatttttgggtgtctacaaccattgtgatgttaaagaccaaactattctgaaattcagaactttctttgaagtgtttgtgggacagtggatgtattggcccatgtattagtgatctttttgagtggatttcgttt

SEQ ID NO: 8056 - DNA, 508 bp, Gossypium hirsutum
  Clone ID: uC-gsronu33B141e02b1
attgaaaccctagcctctttttaatccctcatttggccgaccagaactcacccccaatcgccacaccatcattgtaatagatgactagcaatgagttgggcttgattttgaagaggaagatgcaactctgacaacccgattgattcaggtacggaggcaacatggtgggggtagctggcgcgtacgaaggctgctggtggtgtcgacgtggaggcgccattcatggtagtgctggaggctactgtgttccttgctgctagggttctggaacattgataatttgggcttttcgggcctattctagtagttgggccataatttttggaattggactgcaaactgggccgctattgacatttggatttttatattattgtatttttcatttttttgtggtttttgtttgatttgtatttgcgcggtccccggcccaaattgggctttacatgcttgttgcaagcatgatattgtgatcctgtagttgaaccatttttgattgtggagcttt

SEQ ID NO: 8057 - DNA, 655 bp, Gossypium hirsutum
  unsure (1)..(655): unsure at all n locations
  Clone ID: uC-gsronu33B141e03b1
cggacgcgtgggatttgtttgctctgtatattgaaattttctttctcgattttctctttagccaaaaaagatgcagatcttcgtcaagactctaaccggcaagacgatcactctcgaggtcgagagctccgacacgatcgacaacgtgaagaccaaaatccaagataaggaaggcatccctccagaccagcagcgtctgatcttcgccggaaaacagcttgaggacggccggactttagccgattacaatatccagaaggaatcgactcttcatctggtcctgcgtcttcgaggtgggatgcagatcttcgtcaagactttgaccggtaagacgattactttagaagtggagagctcggatacgattgataacgtgaaagcgaagattcaggacaaagaaggaattccaccagatcagcaaaggttgatttttgctgggaaacaactggaagacggaaggactttggctgattacaatattcaaaaggagtccactcttncaccttgtcttcgtcttcgtggtgggttctaagccctaaggtctcccttaatggtggtttctggtttacgtgaggactgtgcctgtatggcctttaaaaatttctagtcttgttaccggtgcattatgatgttctcttgatggattgctattact

SEQ ID NO: 8058 - DNA, 570 bp, Gossypium hirsutum
  Clone ID: uC-gsronu33B141e04b1
ataagtagtaagggagctttcgagtggactcttcagaagatcgttatgtccatcacttctggtttcaagcttctcttcctccatgttcaagttcccgatgaagatggtttcgatgacatggacagcatatatgcctctcctgaagatttcaagagcctgaagagcagggacagggctagagggcttcgtctgcttgaattctttgttacaaggtgccatgaaattggggttgcttgtgaagcatggatcaagaaaggtgatccaaaggaagttatctgccatgaagtgaagaggatccagccagatcttcttgttcttggtagcagaggacttggtcctttccaacgggtttttgtcggaacggtgagcgagttttgcgtgaagcatgctgagtgccctgtcgtaacaatcaagcgtagattggatgaaactcctcagaccccgttgatgactaaatttgtttcacagaccccttgattcattgctcttggttctgttaatagacttgaaactctacaactataccaattccatatatcagtggggataagaaatgaattgctttgtttt

SEQ ID NO: 8059 - DNA, 518 bp, Gossypium hirsutum
  Clone ID: uC-gsronu33B141e05b1
tatgctggttatgactgttggaggagttactgcattagctactggtgtttatacaacaagagaaggagctagagtcacatggggttatattaataggatacttggacagccatcactgatacgagagtcatccattgctaaatttccatggtcgggcatgatgtctcaagcaaggaaccgaattttaaattatagtacagcagcaacagtggaaagcaaacagagtcttcagaatgttgttctccacccctcgctgaaaaggagaatagagcatcttgctagggctacagcaaacaccaaaacccatcaggccccattcagaaacatgctattttatggacctccaggtaccggtaaaacactggttgcaagggagatagcacaaaaatcgggattggattatgcaatgatgactggaggtgatgttgcaccactgggtgcgcaggctgtcaccaaaatacatgagatatttgattgggctaagaagtcaaagaaaggtttactgctttttattgatg

SEQ ID NO: 8060 - DNA, 439 bp, Gossypium hirsutum
  Clone ID: uC-gsronu33B141e06b1
tgtgacattgtcacaaccaccacccacaagagcttgaggggtcctagggctggtatgattttctatcgcaagggaccaaagccaccaaagaagggccaacccgaagatgcagtgtatgactttgaagacaagatcaactttgcagttttcccttcccttcagggtggtcctcacaatcaccagattggtgccctggctgttgccttgaaacagtccatgacacctgggttcaaggcatatgctaaacaagtgaaggccaatgcagctgcccttggaaagtacctgatgggcaagggataccagcttgttactggtggaactgagaaccaccttgttctttgggatctccgacctcttggattgactggcaacaaggttgagaagctttgtgacctctgcaacatcacttgtaacaagaatgctgtttttggtgacagca

SEQ ID NO: 8061 - DNA, 388 bp, Gossypium hirsutum
  Clone ID: uC-gsronu33B141e07b1
ctagaggctttgcaagtttgcaaaaaaaatgagtgaccccaaatatgcttatccctaccctgctcaaggttattatcaaggtcccccagtggtggcaccaccgcaatatgcagctccaccacctaggagagaacctggtttccttgagggctgtcttgcagctttatgttgctgttgtcttattgatgaatgttgctgtgatccatccatcatctttatcagctgataataaataaaaatattctctgtaatctcactatatatattgtgatgctaggtttaaattcttaggaggattaatcttttcaacactagtaaaattataatttatagatagtgatgatgggtgtgttttgtgctttggtggttcgaagaacctggctgcctt

SEQ ID NO: 8062 - DNA, 428 bp, Gossypium hirsutum
  Clone ID: uC-gsronu33B141e08b1
ggcatttggcctacaaagagcatggcgttccactagaggcagcaaagtataaaatcgtcaaagtccatggatttgattcttgtaggcttgatgctgttcctctgtccccggaactcgttgaaaggttagggatctatggtgcgtctttcgacagaccacgctactgagagagtgatcctactccgaaacgaacagtgatgagtatggctatagatattgaagagcgcgccgatctatccagactcggatccaagaacgatgcgaccctccatcttatgctgcgacaggagagttggtgctgcctcatggtcatgactttgaggggagcgggggcgactttggttgctgaaaggttggactcctgtggttccgtgtgagccaccctcttagccaaccaatgatatccgccagtgcagccacaggaccaa

SEQ ID NO: 8063 - DNA, 435 bp, Gossypium hirsutum
  Clone ID: uC-gsronu33B141e09b1
cccacgcgtccgggtggggttggtccttacaattgttgtcatgaactggtttcaagctgcacagcctgcacttttgtatattgtaccggctgttattggattcttggctgctcactgtatatggaacggagaagttggaccgttattggagtttgacgaatcaaagatggcggttgtagaaggaagtgaagacaaacctagcaagaaagtggaatgaggtatagaaggcaaggcagacagtgaaactacttttagcttgagaaggaattagtgtttacgttaaaaggtcaatctcttggctaacttgttttactgcaatacctttgtaacaacagactttggaattaagcaagaaataatctttagcttcctaagcagagattttttattgacaaagaaggaattccaccagatcagcaaaggttgatatttgct

SEQ ID NO: 8064 - DNA, 106 bp, Gossypium hirsutum
  Clone ID: uC-gsronu33B141e10b1
tccacgcgtccgaaaaaaaaaaaaaaaaaaaaaaaaaaaaaaaaaaaaaaaaaaaaaaaaaaaaaaaaaaaaaaaaaaaaaaaaaaaaaaataaatataaaataaa

SEQ ID NO: 8065 - DNA, 398 bp, Gossypium hirsutum
  unsure (1)..(398): unsure at all n locations
  Clone ID: uC-gsronu33B141e11b1
gtttttgctttcaaaattgaaggaccttcaatttttcgtaggagagagcatgcatgatgatggatgcttggtgtttgcttactacaaggatggtgctgttgacccaacatttttgtactttgcatatgcattgaaggaggtcaagtgctgaggtttgaagcaaagaaaaaaaaaagtggttgctgaagaatttagtcctttttattattgcttttgtctcttgttttcagtactctgctaaagacataaattatttgtggtttttgatgtttttgttttaattgtttgttgttttatcatggaatggtttctatttttatgggttggctaaacaataatttaactctttgttctattactacttgattttattggaaggacttttttgggacananaa

SEQ ID NO: 8066 - DNA, 549 bp, Gossypium hirsutum
  unsure (1)..(549): unsure at all n locations
  Clone ID: uC-gsronu33B141e12b1
gctgaatttctcagttgttggttggttgattgattgttgttgtggttgaagaggatgtgggctgcttcatgtcttgcatcttgttgtgcggcatgtgcctgcgatgcatgccgcacggtggtttcggggattagtcggagatctgcaaggatcgcttattgtggactttttgctctttctcttgttgtttcgtggatccttcgtgaggttgctgccccgctgatggagaagctcccttggatcaaccatttccataaaacacccgacagggaatggtttgaaacggatgcagtgctgcgggttagcttgggaaactttctgttctttactatcctagctttctcaatggttggtgtgaaaaaccagagggatcctcgtgatgctgtgcaccatggtggatggatgatgaaaattatctgctggttcattttagtgattntgatgttttttgttccaaacgagattatcagcttctatgagtcagcatcaaagttttgcgcangactgtttctttggttcaagtcgtgcttttactcgactttgtcatgg

SEQ ID NO: 8067 - DNA, 521 bp, Gossypium hirsutum
  Clone ID: uC-gsronu33B141f02b1
tgagactaaaataccaaaggaggggaccacaagctttccattggtttctaaggaggaggaagaaaatgttagctcggttaagaagatagaagaagataaattaagtgaagcagacacttcagagaatatctcagaagattcttttaatgcaaaggaagtagcagagacatgttcagaaaaagaagcaatccaggagcttgacgatgccaagaaagatgaagctgccactgctcaatgtccccaagtggaggaatcaagtgagcaatctttgccttcagaattgactgttgagaacctaaagcgtggagctgaggccagtgaagaagaggaagaaaaggtgaaggaagtggaaattctcgaaaaggaaagacctcaggagcctgaagctgttatggatcaagaaaccattatagttcaggcttcaataacagaggaatcacaaaagattgaagcaaacgaagagaaaaggaaagaagccaaaaagcttgacgatgggaaatttgaagactcgtcagctggag

SEQ ID NO: 8068 - DNA, 605 bp, Gossypium hirsutum
  unsure (1)..(605): unsure at all n locations
  Clone ID: uC-gsronu33B141f04b1
gcgatgccagaagtactatgaagctggtgcccgctttgctaaatggcgtgctgtccttaagattagtgctaatgaaccaaccgagcttgcaatccaagaaaatgccaacgggctagctatgtatgctgccatctgccagcaatgtggccttgtccccattgttgagcctgaaattcttgttgacggatcacatgacattaaaaagtgtgctgcggtgacagagcgtgttcttgctgcttgctacaaggctttgaatgatcaccatgtcatgcttgaaggtactcttttgaagcctaacatggtgacccccggttctgactccccgaaggttgccccagaggttattgctgagtacactgtccgtgccttgcagcgtaccgtccctgctgcagttcccgctattgtgttcttgtctggtgggcaaagtgaggaggaggctacccttaaccttaatgccatgaacaagctccagaccaagaaaccatggtcactctctttctcattnggacgtgcccttcagcagagcactctcaaggcctgggctggnaaggaggaaaacgtgaagaagcacaagatgctttccttgttagtgcaggctaactcga

SEQ ID NO: 8069 - DNA, 591 bp, Gossypium hirsutum
  unsure (1)..(591): unsure at all n locations
  Clone ID: uC-gsronu33B141f05b1
gtctgagcgaattcgcgttttgttagttcgtgagtgaaacaggtaataaaaggaaaaaaaacgatgggtgttttcacatttgtttgcaggagcaaaggcggtgagtggtctgccaagcagttggagggagagattgagagctctgctgcttccacttacgagctccagcggaaacttgtccaggccgccaccgcctgcgactcctctggtggtgtcacctcctctttctctgtcgttacccctaattctgccgttttccaggtggttattggaggtgctgtaggcggagccttcatcgggggtggaggagctgctgccgctccggctggaggcgctgccgctgccgctgaagctcctgcagctgaggagaaaaaggaagagaaagaggagagtgatgacgatatgggattctctctctttgattaagctcctttactgccttactgcctgtttagatcttagcaagttgttacattttcatttttcatttatgcgtgaattagactatcttgggtgacattgggctctnttcctagttaggagaagccattttcaggataaaattgacatatatgagatgtttttgaaaaa

SEQ ID NO: 8070 - DNA, 406 bp, Gossypium hirsutum
  Clone ID: uC-gsronu33B141f06b1
ttccatctttctttttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagataaaaatggcttgagacaaaaaaaaaaaaaaatgaacatgggatttctcctccttgcttttaaaaaaatctcaaacaattgtggtatgcttcattatacgtctggtggccagtttaccataccgatagttattcgcggacctggagggtgttggacggcaactttgaaacaaagaattctcaacgcctagagtcctattttcagtcagtacctggtatttaaaaaggctgcatgtttatccccttacaatgccaagggattaatgaaggct

SEQ ID NO: 8071 - DNA, 414 bp, Gossypium hirsutum
  Clone ID: uC-gsronu33B141f07b1
gttttcctttttcttgttgaataataagaaggttttcacttttttaactcaagccttagatgaaactggaaccagatattataatatccaaatgttagctaatcaaaatcggaattgtttatgttcatatatactgaattttcgatgtaagatctcaggatattaaaatagtttatattccaactgtctttgattgtaaaacccaactagaattaaatactaagtatacataaacaaaatatatgaaaataaaaaaaaaaaaaaaaaaaaaaaaaaaaaaaaaaaaaaaaaaaaaaaaaaaaaaaaaacaaaaaaaaaaaaaaaaaaaaaaaaaaaactaaaagagggggcggcccttttaagggatccaggtttactaccccgggcttgcaacgtaatagtttttttttgggg

SEQ ID NO: 8072 - DNA, 528 bp, Gossypium hirsutum
  Clone ID: uC-gsronu33B141f08b1
cggacgcgtgggcggacgcgtgggcggacgcgtgggcgacaatccaatgaatccctgtagagctatgtcagttcaaaccaacaccagccatacctcatcactcatcgccgacgatgaggagttggagttcctgatggattctcatagcggtagaatcctcgccggacatggtggacatgtgactgacaaaactggcaatcgtgatcgaccagctgcagattgtgggagaggtaaaccttacaaatcctgccttcccaacccgaatccagacggaaaaagaccagaaaatcctggggtttataaccgtgggtagaacaccctgggaccgataaccgtggatgctgaaggtgaatggcgtattgaactgcttttagtaattaatttttctttttatggccttggctgccttatgtatgaattttatcatttccttttcaatctgctaggcggtctgcatatataaagccaagagtcatatgaaataaatagggataaaatagtgtgtaattagaattagagatatataag

SEQ ID NO: 8073 - DNA, 656 bp, Gossypium hirsutum
  Clone ID: uC-gsronu33B141f10b1
tctttgctataccctaggactatagtcttctcttccgatccatccattactttcaaattttcttcttagatcaaacaaaacaatgtccggcgtttgggttttcaagaatggtgtggttcgcttggttgagaatccagcggctgagtcattagacggaagccgacagagttcgaacactcgccgcaaagtgcttgtgcacactccttctaatgaagtgatcacttcttatgcggttctcgaacataagctatggtctcttgggtgggaacggtattacgaggaccccagtcttcttcaattccataagcgatcaactgtccatttgatctctctcccaaaagattttaataagttcaagtcgattcacatgtatgacatcgtcgttaaaaaccgcaacgtgtttgaagttagggatggttagttgtatagtttagaggagctaattggacgtcttggtgatttccttcttcttcttcttcttcttcttttttttttgtatgtgatgatggatttattttatgattttgagattatggtattgggttgcaaattggtagaatacattcgctatgttgggggtggtttttgaaaaaagctctatgttaagggcttctgttttggtttcagttacttacgtttctgcactttttattttt

SEQ ID NO: 8074 - DNA, 571 bp, Gossypium hirsutum
  unsure (1)..(571): unsure at all n locations
  Clone ID: uC-gsronu33B141f12b1
cccacgcgtccggtcactatggaggttcctacaaagtgaccaaaggactagccacgaagtttggggaccttagggttcttgacacccctattgcggagaactctttcactggcatgggaatcggagctgctatgactggcttgagacccgttgttgagggtatgaacatgggatttctcctccttgcttttaatcagatctcaaacaattgtggtatgcttcattatacgtctggtggccagtttaccataccgatagttattcgcggacctggtggtgttggacggcaacttggtgcagagcattctcaacgccttgagtcctattttcagtcagtacctggaattcaaatggttgcatgttcaaccccttacaatgccaagggattaatgaaggctgcttctcagaagtgagaaccctgttatacttnttgagcatgttttgctttacaacctcaaggagagatatccagatgaggattatatctgtaatcttgaggaagctgagatggtaaggcctggagaacatgtcactattctaacctattcaaggatgaggtatcatgtgatgc

SEQ ID NO: 8075 - DNA, 624 bp, Gossypium hirsutum
  Clone ID: uC-gsronu33B141g01b1
tccacgcgtccgcccacgcgtccgtcagtactcactcaacattcccatttccaatctccagctcccaaggtaaatatgccgatcagaaacatagcagttggccggcccgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaggtggccacgtcaaccccgccgtcaccttcggtgctttcgttggcgggaacatcactctcttgcgcggcattctttactggatcgcccaactgctaggctcaaccgtcgcttgcctgttgcttaagttcgctaccggcgacctggctgtaccagcttttggattgtcatcaggtgtgggcgtgtctaacgcattggttttcgaaatcgtgatgaccttcggattggtgacacagtgtacgccacagccgtgatcccaaaagggagcctgggacatcgcccatggcattggttcatcggggggcacattt

SEQ ID NO: 8076 - DNA, 545 bp, Gossypium hirsutum
  Clone ID: uC-gsronu33B141g02b1
tgtctccattgaagatccatttgatcaggatgattgggagcactatgcaaaaatgacaagtgaaattggtgaacaagtgcagattgttggtgatgatctccttgtcacaaattctaagcgtgtggagaaagcaattaaggagaagacctgcaatgctcttttattgaaggtgaatcaaattggttctgtaactgaaagtattgaagctgtaaaaatgtctaaatctgccggttggggagtcatggcaagccaccgcagtggtgaaaccgaggatactttcatagcagacctttcagttgggttggcaacaggccaaatcaagaccggcgcaccgtgcagatcagaacgtcttgccaagtacaaccagcttctgaggattgaagaagagcttggagctgctgcagtttacgcaggagcaaagatcagagcaccagtagaaccatattgatggtttctttcttatgttgcaatcggcttttcattgtcttttgctctttgcctaaaactagtaaagcacaaagtggatgattttgcaatgttttact

SEQ ID NO: 8077 - DNA, 555 bp, Gossypium hirsutum
  unsure (1)..(555): unsure at all n locations
  Clone ID: uC-gsronu33B141g03b1
gaagcggtggctgtgtcgggtgaggcggcgcttaatcggtcatctaataagtcacttgatgttgaagctcaagtcatggaaattcacgaatttgatgaaacaaaggaagatagcttaaatatcaccaccaacgagctaaacaacttaaacatttccgtcaccggtgtcccgaacgctacgatatccctgaacgagtcgatatctcttcctttaaaacgaaaccgacgagtccgaaccaaattggataagctcgaagcaagactgcaacgagctcgagccgcgatcaaagacgctaaaaactcgagtcaattactggatcccgagtacgttccgataggtcccatgtattgggatgctaaagcctttcacaggagttatatggaaatggagaaacaattcaaggtgtttgtatataaaagaggggagcccccggtgtttcatgatggtccttgcangagcatatattcaatggaaggaaacttcatctaccaaatggatgttcacacgaagtttcgaactaacgatcccgaaaagctcatgcttttaccttncgtc

SEQ ID NO: 8078 - DNA, 253 bp, Gossypium hirsutum
  Clone ID: uC-gsronu33B141g04b1
ctagttttaaaaagaaggctacagagacgggagccaccaatcaaataagacacaaacagaaacctaaagacttgctatagaaagcagacagagacgtgctagggtagaagacttatgtggatactttgtttttttgactatggaacctttaatgatacatattccataaacaaaacaaacactatttcgaatgttgcttgaaaatgaaaatggataatacaattggtaataaaagtaccataaaatttatttt

SEQ ID NO: 8079 - DNA, 570 bp, Gossypium hirsutum
  unsure (1)..(570): unsure at all n locations
  Clone ID: uC-gsronu33B141g05b1
ctgacgcgtgggcggacgcgtgggttcaaattctgctaaagttttgccttttgaaatcgaataattgagaaaatagcttaggttagttgattgcctgaaatgactgataacaattcaccccctgggtctcccaaagtaaacccagatcataattctgaggctaacccgttgcccaaagatgatagctcacttgaaaacatagttcgaaggtttcaggattcaatgtccttagcaaagaaacacaaattttgggaaactcagcctgttggtcaatttaaggatgctggggacacaagtttgcctgaaggtccgattgagcccccaaccccattgtctgaagtcaaacaggaaccttataaccttccgagtccgtatgaatggaccacatgtgatatggattcggaagagacttgtaatgaggtttacaatcttttgaagaacaattatgttgaggatgatgagaatatgtttaggttcaattattccaaggagtttcttaggtgggctntgcgccctcctggttattgcaagagctggcatattggggtccgtgctaagacatcaaagaag

SEQ ID NO: 8080 - DNA, 583 bp, Gossypium hirsutum
  unsure (1)..(583): unsure at all n locations
  Clone ID: uC-gsronu33B141g07b1
aaagatccggtgctcctcactcacaaagcaacaattaactctctctccccctcgttctgttcgccggtaaattcatcataaaatcctcgcttttttccggtggcaaagcaaggggaagctttgaattagggtgatctaagcagagattatatgctttgattgagaattagaggaggagaagaagaagaaaagggaagtgtatcatctccagttgaagtagtgggaagctggaaagaaatgtcttttcagaataagagtttttggatggcaaagggtcctccacatgtgtctgatggagatgcagcattcgataatccttcaagaatcgaacccaagcgatcacatggttggtttgttgatgctgattcgcagctgttccctaacaagaagcaagctgtacaagctgcaaacaacaaatcaagttcaggaatttctaattcaaatgttccgccttgggaaaatgtttccagttttcagtctgttcctagcccatttattgatcggttgtttggttccgaatcctgaaggtctgtcagtttcactgaaaggaacatatctnccatagaagcagantacatgagac

SEQ ID NO: 8081 - DNA, 488 bp, Gossypium hirsutum
  unsure (1)..(488): unsure at all n locations
  Clone ID: uC-gsronu33B141g08b1
cccacgcgtccggtgacgggataaaaccatttgtttcgatttaaacgctttaaagattcttggttttctgatatagattttttttcttgggacttctttgttttccgcgattctgtgggaaagtgagaagttttttttctgggatagaagatgagtaacccatctgcaggagcctcttcaaaatcaaaagtcggttcttcacaaccttcagaaacatctttcaagcgcaaaagaggagtgtttcaaaaagatttgcagcatatgatgtatggttttggagatgatcctaatccacttccggagactgtggcccttgtggaggattttgtggtggaatatgtaacagatatggcacataaagctcaagatattggatcaaagagaggaaagctatcggtcgacgattttctatatctcattcgcaaggacttgccgaaactaaatcgttggactgaattgctatcaatgcangaagagctgaagcaagc

SEQ ID NO: 8082 - DNA, 575 bp, Gossypium hirsutum
  Clone ID: uC-gsronu33B141g09b1
cccacgcgtccgcccacgcgtccgctaatcacagtccttctcatttgggcaatccttcgtcccagcaagcccagattcattctccaggacaccaccgtctacggtttcaacgcctccgtccccaatttcctaacttccagtttccaagtcaccgtatcgtctcgaaaccccaatgacagaataggaatatactacgacaggctcgacctctacgccacctacaggaaccaacagatcacaccccggacctcactccctcccacttaccagggtcacaaggatgtcaacgtttggtcgcctttcataaacgggaacatgatacctatctccccggacttttccacgtctttaagttcggaacaggcttccgggtcggtttttcttaccattaagattgatgggcgggtgagatggaaagttggagctttcgtgtccgggagataccatctttacgttagatgtccggcaataattacttttggaagcaatttaacggtgttattgtcgcacataacgctgataagtttcagtttgtgactagatgcagcgtcagtgtctgaagttttgacagactg

SEQ ID NO: 8083 - DNA, 548 bp, Gossypium hirsutum
  unsure (1)..(548): unsure at all n locations
  Clone ID: uC-gsronu33B141g10b1
agcagaggctagagagatgtcggcggcggcggcggcgacaagccgagcgactcgacggatgggagccgaggatgagaagctagtgttcgaaacgacggaaggaatcgagccgatattgagttttgatcagatgggactaaaagacgatctcctccgtggaatctacaattacggcttcgaaaagccatctgctatccagcagagagccgtcatgccgataatcaatggccgcgacgtcattgcccaagctcagtctggtaccggtaaaacttccatgattgccctcaccgtttgcaagtggttgacacagctagcnnagaggttcaagcattgatactgtcacccacgagggaactggcttcacaaacggagaaagtgatacggacaattggtgatttcatgaacatacaagcgcacgcatgtattggaggcaaaagtgtggggtgaagatataagaaagctagaaaatggagttcatgtagtgtcgggaactcctgtagagtttgtgatatgatcaaacaaagaccctacgtacagggctattaaac

SEQ ID NO: 8084 - DNA, 478 bp, Gossypium hirsutum
  Clone ID: uC-gsronu33B141g11b1
ggcctataaaaccacttaaaagatagtaacaaaatccaaaaatggcggctccggcagtggagggagtagccgtgacggccctccgatcggtcctactccgagtccgacaggcagctgaacgggcggctactcaacccgaacgggtccgggtcgtggccgtttcgaagactaaacccgtgtcactcatccgccaaatttacgacgccggtcaccactgtttcggtgaaaattatgtccaagaatttgttcaaaaagcccctcagctgcctgaggatattgagtggcattttattggacatttacagagcaacaaagttaaaacccttctcggtggaagggccaatctagccttttttgagggtgttgataatgagaagatcgcaaaccatcttgaccgtgcagtttgaagcctgggagaaccctttggagatttttggacaaggtaatacaagtggagaaccatcaaaatctgggatag

SEQ ID NO: 8085 - DNA, 563 bp, Gossypium hirsutum
  Clone ID: uC-gsronu33B141g12b1
ggcagggccctctcactctcagtctccgcagccagtaaaccctacctagtcaaagatatatcattcgctcccaatctcccaattttttatttgctgtaattttttcagaaaaaaataagttaaaaaaaaaaaggaataccaaattctaaaatctctatatccccaaatcatggccctgccagaaaccctagattccccgcaatcatcatcttcttcagatccacaactgttccggaacttgtcatccagtcggctcaatgcccaggcgccggagtttgtgcctactcgctcgacgcctcagcagcagcaacaacagcagcaaagtatgaggatgatgatccctcctcctccgccccctgggatcatgcacgtctactctcctcctcctgcgccggcggggccggcgtttcacctccccgtgcctatgccacctcacttggttcccgttccccatcatatgtccatgagaaatcatcatcatcatccttaccagaaccatcatcatcgagagcaggaagttgaagctgttgctaagaaagatcatcaggagcacaaggatcatg

SEQ ID NO: 8086 - DNA, 366 bp, Gossypium hirsutum
  unsure (1)..(366): unsure at all n locations
  Clone ID: uC-gsronu33B141h01b1
ggtatgcaaagatcggaagagctcaagggcaagctttaggcaacaagtgaaaaccaataggcatggggaattcaaggttcatttgcctttttcagtgagcaaacatgtgaagaaaatcgagggatgtgaagttaaactgattaaaagcagtgagccatattgtgcagtggcctcatctgctacttcctcttcactccatctcaagtcaatgaagcaaggaacccatgttttctcagctgggtttttcaccttcaagccagtcaaacaaccaaccttatgcagccaaaaaccaagtgttcatcccaaccagcttctttcggcgcccattttttctccaaacccacttctaccgncgtccattctttc

SEQ ID NO: 8087 - DNA, 171 bp, Gossypium hirsutum
  Clone ID: uC-gsronu33B141h02b1
cccacgcgtccgaaaaaaaaaaaaaaaaaaaaggaaaaaaaaagaatggcggaggatataaaagatccaaagattacatcggccggcctgctgactgtggtacctctcttatggccccacctcatgcagggttaaatgtgcacattttttcagcctaaagactaggaactg

SEQ ID NO: 8088 - DNA, 513 bp, Gossypium hirsutum
  unsure (1)..(513): unsure at all n locations
  Clone ID: uC-gsronu33B141h03b1
cccacgcgtccggccagcttcagttatatcactgtactgcatgtacctatgctatagtggacttgcaagtgaaccgagagattacgaatgcaatggtcttcacaagcattcaaaagcaatttcaactggtaccttgaccttaggtctgcttaccactgtcctgtcagttgtctactctgctgttcgtgctgggtcttcaacaactttactctccccaccaagctcgcctcgtgcaggaaagcctttgcttgcaatggacaaggcagatgaacacgaagaaaaagagaagaacaagccggactcctattcatatgccttctttcacatagtcttttctcttgcaagtatgtactcagcaatgcttttaaccggatggtcaacctcggtcggagtaagcggcaagntagtccacgtaggatggccatcggtgttggctcggattataactgggtgggcaacagcaggtctctatgtatggtctatagttgctcctatgcttttcccagagaggga

SEQ ID NO: 8089 - DNA, 286 bp, Gossypium hirsutum
  Clone ID: uC-gsronu33B141h04b1
cccacgcgtccgatttgatgattgatcaagtagggaacatacgttttggtttttccaattttatatcataatattacagtgtacatagtcttccggtgattttgacgtgtgtagaaatgttttattgtttcaaaaatagtgatttgtgaaagtattcatttaatttgtaatctgatttttcctttgcatttatttctgtagaggacacaggctatttttgctttgtaattctttgttggtgtgtgctttgtcaaatttgagagcaaaataaggatatcttgaattc

SEQ ID NO: 8090 - DNA, 545 bp, Gossypium hirsutum
  Clone ID: uC-gsronu33B141h05b1
tctagatcgcgagtggccggcctttttttttttttttaaacttcttttaaacacactcacatgccattgatgcgtgcccgcacgtctttgcaaaagctcgcataccctgagcgagcgagcgtttgcttcacagctgcatcgcgcgtgcacacgactatgggagagcacgcctgatgatggatgctatgggaggaggtagcagcctgctgggatgctattcgcttcttccaactatatgtgaataacagacggggtggataggctaagctggcgcagagagctgaaaataatggatataaagctattgtcctgactgtcgattctccaagactcggcataggggaggcagatgtgtagaacacactggttgtaccttcgctgaagaacctggagggtctattaccaacgaaatttgtttctgatgaaaaaggttcaggtttggctgctctggccagtgggactcttgatgcttctttctgttgggaggacatcgcatggctgaaatctatacaaacttgccaattctgatcaaggggtgctcactc

SEQ ID NO: 8091 - DNA, 567 bp, Gossypium hirsutum
  unsure (1)..(567): unsure at all n locations
  Clone ID: uC-gsronu33B141h06b1
agagaacagagataaagaatatttttaatatgggtgttgatttagagtcgatatcggaggcaacttcaggtgccataggatcactattaagcacaacgattttgtaccctcttgatacctgcaaaaccaagtatcaagccgaggttcaagcccatggtcaacgaaaatacaggaatctctctgatgtattatgggaagcggtatctaccggccaagttctttccttataccagggcctaggcacaaaaaacctgcagtcattcattgcacaatttgtctacttctatggatatagctacttcaaaagactgtacctagaaaacnagtggttccaagtctattggaacgaaagtaaacttgattcttgccgctggagcaggggcctgcactggtattgtcactcagcccctggatacagcctgctaaggatgcagacaagtgcctttggaagatacgaaggactctggaaaaccctcaccgaggcacttgagtgatgcatttgatggccttggcactcgcttttgtgacctncaaccctgcatcaatatcagttttgatcactgaaca

SEQ ID NO: 8092 - DNA, 426 bp, Gossypium hirsutum
  Clone ID: uC-gsronu33B141h07b1
taattttttttcttcaaacacaaatcaaagggagaaaaaagaatggcagtggagggttcatcgaagaagatgatagcaacacaagcagagatggtggagaacaaggtccccatcccgtacagggatcaatgtgcacatcttctcatcccgctcaacaagtgccgccaagccgagttttacttaccttggaaatgcgagattgaacgccactcctatgaaaagtgcgagtacgagctcgtcatggagaggatgttgcagatgcagaagatccgtgaagaagaggccaagttgaaacaggctgggaaacagggcgcttctgttcctctcatccccaaaactgctaatgcttaagctgtctccaggagggtttagactactttggcggatatttgatgtttgtcacctgtgtgggggcagtttgaaact

SEQ ID NO: 8093 - DNA, 456 bp, Gossypium hirsutum
  Clone ID: uC-gsronu33B141h09b1
cccacgcgtccgctcgaacgattgccgattcgaagacagctttcgttatttgaaaaaaaaaataataataataataataatcttataagaatcaaatataaacataaaaatcttttatttgttttttttttcttttgaatgaatcgcgactatattctgattaaggttcttcccaaattttagctttctttttttaaagctttgatttgattagaggaattgtttccaagttacagagaagttgaagattttaatgaagctaagctttcattgactaaagaggggaaagcgagttgactcaacgttggaactcggtgctgctaaaggtcaattgggattttgctttaaacagaatatttaaaaatcgaaggatatttggtcaagatgggtaaaagtcaatgaaaactacttggatgaagcttgtttgtgaagctgagtgtacacattctaaccata

SEQ ID NO: 8094 - DNA, 470 bp, Gossypium hirsutum
  unsure (1)..(470): unsure at all n locations
  Clone ID: uC-gsronu33B141h11b1
ctttcgacaagaagcagtttgtcgtgttcatcaagaagttcatcaagaacttgacaccaaaactggatgcggaaaagcaagagtccttcaagaaaaacattgagggagcaaccaagtttttgctttcaaaattgaaggaccttcaatttttcgtaggagagagcatgcatgatgatggatgcttggtgtttgcttactacaaggatggtgctgttgacccaacatttttgtactttgcatatgcattgaaggaggtcaagtgctgaggtttgaagcaaagaaaaaaaaaagtggttgctgaagaatttagtcctttttattattgcttttgtctcttgttttcagtactctgctaaagacataaattatttgtggtttttgaggntctttgttttaattgttgttgttttatatggaatggtttctattttatgggttggctaaacaataatttaactctttgttctatt

SEQ ID NO: 8095 - DNA, 569 bp, Gossypium hirsutum
  Clone ID: uC-gsronu33B141h12b1
caaaaagttagtatctgttctaaagaacgtgcctggaattaaaatagagtccacctacatacttcctgcaagcatggttccagatgattttggcccggaaacagccgctggtaacattcaagaaaatgtgagccatgcattaggtgaattgcctgatgatgcaacaacaaaaggtgatgctttagacacaacatgggatgaactaggacctgtgtccaacacgacttcaaccagaaacgaatcacattcaggataaggaggcaaaggatgggcaccaaagcgacatattccgactattcttctcttcagaggatgaatattctgattccacaggggaatatcaagtgcgacacgatcggggctacaacagaaagccggggtagatgaggaagacagctctttgctgtgcaaatccttgtattagtggcacagtgtaagagtgttggggataacacatatttttcagcgctctctgggggtgtggatgagtgttcaaaatatgatgtcagccgtctggtgctgctggagaagcatgaagaccgaaaatatttgaggactatggaagagca

SEQ ID NO: 8096 - DNA, 406 bp, Gossypium hirsutum
  unsure (1)..(406): unsure at all n locations
  Clone ID: uC-gsronu33B143a05b1
cccggctactacccccccgnacaaacaaaggcaaagggggggaattattacgcattatgggggagaaaacccccccccccccaggaacaacaccagaaaaacatctaccacgacaaccgcaaccccagacactccacactatctcagggcccgactcccccgcaggatatcacaaacactcaaagccaacaaggccgctatcaagccaaccgcaatcccttcacggactagccccgccccaagggacaccgccgctgccgacccccgcgcacaccctcaccgcactcactacaccagcggcatgactggcaaaaccgactcaactcgcgacacccaaatcacccttgaccctgccggatacccccgggcaacaaccccacaccgttcccaactcacccaactcacc

SEQ ID NO: 8097 - DNA, 411 bp, Gossypium hirsutum
  Clone ID: uC-gsronu33B143a08b1
gtagatgcggagtccttgccgtcagtgaagggcggtcttttttaagatatgtggtgcattaagaaattggagagcagttctccattagatgttatggttgcaaatgattagcgctgccttttggagatgtttatcattcgtacatatacaagcagttttaggttaaataatgttatacttgatttgagttcctttccacatttcaaagtcaaaacaaagatattgtgatgaatcaggggtactcgaaccctttttcatagcattccactttatttatatataaaaaaaaccttatagtttctcatatttattttcatgtaaatttcattttttaaattttggatcattttgaagtcttttcgggttcaaaaaaaaaaaaaaacaacatcttaataatacatctacaaaata

SEQ ID NO: 8098 - DNA, 483 bp, Gossypium hirsutum
  unsure (1)..(483): unsure at all n locations
  Clone ID: uC-gsronu33B143a12b1
tgctcaaatggagcaaacaagactctgtttgcaacgcttgggttggagtggcatgtaacaatgatcattccagggttataggtctgcatttaccaggaatggggtttcatggtcctatcccacgtaacactttgagtaggttatcagctcttgaggtgttgagccttagatccaatgttatttcaggttcattcccttctgattttgcccaactcaagaacttaaccacactttaccttcaattcaacaatttttctggtccattacctgatttttccatttggaataatcttacaattgtaaacctttcaaacaatggcttcaatggaagcattaatccttcagtgtcaaaatccagtcaccttacagctttgaatctttcttataactcactttcaggtgatattccggatatcaatatccctagcttacaacagcttgatttatccaataataatctcactggngtcatcccaaactccc

SEQ ID NO: 8099 - DNA, 496 bp, Gossypium hirsutum
  Clone ID: uC-gsronu33B143b03b1
cccatgcttccgcataactggcaccgtcctttacgtgggtttctgtactcaccgtcctggattcaccctcgcttccctccgtatccaccgcttgaagctcaaaaccgcccggcgactcctcctcttcccatctttcaacccttttcaacttaaccctttcttccaaaaaccccaactctcatctctccttctcgtacgacccattcgtcatttcatgtgtgaccagcaatggcgacgttctgatagggaacggaacgttgccggcattcgtcagtgacggcaaggacgagtcgactttcaggggggttacggtggcgtcgacttcagatttggacgcggagacggtgaacaacttgagaccggaactgaagaaagggaatggagtgctcgtgaaagttgagatggatactaaagcgacagcgacaatgggtgggttgaagagcagaaagttgggatagagttacgtgcgatgggattaaaggggttgtcccgaaag

SEQ ID NO: 8100 - DNA, 524 bp, Gossypium hirsutum
  Clone ID: uC-gsronu33B143b09b1
gtaatcttcttcattctcattctctctccactgagctcttgctaaacggtatcgttgtagtcagcctttcatcaatggcgaaagaaccagttcgcgtcctcgttactggagctgcaggacaaatcgggtatgctcttgtacccatgattgctaggggagtcatgttgggtgctgaccagcccgtgatccttcacatgcttgatatcccacctgctgcggaggctttgaatggtgtcaaaatggagttggtggatgctgcatttcctcttctaaagggtgttgttgctacaactgatgctgttgaggcatgcactggagtcaatgttgctgtcatggttggtggtttcccaaggaaggaaggaatggagagaaaagatgttatgtcaaagaatgtgtctatttacaagtctcaggcttttgccttggaacagcatgcagctcctaactgcaaggttttggttgttgctaaccctgccacaccaatgcattgatcctgagggatttgcaccttcatccctgcaaag

SEQ ID NO: 8101 - DNA, 350 bp, Gossypium hirsutum
  Clone ID: uC-gsronu33B143b11b1
taataggggaaaggatccatgcgaactgggctggcacatttgatagtttgtcctaagagacggcggaagcccgaacgacagcgcgtgcagcgcgagcttcaaaagggaatcggggtaaaatttctgaaccgggacgcggcagctgactgcaacgttagggagtccggagacgtcagcggaggcctcgggaagagttatgtttaatgattaacggactggcgaccctggaaacggatgatccaagggtagggcccagtggtcggaagagcaccgcacgttgtgtggtgacctgtgcgccctcggctggccttgaaaatacagaggaccgagtgccgtacgcgcccggtcgt

SEQ ID NO: 8102 - DNA, 115 bp, Gossypium hirsutum
  Clone ID: uC-gsronu33B143b12b1
cgccctttcctatcaagcaatggcaccggccctgcctgcaggaaaaacaaacaaaaatgcctttaaggcactcaagagccgcagaatatagcggcgcgcaggtcaaaatggccca

SEQ ID NO: 8103 - DNA, 376 bp, Gossypium hirsutum
  Clone ID: uC-gsronu33B143c02b1
gcctgcctctcattgcaaaacactatattttgggggggatttaagagcactttttgattctatcagcaacatccttgtagcttttgagcatagggtataacaagcagaatccacatgccttctcaggctttatctgacctcaaagagaagaaagaggacacaatgatgaagaagaagatcgctctcgaaacacctgaatccgagaggaaaacgaacaagatcaaggaacctaagggtagagaagaggaagatgaatcggctgtgaagaagagtaaaaagaagcgtgaggcctcggagctccaaaccgaagaggaggagaggagccagacgagctcggagcttggtgagcccgaggatccacaggaggagaaagaaa

SEQ ID NO: 8104 - DNA, 405 bp, Gossypium hirsutum
  Clone ID: uC-gsronu33B143c08b1
cgccgtttgagagacagctcgcacaggccaagctggtggctgtttaacaggttgttgtgaaggcaccctcgagaaaaggggtctctataaattcagctcacaatatgctatccccagccagggagaaggatgaagatattattttctaatgaagaggttagttatgttctttcctaggagctctgggtttctatctggtgcctatttgatggcgggagattcctttaatcatttagtgttgttttgaataaatggaatgtcatgaaatattgagtattattatcaatgagctgatattcatgacgatagacgtgaaacatttcaaagctctcaagtctgttgcttgaatgatcttctatgctttgaatgagctcctagagcttgcatacgtgccatcattgctag

SEQ ID NO: 8105 - DNA, 400 bp, Gossypium hirsutum
  unsure (1)..(400): unsure at all n locations
  Clone ID: uC-gsronu33B143d01b1
cgatgagaatccgnagacaaagctaagcctgagggggacctattaacaccatatttgggttgataaatactttggcagacgacgacccgagcataatttgatcaacaccggcttctattacatcagatcgaacaacaagaccatctgtctgatccacaaatggtatacactcaaggacagttccaccaggaaaaaagagcaagacgtgttgttagacctactaagacatggggtcgtcaccacattggatctacgagtaaggatatgggagacgagacaagccagtggcattcgtgaagacagcaaagatgtggctgcagaaacgacggtacatgccaaatgttgccaccacatatatgcaaaggtaagggatatgtccgtctaacatcgaaattggaag

SEQ ID NO: 8106 - DNA, 484 bp, Gossypium hirsutum
  unsure (1)..(484): unsure at all n locations
  Clone ID: uC-gsronu33B143d04b1
gcatcgatctcttatgggtccacctgacagtccatatgccgttggagtgtttctagtcaccattcatttccctccggactatccatttaagccacccaaggttgcattcaagacaaaggtctttcaccctaatattaacagcaatggcagcatttgcctcgatattttgaaggagcagtggagccctgccctcaccatatccaaggtattgctctcaatctgctcacttttgacggacccaaatcccgatgatcccttggtgccagagattgcccacatgtacaagaccgacagggctaagtacgagacaactgctcggagctggacccagaagtctgccagngttagtgtgctaatatgcatataataggaaggctttattctatgtggctttgatcttcatttaatatgtacgaatcaatgaaacagtatgtgtgatctggctcttcacttatgtactggaccatgccctccttaaaacaca

SEQ ID NO: 8107 - DNA, 473 bp, Gossypium hirsutum
  unsure (1)..(473): unsure at all n locations
  Clone ID: uC-gsronu33B143d06b1
cctcgtttccgtggacctggtggaccttatgcgttggtcttcttaaaagatgcatgcagagctcttgcaaagatgtctttcgaagaaaaagatctgacaggtgatatttcagatctcggtccattcgaattggacgcattgcaggattgggagtacaagttcatgagcaagtacgtgaaggttggatccatcaagaagacaatggttccagtaaccgaaggggatgccagtggtgaagcctcaggagctgcagaaactgatactaagcaaactgaagatggtccatcacaaactccagttactgagtcagaggaaaaatcttctcctgcagatactaaggaggagtaacatgttcgagctttagctgtttctgtttcaacangtgatcactcgttgtactggacatgccggaagagacagcattgtgttgttcgaatgaatgtgaatcgtcttttatatataaactcaagtta

SEQ ID NO: 8108 - DNA, 461 bp, Gossypium hirsutum
  unsure (1)..(461): unsure at all n locations
  Clone ID: uC-gsronu33B143d07b1
tcgtcacgcgtccgagttgttctccctcttcctggggctccttttaatccgtttgttggtctcaccgcaccatctttgcatcgtcgtctctgtcggtcgaccgtcggccttgcctctgtattctgaagaaaccctaaaacattagggtccacagtcgagaaaaattcatccctcgagagagttaaggcattgcatatttgggacatggatgttgtagctgagcccggaattggatggatggaacttaatgaatacttggagccatatggtttatttttccctcttgatccagggcctggtgcaacaataggaggcatgtgcgcaacacgctgctctggatctttagccatgatgtagttgctactctactactgtctttctttgcattccctagtttgccccttagtctggtgaaaaattacatctganatctctcttactgagggtttgagaagtttcat

SEQ ID NO: 8109 - DNA, 495 bp, Gossypium hirsutum
  unsure (1)..(495): unsure at all n locations
  Clone ID: uC-gsronu33B143d08b1
attaatagagatgcctactctaaacacatgggggcaattttggatggattacattacgttgcagctcttgaatattgatggaatccgtaccattgggagtgttcttggtcaaagtattgctcttgactactatgtgcgccaggttgatgggatggttgcagagtttaccgacataaatcgtgggatggaaaaaacaggaacatttaccatggacagcaaaaaactttttcagatagttggaaaggcaaactctaatcttgctgatgtaattcttaagctcggactttttgagagatcggatatcgcttggaaagatgccaaatatgccataatatgggaatttctacgagatgaatttgaattaactcaaagatttgcaagtcttgattttaagttgaagtttgttgagcacaacattggtttcttcagaaattcttcaaacaggaaatcagatnttttgagtggctcatcatcgtgttgataagcgccgaaatc

SEQ ID NO: 8110 - DNA, 332 bp, Gossypium hirsutum
  unsure (1)..(332): unsure at all n locations
  Clone ID: uC-gsronu33B143d12b1
cgtantttaaaaaaaaaaaaaaaaaaaaaaaagggagatttttttaaaaattttttttgttcncccccccaaaaaccaggtcgcccactcttaaggttccgcgcctccgttcttcttgcgtcgccctttcttaccttttctctggggcggcctctttttttttcgctgcccgttgttcctcctcgtctcccctgtttttcccctggctttgcctccctttttccccttgtccccctttccccctttccccccttgcctttcttgtttcccggccttctcctttcctccttggcctctgttgccctccctttctggctacttggcctccccct

SEQ ID NO: 8111 - DNA, 431 bp, Gossypium hirsutum
  unsure (1)..(431): unsure at all n locations
  Clone ID: uC-gsronu33B143e06b1
gcctcccttctttttttttttttggaatatctcttgggaaccttttaaatttgctgctataccaagaatatcatatatgctaaatagtaattcattaaccaaagtccatagataaggccatgacattactgttaaacatgaaaacacacaaacacaaattattcaacccaaatttcattaatcttaggtccccaatattaccaagaagtagaacgtcattgctctttatgtctgtttaacgaccacatgtgcatcactcacttgtaactgcctttcatttgaaagcctctccccagcaccagctgctgcaatatctgatggactagtgggtctactattatccaaaagcctagcttgtaagttagaatctgaatttacagcagtattntgaacagaaccaagagttctgcctctccaggaaatctgggatc

SEQ ID NO: 8112 - DNA, 429 bp, Gossypium hirsutum
  Clone ID: uC-gsronu33B143e08b1
ataataactgaacctatcctctccctttcaggggtcctattaaacaaacatggcccacgccggcgagcggcggttccaaaggccaaagctccttcacgagcggtggtcggagcgagaaaaggagggctttttaaccccgttctcgacctccaccttaaggcccggtcctccagaccaaacaagccgaaacaaggagagacctttcgtctccttctcggtccgattccaacaccgaagatggtctccggcgacgggctttcgagaccggtactggtgaagtcaacgggtattggaagaataaacctagcctttttggtgcaaaactggtcgtgcttcgggcgttgagtgcgctgcaaatgcacgaggagacgtacggcgcactgaggctgctggttgtgagctgaattgggctaggggttttgccatctt

SEQ ID NO: 8113 - DNA, 542 bp, Gossypium hirsutum
  unsure (1)..(542): unsure at all n locations
  Clone ID: uC-gsronu33B143f01b1
tcatgacctcagcatgatctctcatttttatccgggggggttttctcttttcaaccgtttcttcccatcctctttatcctctctctctgcaaccttacctctcctcccatttccctcaccatgccaggcaaccaagaagttatgtggcccagattagtggctaacaagatcctcagaaagagattaggaagcaacaatttcgtcgctgatttcccatgcaacaaagaaattccaagcttagatcgtccatcgttgagtcccaacagtatattcagtcaccacaaggatacccataactacaggattttcgttagtacatggaatgttggaggggttgcaccacctgaagatttggatatagaggatttgttagatactggcaacacctcctgcgaaatctacgttcttggttttcaagacattgtaccccttagcgcctccaacgtgttaggatctgaaaatagcatggttgccatgaaatggaattccctaattagacgagccttgcacaacaagaagaaaccacactgnctagacaaaat

SEQ ID NO: 8114 - DNA, 297 bp, Gossypium hirsutum
  unsure (1)..(297): unsure at all n locations
  Clone ID: uC-gsronu33B143f02b1
gcgtanaagttctaccaaaccaactgaatcatgtggagagtttttaaaatgaacgtcgtgtaaccaccccccataaggggactgtgcgacaccgtaaagctgatgaaggatggggtacaacggctctggggacattggacattgggtcatcaaggagtgcttgtcacgcgacttagaatgagaaaactcagcgcgaaactcatggggaagatctcatgcaacactatggacgaggaacttttaagggacattcgagcgagctcgggtgctgatgactatggaccctgcagagcatga

SEQ ID NO: 8115 - DNA, 531 bp, Gossypium hirsutum
  unsure (1)..(531): unsure at all n locations
  Clone ID: uC-gsronu33B143f07b1
tanaaaaagaaaagaaaaattacagtgaaaggggcaacttttaaagttccagctgatgtacctgccccttctgaggatgctgagcaacttcgtaaagcttttgaaggatggggtacaaatgagcaattgattatcgacattttggctcacaggaatgcagctcagcgcaatttgattcgtaaaacttatcgcgaagcttatggggaagatctccttaagtctttggatgaggaactttcaagtgactttgagcgagctgtggtgctgtttactttggaccctgcagagcgtgatgcatttctggctcatgaagctacaaagaggttcacatcaagccattgggttctcatggaaattgcttgcactaggtcttcacatgaactgttcaatgtgaggaaggcgtatcacgatctttacaagaaatcccttgaagaagatgttgcgcaccataccaagggagactaccgcaggctattggtcccacttgttagtgcattccgataccagggagaggaggtgaacatgacactg

SEQ ID NO: 8116 - DNA, 459 bp, Gossypium hirsutum
  Clone ID: uC-gsronu33B143g04b1
cccatgcttccgcccacgcgtccgaaacaagaacggggggttttttgattcctgtttggacaacaaatggggttacagttctcgtgtgattgatttgatcgttcacatggcatccaccaaagcatgttgaagttttttttgaaggccagtgaagaagttgtgtttctggtttaaagaatatgaggtgtttgagagaagcttcttgttatatggaataaaaaacccaatgattttaccccttcttgaatgtttacatttctgcggttttgaaggtgtagtgaacaagtttaccagtttgatgttatgaagtaaaatggtgtttatacatcaatcaaattagtgctgtcgtttttttcccttttaattggtgctatttgctttcaagtttacccaattgtatgagaagggatatgggttttcgaatgatttggggcaacccattcggttttttcagtattg

SEQ ID NO: 8117 - DNA, 466 bp, Gossypium hirsutum
  unsure (1)..(466): unsure at all n locations
  Clone ID: uC-gsronu33B143g06b1
gaatantccgaggctttggattcgttactttccgtgagcgagtaagctatgagggacgcgatcgaaggaatgaacggtcaaaatcttgatggaaggaacataactgtcaacgaagcccaatcgcgcagaagtggaggcggtggcggaggatttggaggaggaaacggtggttacagccgcggtggaggcggcggcggatatggtggtcgccaaggaggatatggtggcggacgccgtgaaggtggatacggaaacggtggggggattgtggcagngttgatnccgannggtnngacncccgtgaaggaggatacggtgacggcggatctcgttactcaagaggcggcggtgcatctgaaggcaactggaggtcttaaatttagggtttcaaagtgggcttgggcctatattgctatgggtttggctcggtgttggtagttggcaattctaaagttactctgctact

SEQ ID NO: 8118 - DNA, 339 bp, Gossypium hirsutum
  unsure (1)..(339): unsure at all n locations
  Clone ID: uC-gsronu33B143g11b1
atangctacctggactcttgttttactgcatgaggcatttttatatagattggttcgataaattacttctgttgtgtattcaagcttcagtttcttttttatcttaaaagattgccctcttatattgattggcttcatttgtaatgtagcaataaaaaagaagctttggagggatatggaatgaagcttcaatcattgcacaacatactgatagtaatcatatattgtattaagaactgtaatatatgctacctggactcttgttttactgcntaaaaaaaaaaaaaaaaaaaaaaaaaaaaaaaaaaaaaaaaaaaaaaaaaaaaataaaagaaatcc

SEQ ID NO: 8119 - DNA, 336 bp, Gossypium hirsutum
  Clone ID: uC-gsronu33B143h02b1
cgccccggaatacccggcgcgacccacgccgccggctactagccccaaaaacaccaccaagaagcggggaagcattataaaaaaagcttggggggcaaccaccaacaacagggggcggggcgccgagaaccgaaagagctgacaggggcatgcaccagcagtactaaccaggaacagacaaagctggagcgctgcgggacactcactaccaacggaacactacaagagcggacgaaaatcacgcgctagggaaaggagacctcttatcggagcaacagccaagggaccgggctggagccgccaagtaacatcagatgaaactgagggacagcaagg

SEQ ID NO: 8120 - DNA, 357 bp, Gossypium hirsutum
  unsure (1)..(357): unsure at all n locations
  Clone ID: uC-gsronu33B143h03b1
acaatgaaacgtccggtacgacacaaagangngggggggcttaataaacaattaggggggtaaaaaacacacggaaaagcgggcacagcgaaggacccgcaaatatgacccaacccaacatggaaaccgactgaagaaactacgttaacagaagctacagacacctagacccacccaaagaacaagctaaggaagaaaacaaaaccagcaaaggtgcacaaaggaaccacagacaaggaaagctgcatgacgctgcagacagacacctcacctgaaggggacaagaaacacgcatgaccaaaaggcgacgatgaacacaacaatgacgaccaaacaatcacagacaaaagcgcaaac

SEQ ID NO: 8121 - DNA, 62 bp, Gossypium hirsutum
  Clone ID: uC-gsronu33B143h05b1
aaaataataaaaacaaaaaaaaaaaaaaaaaaaaggaggggtcttttcgatctagttgttcg

SEQ ID NO: 8122 - DNA, 493 bp, Gossypium hirsutum
  Clone ID: uC-gsronu33B143h07b1
atgagttccaaaaacacaggcttggagctgggcagaactgctcagccaccacagagggcaatcaccaactcactgatgtcgtcctccctgaatcgaaagattggagggaagcagacattgtcagccctgttaaagaacaaggctcctgtggatcttgctggacattcagtaccactggggcactagaggctgcttatcatcaggcatttgggaaagggatctctctatcagagcagcagctagtggactgtgctggagcctttaataactttggttgtcacggagggttgccgtctcaagccttcgaatacatcaaatacaacggtggcctcgacactgaggaagcttacccttacactgctaaagatggtgaatgcaaattctcacctgaaaatgtgggtgtccaagtcattgactctgtcaacattaccttgggtgccgaagacgaattgaagcatgcagtcgcgttggtcccgcccggtagtgttgcgtt

SEQ ID NO: 8123 - DNA, 99 bp, Gossypium hirsutum
  Clone ID: uC-gsronu33B143h09b1
taaaaacaaccaaaaaaaaaaaaaaaaacggggggatttataaaaaaaatttgggtgggaaacaaccccccaaaaaaaacaaaaaaaacaaacacacac

SEQ ID NO: 8124 - DNA, 500 bp, Gossypium hirsutum
  Clone ID: uC-gsronu33B143h12b1
tacagcacctcagtggtgttattctctttgggggaactttttaaaaattttggttcgacacgcccttcgttgatgttttgaaggaaggtggtgtcctccctggcatcaaggttgacaagggtacggttgagcttaatggaacccatggcgaaactttcacccagggtctagatggccttgcacagcgatgccagaagtactatgaagctggtgcccgctttgctaaatggcgtgctgtccttaagattagtgctaatgaaccaaccgagcttgcaatccaagaaaatgccaacgggctagctatgtatgctgccatctgccagcaatgtggccttgtccccattgttgagcctgaaattcttgttgacggatcacatgacattaaaaagtgtgctgcggtgacagagcgtgttcttgctgcttgctacaaggctttgaatgatcaccatgtcatgcttgaaagtactctcttgaagcctacatggtgacccccgttctga

SEQ ID NO: 8125 - DNA, 62 bp, Gossypium hirsutum
  Clone ID: uC-gsronu33B144a03b1
atttttttaaaaaaaaaaaaaaaaaaaaaaaaaagggggggatttaaaaaaaaatttggtgg

SEQ ID NO: 8126 - DNA, 380 bp, Gossypium hirsutum
  Clone ID: uC-gsronu33B144a05b1
actcacgagggatgtttctatcactggttatgtcgttccttgctttgatctacattttcttggctgttttggagtttcagtggaacaataatggagttcgttcttcgctgtttcttcaagattgttgcttcccaatgtcgcatctcgtttcgaaaaaaaatgggtaattttgtgagtgattctaagtttttgaatgtattggaaaatgaagcgtttttcccttagcgatttgcttcacgaaataagaaagagaaaagtttggattaatggttttttttgggggtttaatttgtagggtattaaccaaatgtttgatttagggtttcaatgtaaaaagaaatgttaaaattctgatgaagaaaatcttgttagaatcccgt

SEQ ID NO: 8127 - DNA, 466 bp, Gossypium hirsutum
  Clone ID: uC-gsronu33B144a06b1
tgttgttgaacacctaaatattataatttgggtggaggtgctttgctgaacaacatcgatttgtcaattgttttgttgatttttatcttacgaatatgaaatgttttcaatacaaaaagtcccttggatcctacagctagagcatgctcctcattgtcggtatatcttgttctattatggtataaggctactaagttgtcatatgttttgtaatgtgattcattcattttggatatgaaaatgcaagttattgacatcatccttggattagcaggaagaaaggggaaggaggatgcgataataaacccagaggaacaataaaaccatcgatttagcaacattttgggctgtgatatgtaatgtctctatatagtttttggattcagataaagattgaaggaatcgcttctacatcattgatgagctgcaccaccttagttttagaatcatggtcaacggatgcatg

SEQ ID NO: 8128 - DNA, 359 bp, Gossypium hirsutum
  unsure (1)..(359): unsure at all n locations
  Clone ID: uC-gsronu33B144a07b1
ttgtatttgtcataaagcttctccaattccttggggctctgttaatcttgggattggccttcggtatccgctcctataccaaaacaccagcttcatcttaagcattgagactcccaagagataatttgagcaatcttcacaataagattatgctagtttaaatttctttggaattttcacatactgcaggttggtaaatggttggatatttttattcaaacatttgctccaatgcagttgaaaaaactcagattcgcctccgattgtgataatttgataattgtctttcccagttttcaaaannnaaaaaaaaaaaaaaaaaaaaaaaaaaaaaaaccataaccagggggcggccgctc

SEQ ID NO: 8129 - DNA, 458 bp, Gossypium hirsutum
  Clone ID: uC-gsronu33B144a10b1
tttttaatctcctcctcctcctcagaaatcggggggtcattttcatggccttttgtggcaaggactcctttgacatgactatcggtggtcagcccgctggtcggattgtgatggagcttttcgcagattgcactcctcgcactgctgagaacttccgtgccctctgtaccggcgagaaaggcgtcggccgcagcggtaagcccctccactacaaaggctcctctttccatcgtgtgatccctaactttatgtgccaaggaggtgacttcacggccggaaacggtaccggaggtgaatccatctacggatccaagttcgctgacgagaacttcatcaagaagcacactggtcccggtattctctcaatggctaacgctggtcccggaactaacggatctcagttcttcatttgcacggctaagactgagtggctcgacggacagcacgttgtgtttgga

SEQ ID NO: 8130 - DNA, 442 bp, Gossypium hirsutum
  Clone ID: uC-gsronu33B144b02b1
cactcatttctcactaaacttgttattaagaaactcgaatggggaaaccgagatgatatcgatgccattaaagccatgaataacgaaggctttgaagtcatcatcggaacagatgtcacctacattcccgatgctattttaccattgttttcaacagccagagagttgatttcatccaacaaaagtgctgagaaagatcaagcaccagctcttatcctgtgtcatatcttccgacgagtcgacgaaccgtctttactttcagctgcatctagatatggctttagattggtagataaatgggcgaaaggaagtccaaacaatgagtctcaaagcttaatcagctcttggtttccagagaacaatttcgaggagcatatcccaacttcagcactaaatatcatgtatttccaaattagatgaatagtatcatataagccttcac

SEQ ID NO: 8131 - DNA, 421 bp, Gossypium hirsutum
  Clone ID: uC-gsronu33B144b12b1
tttttattcaatcatgcatttttcttctttggttgtgtttcttttaaacttttaacagaacatctagtagcattagaatcatgggtgttgtgagttatgagtttgaggtaacctccccaattgctccagccaggctttttaaggcttttgttcttgaggctgccaagatttggcccacggctgcccctcatgcagtcaagagtgttgagctcgaaggtgatgctagtcctggaagcatcgtaaagatcacctttgctgaaggccttccataccaatatatgaagcaccagattggaggacatgacgaaaacaatttttcatacagttacagtatgattgatggtgggcctttaggggacaagctcgagaaaatcagctatgagaatcagtttgtggcagctgcagacggaggaagcatttg

SEQ ID NO: 8132 - DNA, 321 bp, Gossypium hirsutum
  Clone ID: uC-gsronu33B144c01b1
cttattcgtccgctggtctacaactccggccgaggatcgtctccaccactattccccttctcccaccaccaccacctcttccgccaccttttccgagccaactcttcagcctccggctccagtgcctcctcccgccgcatcctcgaaacctcagtccactcctacttctccgaaactcgaaatcagagatccagttaatagaaatagtaacaacaatagcggtggtaacgatcaaaacggcgactcttctggcgtttctcccgatgatatctctcgccaggctcagctcttggccgagttatccaagaaggtgataaatat

SEQ ID NO: 8133 - DNA, 309 bp, Gossypium hirsutum
  Clone ID: uC-gsronu33B144c02b1
tgtattaattcagtatggcactggagctatttctggtttctttagttatgactatgtccaagttggtaacttggttgtggaagatcaggaatttattgagactactaaggagccaggtcttatatttttggcggccaagtttgatgggattttaggacttgggtttaaggagatttcagttgggaaagctgtcccagtgtggtacaacatgctcaaacagggtcttatcaaggaaccagtattttcattttggcttaaccggaacgtaaggggatgaagtgggtggtgatattgtgtttgtgggggttt

SEQ ID NO: 8134 - DNA, 375 bp, Gossypium hirsutum
  Clone ID: uC-gsronu33B144c05b1
gtttctcttaagtcttaccataaaacagagcagagaaggtaaaacccaaagtttgaaaaccatcaaaaatggttcaaaggctcacttaccgtactcgccatagctacgctaccaaatccaatcaacaccgtgtcgttaagacccctggtgggaaattggtctatcagacaactaagaaaagagcaagtgggcctaagtgtcctgtcactggcaagagaattcagggtattcctcacttgagacctgctgaatacaaaaggtctagattgccaaggaaccgccggactgtgaatcgtgcttatggtggtgttttgtcctgcagtgctgttagagagaggataattcgagccttcttggtggaagagcagaaaattg

SEQ ID NO: 8135 - DNA, 478 bp, Gossypium hirsutum
  unsure (1)..(478): unsure at all n locations
  Clone ID: uC-gsronu33B144c07b1
ttgattcccttcgttgtttcctcaactttcagtgtttatttattattatttttatttttttggtttagtgtgttgcaatggccgaggagccgacaccaaagcgccaaagagaagaaacccagagctcaaacgaagaacatgttgaagaaacaaaacgccataagtcttacaatcacatactctctttgcttgaagtcgaagaggatgagcccagccaagacttgtcccccctaatcaccactttacagcaacagctctcctcggactccgttttggatgcccctttccctctttgtgaaccagcaacaccatcgccctcgaacccagacaaggaaaccgccaccaccgtcctcagcttagaagactgcacatcagcaacttgttccttgaaagaagatgatgatgatgatgataaagtgcacgtcataagacatttgcttgaagcctctgatgatgagctggngattccaaatagaga

SEQ ID NO: 8136 - DNA, 480 bp, Gossypium hirsutum
  Clone ID: uC-gsronu33B144c08b1
ttctacacctatgagaacacaagccggagatagcggcgacggtgagtttcctctcaacgtcccctcttcgggaaacacagtggttctaaagacagggctgacgaaaaccagtgttagtgataccatttataccgatggtcagctggctgtttatcgagtcgatcaggtgcttcaacctttgcaagtcttcgctgctaggtcttcagctctggcaccggcaccgggaatgtctaggaaggctgctgacgttgatgggaaatccaaagcttcgagccttgccatgcaaaacttagctttgtttgtagttagtgttatagcttttgcactttctttgtgacaataaaagggttttgataggatttcgtgatggaaaattcggggacctcttattgcccatgggtctcttctctccatgggctattgaagatgtgatttgggcgtgcaaggtttcttggttcttttggggaatcataattctta

SEQ ID NO: 8137 - DNA, 435 bp, Gossypium hirsutum
  Clone ID: uC-gsronu33B144c09b1
ttctttcgcgtccggctgagtttaagcatatcagtaagcggaggaaaagaaacttaccaggattcccctagtaacggcgagcgaaccgggaaaagcccagcttgagaatcggtcgccatcggcgtccgaattgtagtctggagaagcgtcctcagcgacggaccgggcccaagtcccctggaaaggggcgccggagagggtgagagccccgtcgtgcccggaccctgtcgcaccaagaggcgctgtctacgagtcgggttgtttgggaatgcagccctaatcgggcggtaaattccgtccaaggctaaatacgggcgagagaccgatagcgaacaagtaccgcgagggaaagatgaaaaggacttctataacttatttttctttcaaattctattgccaattatataaacctaagctatggcttctatcatttaa

SEQ ID NO: 8138 - DNA, 388 bp, Gossypium hirsutum
  Clone ID: uC-gsronu33B144c11b1
tttctcttcaaaagtatatctatgaaacaagtgcttattccaaagagctctagcaattgaaggaattgagagaagcaactgttcaaaagtataatgatttgagcgttatgaatgtacctgtggacgaagcccagttcttaaccatgcttttaaagcttatgaatgccaaaaaaacactggaaattggggttttcacaggctattcccttcttactactgcccttacattgcctgaggatggcaaggttatagcaattgaccctgataaagaagcatatgagggtgaagaagggagcttcgatttcgtatttgtagatgcatacaaaagcgactacctaaaatttcacgagctgacgctaaattagtaagggtcggggaattgtagcta

SEQ ID NO: 8139 - DNA, 318 bp, Gossypium hirsutum
  Clone ID: uC-gsronu33B144d02b1
cctcttgcgtccgaaaaaagaagaaaaacaaaggggtcgattccagcgctgttctaatgaaagtaccaaatataagctgcaagacataaacgccatgtcctgctcccttgcccttgccaactctcctgcggtttctccgcccatgtctcttttccgtgacaattctccgatcatctctccgtcgcccgaagctttgaatttatcgatgactcacctcaaaccttcgtcgtctccttcttccccttgttcgcctatgagggttcgccttcaaaagcctacgaccggggctctagtatcttcttctgtttcaacgccggc

SEQ ID NO: 8140 - DNA, 404 bp, Gossypium hirsutum
  Clone ID: uC-gsronu33B144d06b1
cttattcgtccgaaaaaaatgtcttcaggttgcaatggcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctatgcttgtggggaaaataat

SEQ ID NO: 8141 - DNA, 451 bp, Gossypium hirsutum
  Clone ID: uC-gsronu33B144d07b1
ttgttctgatagccctgcgtttcattaagcttgcattactggtagccgaataagattgagatgacgactatacgccgattttgctgcaatgatcttcttcgtttcgcatctgtcaatctcgaccacttaacggaaacctttaacatgtcattttacatgacatatttagctcgatggcccgattactttcatgtagctgaaggccccggcaatcgaataatgggttacattatggggaaagttgaggggcaaggtgagtcttggcatggccatgtaacggcagtcactgtagcgccagaatatcgtaggcagcagctggctaagaaactgatgaaccttttggaagatatcagtgataagatagacaaggcatattttgtggatctgtttgtgagagcttctaatacaccagctattaagatgtatgagaagcttggatatgtaatataca

SEQ ID NO: 8142 - DNA, 463 bp, Gossypium hirsutum
  Clone ID: uC-gsronu33B144d11b1
ggccggtcctcaaccggaacgtggccggggccgtttgaggaagatcaccaccaccccacccttgtccaccaaagatgaggcttcatcaatggcgatgccgacgagtccgacgacacctgggacaccatcgacgccggtgtcggctcgtagggacaacgtgtggaggagcgtgttcaatccaggtagcaaccttgcaaccaaaggtattggcgctgaagttttcgacaagcctcaacctaactctcctactgtttatgactggctttacagcggggagacccggagcaagcatcaccgttgattaggcggtggctgacggcggcggatggtagcaaaaccactagcagaaggttgcagctactgaaagagcaggatttgcatgtaaatatatatatcgtcctttttaaaaggtcttcaatgggtcaattaagtatagtagtaagtagatgtttaaagaataagc

SEQ ID NO: 8143 - DNA, 305 bp, Gossypium hirsutum
  Clone ID: uC-gsronu33B144e03b1
ctctttcacccccccacgcgcccgcccacgcgtgggggttgtttatagaattttttccctcactccccccgaaaaacaaaatgacttcaggctgcaatcgcggatcctaactgcagcagcggcgacaactgctcatgcagcaggaaccttaacctcggatatccggagacgacaaacagcactcagaccatcatccccggagctgcgccagcgacagatgaccattgagggaccagacatgagcactaccgaaacaggacatggatgcaagtgaggatcaaaccgatcttgcgacccatgcacct

SEQ ID NO: 8144 - DNA, 397 bp, Gossypium hirsutum
  Clone ID: uC-gsronu33B144e04b1
cttactcttccgtttcgtggtttaagggatttttgggattcgtttcttctcacgctcgattaccttacaaaaagagaaaatgaccaagtgttacccaactgtgagcgaggaataccagaagtcagttgaaaaggccaagaggaagctcagaggtctcatcgctgagaagaactgtgctccactcatgctccgtttagcgtggcactcagctggaacttttgatgttaagaccaagaccggaggtccattcggaaccatgaagcatcctgctgagctcgcacatgctgctaacaacggcctagatatcgtcgtcagacttctcgagccgatcaaggagcagttccctaacctcacctacgctgacttctatcagcttgctggtgtcgttgtcgttgag

SEQ ID NO: 8145 - DNA, 415 bp, Gossypium hirsutum
  Clone ID: uC-gsronu33B144e05b1
cttattcgtccgctaccttaacacaacttaccaggggaaattccccaagttttttgtttcaaaaagcttcccacattcaccatgtctggcacgtgcggcaactgtgactgcgctgaccgcagccaatgcacgaagaagggaaacagcaacaccatgatcgttgagactgagaagagctacatcaacaatgttgagatggatgctccagctgagaacgatggcaagtgcaattgcggtactggctgcagctgcacagactgcacctgtggccactaagccaacatacaatggtcatgcttcagatcatggcatatatagggatctaaataatgaatttaaggttgaataatttgtgtcctgtgtagtttgtgtggtgacttatatctgtcaggtaacctttctcttccttactatg

SEQ ID NO: 8146 - DNA, 385 bp, Gossypium hirsutum
  Clone ID: uC-gsronu33B144e06b1
cttactcgtccgcccacgcgtccgccggttttgagggtgacaacatgattgagagatctacaaacctcgattggtacaagggtcctactctccttgaggctcttgaccagatcaccgagcccaagaggccctcagataagccacttcgtcttccacttcaggatgtctacaagattggtggtattggaactgtccctgttggtcgtgttgaaactggtgtcctcaaacccggtatggttgttacttttggtcctactggtctgaccactgaagttaagtctgttgagatgcaccatgaatccctcccggaagctttccctggtgacaatgttgggttcaacgttaagaacgttgctgttaaggatcttaaacgtggttttgttgc

SEQ ID NO: 8147 - DNA, 440 bp, Gossypium hirsutum
  Clone ID: uC-gsronu33B144e07b1
ttttctttctctgtaaccttagtttgttccacagaagtgattattggttgagaaaacatggggaaggacaagcataagcctgatgataagggtctgttttcacatcttgctcatggtggtcatggacaccctcctggcggatatccaccggctggagcgtacccccctcaaggctatccaccagctggctaccctcctcaaggaggatacccccctcacggctatccaccatctggctatcctggtgcatcccattcagggcacagtggcatgggagcgctgcttgcaggtggtgcagcagctgccgcagctgctatgggggctcaccacgtgtctcatggtgctcatggtgctcatggtgcttatggtgctcatggtgcttatggtgctcatgggtttggtcatggtcatcatgggaagtttcatacatcatggtggtg

SEQ ID NO: 8148 - DNA, 400 bp, Gossypium hirsutum
  Clone ID: uC-gsronu33B144e08b1
tttataaaatgagttcttgaaaatcagatttcttgctctgaatatctctgataatggctccgattgctgatttgtctgtggtagtctcctgacatttccttattactgttcttgaatcccccataagttttactgagtgggttcttagtgaaatccctagctttgtaccatctaaacatgcatatgcctctgccgcaaaaggagaaggaacattgctatgaataactgtctttaacactgttaagtttcccctcagattccatcctaccaggtcggaagctgatctgaaagttttgttgtcgtacacagcatcaaaaaggatcctgactctcgaaccatatccaccacaacgcataacagaaaagaagacattgacagctgttactccttctgaaaaccc

SEQ ID NO: 8149 - DNA, 446 bp, Gossypium hirsutum
  Clone ID: uC-gsronu33B144e10b1
ttgttattcagcgtgttgggaacaaattattttgcgataatagagatgggtctcaattagatttgttatctgtccatgagacatctcaagaaccattgcctgaagctaaagatgatattaactctgcttattcattgagtgttgaagctgcatatataaatcagaatttttcacagcaagttttagttagggatgggaataaggttagtttcgatgagccgaatccgtttgccaatgaaggcgatgaagtggcttcagttgcttataggtatagaaggtggaaactcgataacgacatgcatttagttgctcggtgtgaggttcagagtgttgtcgatgttaataaccagaagtcgttccttactttgaatgcactcaacgagtttgatcctaaatactccggtgtcgattggagacagaagttggagacccaaaggggtgcttgt

SEQ ID NO: 8150 - DNA, 401 bp, Gossypium hirsutum
  Clone ID: uC-gsronu33B144e12b1
tgttttaaacatcccttcccgtcttcagccggaggtgagtcatggttaagcataacaacgttgtgccaaatgggcacttcaaaaagcactggcagaactatgtgaaaacctggttcaatcagccagcaagaaaggctagaagaaggattgcaaggcaaaagaaggcggtaaggatctttccaagaccaacttctggacctcttcgcccaatcgtccatggccaaactttgaagtacaacatgaagttgagagctggcaagggtttcactcttgaagagcttaaggctgctggtatttcaaagaaacttgcacctaccattggtattgcagtcgatcaccgtcgtaagaacaagtcccttgaaggtcttcaagccaatgttcagaggcttaaaacttacaag

SEQ ID NO: 8151 - DNA, 341 bp, Gossypium hirsutum
  Clone ID: uC-gsronu33B144f01b1
ggtaattgcctcttaattataatcctaaattcggggcatatttcaacacttttgcgctgttgaccaacctatcgctcaactgaccagattcccccataagccgcgtctctctccgtctcttgcaaaggaagagaaaagattcttttcaatcgatcatggggtctctataaaattggctgtttcttttatatatatgaactcttcttcattccgcgattggaatcatagaggttttctcctattcctcctggccaatttcgttttttctttttttcatttcctttttcttttgattcgaagcaaaaatgagcgcgtataagcgcgtggtacagttagggttc

SEQ ID NO: 8152 - DNA, 504 bp, Gossypium hirsutum
  Clone ID: uC-gsronu33B144f05b1
gtccggttggaaagaggctcatgacttgtcgcctacccttccccgactcgctattactcagttaactcgccctcccttcactcactcccaccatggcattccatttttctgcttaaaagctctttcctttccttttttgtttttttttcctcaaatctcatcttttgaagtaaattatttttatcattattctttagagtaaaagggagagtaaaagggagagatgtatatggtgccgccaccccagcgatcggatccgggttccatcggcggcgggtcgggtgatttacgggtttaccaagcttggaaaggcagcaatatatttttatttcaagggaggtttatatttggaccggatgtaagatcattagggctgactattttgcttatagtagctccagtttccattttctgtgtttttgttgcaaggaaattgatggatgatttttctcatcactcgggcaacttaattatggtggctgcctgtggcttcactgcctatga

SEQ ID NO: 8153 - DNA, 462 bp, Gossypium hirsutum
  Clone ID: uC-gsronu33B144f06b1
attttattgtgcttctctctcagatcttgaaaatgtgtacatcaatgaagaagatccacaaagataaggatgttgaaccaacagaatttgaggaatcagttgcccaggcattctttgatttggagaataccaaccaggatctgaaaagtgacctcaaggatctctacattaattcagcagtccaaattgatgtgtctgggagccggaaagctgttgttatccatgtcccctaccgattgaggaaagcttttcgcaaggttcatgttaagcttgtgagggagcttgaaaagaagttcagtggaaaggatgtgattcttattgccacccggaggatattgaggcccccaaagaaaggttctgccgttcagaggcctcgcagccgcacattgacttctgtacacgaggcaatgctagaagatattgtcttgcccgcgagattgttgggaagcgcactagatatgc

SEQ ID NO: 8154 - DNA, 256 bp, Gossypium hirsutum
  Clone ID: uC-gsronu33B144f07b1
ctcgtaactccaccggtcacagcggttcgtatagggagaaaatgagatgaaactatggcatgggccccgccatcgagtgcggcatgctgaaactctcgggccgaatagacacccttaggaatccaggtgcttcgtattcgaatagtctatgttacctaattctttctgacagagtaatttagcttaattctgaaccgagtgtcacaaaatcgagctctttaaactttacgacaatgaaagcgaaaacccatcacag

SEQ ID NO: 8155 - DNA, 406 bp, Gossypium hirsutum
  Clone ID: uC-gsronu33B144f08b1
ttgtgatcttcacaagttgtataaaagttacagagagaggatgaggaaatttgacatcttgaattaccagaagatgtatgcaataggctttcttcactcaaaagatccacttcaatcaatttcaacccacaaatcatcgtctccagcaattacatctcttcttcaccaaaacctgaggctccgacgccgaaaaaagtccaatttcgaccccaccaccaagttcatcaaggagctccacagtgatttagaaatggtctacgtaggccaactttgtctttcttgggaaattcttcattggcaatatgagaaagccatggaaatatgggaaactgatccttatagtttacgtagatttaatgaagttgcttgtgaatttcaacagtttcaagtcctgattcaaagattc

SEQ ID NO: 8156 - DNA, 431 bp, Gossypium hirsutum
  Clone ID: uC-gsronu33B144f10b1
gttatcagctgtggctatgaagagaagactgcatgggggaaagagattggatggatatatggttcagtcactgaggatatcttaaccggcttcaaaatgcactgccgaggatggagatcgatttactgcatgcccttaaggccagcattcaaaggatctgcacccatcaatctgtctgatcggttgcaccaggttcttcgatgggctcttggatctgttgaaattttcctaagcaggcattgccctctatggtatggctttggaggtggtcgtcttaaatggcttcaaagactagcatatataaacaccattgtctatcctttcacatcccttccactcattgcctattgttcactaccagcaatctgtcttctcacaggaaaatttatcataccaacgctctcaaacctggcaaggtgttctctttcttg

SEQ ID NO: 8157 - DNA, 425 bp, Gossypium hirsutum
  Clone ID: uC-gsronu33B144g01b1
cttctttgtttggtccttttggcacaaaggaagctcctgctgttgtcaagtcctactatgacaagagaatagttggatgcccaggaggtgaaggcgaggatgagcatgatgttgtctggttttggctggagaaaggcaaaccacatgagtgtccagtttgctcacagtattttgtgctggaagttgtgggacctggaggacctccagacggacatggcgatgatgatcatcattaattgcaactgggaatttttttttcctgatggaataaaattgcagaagacgattaaatgatgttccaatatacaatgcaccttcaaatgttcaaaagctgttatctgtcgtttggttttgagatggtattctctgtttctttatggtactttagactgatacacaggtatgggcattttttgggtaaaact

SEQ ID NO: 8158 - DNA, 407 bp, Gossypium hirsutum
  Clone ID: uC-gsronu33B144g06b1
cctactcgtccgcatcaaagcaaatagagaagaatttagaaagcaaagatgattagactcgtcaatgtttctatttgtgttctctttatttctgttactggcatcctagtaaaagccgataatgcaccttctccatcgccaaagacaactcctgtgtctccggcgaaagctcccaccacttcttcaagtcctccaatcacatcgccttctaaatctccttcatcatcacctccgtcggcaactcctgcgagttccccatcgataacatcgcccccgcctgcaacaactcccactgctatgcccacaccttctcaatctcctactgccactccgcctgcttcttctagccccccggctcaatccccagcgactccatcaccagcggcaagttctcctccgtccatgac

SEQ ID NO: 8159 - DNA, 274 bp, Gossypium hirsutum
  Clone ID: uC-gsronu33B144g07b1
tcgtaatattccatttgtattgacttatttagggcaggtgtattgtactgcttatatatatggtaatgtatacaggtaatgatttgaataatgcgtagacacaacatgacatttttcttctccgattgaagaaaggcaaacaacatgagtgtccaataagataacaaaattttgggcctaaaattagaggaacctaaaggggcgcccgccggaaaggaccaaaactaacctccccgggcggaccatgtaatagtttttttattggggcacctaa

SEQ ID NO: 8160 - DNA, 446 bp, Gossypium hirsutum
  unsure (1)..(446): unsure at all n locations
  Clone ID: uC-gsronu33B144g10b1
tttttggtctctccgccgtttcgcatttcgtctttctctctccaatggcttctattgctggttcatccatctccatgcaacctcgcccctttgctaaaggcagtgtttctgggttgaaattgggttcatttatgaaccagggaagaagcaccctctcatttacgatgcgtccaatgcctgctcgcttgcagatctgctgtgctgccaaacaagagaccgtggataaggtatgtgaagtagtaaagagacaattagctttagacaatgacaaaccaatcaccggtgaatcaacatttcttgatcttggagctgattctcttgatacggttgagattgtgatgggacttgaggaagaattcggaatcacggtggaagaagacaatgcacaatccatcacaactgntcaagatgctgcagaacttattgagaagctgtgcagtgagaaa

SEQ ID NO: 8161 - DNA, 409 bp, Gossypium hirsutum
  Clone ID: uC-gsronu33B144g11b1
tttgttgcatccgacaatcttcgagaatggtggaaggataaagtccggtttgatcgtaatggtcctgctgctattgctaagtaccaggctgataatttgattcctggcaagaatgatggctgtaacaacattgggccaacgccacacaccttacaagaactccaagatacaactcttggttctcttttgtctgcactgatgcaacattgtgatccccctcagaggcggtttcctttggagaaaggtgttcccccaccatggtggcctactggcaacgaggaatggtggccacaactgggattgcccaaagatcaaggtcctcctccttataagaaaccttatgacttgaagaaggcatggaaagtgggggttctcacggcaggtatcaagcataatgttcctgatattg

SEQ ID NO: 8162 - DNA, 247 bp, Gossypium hirsutum
  Clone ID: uC-gsronu33B144h01b1
ggaaggagagccacactgtagagaggggtattactaagtggtctgatgagggggacctcatctagctaaaccgggctatgctaacagatagctaaggattcagagacgactcactgaagcagatgtgcaccacacgggcgcgggaggagcaatacatggagcctccagcaaaggagaatgagagaggacgattttgatcatgctgataaaccagagagaacgctgatacgggaggaacaagtactac

SEQ ID NO: 8163 - DNA, 427 bp, Gossypium hirsutum
  Clone ID: uC-gsronu33B144h03b1
atacaaagcttcatattatctttttgagggccgtcttaagaatactttttgggtctaacaactacaatcgttttctttttgaagtcgggttttagtttttggggagaaaaaaatgttgggagtatctagcagtgcgatagtgtctccgtcggacgagctggtggcggccggttgccgaactccatcacctaagataacggcggatgctctggtgaaacggttccttgagacgaactcctacggcgtgtccatgcagatcggagaccatgtccaattcgcttattctcaccataaagagtctgctttacggaccagatcatttgctgtgaaagatgaaatcttctgcttgtttgcgggagcccttgataacttggggagtttaaagcagcaatatggtctggcatagtccgcacatgaagtgattttg

SEQ ID NO: 8164 - DNA, 416 bp, Gossypium hirsutum
  unsure (1)..(416): unsure at all n locations
  Clone ID: uC-gsronu33B144h06b1
gtttttcctcagttgttcaacaacattagcccaatctccggcactggccccggcaccttctggcccgacaaacgtcaccaagatcctcgaaaaagccggtcaattcaccctcttcattcgtcttctaaagtccactcaagtggccaaccagctgctcggtcagctcaacaattccaacaatggtatgaccgtttttgcaccaacggacaatgctttctccagccttaaatcgggcacattgaattcactcaccgatgaacaaaaagtgcagctggtgcaattccacatcgtcccaacatacctcacctcgtctcagttccaaaccattagcaaccctttgagaacccaagctggtgatagtggcgatggcangttccctctcaatgtcaccacttcggggaactctgtgaatataa

SEQ ID NO: 8165 - DNA, 362 bp, Gossypium hirsutum
  Clone ID: uC-gsronu33B144h07b1
ttgtttcctgaaggtcacccacacttttgcgacactgtatattccatgggaacacatatgggggaacctaacaaggtaatctggttaatgctaattgatagctatggattaggagaggactcactgaagttgaactacacaacattggtgcggatgatgaaatacatggctcctccaccaggggagtatgagagaggactttttgctcatactgataaaccagtcagtacacttatttgtgaggatcaagtttcaggattggaaattgaggtcaacgacggccaatggatcaagttgaccaatctatctccttcttcttttgttgttggaggtggagatcctctcaaggcatggagtaatgg

SEQ ID NO: 8166 - DNA, 515 bp, Gossypium hirsutum
  Clone ID: uC-gsronu33B144h09b1
tcttacgcgtccgcttcaacgcttcaaattggtttgcttacgaggtagtaccagaagagtctcgatccaagcgaaaagatgctacccaaaaaatagaataacccctagtcagaaacttaacattctcaactactaaccacataaaattacttacctaagttgtccataaaatgccaaaataaggaacaaaattgcgattgcagttgaaatgaaagcagaatcgaaagaaaaaaggaaagagaagggtagggttcgacaaaagagagaagaaatctcaaatgagaatcggcagagtttttggagagaaacgtcaaaaagatgagtacgtactgaacgatcgcagttaatcgagggatgacacgagaccaaatagaaagaagttgagaataaaaaagaatgggtgagcacaaaaatttcagcagcaacaaaaaaataatgaaaaaggaaaacggctgcactaaggaaaaagaggagaagagaaaacccaatattctgtttttggggaaaagaaagag

SEQ ID NO: 8167 - DNA, 462 bp, Gossypium hirsutum
  Clone ID: uC-gsronu33B144h10b1
tccacgcgtccgctcttacctgttgctcggggcggattttatataagccttactgtgtttttccgggctacctattatgaagttaaataaaaaataaatagatattaataaccccactgatgctattcgattattatcatcgtcgacgtcttctttaattcattcgcttcgcttctcttcgccttcactgctcaccactttccacttcgcttcgaattctccactatcgtctcttggaccaaccaatcagaattcggataagatattttcttattcttcttctattggtcttgctccgcttgctctgactcccagaaaactaatcgctctctttcaaggtgcatgcaacagtcgaagaaactgagcagccaaaatggtgggaaaggaaagcgggaccaaatctgaatgatattcattctacaaaagaattattagggccttaagtgaagctggggatagaat

SEQ ID NO: 8168 - DNA, 306 bp, Gossypium hirsutum
  unsure (1)..(306): unsure at all n locations
  Clone ID: uC-gsronu33B145a08b1
caaatgccgacaccaaaaccaatgtccatattacatggggggtaaaattatcatcaatacttgaaaataaaaatacaacaaattcagaaccattccatgataaaacaacaaacaattaatcaaaaacatcaaaaaccataaataatttatgtntntagcagagtactgaaaataagagacataagcaatagtaaaaaggataaattcttcacaaccagtttttgcttctaatttgaaggaccttcttttttactcgagagagcatgcactttgcatggatgttggtttttgctactacactgatgg

SEQ ID NO: 8169 - DNA, 462 bp, Gossypium hirsutum
  unsure (1)..(462): unsure at all n locations
  Clone ID: uC-gsronu33B145a10b1
acttatgcaaagaattgctatagcaagagcaattatgaaggctcttcgaatccttgttgtggatgaagcaacaagtgcactagactggaatctgaacgagtggtgcaagaagcaatgaccaagcctccattggccgaaccaccatagtaatcgcccaccgcctgtctaccatccgcaacgctgagcttatagcagttttccaaaatggccaggttatagaaattggatcacatgatgagctgatagaaaatcaaaatggtcactacacttcattagtccaccttcaacaaacagagaaagaaaagaaccctgaagaagctaactcaactntacctacttgtgcttcatcttcaatcacaaatatggatatcaacaacacaagtagtagaagactttcattggttagtggatcaagttctgccgattctttntctcaaaaccgtgctccactggcttgcattt

SEQ ID NO: 8170 - DNA, 520 bp, Gossypium hirsutum
  Clone ID: uC-gsronu33B145b01b1
cccacttgtttcgcccacgcgtccgcccacgcgtccggggtctcctatactcaacttcttccacttaaaagcaagttagctagctagggtttgtgagccagagagatgggttcaaaaagacggcatcactagccctcttctttgcactcaacatcctcttcttttccctggtgagtgcttgtggttcctgcccttcccccaaccccaaacctaaacctaaaccaaagccaaaccccactccctccccatcttcttctggcaagtgccctagagatgctcttaaactcggtgtatgtgctgatttgctcggtggcttgctcaacgtcaccattggtacgcctcctgttcaaccctgctgctctctcatccaaggtcttgctgatcttgaagctgccgtttgcctttgcacggcaatcaaagctaatattttgggcatcaaccttaatgtcccactttccctcagcttgcttcttaatgtctgctcaagaaagtaccctctggcttcaatgtcgctaaatca

SEQ ID NO: 8171 - DNA, 481 bp, Gossypium hirsutum
  Clone ID: uC-gsronu33B145b05b1
cccacttgttcggaaagatgttatgtcaaagaatgtgtctatttacaagtctcaggcttctgccttggaacagcatgcagctcctaactcaaggttttggttgttgctaaccctgccacaccaatgcattgatcctgaaggaatttgcaccttcaatccctgcaaagaacattacctgtttgacaaggttggatcataacagggcactaggtcaaatctcagagaaactaaatgtccaagtttctgatgttaagaatgtgattatttggggtaatcattcatcaactcaatatcctgatgtcaatcacgcaactgttatgactccatctggagaaaagccggttcgcgagcttgttaaggatgatgcatggttgaatggagaattcataaccactgtccaacaacgtggtgctgcaatcatcaaagctaggaaactctcaagtgcactatctgctgctagtgctgcttgtgatcacattcg

SEQ ID NO: 8172 - DNA, 340 bp, Gossypium hirsutum
  Clone ID: uC-gsronu33B145b07b1
ctgatagcaacccttatgtaaccagcttgttattatttcaattaaataacatgatatctaaaacctcctgtggtcaaaaaaaaaaaaaaaaaaaaaaaaaaaaaaaaaaaaaaaaaaaaaaaaaaaaaaaaaaaaaagaaaaaaaaaaaaaaaaaaaaaaaaacatggagagaaaaaaaaaaaaaaagaaaaaaaaaaaagggggggccttttaaaagaacaaaatttaacaaccctgtgaatacaactaaaaatttttttaatagggaaccaaaaaaaaaaaaaacgggcggggactaaaaaacgggagaatgggaaaaaccttgcgttaaccaaatta

SEQ ID NO: 8173 - DNA, 408 bp, Gossypium hirsutum
  Clone ID: uC-gsronu33B145b09b1
cccccctttatgctactcctcccagaagatgaaacaaagatgaacccttatacaccccctttttgtattcacaccccaagctcccagcttaccacccccctccttccaatcttattatggttccctataccaaagcaaaaaaaaaaaaaaaaggaggaagcttacccatttttaccaaaaaagcctatacgaggtccggctgccgcttacagtggcacccacagcggaccgccgaccggaccatggccgaccttgtggccaaaaatcatccaccctctccctctctctccttttttgctattatcatatttcttaatatcacattatatatatcctcccacaatatcacgaatattttaaaatccatattacgcatatatatatcctataccattcaatccatacatc

SEQ ID NO: 8174 - DNA, 101 bp, Gossypium hirsutum
  Clone ID: uC-gsronu33B145c01b1
cggccggaatttccgaggtcacctactcgccccaattattaccccacaaaaccagccaaaaaaaaaggaggaatataaaaacaaaaaacggggaacacccc

SEQ ID NO: 8175 - DNA, 447 bp, Gossypium hirsutum
  unsure (1)..(447): unsure at all n locations
  Clone ID: uC-gsronu33B145c09b1
gggtaactggctaggcagatgaccctgttgatgggtctctgctattatttagggaactgcataaaggatgtggtttcagctcctagccaaattgccctcctgttagaaggataacgctaccaaagatgaagaagaaaatgctttggaatatgggttgccttcttctcatactctgaatacagtgtgcttatcaggattccttgtatgctatgtgctatcctacacacagtgtgaagatgcttttgtgaaacttggtgcagtcacccttgcttgcttgcttgtgggtttcattggctctggaaggatataccttggcatgcacagcttgattgatataattggtggtcttgtcttcgggtttatgattcttgcaatctggcttacagtccatgaatactgtgacgcctttattgtctctggacanaatgttacatcatttatgggctg

SEQ ID NO: 8176 - DNA, 265 bp, Gossypium hirsutum
  unsure (1)..(265): unsure at all n locations
  Clone ID: uC-gsronu33B145d02b1
cgggactgcttaggtgtggtaagagttgcaggttaagatggataaactacgggaggcctgatcttaagagaggaaattcagtgaagctgaggatgaacttatcattaactccacagtttacttggaaacanatggtctntaatagctgcgagattaccgggaagaactgacaacgagatcagaactactgaacacgcacataaaaggaagcttataacagaagaatcgatccacaaatcatgggccacttaattaaaccaacaac

SEQ ID NO: 8177 - DNA, 393 bp, Gossypium hirsutum
  unsure (1)..(393): unsure at all n locations
  Clone ID: uC-gsronu33B145d04b1
ctcgttcttttgatgttagaatatgatcggctttatggaggctcgttcaaaccagctaggatgcggcttttcgtgtttccagcgaccggtccgtgaattacgggagcgaaggggccaattggaccgtgagcggttcgtggaggctttaaattccggtacgactccgggaggcgagaaaaccgctgcgatcccgcaagcaatgtggatttcttgtttggacttgaaaaggggatggctccacctccgctggttaaaatccgtgatcccgtggcggaaccggtgatccaaccaccgncaccttcggtaccggaagtcgttgggacggatcatgctttgagtccaggtgaaattcaaagacagatacangaattgcagaggctttaaattcgggat

SEQ ID NO: 8178 - DNA, 139 bp, Gossypium hirsutum
  unsure (1)..(139): unsure at all n locations
  Clone ID: uC-gsronu33B145d09b1
taaataagtccctcgagtgtgtcttcttgcctatgtgggcgatgattgactatgtctgtggttttatacaatgatggaatgaccagtcaatggcctttgtctgnttnaaaaaaaacacacaataaaaatatataaaaat

SEQ ID NO: 8179 - DNA, 473 bp, Gossypium hirsutum
  unsure (1)..(473): unsure at all n locations
  Clone ID: uC-gsronu33B145d11b1
gcttattgattgagaggtactactctcgcatgaccctggatttccacaccaacaagaagatcatcgaagaagtggctatcatccctccaagcgtctccgcaacaagatcgccggctttccacccatctcatgaagcggatccagaagggtcccgttcgtggcatctctttgaagctccaagaagaagagcgtgagcgtcgcatggatttcgttcccgacgaatccgccatcaaggttgatcaaatcgaagtcgataaggaaactctcgatatgctttcggttctcgggatggctgatattcccggccttgttaaggtcgatccggttgctgttgcggttccccaaatcgggttcggtcgcggtggtggacccggaaggagattctaagtggtgggtatccatggatttgatgggttcttaaatcttaagtttgctatgcttatttttggtagttnttttctctataattttat

SEQ ID NO: 8180 - DNA, 524 bp, Gossypium hirsutum
  unsure (1)..(524): unsure at all n locations
  Clone ID: uC-gsronu33B145e02b1
ccgattttttcgccgttgatatacatccggcagcaaagggtcgggtaagggatcttgttagatcatgccaccggtgtggtgatcggagaaccgcggttgttggcaacaatgtgtcaatttgcatcacgttaccctcggtgggaccgggaaggcatgtggagatcggcatccgaagattggtgatggagttttaattggagccggtgcaaccatattagggaatgtgaagattggggaaggagcaaagatcggggcagggtcagtagtgctgatcgatgtgccacctcggaccacggcttgaggaaaccctgcaaggctcgtcggagggaaggagaaaccgtcaaggcatgaggaatgccccggagagtccatggatcacacttcattcatctctgaatggtcagattatatcatttgattcaagtttctttgcttattagattctctagtctaaaangctgtctgttttgcatgctatatggtngtgaagcctgataaaaattgaagctcttctatttttactt

SEQ ID NO: 8181 - DNA, 495 bp, Gossypium hirsutum
  Clone ID: uC-gsronu33B145e08b1
ttgttttggggcaagatagatagcgtagatcaatccatatgcgggaatatatcccgaaagacaccaataaataggcaattaaacaactccatgtccacatacaagaaagcaataaaagcatcaagaaactgaaacatagacacacaaaagggtaatagggggttttagtatataaaggaacacacaagacgatgatatccatatgctctatcaagcaacatgtaagaaaaggaatgtttcaagggctagctttagaaggtggtggagagaagaatgggatagatgggatcatagctggaattgaaggcatgttccgcaatggcggtattgtaataggcaaagttggaagggtagtgggaaacggcatgctaggaaatggcaaacatggctgcgttgtgggcaatgtggggatcgttggctgggcagattgggcagctgaagaggtgacgagccgctaggccaacgttgatgcttgaaaatgacaatgccatgaag

SEQ ID NO: 8182 - DNA, 518 bp, Gossypium hirsutum
  Clone ID: uC-gsronu33B145e09b1
ctgttgcgtgggcggacgcgtgggtttgaacccactcttcctttccattttcctctctttttctcttcatttccttcatctctcaaaccattaaaaaaaaaaaacttttcaaacccattgatataaacctaaaaaagcttagcttaatgggtcttgatgatgcatgtaatacgggacttgttctagggttaggcttctcatcgacgccggaaactccatccaaggccgacaaccaaaagcccaagaagtcaacagccaaggtggcgccggtcacaagttttgaaccattccttacgctgggtctttccggtgatagctacggagttactgttgccaaaaaggttgatgtcaacaacaaaggtggtggttatcttcatcatcgccatgaagactctccccccaccgctgccgccggtgatttgtaccgtccaggttctccccctagtgcttgttcatcattttctagtggcagagtgaagagggagagagaccatagctgcgaagaagtagaggtagag

SEQ ID NO: 8183 - DNA, 534 bp, Gossypium hirsutum
  unsure (1)..(534): unsure at all n locations
  Clone ID: uC-gsronu33B145e12b1
gttctttatcatgttcaacaatgcaggcattcctgggggcaatgttgtaagagtgacacatgccggtactgaggacttcaagagaggttcgatgtcaatgtattgggtggtttctgggtgccaagtatgctgccagggtcatggttccggctaagaaaggttgcatactcttcacagcaagtcttgcttcaaaaatctccttcggtctcccccatgcatacaaggaatcaaagcatgccatagcagggttgacgaagagcttgagcgtggagttaggtgagcatggaattagagttaactgcatttcgcctaatggaattgtgaccccaatgttacaaaaagcaattgggaatgtcgataagaagaaaggagaggagatggttgcggtttcagccgtgttgaaaggcaccgtattggagcctgaagattttgcgcatgcagcactctatttggcaagtgatgaggctaaatntatcagtggtgttaattaccagtcgatggagcgtatagtgttaacaatcaatcatggaagat

SEQ ID NO: 8184 - DNA, 389 bp, Gossypium hirsutum
  unsure (1)..(389): unsure at all n locations
  Clone ID: uC-gsronu33B145f01b1
cccacttgttcgcccacgcgtccgcgatatcttcactgggaagattttggaagatattgggccctcctcccataactgtgatgttccgctgtcaatcgtactgactaccaattgattgcatttctgaggatggatttgtgagcttgctgactgatagtggtgatactaaggacgatctcaggctcccaactgatgagaacttgttgaaacagatcaaggatgggtttggtgagggaaaagacctggtggtgtctgctatgtcggccatgggggaggagcagatctgtgctctcaaggacattggtccgaaataggttgaggtttggtgattctaagtatgttattacaaatcttaaatggaattatntttataagtggctgttaatatc

SEQ ID NO: 8185 - DNA, 475 bp, Gossypium hirsutum
  unsure (1)..(475): unsure at all n locations
  Clone ID: uC-gsronu33B145f03b1
gccgtttttgagatccgacactccacatcgcagcaatgggtgaggaagtaaaggctttggttcctgagtcactgttgaagaagaacaagggaatgaagaatgggagcttgccaaaaacaggagctcgaagccgccaagaagaagaatgtcgagaaccggaagttgattttcaacagggctaagcaatatgcaaaggagtacgaggctcaggaaaaagagttgattcaattgaagcgggaggcaaagttgaaaggaggattctatgttgatccagaagctaagcttttgttcattgttagaatccgcggtatcaatgccatgcacccaaggaccagaaagatcttgcagctcctacgtttgagacagattntcaatggtgtttttcttaaagtgaacaaggcaacaatgaacatgcttcaccttgttgaaccttatgtgacttatggatacccgaatctcaagagtgttagggaac

SEQ ID NO: 8186 - DNA, 480 bp, Gossypium hirsutum
  unsure (1)..(480): unsure at all n locations
  Clone ID: uC-gsronu33B145f08b1
ctttgtatgaaaatgttggtgctgaagattactttgggaggttctaatataaggccggcagcggtggtttcactccggaccgggtgcagtgtattgcaaatgtgagatgccatataacccggatgaaccttatggtgcaatgcgaaggatgcaaggattggtttcatccatcctgcatggagatgaccatcgaagaagcaaaaggattggatcactttttatgttctgattgtacttcagaggatgatgccaaaagatctatgaatacgttcccagtatcagcatcccttgagccaaaggtggaaccgaagcgtagaaagagataaccccatcatggtaatgcggaatgaggaggtaccgattttctagcacattagctcagatattgttcttgcttgtgctgtggaatngtacagtgcagagaagatactctgcttgcacaccaaggaaaaaaaaaggggaggctatctttcataattt

SEQ ID NO: 8187 - DNA, 583 bp, Gossypium hirsutum
  unsure (1)..(583): unsure at all n locations
  Clone ID: uC-gsronu33B145f11b1
ccttctcgtccgggatgcgtttgggttgatgaaagaaatggttgagctcccagtggagacgaaacagaagaataatagtcccatgcctaccatggttgggttggaccatgcaagcagtttctgtgttgtatgaaggctttggagttggagatgcctccaactatgactctgttaaaagttttgctcaacttatgtggcctaatggtcacccacacttttctgacactattcataccctagggacgcaaatggaggagttgaacaagttaatttggttaatgttaattgatagttatggattaggggatgactcattgaagatgaactacacaacgttggtgcggatgatgaaatatatggcccctccaccaggagagtatgaaagaggactctntgctcatactgataaaccagtaagcacactcatttgtgaggatcaaatttcaggactggaaattgaggtcaatgatggtcaatggatcaagctaactaaattatctccttcttcctttggatttgggntggagatcccctcaaggcttgcagcatgggagantgaatcagtgaatacagagtgatgatg

SEQ ID NO: 8188 - DNA, 511 bp, Gossypium hirsutum
  Clone ID: uC-gsronu33B145g05b1
gtcgatagctgcgtcaaactgtatggacttccatagggcctcttctctgtgttcggatctaccagtcgtggtggtaatttttctttctcgacaacttcaagctctcctaagtaactctgtctttaatagttagatcccttcctgatgaactcttcctttcatggagcatctgatttctcgagctccagataacccataaggtgcaacaaaaaatacggatctgctcctttgttcctctactgaatacccaagacattgtctgaacacatgaaagctgtcttcttcttcagaacaaccacgtggacaccttgcagtagtggtcactctcttttgtctgaggttagcaagtgaagggatgtagttccaagatattcgccatacgagaattaggatttttgttggtaactgtaaactccataatttcctgtagaaatctttggtatcggtctgtaataaataattactaggatccaagctagcttcttgtaatagtttgtaggcacttctgact

SEQ ID NO: 8189 - DNA, 573 bp, Gossypium hirsutum
  unsure (1)..(573): unsure at all n locations
  Clone ID: uC-gsronu33B145g10b1
ctctcataatctcaaagccggaggaggggttcgatcccacacctcttcgggaaaaaaaatcatcttcaaaaacgaaaaatttataaaattttctttctaaaattctaaaaaaaagaaagaaaaaggaatcaatggcgtcgtccgatagcctgagcgacaagaacgcggttttcagaaagctgaaagcaaaatcagaaaacaagatgtgtttcgattgtaatgcgaaaaatccaacatgggcgtcggtcacgtatgggatctttctctgcatcgattgctcagccgttcaccggagcctcggtgtgcacatcagctttgttaggtctacaaatttagactcttggtctcctgaacaattgaaaatgatgatctatggtggaaacaaccgtgcacaagttttctntaagcaacatggttggactgatggaggcaaaattgaagccaaatatacttcaagagctgctgatttatataggcaaatgctatcgaaagaggtggctacaagtatggctgaagatgctgnttngccttcatccnncgttgctctcaatttcagcagcaactaatggattt

SEQ ID NO: 8190 - DNA, 303 bp, Gossypium hirsutum
  Clone ID: uC-gsronu33B145h01b1
gaaggttcttttatagccaaagtcaacgaaccgctcagaaacatggttggaaacttaggatgcgtcgtcgtatccgttgatggcaacgaagaagcatggacgccttacgatgggcgctcataatattaagctccgaccatcttctccggactctactcaaccgcccggtcacttcctcatcctctacagccaacctccaccgtccatcgctgctggcctcaatcccggcgccatccccttcggcgggcccacccacctagaagttcctgcattcacggcagctatcgaggcgcatcagaagag

SEQ ID NO: 8191 - DNA, 449 bp, Gossypium hirsutum
  unsure (1)..(449): unsure at all n locations
  Clone ID: uC-gsronu33B145h02b1
aaacaaatcactcccatattaaacattgttggtgaaacaaggacgtcttcaactctgacaggtgggcttgaggcagatgtagagattaagcttctcctgagcagttccatgaaatgtttcccacaaaccgcaccatgtgcaccatacttgctatgacaagattcaaggatgcgatttacatgaaagtgaatgggggaaagtcggtaccattgtccattggagttatgtgcatgatggaaaggctaaaaaggcaaaggaagtagtggaagcagtagaccctgataagaatttggtcactatcagagtgatcgaaggagatctaatggaagagtataagagctttgtaatcacgattcaagtttcgcccaagagcgatggtagtggcagcgtagtgcactggactctggaatacgagaagctgcacngtgggattgagcatcctgagactc

SEQ ID NO: 8192 - DNA, 146 bp, Gossypium hirsutum
  unsure (1)..(146): unsure at all n locations
  Clone ID: uC-gsronu33B145h03b1
ccgccccaccattttttcctcgtccttctcgncccccattattatccccccgcgcgccatgaacaccacaggagggccttttcaaacccctctggtggttacccacccccctcacaaaatccctccgctctaaacatccccaaaat

SEQ ID NO: 8193 - DNA, 463 bp, Gossypium hirsutum
  unsure (1)..(463): unsure at all n locations
  Clone ID: uC-gsronu33B145h05b1
cccacttgttcgcccacgcgtccgtttcatttcacatgggacatgttctaatctctgccctgggcttcccaggtagagttcagggtttttatttttcttgtttttgcccatctgggtattcataaattttctatcttggcttggtttttaagcacctattggtcttatattgaattttcaattgtagacttccctataaattgattggttttagattaggttatctgaatttttttttcagatttttaatcgatggttttagaagtagattattgacttttgctcacccagtttttcaatttccccttaacttgttcctttctgcagattcatgaataatcattcttttctcttacatctagatgctttcaaggctttttgaagttctgggtttttgaaggttttgctaatttatatattgctctgngaatctgtcatcggaattcttttgtataaacataca

SEQ ID NO: 8194 - DNA, 382 bp, Gossypium hirsutum
  unsure (1)..(382): unsure at all n locations
  Clone ID: uC-gsronu33B145h06b1
atcatttatatgccttggacgacgacaacgaatggggggggttttcgtgcgatgcctacggggaggagtgtatcgatatatacaaatcactcaaactcacaccatcaaaatctcgcttctcaagtttcgaatttgaatctaggaagctcattcggttataatgacccattataagaccaggatcagcttccatcgtaagttattcgatatatattttccgtattagtgttacgaacaaatgtttatgcttcgttttaaaacaagctaagcggctttcgccgcttcaaagtgttgtgttatgaccgaatcggagccgtagtccgattgatggaactatggaatgacattgagaggttcgngaaacaatttaaaattcataata

SEQ ID NO: 8195 - DNA, 586 bp, Gossypium hirsutum
  Clone ID: uC-gsronu33B145h12b1
ggctcttccaccgagaaaaaacaagcagctgctatgttgccggtagttcaaaaacagcatcagcttttggtgactttgcttctttgcatgctgctgctatggaggccctccctatatcttggataagcttttcaatcaatatgtggctatcatactttctgtgacttttgttctagcttttggtgaggttattccacaagcaatatgcactagatatggacttgctgtaggtgcaaaccttgcaggtcttgtgtggattttaatgattatttgctatccaatagcttatcccattggaaaggttctggattgggtactggggcataatgaagcactatttaggcgcgctcaactaaaagcccttgtctccatccatagccaggaggctggaaaaggaggtgagctcacacatgatgaaacaaccattattagtggagcactagatttgactgaaaagactgctgaggaggctatgacacctatagaatcaactttctctttagatgtcaattcaaagctggactgggaaggcatgggtaaaatcctcgctcgtgtcatagccgagtccctgctactcaggaatccc

SEQ ID NO: 8196 - DNA, 371 bp, Gossypium hirsutum
  Clone ID: uC-gsronu33B146a08b1
tatagcgaaatacatggaagaggggggcttttctttacttctttgggtgttcacaaaaatctcaggtcctcagcttaaaaactcagctgccagatgcaagctgataaagatcaaggcctcccacaagctctcctaagccggcaaaaaagagacagcccccgctacagcaccctacattgataagaaagctgcgcgcccccatcagcccttgaaaactctggggacccagtaccgcacatagacagtcgtactcataaccgcattaagtcccgaaggtgcacagccttctgacaatataacaccgtctgctagggaaggcgccaaaatggatccttttcctacataaaaggattggctctcatggctgggca

SEQ ID NO: 8197 - DNA, 77 bp, Gossypium hirsutum
  Clone ID: uC-gsronu33B146a10b1
tattttaaaaaaaaaaaaaaaaaaaaaaaaaaggaggggttaaataaaaaaaagggtggggaaaaaaaaacacacga

SEQ ID NO: 8198 - DNA, 165 bp, Gossypium hirsutum
  Clone ID: uC-gsronu33B146a11b1
tcattcgtccgatgaaaataagaaacaatatgatgagaatttaaaataaaatatcgttgggactaggaaacagtagaaaacgaaaacaaggaatcgatctcaacctttctacttgtatattgtttttttgatcgcttaacatgagttccatacttgttttgatga

SEQ ID NO: 8199 - DNA, 530 bp, Gossypium hirsutum
  unsure (1)..(530): unsure at all n locations
  Clone ID: uC-gsronu33B146b01b1
gcagttgttttgacaactgctcatgcagcaggaacggtaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggtgaaaataatgtataagccatttggttgggagcaaattgtccttttctccaaggatttttgctgctcattcatggtgacttgggttatggctttatctgctggtggtaaaatcttataaaaatatatatcggntgctgctctggcttgtatcaaatcattgtctgaaaatatatgggcatcttta

SEQ ID NO: 8200 - DNA, 538 bp, Gossypium hirsutum
  Clone ID: uC-gsronu33B146b03b1
tcctcagtccgcccacgtgacccaacctctggtgtcttgccccacatgcacacctcactataatgttgctcccaaacccccccccaaaaaaaacaacaaaaaaaaaaaccccccaccaatcaacccccccttctccactcccccactcccctcaaacccccacacacccaccgggccgccccccccaaaaaccccccccctacctccccaccctccccccaccacaccccccctacagggccccccacccccccctcattgcccccccccccccccacccccaccccgaaaacccctgccttccccccccccccctccccctccatcccctccccccttccccccctcccttcatacaaaacagcccccccccctccccccttcccccatttgcccccccccatttccccccatcccccccccccccaacgccccccccacccccccccccttttaccttcccccccctctctcccctatcactcccccccccccaccccccctcccctccctatcctccccttccccccctcccccc

SEQ ID NO: 8201 - DNA, 430 bp, Gossypium hirsutum
  Clone ID: uC-gsronu33B146b06b1
cttcttttttactccacctgctaaaatgcaccaattgccggtgcttctcagcctcatcgcagtgtctgtactgctgatggtaactccagtcattggataccgtccatggcctcacttaaaacccaacagctccgatttaacgtttggaagctccaagaaattcgagggctcatcagagttcgtccaaatgagataccatatgggaccagttctcaccgccaacatcaccgtacacatagtttggtacggccgatggcaaaaatctcagaagaagatcatccgtgagttcatcaactcaatctccgccgttgatgccaagcgcccttctgttgccggctggtggaagaccgtacaactttatacggaccaaacgggcgccaacatttcccatactgtgcatttaggggaagaggagaacgaccgattttac

SEQ ID NO: 8202 - DNA, 528 bp, Gossypium hirsutum
  Clone ID: uC-gsronu33B146b08b1
ccctacaccacgaaaaagttggaaatttgggagagccaaatcctaaacccatcgccaagggttccttcggttgttgacgtaaagcaagagggtactcaaaatagcaacatattcggtcatggcaatgatgaatttcaagcatcagcagctgcttggccccaaatcatgccagtttcccctcctagaccttgtattactagcttaagttgtaacatgatagatttgtcttcctacaaagcggcagaccatgaaacatccgtttattaacctgttttagatcaatcttctcaaggaatatccatatatgactaaatccgtataagaaagtatttaattataacatctactcattaaatcataactattcattaagtgaataattttaatcctttattataattacactttttttaacccccttttttttcttacattataaatacctatctcctgttttatttcaacttctaattactatcatatttatttattataatcattttcaatttaatataactcttataatta

SEQ ID NO: 8203 - DNA, 425 bp, Gossypium hirsutum
  Clone ID: uC-gsronu33B146c03b1
tgctggtgcgcctgcgggggccgccccggcattcctgggtgggacctattcgtccggctttttttgctaccaaactctggcacaggcggatgcggggctttaccaccaacttcggccggtcacaaaaatagccacagaccacaccccacaggcccgctgccactgccctgttggcaaccacatcacactcacgttcgatcatcgcgtaggcgcctggtgtggtgccaccactcgcttgctgtacggcactttcacttgcctcatacaatgccctagaggcaacaccagtggggtccacttcaacatttacctttcctcactcgaaggcgacatatcgcaagacgagatcggcttctaattccttggcaaagacaaaactatggtccaaaccaattactacgctacaagaactgggaacagagagc

SEQ ID NO: 8204 - DNA, 431 bp, Gossypium hirsutum
  Clone ID: uC-gsronu33B146c08b1
tttgtatcttgcatgaacttctacaaggattcgggggctcatgctgaagacattgtgagggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgttctgtctgctagagaaggcatcgattcgttgggaggcccttacattcctctcaaaactggaagaagagactgtagaaggagcagagcacatgttgtggaggagtatcttccggaccacaatgagac

SEQ ID NO: 8205 - DNA, 349 bp, Gossypium hirsutum
  Clone ID: uC-gsronu33B146c09b1
tattgcgacgctgttatgcaacaagaacggcagcatgggttctcatgagcaggtactcctcaccactactaagcaacggctttgaccgcaccaaggggaacaaatgagtgtgatccaataaagcgacagagaaagagagcagtgagaggtcgcctagtctccgcggttcaagagaagaaagcgaaaacaggaatgatgtagacaagccgtagggtcaataaaaaacaaggggttcatcgttaccacatttggattattcagagggtctcggatgtcttgctgctttagtatacaaatgttgtctagatcttatgtgtttgtcttttacgaccttttttgcaaatgcagg

SEQ ID NO: 8206 - DNA, 138 bp, Gossypium hirsutum
  Clone ID: uC-gsronu33B146c10b1
ttatttctgagagaacaaagaaagaaaaaatgggtctgctagacaaaatgtgggacgatgtaacagctgggcctccacctgaacgtggtctcgggaggcttaggaagatcaccacccaggctttgtccatgaccgatg

SEQ ID NO: 8207 - DNA, 328 bp, Gossypium hirsutum
  Clone ID: uC-gsronu33B146c11b1
tctttattgaacagcatgcatcagataatgtggacaagatattggtcggatacagggcagacatggatgaaagcaaaagggccgtgccaacctcaaagggacaagctcttgcggacgagtatggaatcaaatttttcgaaacaagtgcaaagactaacctaaatgtggaggaagttttcttttcaatagcaagggacataaagcaaatactcgtcgatactgactcaaaggctgagccttgaacaattaagatcaataaacctgaccaggcagctggagaggggccaaagctgcacatagaccggctggctcgtgtttatcctagggg

SEQ ID NO: 8208 - DNA, 387 bp, Gossypium hirsutum
  Clone ID: uC-gsronu33B146d01b1
tttattatcgacgaaaaaaaaatccatcaccgaggtaggttccccaaattctgttgggagcgccggcgaaattttgatctgaaaatctaaaaatgtcgtccacattcagcggcgatgaaactgctcctttttttggcttcctcggtgccgctgctgccctcgttttctcctgtatgggagctgcgtatgggacggctaaaagcggtgttggtgtggcgtccatgggagtgatgaggcccgagctggtgatgaaatcgatcgttcccgttgttatggctggcgttctgggtattgatgggttgattattgcggctattatcagtactgggaataacccaaaggcttaatcttattaccttttcgatggctatgctcatctttcctctg

SEQ ID NO: 8209 - DNA, 416 bp, Gossypium hirsutum
  Clone ID: uC-gsronu33B146d09b1
tttctatctgcttagcttaaaaaatcttgaatgcggactctcctacttccctcgttatcgtcaatggcttcggacaagaagattaagatcgggattaacggatttggaagaatcggacgtttggttgccagagttgctcttcagaggaacgatgttgaactcgtcgccgttaacgatcccttcatttccaccgattatatgacatacatgttcaaatacgacagcgttcacggtcaatggaagcaccatgatcttaaggtcaaagactctaaaaccctcctcttcggcgaaaaacccgtcactgttttcggaatcaggaaccctgaggagattccatgggctgaagccggggctgagttcgttggtgagtcaactggagtgttcactgacaaagacagggctgctgctcacctgag

SEQ ID NO: 8210 - DNA, 277 bp, Gossypium hirsutum
  Clone ID: uC-gsronu33B146d11b1
tcttttagtccggagggcgaggctgtattatctaagagataagcttccaaggttgtcgactttcaaatgaaagacactgccgatgccatcatcgctcgggttcttcttccccaaaaattccaaggccagtttcttagttgcatacatgttgtaagagctttaatttctatgatccgcccccgcccccttttttccccttttgttgtaaaatttgctgttttggtttgggaaaaaaacaactgaattcaaatattcaatgctttgcttaattcatttc

SEQ ID NO: 8211 - DNA, 511 bp, Gossypium hirsutum
  Clone ID: uC-gsronu33B146e01b1
ccctttctttcgggaaattagtgcagttcctcaatataaaggggaagtatatgatgatgaagaaaccgtagatttagatgatgttgaagacgacagtgacgacgaaaagaacgacaaaaatggtagttggttaactacaactccttcgacaaaattgggatcatacgaatactttgagaaagttttaagaaaaccaaagcacattcttgcccctatggtcgatcaaagtgaattagcatttaggcttctatgtagaaagtacaacgtcaatttatgctatactcctatggttcacagtcgcctattggtagaacaaagaaaatacagaaagaaatacctcgtaacatgccctgaagaccgccctctcgtaactcagctttgtggaaacgacccagcaattgttttacaagctgcactcattgctcaagaaagaaccgacgctattgacatgaactttggatgtccacaacgtatcgcacgacgtggatactacggcgcctttcttatggac

SEQ ID NO: 8212 - DNA, 119 bp, Gossypium hirsutum
  Clone ID: uC-gsronu33B146e02b1
ttcgtccgccctttcttctgcccacgcgtccgatatataatatgggggggattttattgaagcatagggccaaaactaacaaaaaaatacttatacatgataaaacgtgtgtccgttct

SEQ ID NO: 8213 - DNA, 457 bp, Gossypium hirsutum
  Clone ID: uC-gsronu33B146e05b1
gtggtctgttaatgtattgcctcttagatctatccctgaaggagctgtcgtttgcaacgtcgagcatcatgtcggtgatcgtggggttttcgctagggcttctggtgattacgctattgttattagtcacaaccctgataacgacaccaccaggatcaagcttccatctggttcgaagaagattgttccaagtggttgtcgtgccatgattgggcaggttgctggaggtggtaggactgagaaacctctgcttaaggctggtaatgctttccacaagtatagagtgaagaggaactgctggcctaaggttcgtggtgtggctatgaacccagttgagcatccccacggaggtggtaaccatcaacacattggtcatgctagtacagttagacgtgatgctccacctggacaaaaggttggtcttattgctgcaggaggactggtaggctcagaggac

SEQ ID NO: 8214 - DNA, 502 bp, Gossypium hirsutum
  unsure (1)..(502): unsure at all n locations
  Clone ID: uC-gsronu33B146e10b1
ttctttttctccgctcataccccaaatccccatacggcttctgttcaacagcaaagatggcaactgtgcgggttacctcctctagtatcgttcaagcttcaatcccgaaccgattcacgagtgccattgtcaaggccccgacttctcttggatcttttaagaacatctccaaatcttttggcttgaaatgttcctccaatcacaaaacattaatggcagcttataagattaagcttgtaggaccgaatggtgaggtgagcgagtttcaagcccctgacgatcaatacattttagatgcagccgaggaagcaggagttgaactgccatactcttgccgagctggagcttgctccacatgtgccgggaagattgtgtcgggttcagttgatcaatcggacggatcctttcttgatgaaaaacaaattgccgatggttacgtgctgacttgcgtntcgtacccgacctcagattgtgagatccacactcacaaggaagctgatct

SEQ ID NO: 8215 - DNA, 511 bp, Gossypium hirsutum
  Clone ID: uC-gsronu33B146e12b1
aaatttattacctctaaaagaaaaccctagccgtcggtcacataccaaaaatgactggagaaccagtgaaccccaaagcataccctttagcagatgctcaattaacgaccacgattttggatctcgttcaacaagctgctaactacaagcagctcaaaaagggagctaatgaagctactaagacacttaacagaggtatatcggagtttgttgtgatggctgccgatactgagcctcttgagattcttttgcatcttcctttgcttgctgaagataagaatgtcccatatgtatttgttccttcaaagcaagcacttggccgagcatgcggtgtcacaagacctgtaatcgcatgctctgtcacatcaaatgaaggaagccagttgaaatcgcaaatacaacagctcaaggatgccattgagaagctcctaatctaaagatattacgtaactcatattcggtgtgatgggcctcttggaatggggtggtcgctcctttagaggccttgact

SEQ ID NO: 8216 - DNA, 357 bp, Gossypium hirsutum
  Clone ID: uC-gsronu33B146f02b1
tttctcgtccgcccactcttccgcccacgcgtccgatttaaaaaaaaggaggaattttttaaaaaatttttggggggtaccaaacaacaaaaaaaaaaaaacataaaaaacttacgcttagctaatagctttggcttcttgtttcatgcactttttaccagggggggccccctttgggggacccaagttcccttccccgtgctggggccttattggtttttttttggggccccctaaacatattttcctgccggtgttttcccacccttgggccggggaaacccttgcctttccccaatttaagcccctgggagcccatcccctttcgcccagtggtttgtttaagaaaagggcccg

SEQ ID NO: 8217 - DNA, 523 bp, Gossypium hirsutum
  Clone ID: uC-gsronu33B146f03b1
gttggtcgtagggaacctcttataaggaagatcatgtggaggaacttggtgatacaggccatataccaagtgactgttctactcgtcctcaattttgatggcaagaagatattgaatctggagcatgaaagcaaggagcatgctaacagagtaaagaatacgctgatattcaatgcatttgtcctttctcaaatctttaatgagttcaatgctcggaagccagatgaagtgaacattttccgtggacttagcaaaaactatctgttcatcggaatagtggcgataaccataatacttcaggctattatcgttgagtttcttgggaagtttgctaaaacagagaagcttagctggcagctgtggctggtatcgattggtatcggttttatcagttggccccttgctacccttgggaagttcataccggttccagaaactccagtcagtcgggtctttttaggatgttctacccgcgaagaaatcaaatgttcaggtagtcaaagcatgaggactcaatgctaca

SEQ ID NO: 8218 - DNA, 524 bp, Gossypium hirsutum
  Clone ID: uC-gsronu33B146f09b1
ggaattaacttgctggatctacttcagcgcgtccgttcttttaggaaaataagagcagatactaaatgggaagggtaagtatatgatgatggagaaacacgaaaatttagatgatgttgaagacgacagtgacgactaaaagaacgacaaaaatggtagttggttaactacaactccttcgacaaaattgggatcatacgaatactttgagaaagttttaagaaaaccaaagcacattcttgcccctatggtcgatcaaagtgaattagcatttaggcttctatgtagaaagtacaacgtcaatttatgctatactcctatggttcacagtcgcctattggtagaacaaagaaaatacagaaagaaatacctcgtaacatgccctgaagaccgccctctcgtaactcatctttgtggaaacgacccatcaattgttttacaagctgcactcattgctcaagaaagaaccgacgctattgacatgaactttggatgtccacaacgtatcgcacgacgtggatact

SEQ ID NO: 8219 - DNA, 231 bp, Gossypium hirsutum
  Clone ID: uC-gsronu33B146f10b1
ttcctcgtccgatcgcgagcggccgccctattcaggatcttttttttttttttctatggtctccctttatttgttcttttttttttttggttattctgagtttgtgtcctgtatcagtgtcgtgttgcaaaaatgtattgagaattttgctataatatattaatggcacttgaagtctaaataaaaaaaaaaaaaaaaaaaaaaaaaaaaaaaaaataaaaaaaaagagta

SEQ ID NO: 8220 - DNA, 356 bp, Gossypium hirsutum
  Clone ID: uC-gsronu33B146g01b1
ctcgcccgcctggacgtaccgggccttaattgccggacctgactctacgcgtccgttttataccgtgtcagaacgcacgatcggtgtggacggttgccttccagtttccgttcggtgccaatcttcaggataatgttctggccatggcactccagtatgtacgttgcgtcattccttctgtccagaggattgctatggccatatgtccatgtggatcgagccctactatgggaccaaaaccatcttcaggttgtaacccagcgcttaccctggctcattggatctgccagagctaccgttttcatttgggggaagagatagctgaaatgcccatcacttggtggccactcaacatt

SEQ ID NO: 8221 - DNA, 465 bp, Gossypium hirsutum
  Clone ID: uC-gsronu33B146g03b1
cttagtcatagatataattatgatccatggctaaaaattaatatacaccaaattcttatacccagcttcgcctgggatttaacaataaattataaataaatttattttgtaattatataaaaatttcgttgtttaaatatttatattatatgttaatgaatttataattaaattagactaatcataaaaaattatgtaaaataagagttgcattaaaatacaataaaatgaaggaaaaagaataaacatgataaacacaacgagaaaaagaacatcctggcagtccaaacgcttcgaaacaccttatgggatcgaccctaatggccacaacatccatcctgctatgtgctgggttggcagccgtcatcagcagcacttacacagtcaaaaagccactcaatgactctatattcggagctcaacgggagttcatggtggctctcaagtacgtcacaatcctatgta

SEQ ID NO: 8222 - DNA, 458 bp, Gossypium hirsutum
  unsure (1)..(458): unsure at all n locations
  Clone ID: uC-gsronu33B146g07b1
tgtattttccgtgtcagaacgcacgatcggtgttgacaattgccttccagtttcccttcgataccaatcttcaggataatgttctgaccatggcacgccagtatgtccgtagcgtcatttcttctgtccagaggattgctatggccatatctccatgtggatcgagcccaactataggaccaaagccatctccaggttctcccgaagcgcttacgttggctcattggatctgccagagctacagtttccatttgggggaagagttgttgaaatccgaatcacttggtggcgactcagtattgaagaatctttggcaacatcaggatgcaatattgtgttgttcgttgaagtctgtaccggttttcatcttcgcaaatcaggccggtctagacatgctngagacaactctagtggatctaccagacatcacactggacaaaatattcgatgagtcggga

SEQ ID NO: 8223 - DNA, 495 bp, Gossypium hirsutum
  Clone ID: uC-gsronu33B146g11b1
tgttgttttcatctgaagaggataatccatctgtgatgataccaaaccacctgctagtgcacaccccggactgttcacatttgagttttggaagttttggacctgcaattggttctgccttttctggatcatttgcatcaaggcccttgaagaataatttggatgaagctcctgaatcagctgatatctcttctattgggcactctgagaatagaaatcccgagtattatggggacgaacatctcagaagtaatgcagagggaaatataatgattagaagtactgtcaacactggaaattatgaagctactgaagattctcaaccagcagtactgaaacaggatgcttctgaagctgcccaagggaaccaatatgcatttccttcatctgcatctggttatagctatgagaactctcaacagttaaatcctgcttttactcatcctcagacaagcactcaaatgcagaatctcactccgttctcaagcgtaatgc

SEQ ID NO: 8224 - DNA, 477 bp, Gossypium hirsutum
  Clone ID: uC-gsronu33B146h10b1
gttattggtgaagaaacctctgagacagaatcgggggattcacttaaatgccacattgggcaagaagtgaaccatttacatgaaggtctaaagcatgctttgaaatcagaactggaaaaggcttctcctgccctcgggcgcagtgcaatttacttgaaagagtcccgaattaatggtttaccaaggtatttgactattcaattcgttcgttttttctggaagagggagtcaaatcaaaaggccaagatattgcggaaagttgattatccactggagttggatgtttatgatctatgttcagatgaacttcgcaaacaattggaaggtcctcgtcagatcctgagggatgaggaaggtaaaaagctcggtctgaaagctaatgggaaaagctccagctcaaaagatgatgatgtcaagatgatcgatggagaggggtcatccaatgcaagtggagaatcaactgtgacaacatctcaa

SEQ ID NO: 8225 - DNA, 370 bp, Gossypium hirsutum
  Clone ID: uC-gsronu33B147a01b1
ctcactgctttgaagggtttagatgcaaggttaaaagagatacgttcttaccttgaccttgttatcgatgagaagcttccactgaatcatgaaatactgtaccatttacaggatgtgttcaacttgctgccaaacctaaacgtaaatgacctaatcaaggcttttgcagtaaaaaccaatgatatgatgttggttatatatctgtcatctctcatccgaagtgtcattgcgctccataatttgatcaataacaagatgttaaacaaggaacatgagaaggcttgaagatgctaagccaacaactgtccaggctacaagttgaatccgaacataaagtcctaatcatgtcaaaaacttgagcatagggcgc

SEQ ID NO: 8226 - DNA, 525 bp, Gossypium hirsutum
  unsure (1)..(525): unsure at all n locations
  Clone ID: uC-gsronu33B147a04b1
cccattcgttcgcaggagaggaacatcgatagatagaaggagatggcggtgagaggtagagcagtagaaacgctgccaaagctgatgaggagcccgaggaaggactcggcttcttcaacagtgactcgaactccagccttgccctcccttagacgcgctttctctctctacgatcagattaatctcatcgacaatgttcccgatgaccagcttcgtttccaacgatatacggaaacaggattcactgtgaacggtgtcaactatgaaggcagcttgctttgtgtgggaaatttggttacttcttggggcccccgtaaattttctgaaattactccccaaagcttatccatctttcaaattatacgacctattccagaaattttgattcttggctgtggaaggtacattgaacctgtagatcccgaactcagacgcttcatccgatctactgggcatgaaatggnaagcctagactcgagaaatgctgcatctacttacaacatacntgacgaggaaggtagaatt

SEQ ID NO: 8227 - DNA, 402 bp, Gossypium hirsutum
  unsure (1)..(402): unsure at all n locations
  Clone ID: uC-gsronu33B147a06b1
catctgcttcattggnnncgaaatggtgggacttaaaaaagacttttgggggggaacaccccagaaaaaaagaaaaaaaaaaggaaaaaagaaaaaaaaaaaaaaaaaaggggggcccctccagggggagcaaagataactccccggggcaggccaggcaaaagctcccgtaagggggccccaaaaaaaaaaaaacgggccacccctggccaaccccaggacggggaaaacccgggggaaccccacctaaaccgccggggaaaaaacccccagtccgccagcggggggaaaaccaaaaaggcgcgcaccaagaacccccccaaaaaggggcccaacaggaagggaaaaggggccgcccccggaggggccccataaagggcggcgggaggggggggcaacccc

SEQ ID NO: 8228 - DNA, 504 bp, Gossypium hirsutum
  Clone ID: uC-gsronu33B147a07b1
ttcatattcagattaggaaaatgaagggattgaagcagaagaaggcacacctgatggagatccaagtcaatggtggaacaattgctgacaaggttgattttgcttacaagttctttgagaagcaagtccccattgatgctgttttccagaaggatgaaatgatcgatattattggtgtcacaaagggtaaaggttatgaaggtgttgtcactcgttggggtgtcacacgtctgccccgtaagacccatagaggtctgcgtaaggttgcttgtattggtgcctggcatcctgccagagtctcctttacagttgccagggcaggtcagaatggataccaccaccgtactgagatgaacaagaaggtctacagggttggcaaggttggtgatgagacccactctgccataactgattatgacaggactgagaaagatattaccccaattggtgggttccctcactatgggtttgtgaaaagtgattacctgatgatcaaaggagggt

SEQ ID NO: 8229 - DNA, 359 bp, Gossypium hirsutum
  unsure (1)..(359): unsure at all n locations
  Clone ID: uC-gsronu33B147a11b1
catctgcttcattngnntcgaaagggttgacttaaaaaaacttttttcgggcaacaccccagaaaaaaaaaaaaaaaaaaggaaaaacaaaaaaaaaaaaacaaaaaaggggggcccctccagggggacccaagataacccccccgggcagcccacgccaaagctcccgtaagggggccccaaaaaaaaaacaccgggccacccctgcccaaccccagcacggggaaaacccgggggaaccccccctaaaccgccggggaaaaaaccccccgtcccccaccgggcggaaaaccaaaaaggcccccaccaagcgcccccccaaaaagtggcccaaccggaagggaaaaagggcggccccc

SEQ ID NO: 8230 - DNA, 402 bp, Gossypium hirsutum; identical to SEQ ID NO: 8227
  unsure (1)..(402): unsure at all n locations
  Clone ID: uC-gsronu33B147a12b1

SEQ ID NO: 8231 - DNA, 561 bp, Gossypium hirsutum
  unsure (1)..(561): unsure at all n locations
  Clone ID: uC-gsronu33B147b01b1
gtcgttcattattttcactcttattcgattaaattccagaactcgaagcgaagagacaaagatcgccatggcacctcctgcaaaagcaataactagtcccgtgcctgatgcgtggtatccaaccctagccgtcttcatgctcgccattggtcttgtcctcactgcttccttcttcatctacgaagcaacttcttccaaacgaaatcgcagtcttgcaaaggagctcacaaccgggggagtggcatctgtcttcctgggattcgggtcactgtttttgctactttcagccggcgtttatgtctgattttcatatattttttcaaccattttaaaaatttgctgagcagaatggtgttgaatggaggatcatggcttcgaccttgttacctatagactcttttttttttttgttattaatcagataaagagtgcttctatgagaatattttgatatctcttgggttttcttggtgcatgcccaaatttataggagtcgtagttgcatcacattngttaagtngcacactggntcaaattgcagtaacctcattcacatcgact

SEQ ID NO: 8232 - DNA, 91 bp, Gossypium hirsutum
  Clone ID: uC-gsronu33B147b04b1
gaaagcaggacgcccgcggcgccggcccggacctaacccccgggccgacccacccgacctttgttaccagccccaaggaccacaccgcaca

SEQ ID NO: 8233 - DNA, 518 bp, Gossypium hirsutum
  Clone ID: uC-gsronu33B147b07b1
ttcactcgtccgatcttctccaaatgtgaggatgcatggaattttgttggacacattggggtcgagtccagtaggcaaaggtgttgaattaaaacagatgattgtttcctcttataacgttttatgtcttgctacaaatttattgaagaaggatggttctttctgtatatacataaaaaggcaagttttgccgagaatcagatggtattatggcaaaagagaagggtgaaaagatatatataataggtaatgttgttttggtgtgaaaaataaagctgctaagtgctaagttaaatattggtggtcactgcttgccatttctagccagagaaggagagacgggtgataggagtggtgtagatctattccctgctggtaatggtacatctgcccccactcaaactgaaatccttatccttccccttgcccttccccttgtagtattattatgtaactattcacatttgttccgttcattcactgaaatttaattggatttcatttcaatttctcttttc

SEQ ID NO: 8234 - DNA, 395 bp, Gossypium hirsutum
  Clone ID: uC-gsronu33B147b08b1
ttattaagaaaaaacaaagacaaaaaaaaacggggggggttaaaaaaaaaatttagtcaaacaaccacgaaaaaccaaaaagcacaagaaaaagaccccaatatacccgaggaggtgctgaaaccccgccctgcccccgagatggaacgaccctctactctatacaacgcagacgttcggctttacatgcatgccaacacgcggaacgcggacgacagtgaacctagtcgcccaccactagacacctgggcccgacccaccctcgaggatggcgagcacccctggatcttgcaaccagtcagaggctggcggaccgccagggaacagcgaaaagagcccctccctggccctgggggaggccaaaaaccctatggtgagccacaaacccaactcct

SEQ ID NO: 8235 - DNA, 443 bp, Gossypium hirsutum
  Clone ID: uC-gsronu33B147b09b1
ctcctttttctggctgctaggcaaggcaaaaaggggggctttataaccttttttttgttatcaaccacaagcttccactgaatcatgaaatactgtaccatttacaggatgtgttcaacttgctgcccaacctaaacgtaaatgacctaatcaaggcttttgcagtaaaaaccaatgatatgatgccggttatatatctgtcatctctcatccgaagtgtcattgcgctccataatttgatcaataacaagatgttaaacaaagaacatgagaaggctgaagatgcttagccaacaactgtccaggctacgagttgaatccgaacataaagtcctaatcatgtcaaaaaccttgagcatagggtgcttttaacatccataggatcctctattcttgagattctgtattcttcatagctcaatcaaaagatattcagtcggctt

SEQ ID NO: 8236 - DNA, 560 bp, Gossypium hirsutum
  Clone ID: uC-gsronu33B147c01b1
gaatctcttgccttatccagataaacataatgattcatactcagctacaaaggcgttgggagaggcattggtcgtcaagtcaaatggagttaacgggcttctaacttgttgcatacgtcctagcagtatttttggccctggagatgggttgttggttccatctttggttgcggcagccagagcagggaaatccaagttcataattggtgatggcaacaatgtatatgatttcacttatgtcgagaatgtggctcatgctcatatttgtgctgaacgagctctagcatctggaggagaagtttcagaaaaagctgcagggaaggcatattttataaccaatttggagcctatcaagttttgggagtttgtttctctaatacttgaaggtcttggctatcagaggccaaaaataaagattcctgccattgttgtaatgccaattgcacatattgtggagtggacatatcggctattaggcccatatggtatgaaggttccacagttgacaccttcaagagttagaattctgacttgcagcagatctttttgattgtcgagag

SEQ ID NO: 8237 - DNA, 457 bp, Gossypium hirsutum
  unsure (1)..(457): unsure at all n locations
  Clone ID: uC-gsronu33B147c04b1
cccactcgttcgagccaatatgcgatcgcgaaattcatcgaagagaagtataagcaattaccggcgaatttccgcaaagtcttacttgttcagacgaagaagtttgttgcttctggaaagcttgtcaaagtaaaagcctcttttaagctgccttcggcttctgccgcagctaagaaaccggccgccgtagctaagaagcctgccgccgcgaagcctaaatctgcagctaccactgccgcctcaaagtccaagccgaaggcgactaaaaccgcgtcgaaaccgaaagccaaagccaaagttggaacgcctgtgaaggcaaaggctaaagttgcggcgaaaccgaaggctactacaactaaggccaaagctaaaccagcggctaagccaactaaggtagcgaagacggcgaagaagagttcgccagggaagaatcgacaaggaatccataacaaanaan

SEQ ID NO: 8238 - DNA, 432 bp, Gossypium hirsutum
  Clone ID: uC-gsronu33B147d02b1
cccactcgtccggtatggtggtaggggtgatcgtcatggtggaggtggtggccgttacggtcctgatcggaatggagatcgatttggtgggcgcagcagggatgcaggtagtcgtgggggatctggaagtgatagatacaatcgtgatcgatctggaccctatgaccgtcgtggaactggaggtcctcgttctggttaagatgactgcttgtgctgatgaactaggttgctgctttttggcaaagcatgaagtttcttttttacagaatgtgctctcttcattgttgtctgggtggaacaatataatagttcagtcctttgaagtgtgaaacttggcacaaacctacaactatttatgtgttcgtaaaatgctgtgttcgatggagttttgtgcttaaaaaaaataaaaaatttataaaattaaaataaatg

SEQ ID NO: 8239 - DNA, 365 bp, Gossypium hirsutum
  Clone ID: uC-gsronu33B147d09b1
tataatagcaaagggaccaaattcttgatgatgcttataataaatatatgtttgatgatgacggtttaccgaaatggttcttagaggaggaaaagagacatcgccaaccaattaagcccgttacaaaagaagagattgctgcaatgcgtgcacaattcaaagagatcaacgctcgaccggctaagaaagttgcagaggcaaaagcacgaaagacgcggattgcaataaaaaagctcgaaaaggtacggcagatagcaaacagtatttcagaccaagctgacatcttcgaaaggtcaaagaggaagcaaattgaacaactctacaagaaggctacccccaaaaagccccaaagggaatacgaggtc

SEQ ID NO: 8240 - DNA, 371 bp, Gossypium hirsutum
  Clone ID: uC-gsronu33B147f03b1
tacacttttaactgtctctgcaagtggtaagagaagagtttctgaaacaccagtgacttctactaccagcaaggagcaatctcaaactgcttacagagaccgtgcggccgagaggaggaacttgtatggttcatcatcttccacaggagatgatctgcctgaccctgagctcaggaattcgaatcgagatatggcattcaaaaaattctcctcagatccaatgcctttcccacctggtgttggtggtggacggggggttgtgtcagatgatgttcaaagctttgaggtgatcacagcagagaaagcatttgatgagaaatatgagggcatccaaatgctccgcaatatgggttggcatgaaggattgggat

SEQ ID NO: 8241 - DNA, 543 bp, Gossypium hirsutum
  unsure (1)..(543): unsure at all n locations
  Clone ID: uC-gsronu33B147f05b1
caaatttctaacctgaagaaagaagagagtttatgagaatttcccaaatggatgcttttcagtggcacaagattgctgctgtttctggaatagcagcccttggattgggcacttatggcttccatatctttaaacctgaaaatcccgtttacaaggaggtatggcaaatcgcttctacttaccacttgtttcacacagctgctcttctttctgctcctattaccaaacgcccccacatttttggaggccttttgactgctggcattctttctttctctgggtcgtgttacacggcagcatatctggaggacagaaaatattcggcccttgctccatttggtggccttgcttttgttgccggttgggcaagtctgttattctaaggttggattttccttagaagaacttatgctatcacttgaaacaagttagagaacatcttgtcctctttgttatgccatatatgtaacaanacctttgtataagtgttgtctcataagataccctaatacatttttaattgcanacaagacatanatatgt

SEQ ID NO: 8242 - DNA, 504 bp, Gossypium hirsutum
  Clone ID: uC-gsronu33B147f09b1
ttatatggttcccaatatggagtgcagctagagagtgctgtgagggaccgattggcagctgacgacaaatacgaagaggaagaggaagaagccttggaaaaagttgttgaattcttccagtctaaatatttcaagaaggattcagtcatcacttaccattttccagcaaattcagccactgctgagattgcattcacgacggagggaaaggaggaagcaaaaatcaaagtagagaatgcgaatgtggtcgagatgatcaagaaatggtacttaggaggaacaaggggagtgtctgcaactaccatttcctccttagctaataccctctccgctgagctttgcaaatgaacccatgccgttttgttaccaagtctttcctactaagaaccatcctgtttgttgtgctttctctaccaataaattatgatatgattggagttttcgcttatttacagatccatttccttcactcccatgattgagtgaagcccaaaaatgaaaatg

SEQ ID NO: 8243 - DNA, 168 bp, Gossypium hirsutum
  unsure (1)..(168): unsure at all n locations
  Clone ID: uC-gsronu33B147g02b1
gatnccattaccactctatttcacttcatcaaaatttcatttcatttttcttctataaattctcttctcatttctctcataaacctcttcccctttcatacaaaaatctctctcttctcttcctctgtgttatttgaagtcttatgtgttatgaaatttttcatgttt

SEQ ID NO: 8244 - DNA, 363 bp, Gossypium hirsutum
  Clone ID: uC-gsronu33B147g03b1
aagccttagtagatgcaattgcgaggcttgaagaggcatctgatgatgaaagcgatggagagcatcgattctcacaaggtcaatcaatggatcaagaaagagcatggagaaaacggcaatacgatgagatgggtgaaggtaggatgattgaagggtccgatggcaataaatgactcggccgatgagagatagtcagcaaagcaagaattgggaggggttaacgacttgtgattttagccgcagcttttgtatatccagtagcagtagcaacaacaacagctgtagcagtcgcctccactttcagtgcttgcatcttgttttatccttttgaccttctaccaagctaaggtaaatgacctatct

SEQ ID NO: 8245 - DNA, 102 bp, Gossypium hirsutum
  unsure (1)..(102): unsure at all n locations
  Clone ID: uC-gsronu33B147g05b1
caggattgaaccaaagatctcggtgggcaaagcagggggcagtttttaaaaacctttttccccccntaaacccccccccccngaacaccccacccccctccc

SEQ ID NO: 8246 - DNA, 276 bp, Gossypium hirsutum
  Clone ID: uC-gsronu33B147h03b1
cccactcgttcgcccacgcgtccgctcgcacatgctgctaacaacggccttgatatcgccgtcagacttctcgagccgatcaaggagcagttccctaacctcacctacgctgacttctatcagctcgctggtgtcgtcgccgttgagattactgatggacctgaaattcccttccatcccggaagagaggacaagccttacccaccacctgagggccgccttcctgatgctaccaagggttctgatcacttgaggcaggtggttagggctcaaatg

SEQ ID NO: 8247 - DNA, 333 bp, Gossypium hirsutum
  Clone ID: uC-gsronu33B147h07b1
gtcgttgaaacgtattattaaagttgcacatttgacaagcaatgccttggctctcattaataattatgcctcaactcaaggttactatttaccttaatttctcatgaaaacttcaaaagagaaaaatgatcaatatgtatataggtatatcttaggatcgaattcgggattggtgtcaaccaaagattagatatcaactgtgattcggccgactaggctgcttttatgtttattttgctttgcgtgttgtatgcttatcatcaaacaatcagggcaattagaaaaatgttgttccaaactaagatggctagagattgcatattggggccagaa

SEQ ID NO: 8248 - DNA, 278 bp, Gossypium hirsutum
  Clone ID: uC-gsronu33B147h08b1
ggcctccgagaagaagccgacgccgccatggttcacgtcagtttctaccgcaattatgggaagacatttaagaagccaaggcgtccatacgaaaaggaacgtttggatgctgagttgaggcttgtaggagaatatgggctccgatgtaagagggagttgtggagggttcaatatgctttgagccgaatcagaaatgctgctagggatcttctcactcttgatgagaagaaccctcgtcgtatttttcgaaggtgaagcttttctttgtaggatgaaca

SEQ ID NO: 8249 - DNA, 373 bp, Gossypium hirsutum
  Clone ID: uC-gsronu33B147h09b1
ataaatgcagcgtaatgggtgaagaagtgaaggtttttggatactgggcaagcccttacagctacagggcagagcttgctttgaagttgaaaggtgtttcttatgagtacataaaatgaggatatctttggcaacaagagcgatttgcttttgaaatacaatccggttcataagaaagtcccggttattattcacatcgggaaaccaattgtagagtctcttgttatacttgaatacattgaggaaacttgaaagcataattgctatttgtcacacgatccgtaaggctaaattaacgctttgattttgaaaaaaaagaaagcagcaaaaataacaggcctctgtaaggatatatggataaggaggatgaatg

SEQ ID NO: 8250 - DNA, 99 bp, Gossypium hirsutum
  unsure (1)..(99): unsure at all n locations
  Clone ID: uC-gsronu33B147h10b1
ttagttttggacgcaatgaatgctgctgcacggggggggtttaaacaaaacttttggggtgtncaacccgctgaggngcgcgaaaggacagccttttat

SEQ ID NO: 8251 - DNA, 426 bp, Gossypium hirsutum
  Clone ID: uC-gsronu33B147h12b1
ttctcttcgtccgcttggtcttaccttagtctcttcccttcgcatctcaaagcttcccattcacactcggttcttcgtttttgacgagctaactcactcagtcagttactcgttctctctttggctcactcgctcgatctctctctagatttttccgattacaaatggaggatttcgatatcccggcggcggaagacatgatgaacgaagatatggatcttcccgacgacagtcccattctgaaagtcggagaagagaaggagatcggaaatcaaggcttgaagaagaagcttgttaaggaaggtgaaggttgggagtatcctgaaatcggagacgaagttgaagttcattataccgggacgttgctggatggaacacagttcgattcaagccgcgatagaggcacttcttttaagttcacctctc

SEQ ID NO: 8252 - DNA, 453 bp, Gossypium hirsutum
  Clone ID: uC-gsronu33B148a04b1
attcgcccacaggtttgttaccaccacaggaaggccaggccgaacgggggggggtttgtataaaatcatctgttggtgaacgaaccagaaccttggatattcggacaagacaaccagcactcagaccataacaatacgaagacgcaaccaagcacgaattccctattggtaccagaaatgaacactacagaaaaaggacatttctgccagtgtggatcaaactgcacctgtgagccacgcaactggcgaaaagcatgatgaaagccatagattatgaaaaaaagaaagcagccaaaaaaaacaggccctccgtaatggagaatcgccatgtaacgaccccctctcaatgcaacctaaaaaaaggccactaagggggcccccccaaagaaaaaaacccacggccacggactcaaaaacccccgcgctcccccaaaaaaccccgggtggaacccc

SEQ ID NO: 8253 - DNA, 493 bp, Gossypium hirsutum
  Clone ID: uC-gsronu33B148a09b1
cgtgtagtttctttttttttgtgtagcgattctcagttggtcttttctttaagcttacagcttctctccagagttttataatgggtaaggagaaggttcacatcaaccttgttgtcattggccatgtcgactctggcaagtcgaccactactggtcatttgatctacaagctaggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactttatcaagaacatgattaccggtacctcacaggctgactgtgctgttctcattattgactcaaccactggtggttttgaagctggtatctctaaagatggtcagactcgtgagcatgcttt

SEQ ID NO: 8254 - DNA, 482 bp, Gossypium hirsutum
  Clone ID: uC-gsronu33B148a10b1
gaaatttattatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggcgaaaataatgtataagccatttggttgggagcaaattgtccttttctccaaggattcttgctgctcattcatggtgactgggtttatggttttat

SEQ ID NO: 8255 - DNA, 85 bp, Gossypium hirsutum
  Clone ID: uC-gsronu33B148a12b1
accgccctttcgttcgcccacgcgtccgggctgatttcgcacttgggggacctatataaatatataaagtcaagaaaaaaaacac

SEQ ID NO: 8256 - DNA, 541 bp, Gossypium hirsutum
  unsure (1)..(541): unsure at all n locations
  Clone ID: uC-gsronu33B148b01b1
cccacgcgtccttttgccttgtctgaaaacagcactgtcaacaggctagtgaacttactaaacatggacgtcactccatacaccgacaagatcattgctgaatacatttggataggaggcagtggactcgatatgcgtagcaagtccaggacaatatcaaagccagttaaacatccctctgagcttcccaagtggaactatgatggatcaagtactggacaagcacccggtgaagatagtgaagttatcttataccctcaagcaatctttaaggaccctttccgaggaggtaacaatatcttggtaatttgtgattcatacacaccagctggtgagcctattcccacaaacaagcgccaccgtgccgctgagattttcagtaacaagaaggtggtcgatgaagtaccatggtttggtattgagcaagagtacactttacttcaacanaatgtgaaatggcctttgggatggtctgttggaggctatcctggtcctcagggtccttattactgtgcagctggtgctgacaagtcatttgggc

SEQ ID NO: 8257 - DNA, 394 bp, Gossypium hirsutum
  unsure (1)..(394): unsure at all n locations
  Clone ID: uC-gsronu33B148b06b1
tgggtggacccacgcgtgcggcctcattttcattatgaaagttggaatcgcttgttcggttgaatgacctacaaaccagatggacattttggatgcagccaaggaactgcattttatgagggacaaatttggtgggacgagtatccgaacagacagagaaagagcaaatcatctctagaatatggagttcggatgtctacgatgattgtgcagtacttgtatctaaatctaaaccttgtttaatatattttgttttaaatttccagtcgctactttatttttcttcttctagccaaaaacattaatattacttggttttttgtcagtataactatgtaactccacatttaataacggttgacttctttcttttaaaggggnccccaaataaaaa

SEQ ID NO: 8258 - DNA, 382 bp, Gossypium hirsutum
  Clone ID: uC-gsronu33B148b09b1
cggataaatggagacggtttgttgcattcgtgaagaagatgaatgttggaaaaggagcttgtgggtgtatacacaacccgctctagctaaccaacatcatgataatgagctatccaaggggaagcctatcccaggtgagaagcgaccacaacacaagccattccctgaacaccgaccgccaatacacagtggacctggcggtaaaggacaggagccaccacatggggaaaaacctcctcatagaaacttatagagtgtggcagttgagggcacacataaaccttcacgacattcaggtggtaaaccttcaagacactcggggggtaaacctccacatgttgaggggatccataccgataaagcacccatgaagccattccct

SEQ ID NO: 8259 - DNA, 494 bp, Gossypium hirsutum
  Clone ID: uC-gsronu33B148c01b1
tcgcccacgcgttcgtccacgcgtccgctttgttttgcctaagccatgtcgaggagaaaggttagtgagcccaaggaggagaatactaacctaggacctgctgttcgagagggcgagcatgtttttggggtggctcacatctttgcttcatttaatgacacattcattcatgtgactgatttgtctggaagggaaacaatggttcgcattactggtggcatgaaggtgaaagctgatagggatgagtcttccccttatgcagccatgcttgcagcccaagatgtttctcaacgctgcaaggagttgggtattactgcccttcatataaagctaagagctactggagggaataagaccaagacaccaggtcctggtgcacagtcagcacttagagcccttgctcgttcaggcatgaaaattggacgcatagaggatgttactcccatttccactgacagtacccgtagaaagggaggcagacgtgggagaaggct

SEQ ID NO: 8260 - DNA, 460 bp, Gossypium hirsutum
  Clone ID: uC-gsronu33B148c04b1
cccacgcgtccgtttcacgcgtccgcggacgcgtgggcggtggggagaaaatcatttgagttttggctgatacggcggccggatgggcgcttgaaggggcggagaaaatgggaatcaaacgagcggcggtgcttctctctggaccggcatctatggcactggcactgcatgttccaaagcttggtgaagctggaattttagatagtgatggaacactaaaaacagatgaaccgatcacactttcagaagatatcccatcatggagtagcggtgagctgtcatggagttgcagtgacgacccagtgatgcagaaacttatatctgcatatgtttcaaccgctgccaaaactttcaaatttgcagaacagattctttgcaactcatttcatgagctcgatccatctgccatgaaattgatccccaaagccttacccattggccctttttccacaaccaatca

SEQ ID NO: 8261 - DNA, 444 bp, Gossypium hirsutum
  Clone ID: uC-gsronu33B148c06b1
cccacgcgttcttttacagttgcttctattatagtgctagtttcagtagttcatctattcctgtttcctgtcgtcccatctcttgattacttcagtgctcggcaagtccagtacaaatgtgttccaattaattcatcacttgaacagagtactgatcatgtttgggaaaataaaccacaaggtcttaatttagatcacaggtttcctaccgacttgcataatggagttgtttatcgtaatgcaccgtggaaggcagagataggccgctggctttctggttgtgatgctattgctacagaagtcaacattgttgagacactaggtgggaggcgctgcaaatctgactgcagtggtcaagggtgtctgcaatcatgagttgggccaatgttgatgctttcacggatttagtggagaagcatgctcccagaggctaaatttgagttg

SEQ ID NO: 8262 - DNA, 520 bp, Gossypium hirsutum
  Clone ID: uC-gsronu33B148d05b1
caatgctttggcattgttgtttgcaaacttgagtgttgaaggtatggattctttaacttcaaaatatcgtgaagttgctgagcaattcaaaggacagggaattggtttccttttgggtgatcttgaggctagtcaagctgccatccagtattttggagttcaagaaagccaagtacccctaatcatcattcagaataatgataggaagaagtatttgaaaccaaatttgcaggctaatgacattgcaccttttgtgaaggattacaaggaaggaaaagttccaccatatctcaagtctgaacctattcccgaggagaataaggaacctgtaaaagtggtggttgctgacacccttgaagacatggttttcaaatcaggcaaaaatgttctgcttgagttttatgccccttggtgtggacattgcaagaaattggccccaatcttggatgaagttgctgttcattatgaaaaagatgataatgttgtgattgcaaaacttgaagccactgcaaatgatatt

SEQ ID NO: 8263 - DNA, 270 bp, Gossypium hirsutum
  Clone ID: uC-gsronu33B148d10b1
gtgatggcttaatcttcttgtcatcgtataggtcaatctactatgactatatcgtactatctttaaaaacatgccttcgtgttaggacattcaccttctaggaggtgcttctagtatttcagacagtttactgatgcttttgcttagattatctaatgatttgacatgtatgattctgctctttgatctgcattataagatttctgattaagtcggcataaaaaacccttatttaaaaaaaaaaaaataaaaaaaaataacaataaaaat

SEQ ID NO: 8264 - DNA, 473 bp, Gossypium hirsutum
  Clone ID: uC-gsronu33B148d11b1
gacttggtttgttgtaatcattgacggatcgacggtgagagcctttgtgactgacgaccagcagttcacgaagagcgtggatgagcgtttcgcagctcttgacctcaacaacgacggtgtcctctccaggtccgagcttcgcagggccttcgagtctctgcgtctcctcgagtcccacttcggtgtcgacgtcgccactccccccgacgagctcactcagctttacaactccattttcgagaggttcgattgcgatggcagcggcaccgttgacctccaggagttcagatctgagatgaagaagattctgcttgctattgctgatggattgggatcttgccctatccagatggttcttgaggatgatgaccaaagttttctgaagaaagctgctgatcttgaggctgctaagctcgatccaaaccatgcccaagccttctgaatgatgctcccaggttgctggacttggaatt

SEQ ID NO: 8265 - DNA, 288 bp, Gossypium hirsutum
  unsure (1)..(288): unsure at all n locations
  Clone ID: uC-gsronu33B148e02b1
cccacgcgtccgtctcacgcgtccggatttctcactcccaaggacattgttgagggctcaccaaatctcaatcttgcatttgttgcacaaattttccacaacaggaatggtttatctactgaaagctttttacataaaaaaaaaaaaaaaaaaaaaaaaaaaaaaaaaaggaaaaaaaaaaaaaaaaaaaaaaaaaaaaaaaaaaaaaaaaaaaaaaaaaaaaaaaaaaaaaataaaaaaaaagggttnnaattgaatgagaattaaaattgattttattgggaaagg

SEQ ID NO: 8266 - DNA, 498 bp, Gossypium hirsutum
  Clone ID: uC-gsronu33B148e03b1
cgatgacgttgcttgagcacgcagggaacgacaaatcgtgcctatggcacgcttctgactttgctgatgatgaactgaaagatgaacttttctgcattcgttttgcatcagtggacaattgcaaaagcttcatggaaacggtccgagaagttgctgaatcacaaaaatcaacagaggaaaataaagaggcatctgctgcagctggtctacttgagaagttgagtgttgaggaaaaggaagccaaggataaagtggaagagaaggatgttaaagcaaaggaagaaacggaaacaaaggaggatacaaaaaaagtagatgatagtgagaagaaagatggggagccagaatcaacttaaaaaagggggttgggtttggtatttgtttctttgtgccatatgcctttgtgggctatatggtgagattagtcaccttccatgtcttgcatattcatcttctgcagaggaaactagatgggtcagtatgttcataagctggaat

SEQ ID NO: 8267 - DNA, 458 bp, Gossypium hirsutum
  Clone ID: uC-gsronu33B148e04b1
gaacaaagtatgtggatttgaaaagaaaaggccatctccaccgtacattttgtggtgcaaagatcaatggaaagagataaagaaagagaatcccgaggctgatttcaaagaagtttcgaatattttgggtgcgaaatggaagacgatcacggccgaagaaaagaagccttacgaagaggtatatcgagccaaaaaggaagtgtatttacaggccattgcgaaagagaaacgcgagacggaagccatgaaactctttgaagatgaacataaacaaaagacagcaatggagttattggaacaatacttgcagttcaaggaagaagctgagaaagaaaccaagaaaaaaaccaagaaagaaagggatcccttaaagcctaagcaacccatgtcggctttcttttttgttctccaacgagaagagggcggctttactcgccgatacccggagcatgaacttt

SEQ ID NO: 8268 - DNA, 439 bp, Gossypium hirsutum
  unsure (1)..(439): unsure at all n locations
  Clone ID: uC-gsronu33B148e05b1
gtcaaagtttaataaagaaaaaaaataaaaagaagcaaaagcagaagagatatttaagagaggaattcgaggaagaaggtgaaggagaagagaagaagaagaagaaaaagaaggagaagaagggactggaagaaaagattgaagagaaattagaaggggaaaagaaagaagaggacacctcagttccagtagagaagtgcgatgagccagtagtccagccagagacgccagagaagaaaggtttcctcgagaagatcaaggagaaactccctggacaacacaagaaagctgaagaggccagtagcccggctccagccccagcagctgagccccatcacgaagaggagtcaaaggaaaagaagggaattttggagaaaatcaaggagaagcttcctggttaccactccaaatcagntnnnnnnnnnnnnnnnnnnnnnnn

SEQ ID NO: 8269 - DNA, 228 bp, Gossypium hirsutum
  Clone ID: uC-gsronu33B148e07b1
agctttgttacatagctgagataaaaaacactaacgagcaaggggagcttgtttgaaaaaactgtgcgtaaagacaaaggggcacaaaaatttaacaacaggaaaggcttaactaatgaaagctttttacctcacccacaaaaaacacaacctaaaaatctactcatccctcactttaaaaaaaaaaaattaacctccccgcatctatccaacccaccccgatccaat

SEQ ID NO: 8270 - DNA, 254 bp, Gossypium hirsutum
  Clone ID: uC-gsronu33B148e10b1
gctggcacgccggcacggagccgggccggactggccggaccgacccacgcggccgcccatgcgttcgcaaaaaaaataaaaagaagcaaaagggggagatttttaaaagaggattgggcggaaaaacgcgaaggagaagagaagaagaagaagaaaaagaaggagaagaagggactggaagaaaagattgaagagacattagaaggggaaaagaaagaagaggacacctcagttccaggagagaagtgcgatga

SEQ ID NO: 8271 - DNA, 299 bp, Gossypium hirsutum
  Clone ID: uC-gsronu33B148e11b1
cccattcgttcgcccacgcgtgcgaataaaaagaagaaggcagatagttagctgaaatattaagattggatttagggaaaaagatttggaagataagaagttaacacacacgagaatgaagggggatgtctcttataaggggggacctttattaaggccacaggccatcgttgtacatcttggtgtctggaaacttttttgatttgcccgtttttgttttttaggcgcctttgcttgtaagctcggggggtgaaataactgaaggggcttggcatttatatctttttttgaatggtttg

SEQ ID NO: 8272 - DNA, 538 bp, Gossypium hirsutum
  unsure (1)..(538): unsure at all n locations
  Clone ID: uC-gsronu33B148f05b1
gacccttttattagtttcacaactaaaagaacccaagttttgatattgtttaaccgccatggatgagacccagaaaagcctacttttgatggggtcaatagcaagtgcaaatgaatcattaggtgaaatgcggaccactccattgatacgtaacccatcccaaccatctttttactatctttcactccaaggaatcactgtgggaagcactcgcttgcctatcaaggaatcaacttttgcactagaagacaatggcagcggcggtgtaatcatcgactccggcaccactatcacgtatctcgaacaagctgctttcagcgtgctgaaaaaggcattcatcttggaaatgaagcttcccgtcgacactttgagttcaacggggcttgacctttgcttcaccttgccatcaggttcaacccaagttgaagtacctaaacttgtattccatttcgacggagcggatttggatttaccggcagagaattatatgatcgcggactcgagcttggnggtaatttgtttggcgatgggaggctct

SEQ ID NO: 8273 - DNA, 330 bp, Gossypium hirsutum
  Clone ID: uC-gsronu33B148f10b1
acccgttcgttcgtttcaacccaaaaaagaaaagaacgcggaaaggtttaacaacaatgggtctgtcaaaggcttctctaatccttgatctcgtcgctgtttgtgctcttatgggttcagccgtagctgctgaagccccagcaccgagtcccacctcaggaaccgccttcatctccccctcattcgtctctgttttctttgccgatgcaccggctctgctattcgggtctactctcaggatctggagggcgttggctattgatggtgtagagagggggtctgatttctcatttatatagatctaatttttgggaggggtgaattttatat

SEQ ID NO: 8274 - DNA, 398 bp, Gossypium hirsutum
  unsure (1)..(398): unsure at all n locations
  Clone ID: uC-gsronu33B148f11b1
gggggtcntatccatgttccctggtattgcggaccgcatgagcaaggtgatcactgctcttgctccaagcagcatgaagattaaggtcgttgcgccaccagagagaaagtacagtgtctggattggaggatctatcttggcatcactcagcaccttccaacagatgtggatttccaagggtgagtatgatgactacagctcatgcatggtacacaggaagtgctgacaagatctgtgaacgctgctgatggggggttacaattagggtggacatgattacttatcatgtttgaggctgtgggatcatagttttgttttcaaggttcttttcttaagtgcagattgggtttaggactggccatgaactcgcttttttgtttaatgcaaccccaaattag

SEQ ID NO: 8275 - DNA, 505 bp, Gossypium hirsutum
  Clone ID: uC-gsronu33B148g03b1
caaatttcatgagttttaccaaaaaaggcagcaaattaagcttttcaatatttgcttttaatcaatcgaaatggcttcacaagtttctcaaatgccttcttcatcacccctttcttccaataaggatgaaatgcgtcccaaagccgattttcagcctagcatttggggagatttcttcctcaattgtcccgacaagaatattgatgctgaaactcaaaaacgccaccaacaattgaaagaagaagtgaggaagatgattgtggcaccaatggctaattcaacccaaaagttagccttcattgattcagtccaaagactgggtgtgagttaccatttcaccaaggagatcgaagatgaactagagaatatctaccataacaacaatgatgccgagaacgacctctacaccacatcccttcgattccgactactccgagagcatggattcaatgtttcatgcgacgtattcaacaagtttaaagacgagcaagggaatttcaagtca

SEQ ID NO: 8276 - DNA, 482 bp, Gossypium hirsutum
  Clone ID: uC-gsronu33B148g04b1
gcggcaagaagttgtttttctctctctctctctttcccatagttggacccatcttttaatccatcgctcacaaaattatggggctgaaggaggaatccgaggagcatgccgagaaagttaagaccctgccggccgccccttcgaatgatgacatgctcattctctatggactgtacaagcaagctactgttggaccagtgaataccagccgccctggaatgttcaacatgagggaaaagtacaagtgggatgcatggaaggctgttgaagggaaatcaaaggaggaagcaatgggggattatatcaccaaagtaaaacaactgtttgaggctgctggaagttcttgatgtgtgtgtgtatgaccaatgaaactggtgtaatttcaagcccttgtcggttacttggggttttcatttactaagaataaattatgtactctttttctattgctattaatgtattcacagtagaaacctcttgat

SEQ ID NO: 8277 - DNA, 422 bp, Gossypium hirsutum
  Clone ID: uC-gsronu33B148g05b1
tcattcgcccacccgtgcgtactcccacacgaacgcaaaactcgagctaggcgggattaactaaaactgttgctggccctaacgacaagttctatgaaggtgataatcaatacacaatgagtgggcaagctttggagttcaagcagctcaatatccatgcatgggaagcatttgataaaggtcaagatattcatatgcaggctgctccatctcaagctgaactcctcttcaggaattataaggtcatcaaagagaagttgaaatcaaagaccaaagataccattatggaaaaatatggcaatgcaaccactgaagaagagataccgacggagcttctcttggggcacagtgagaggcaagtcccaatatgaacgagcctgcagagctataaagggaatggaaacatcgttttctaaaagcaa

SEQ ID NO: 8278 - DNA, 403 bp, Gossypium hirsutum
  Clone ID: uC-gsronu33B148g06b1
cccacgcgttcgttaggacttggggttagttgttggagggctatcgtgctttcgtccggagtttgcacgcactcacgcgcccccttcttggcctccacgtacggtggttggaaactggaaagtttcctttttccgacacgaatcaaaatggtacgcttcccttttccttttcattatttgcaatatatacatgtacatatatttaaagcatccacctttatgtatttcgatcgactgctggtttctttagtataagaacgattttgtttttattgaatctctctggtcttgccaaaaaaacctttattacagattaaaagaaatgggtttttataaccctcaattacattctagggaaagaatctgtggagttctttccatgaagatatccttagctgttgtg

SEQ ID NO: 8279 - DNA, 316 bp, Gossypium hirsutum
  Clone ID: uC-gsronu33B148g09b1
ggatgcataaggtgtgaaaggctagaagaattgattgttgaacgaacatctgaacgggtggggaggagatggctttctccctcaaccccagtcgagagcaacgccatacgcccatttatgaggaagttccatcctttgaccccatatcagcccccccattttgcgcggtttcttgctccaattgtcctatcacttgtatgccgacgctttaacccaataaacgccacccatcaaacctttccaggacccctggcgctactttgtggcctctcttgcatttaacccttccccctttggtgggcccctcattgcattt

SEQ ID NO: 8280 - DNA, 274 bp, Gossypium hirsutum
  Clone ID: uC-gsronu33B148g10b1
ggtggtgtgtcggttgtatttgcatggaacttgggtcatggatggacctttgttgggtctttgatcaacagtatgtgcttagcttatgttactgtgctcgtggagcaacggatgttgaagcaagagtatagagctgaagcataacaggttataccaaaagacaacctcagtgtgggtacctatggtcagatcttctgctatagcagtgaaggatatggttacttgatctgactaattttgtttcatttgaatcaaacattttgtgatggttgtt

SEQ ID NO: 8281 - DNA, 541 bp, Gossypium hirsutum
  unsure (1)..(541): unsure at all n locations
  Clone ID: uC-gsronu33B148g11b1
cccattcgttcgcccacgcgtccgcaaaactcgatctatgcgtgaagatcctcttcctgatgctgaccctaatgagaagttctatgaaggtgataatcaatatagaatgagtgggcaagctttggagttcaagcagctcaatatccatgcatgggaagcatttgataaaggtcaagatattcatatgcaggctgctccatctcaagctgaactcctcttcaggaattataaggtcatcaaagagaagttgaaatcaaagaccaaagataccattatggaaaaatatggcaatgcagcgactgaagaagagataccgatggagcttctcttggggcaaagtgagaggcaagtcgaatatgatcgtgctggcagagttataaagggaatggaaacatcgcttccaaaaagcaagtatgaaaaggatgttttcatcaacaaccacacanagtgttggggttcatggtggaaggatcgccaatggggctacaaatgttgtaagcaaacaattagaaatagctactgtactggtgcagccgggatg

SEQ ID NO: 8282 - DNA, 274 bp, Gossypium hirsutum
  Clone ID: uC-gsronu33B148h07b1
ggcccggactactggctcgacccactcttcgccaccgtcgtaaggattgacgagttttgagcatcccaggggcaaaattaatgcaatgccaagagattgacagcgaaggggtgatgtgtggtgccaattttatggccgatgctcagtcgagaacaagtaggatgccctctagttggtagcgaagccaattgggcactgcgaggctccaaagcttgaataattcaatactaaatgacccacattttaatatgcttcttcttttttgttggggggg

SEQ ID NO: 8283 - DNA, 300 bp, Gossypium hirsutum
  Clone ID: uC-gsronu33B148h10b1
cccatgcgttcgcccacgcgtccgcccacgcgtccgagggtagcacttgaaatggcttgtacaagaaagctgagaagatggtaccgacgacgacaagggcaagagctagaaagaggtagcgattcagggtcgtataccggaaacagtggagacctagatttgagcagacggagtggacgctgatataaacagcgaggtggacccctaccctctggcatgggatgaaccagaatgctattttgatgtggacaccaaggtggctgccgaaggaacacaggctttgactgctgatgcggctag

SEQ ID NO: 8284 - DNA, 287 bp, Gossypium hirsutum
  Clone ID: uC-gsronu33B148h11b1
tcacccgcccacacatttcattttgcaagcagcgaggggacaatcaggggccgcagttgataacacagtatgcgtgaggtacaacaccggcaaggcacgatgatgagagccctggggtatcgaaggagggcagctaaggtatgtatattgcaaatagcgcaaaccatcatgttagcagactggggaagcggatataatcaagagcatgatcgccacctaccctctgggggggactgagtgacgatgctagcaagctgaggttgacgagcttgctggccaaagaaaac

SEQ ID NO: 8285 - DNA, 403 bp, Gossypium hirsutum
  Clone ID: uC-gsronu33B148h12b1
cagactcatatgtcaattcagttctgcgacaatcgtagttccagtagtttaaccgagaatccgagttctattcctgctggaaatcatcaccagcagcagcagagtcatcagcaggggcaaagtttatgcttgaatttttccgattatggctttgatgagagtagcagtgtgaggaatgggaattcatcttctcatttattgaaacctgaatccggagagatattgaattttggtgagagtaagagaagtgggaatgggatatttgttcacagggaactctccgctcgctgtggagaacacgacgaggtcgcctaactcaagagggagtaacgaagaagctatgctttcgtttacttaacgtgtaattttaccttcatctggtgcgttggaatcaacttggggg

SEQ ID NO: 8286 - DNA, 452 bp, Gossypium hirsutum
  Clone ID: uC-gsronu33B149a03b1
agctgcaagatgcaaatgacatgactgacttcgtgggtccatttcttgattttgtgcccgataaacggcctagtgctgctcagtgccttgttcatccatggatcgatgctggtccccgacttttagagccatcagggtcttcatcgaaaacccaagtagcggtttctgagaaaaaaacgaaggagatggatgatatggaggcgatggaggttgcaatggggaatattgccataagtgcagattctaaacatgccaaagatcactagcctccttcgaaaccctccaacgcagccatttcttcttccaggtaggagcttgcctctttattttatatatgcgtaggctagttttgtgtctgtatctgtgcacggaacatgtaattctttagaaaatatatattcttttataaaatataacctgaaatgaaattacattcataatgcactggaaaa

SEQ ID NO: 8287 - DNA, 530 bp, Gossypium hirsutum
  Clone ID: uC-gsronu33B149a05b1
ctgtacttgtgggcggacgcgtgggcggacgcgtgggcggactcttgggcggactcgtgggcggacgcgtgggcggacgcgtgggtgtttgtctattgaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaggtctatattattgctctgtctgggcttgggaatagaagcttcgtcgtggtgacataatgataagccatcggtgggagca

SEQ ID NO: 8288 - DNA, 462 bp, Gossypium hirsutum
  Clone ID: uC-gsronu33B149a07b1
tgttttaaaatatctctctcttcactttcttctcttttcaacttcagggtgaaaggcggggaggccgtagacaatctctcttgcgctcttctcgtagaatggatcagattcaacatccaactgtcatgcagaaggtagctggccagctcctttcttctagcatttcccgagattttcaagggtatgatgggtctttcaggaggcctgccctataccaaggacattttgcatatgggaattattccaatgctggaatgcactatcctattgttccatcaacagctaccgccatttgtgttcaagcccctgcagagaaaggatttaccagctttgccattgatttcctcatgggtggagtttctgctgctgtgtcaaaaacagctgctgctccgattgagcgtgttaagcttttgatacagaaccaggatgaaatgatcaaaactggcaggctctctgagccct

SEQ ID NO: 8289 - DNA, 403 bp, Gossypium hirsutum
  unsure (1)..(403): unsure at all n locations
  Clone ID: uC-gsronu33B149a09b1
tctacgcgtccgcccacgcgtccgcaaaaatatccctaaaaatcacgaccaaatagggattcccttttctctcattttcctttcatccaaacaatgcctctccttcactcttctgcttgaaacccagaagaaaataaaattatgaataattcttggtttgacaaagggtttgatggggcgaatgatgatttctttgatgatgtaataaagtatttggatttcccattggaagatgttgaaggcactgatggtggcgatggtagagtgggagaaggngtcatanattttcatttgcctcttgatgatgacgtaaaacacaacaactccggtggcggggaatagagggattgttacttcaaaacttggaaccgccgcctgctaatgttctcgccggcatgttttc

SEQ ID NO: 8290 - DNA, 96 bp, Gossypium hirsutum
  Clone ID: uC-gsronu33B149a10b1
tactacgcgcccggcgggcgacaacccaccgaagagccttttatacccattttttgtgttaacacccgggaggcggggcgatggggcccagagtgc

SEQ ID NO: 8291 - DNA, 526 bp, Gossypium hirsutum
  unsure (1)..(526): unsure at all n locations
  Clone ID: uC-gsronu33B149a11b1
ctctttataaaaagtagcccaaggggaaaaattcgctaggggatattaaatgacgtgtagggtttctcaatggatcattttcataattgtatgtttcttaagtgaaacagctttcatctcaccatcacaggctactgtcaatgatctcaagcaatcgatgaaggaaaaacacctcacagattttttggatagacatgaacaaacaatcaagggttggcatgaagcacttcatttgaagatggttcaaagagaaaagaaagtaattattgagcagaagaagaaaggagggaaaggaggcggaagctatggcggtggaagtcttcttcgacctcgtgccaaaaagagtgcagcaaactttctccatccaacaacattccttagatttctatntacctggttaatccccactatgttctttntataacttggatataagcccctattatatatatatgtacccctcaaatatgttgtaagtgttggtcacttttttatttttatttttttaaaatatcatttggaattt

SEQ ID NO: 8292 - DNA, 130 bp, Gossypium hirsutum
  Clone ID: uC-gsronu33B149b04b1
agttgttggtgctttttttttttcctgttttggatgtgaaagaattagccatttacttttgctgtaacaactgttgcatttctggatatttgcagacttgtgtatctttctttctttaaagtttctttct

SEQ ID NO: 8293 - DNA, 424 bp, Gossypium hirsutum
  Clone ID: uC-gsronu33B149b06b1
gttcttttctacattcagcaaaggggggctctgagatcacataccaaaatggtgaaagccgttgccgtccttagcagcaatgaaggtgttagcggaactgttttcttctcccaagaaggagatggtccaactaccgtgactgggaacctttctggtcttaaggccggactccatggcttccatgttcatgcccttggggacataactaacgggtgcatgtcaactggaccccattttaatcctgctggcaaagagcatggtgctcccgaagatgagaaccgccatgctggtgatctaggaaatgtcactgctggtgatgatggctgtgctagcttctccatcaccgacaaacagattccactcacaggcccaaactccattatcggaagagctgtagttgtccatgcagatcccgatgaccttg

SEQ ID NO: 8294 - DNA, 511 bp, Gossypium hirsutum
  unsure (1)..(511): unsure at all n locations
  Clone ID: uC-gsronu33B149b09b1
tatantttttttttttgaaaaacaaaagtcacgagtatttaactggaattgacgggcgcacaaccccatgttcaaacaatgccggcgaaaaaaggaaaaggaaaagacaagatgaaatacaaaagagcttctccaattgaaattacaaaacagaatattattctccaagaaaaaccggcccaatgttatttaacagcttaaatttactcctctgccaatggaactgattcagccagcttgcggtacttaagagcataaaacatctcaaggtaacgacgactctcacggcgttcaaggttggaaacatgcttccagaatccatacactccggtcagggtcaatagtctcttcgagtaaatttncatgtatactttttctcgatacgtttcaagccttctaaggtgaaaccaccaccatatgaacctaagccaccggtttatacaccttcaaaaaagagaagcctgaacccaaccaccagtgatgaacctctaagaagagaagctgacctaac

SEQ ID NO: 8295 - DNA, 435 bp, Gossypium hirsutum
  Clone ID: uC-gsronu33B149b11b1
tattgcttgggcttttggtggtatgatctttgctcttgtttactgcactgctggtatctcaggtggtcatatcaatccagcggtgacatttgggctgttcttgggaaggaaattgtcgttgacaagggcaatatactacatggtgatgcagtgcttgggagccatatgtggggctggtgtggttaaagggctcatggggaagacaaggtatggcgctttgggtggtggagctaactctgcgaatcatggctacaccaagggagacgggcttggtgctgaaattgttggcacctttgtgcttgtttacactgggttctcagccactgatgccaagcgcagtgccagagactctcacgtccctattctggcaccattgccaattggggtccgcagtgttcttggtgcacttagccaccatcccaatcacagggaccc

SEQ ID NO: 8296 - DNA, 522 bp, Gossypium hirsutum
  Clone ID: uC-gsronu33B149c05b1
gctttgacttcctttttaagttagcaaaatccaaatgggtaatcttttctgttgtgtacaagttgaccagtctacagtagccattaaggagagatttggcaggtttgaggatgttcttgaacctggatgccattgcctaccttggtttcttggaagtcaacttgctggccacctgtcgctaagattgcagcagttggatgttcgttgtgaaaccaagactaaggacaatgtatttgttaacgttgttgcatctattcaataccgggcactggcagacaaggcaagtgatgccttttacaagctgacaaacacaaggacacaaattcaagcctatgtgtttgatgttattagagcaagtgttccgaagctaaatctggatgatgtttttgaacaaaagactgaaattgctaaagctgttgaagaagaacttgagaaggctatgtctgcctatgggtatgagattgttcaaacacttattgtggacatagaacctgacgagcatgtgaagcgtgcaatgaatga

SEQ ID NO: 8297 - DNA, 393 bp, Gossypium hirsutum
  Clone ID: uC-gsronu33B149c09b1
gctggtctcaccggacgtaagatcattattgacacttatggtggctggggagcccacggtggtggtgctttctctggaaaggacccaaccaaggtggacaggaggggtgctcacattgctaggcaggctgccaagagcattgtagcaaatggacttgcccgcagatgcatcgtacaagtctcctatgctattggtgtgcctgagcccttatctgtcttcgtggacagttacggaaccggaaagattcccgacaaggaaatactccaaatagtgaaggagaactttgactttaggcctggtatgatcaccatgaacctggacctgaagagaggtggcaattgtcggctcttgaagacagctgcttacggacactgtggaagggacgacccagac

SEQ ID NO: 8298 - DNA, 194 bp, Gossypium hirsutum
  Clone ID: uC-gsronu33B149c11b1
atagcgacacgccctttttttcgattatttttttagggtttttttaaaaatttttttttttaaaaacaaaccgataatattaagaaaaaagaaaaaaagaataaaaactaaaactacaatgtgaaaaccaaaatacaagataaggaaggcatccctccagaccagaaattaatgatcatcaacggaaaacagct

SEQ ID NO: 8299 - DNA, 304 bp, Gossypium hirsutum
  unsure (1)..(304): unsure at all n locations
  Clone ID: uC-gsronu33B149c12b1
cttcgcgtccggaagaaagcacaagatgctttccttgttaggtgcaaggctaactcggaggccaccttgggtacatacaagggtgacgcaaagattagtgagggtgctgcagagagccttcatgttaaggactacaaatactaagaatttagtcttgtggtctgtgtatcagagaaattttctgtattgatgattttgggggttttccgtttcttctcatggaatttaggttgtgaaatcagaccgtttcttctcatggaatttaggttgtgaaatcagactcaaataagcttggggggcccna

SEQ ID NO: 8300 - DNA, 377 bp, Gossypium hirsutum
  Clone ID: uC-gsronu33B149d09b1
ttcctaaaggaaaaaaaaactcaagaagtttaggtgtaaatctcacctttttctatttttgtttgatttctttcaatatgcgtgtgtatttctggaaaaaagaagatccaatttacatcgtttcattcggtttttatagccgaagaatcaataaaaataaaagggaaaaaataaataaaaaatccttgttgtaatctgttattatttgctgtcaattattgtttactattttctgttattctcttctcgtacgtgtggaggtcgtggtgctgctgacatggccaggccgttcgtaggcgtgtcgatgcggagcgtgaagcaacgtcgcgcgtggaagctggcctgaaggcagtagcggtgtacggggaaagggaccc

SEQ ID NO: 8301 - DNA, 446 bp, Gossypium hirsutum
  Clone ID: uC-gsronu33B149d11b1
tattacgcgtccgcgaacaatgttaaatcaagtgtttgcgacatcccaccaaccgggttgacgatgtcatcgacgtttatggggaactcgacgtcgatacaagagatgtttcgacgtgtttcggaacagttcacagtgatgtttaggaggaaagcatttttgcattggtatacaggggaagggatggatgaaatggagtttactgaggctgaaagtaatatgaatgatttggtttctgaatatcaacaatatcaagatgctgtggttgatgaagatggtgaagggtatgaagatgaagctgaggaaaattgacgggatccttttcaactttttatagtaatggcctagagaaaaaaaatcaaatgtggtgttcattctgatggatctaaataaggaggccatgatgtttatttgtgtcggagacttagacatggagttgtgaattt

SEQ ID NO: 8302 - DNA, 532 bp, Gossypium hirsutum
  unsure (1)..(532): unsure at all n locations
  Clone ID: uC-gsronu33B149e05b1
cctactcgtccgcccacgcgtccgcccacgcgtgcgaatggggtgggctatagcactccatggaggcgccggtgacatcccacattctctgccaccagatcgccgcctccctcgtgaagttggtctccgccactgccttgacgttggcatcgccgctctcaaagcccataagcaccctttggatgttgttgaacttgtggttcgtgaactggaaaactacccacatttcaatgctgggaaaggatcagtgttaacttcatcaggcacggttgagatggaagcttcgataatggatggaaagagcaagaaatgtggggctgcttcaggtctcagcaccgttgttaatgccgtatcactggcaaggttagtcatggagaaaactcctcatatatatctgggatttcatggtgctgaggcctctgctagggaacagggtgttgagactgctgaccncagctattttatcactccagaaaacatngaanggctaagcaggcacaagatgcccacagagttcagattgatacaccca

SEQ ID NO: 8303 - DNA, 551 bp, Gossypium hirsutum
  unsure (1)..(551): unsure at all n locations
  Clone ID: uC-gsronu33B149e11b1
ttttgatcatcggaggaactggatacctgggaaagttcattgtggaagccagtgcaaaagagggtcatcccacttttgtttttgtaagggagtccaccgtctccgaccctgttaagggaaaacttgtcgacaacttcaagaacttaggggtccatttgttgttaggggatatgtacgaccatgagagtttggtcaaagcaataaagcaagttgatgtggtgatttcggttgtgggtcaaatgcagttatcagatcaagttaagatcattgctgctattaaagaagctgggaatgtcaagagatttttcccatcggaatttggaatggacgtggacaagaacaatgcggttgagccagcaaaatcgacattcgcaatcaaggctcaaatccgtcatgctgttgaggctgaagggatcccttacacttatgtgcctgctaactgctttgcaggctatnttcttcctacattgtcgcagccaggagccacctctccccaagagacaggtggttatctaagtgatggaatcctgagctgtctcaccatgaagctg

SEQ ID NO: 8304 - DNA, 513 bp, Gossypium hirsutum
  unsure (1)..(513): unsure at all n locations
  Clone ID: uC-gsronu33B149f01b1
cccacgcgtccgcccacgcgtccgcagtgagatggggattgaaccagagtttcccggccgggaccgactcgtcttataagaccatcaaggtccagctttgctatgcacccatcagccaagtcgaccgtgcatggcggaaaaccgaggaccatcttaacaaagacaagacatgccagttcaagatcgtcaagaaaccctacaccaacgtcaacgaaacccttgaatggaccatcgaacgagacgtgccgacggcgacgttctttatccgagcctacgctttggactccgacgaccacgaggtggcgtacggtcaaaacaccgacgccgagaagaaaaccaatctgtttgaaatccaagccatcaccggccgccatgtttcgctcgatatagcgtcggtttggttcagtgctttctccgctgtgtcgctgatggggttcttctttatggagacaagaaaggcanggcaatctcagcagtagtgtgatatattatggnttaagaaccctaattaac

SEQ ID NO: 8305 - DNA, 542 bp, Gossypium hirsutum
  Clone ID: uC-gsronu33B149f03b1
cttactcgtgggttcatcgtgatcttgagccttgaaacattttgcgggatgactctggacatctgaaagtcgcagattttggtgttagcaagctgctcacagttaaagaagttaaacctctaacatgtccggtgacatcttgtcgatatgttgccccagaggttttcaaaaattatgactatgataccaaagcggatgtgttttcatttgccctgattctacaggagatgattgaaggctgcccgccatttcttacaaagcaagataacgatgttaccaaggcatatgcatcaaaggagcgtccgcctttcagagccccatctaagtattacgctcatgggctcaaagagttaattgaggattggtggaatgagaaggctgctaagcgaccaacatttagacagataataaaaagactggaatcgatccatgacagtttcagtcataaaaagcattggaaggtgtgtgcaatcttttttactattaggctgataattgtctctacggtgcatatgctcagctagaccattaactggttcaga

SEQ ID NO: 8306 - DNA, 419 bp, Gossypium hirsutum
  Clone ID: uC-gsronu33B149f07b1
ttatatctacagatctctgtccctctttctctacggctcaaaccctaattccttagtttttacagaagatcgggggtttaatcgcagagaatcaaccatgtttaacaggctcttcgagagacccaagcaggaagcaaatgctctaaccacgttagacaaattaaatgagacccttgaaatgctcgagaagaaggagaaagtacttgtgaaaaaggctgctgctgaggttgaaaaggccaaggaatttgccaaagggagaaacaagagagcggctatacagtccttgaagaggcagagactatatgaacagcagatagagcagcttggaaacttccagcttcggattcatgatcaaatgataattgtagaaggtgctaaagccacaactgaaactgtagatgcattgagaactggagcag

SEQ ID NO: 8307 - DNA, 457 bp, Gossypium hirsutum
  Clone ID: uC-gsronu33B149f08b1
ttttacgcgtgggcttgaatgttgagtttgtgcatgttagggtaataatgcattgaatggatatatgaatgtttattatattgtattgaaaatattaggtaagtataattcttgttacatgagcttactaagcacgaagtgcttacctcgtttcctttttccctgttttgtagtgttaagagctcggaggtcggatttggtcggagacacatcacactgtcaacctcacgattccggtatataaagaaactttattttggaaatcaatggcatgtataagctaacaaagtaaatgttaacgtgaaatgaatgtaaagctagccattagtatggttaacaaacctggttatagataagtgatgacgttatcttatataaatgcatgaatctatcatgaaaatatgttgaattgaaaaaaataattaattcgtaaacttccgtaatgcctcgtacccta

SEQ ID NO: 8308 - DNA, 473 bp, Gossypium hirsutum
  Clone ID: uC-gsronu33B149g03b1
ctcttttctcaagctttttcccaaatagccatggctatggcgatggcgggaactgcaaccttcagtatctcatcagctacttcaatcttccggacttcatcttcacttaaattctcttcaaaaccaatgcttattccaatgcgtttttctccaaaaacccaatctcctcccagaactctccggatttacgctttgactagtaacgatatcaaagtgggtactaaccttgaagttgacggtgctccttggcgaattttggagtttcttcatgtgaaacctggaaaaggggctgcatttgtgagaaccaaaatgcgcaattatatcactggaaacaccgtggagaaaacgtttcgagctggaagtacgattgaggaggcaaacgttttcaaggaatcgaagcagttcacatacaaagatggttcccagtttgtcttcatggacctgaacacattcgaagaatcccgtctaaatga

SEQ ID NO: 8309 - DNA, 507 bp, Gossypium hirsutum
  unsure (1)..(507): unsure at all n locations
  Clone ID: uC-gsronu33B149g04b1
ccttcttcgtccgggcaacgcctccaccatatcttccgtcaaaaatcgacatctggaccatcctatccgaatccaggcgcatactcaaagcccacagtggccacttccaagctctctcactcctctttctcctcccttcctcttgttttttatccatttatcccttcatctatcaacacttctctcccaccattgaatcccacctcagcttccttgagcaaaatccccgcatcttccccattaaactccccatcttcaatctcctttacaccctcattctctccatcttctctttcttcgctatcggtaccatcacttacagcgttttccacggcttttacggtcgacccctcaaccttttatcctcttttaaggcagcatccacttccttcttccctctcctctcgacttcccttggtaacccagttatcgtttatggaatcagtttagttcttggtttggtctttttggattaatcaaagcaacccaattntactcttcacctac

SEQ ID NO: 8310 - DNA, 486 bp, Gossypium hirsutum
  unsure (1)..(486): unsure at all n locations
  Clone ID: uC-gsronu33B149g08b1
ttttattctcccattcacttaggggtttcaaagagccacctcctccacaaaccattttcgaccatgataaaattatttggttaggagatctgaactaccggcttgctgccggttgcgccgatacgtacgaattactgaagaagaatgactggcaaactcttctagagaaggatcagctaagattggaacaaagggctggtcgggtgtttaaaggatgggaagagggcaggatatacttcgccccgacttacaaatacctaactgattccgacgactatgtcgtccaaacatcgaaatccaaagaaaaacggcgtaatcctgcctggtgcgataggatattgtggaaaggcgagggacttaagcaaatgtggtactcaaggggtgagtctaggttctcagatcacanggccggttattccctcttctcagtacaggttaatttagccaagaatcccaactacaacgctagatcctgcccaccgacat

SEQ ID NO: 8311 - DNA, 450 bp, Gossypium hirsutum
  unsure (1)..(450): unsure at all n locations
  Clone ID: uC-gsronu33B149h07b1
tatgttgtggctaggtcatcggagtatcctgaggggcagttgattacagataagttgttggagacattggaggaatttgtgagggatagagctaaaaagccaacgagtccagagagaaaggagcttcctcctccacctaaagaggaagagcttgaaccaaatatgaatgaaataaaggcgctacctgcacctgagaattatgctccaccaccgccaccatcagagccggagcctgttaaacctgcagaaccccaggaggatttagtgaatttgagggatgatgttgtcacagccgatgatcagggaaacaaatttgctttggctttgtttagtggtcctgcagcaaataatggtaatggatcatgggaagcattcccatcaaatgggcagcctgaagtgacatctgcttggcanaccccagctgctgaaccagggaaggcagattgggaa

SEQ ID NO: 8312 - DNA, 512 bp, Gossypium hirsutum
  Clone ID: uC-gsronu33B150a09b1
tatatattgcccgcaattgtgttttgatttagtatttgagcaaggctttgagctctctcacaactggaaaaatgggagcgtctatttccttggttacaaagcttttgtcccagaggaaggctctgatgaggaatttgatagtgaggaagaaagtagcgaggatgaggaacttcctgtagctgctgaaaacggaaaagctaagacagatgcaaaaacagccaaagctaatgctgggaaacctgatgctgtaaaacaagctgtcaagatagcagaaccaagcaataacaagaaaaatgaggacgatgatgatgatagtgattccgaggatggaagtggttctgatgatgaagatgattccgaggatgaagacgaagagatgtctgtggatgaaagttcagatgaggatgaggagacacctaagaaggttgagtcgagcaaaaagagaccagcagaagctgcaacacctgtttctgcaaagaaggccaaacctgcagcgacacctcagaagacag

SEQ ID NO: 8313 - DNA, 469 bp, Gossypium hirsutum
  unsure (1)..(469): unsure at all n locations
  Clone ID: uC-gsronu33B150a10b1
ttattgttggataagattcaacagaatctattcgatgtggcaaaacaaaaaagagatgcctgcattgaagttgtaaaaacttgggacgagtttgtaaaagctctcgggcaaaagaaactcatcttagctccttggtgtgatgaggaggaggtggagaaagatgtgaaaactcgaacaaagggtgagatgggagcagctaagtctctttgtactccattcgaacagcctgaactcccagaaggtactaaatgctctgcttctgggaagcctgcaaaaaagtggacctattggggcagaagttactaagattatttgccttttgataaccgtctccttctcatggtccatcggcttgggtcatcgggccgttctaaacagggaagttttcaatttaaaatcatgtgagactgattagaggattcagttttaagcatttattntcctttttttttttggtcgaatttgcttt

SEQ ID NO: 8314 - DNA, 506 bp, Gossypium hirsutum
  Clone ID: uC-gsronu33B150b02b1
gccagttcacttgatgtatgatggcagcgatgaaaaccttttctaccactactcgtctgtcgcacaaagaattggggtttacactgcccgggactatgctgatatagttgaatatctggttgaccgatggaagttgaaggaactcattggactttcacccgagggccgtgaagctcaggaatttgtgtgtggacttgcaccgagaattagaaagctagaggagagagctcaattgaggaccaaggaatcacccagtgttccattcagttgggtttctggtagagaagtgaagctctaaattggctatcctccaagtgacttgtaatacaagaaagaaacaacagggcttagggaggagcatgatgaaaactgcaactctgtgtttagctggaatgcaataagtggaggaagtgtgtgtgtgctttttcgttgttacttttcttaaaacaggtaatatcaacatcttccttctatttgatgaaatggataacgatatctataggcat

SEQ ID NO: 8315 - DNA, 116 bp, Gossypium hirsutum
  Clone ID: uC-gsronu33B150b06b1
catgctacttgatatcttatagagagagctacctacatttaactgactggccgttgacaaccaacggactgactgaaccatcccgggagctacctaaatcaattggctggaaatac

SEQ ID NO: 8316 - DNA, 502 bp, Gossypium hirsutum
  unsure (1)..(502): unsure at all n locations
  Clone ID: uC-gsronu33B150b11b1
ccctcgcgtccgattccctctgtttcatcaacaatacaaaaagaaactcatctctcttttcttacctcctcctcctctttcccaagcaaaaccaaaagcatgaagaaatcttgggcgctaatcgatgcagcctcgtggggtatcggcgcagccttattggtcttaatattgataggttccatcagcgcaaactctgtatcggagaaagcagatgtgaaagggatgagccaactgttgaaccgaccttgtgatgaaatctatgtggtaggagaaggggagacccttcacacaatcagcgacaagtgtggcgaccctttcatccttgagcgcaaccctcacatcaatgaccctgatgatgttttccctggccttgttattaaaataatttcttcacctgctagaaaactatagactggttttggtcgnncttcttttttcttcttctttatcatgtgaaataggagataaacgcctttgtgataagttcaaggctcaatcaaac

SEQ ID NO: 8317 - DNA, 133 bp, Gossypium hirsutum
  Clone ID: uC-gsronu33B150c01b1
cccacttgtccgcccacgcgtccgatagaagccatggggcgtaatgtatataaatggaatgaaaatgaagaagatttaaaaaaaaaaaaaaaaaaaaaaaaaaaaaaaaaaaaaaaaaaaaaaaaaaaataaa

SEQ ID NO: 8318 - DNA, 518 bp, Gossypium hirsutum
  Clone ID: uC-gsronu33B150c02b1
cttattttgatcatagagagagaggagagatatggcggctgttttgagagttgttgttgctgtggatttctctccaagcagcaagaatgcgttgaaatgggctgtggataacattatgcggaaaggggattatcttatccttgttgccgttcaacctgaaggtcattatgaggaaggcgagatgcagctttgggcaatcagcggtggttcaccacttatccctttaagtgagttttctgatcctgctaccatgaagaaatatggagtaaagcctgacccagaaactctggatattgctaacactgctgctaagcaaaaagaagtcatggtggtgatgaagatatactggggtgatccacgtgagaagttatgcgaggccattgatagcatccctcctagctgcatggctgtaggaaatagagggcttggcacgcttacgagggctataatgggcagtgtgagcaacctatgtggtgaacaatggttctctgccggttactgtagtgaagcaccatggc

SEQ ID NO: 8319 - DNA, 550 bp, Gossypium hirsutum
  Clone ID: uC-gsronu33B150c07b1
tattatttgaagtctggccatacttggaaacctacacagaggatgttgctcatgaaatctccaaagagttgcaaggcatgccagatctgatcatcggaaactacagtgatggcaatatcgtcgcctccttgctcgcacataaattgggtgtcacacagtgcaccatcgcccatgctttggagaagacaaaatatcctgattcagatatctactggaagaagcttgaagacaaataccatttctcttgccaatttacagctgatctttttgcaatgaaccatacagatttcatcatcaccagtactttccaggaaattgcaggaagcaaggacactgttggtcaatacgagagccacactgctttcactcttcctggtctctaccgtgttgtacatggtatcgatgtgtttgatcccaaattcaacattgtttcccctggtgctgatatggagatatacttcccttacaccgaagagaagcggaggttgaagcatttccatactgagatcgaagacctttttacagcaaagttgagaatgaagacacttat

SEQ ID NO: 8320 - DNA, 525 bp, Gossypium hirsutum
  Clone ID: uC-gsronu33B150c09b1
tttggattcaacgattctcttccctttcatgaccacgagtatgtctcgtagctgctctcactgtggaaacaacggccacaactctcgtacgtgcggtgaagttgttgccggtgatgcaagcaatggcagcggtggaagtggaggaggagaagagaagggtatcatgttattcggtgttcgagtcatggaagggtcgttcaggaaaagtgttagcatgaataatctttctcagttcgatcaacctcaggtttctaacgccgatgctggctatgcttctgatgacgttcttcatggatctggaataggaagaagccgtgaacgcatgagaggtgtaccatggacggaagaggaacataaattatttttattggggttgcaaaaagtagggaaaggggattggtgaggaatttcaagaaattttgtgaagacacgtacaccgacccatgtggctagtcacgctcaaaagtattttcttaggcgaaataacttgaatcgaggccgtcagatctagttttatgattaaca

SEQ ID NO: 8321 - DNA, 340 bp, Gossypium hirsutum
  Clone ID: uC-gsronu33B150d06b1
ccttcttgtccgcgagaattggatcagcgctactcttgtccttactcctctcgttggaacctacgcatatgtccagaacttcaaagaaaaggagaaattggaacacaggtattaaaaacctcaggaagcatcccttttatcggagtaactctgagcttttatgttttagatgcaaatttattgtggttcgatccaatgatgaatcatgtcttttgtttgggatctgattagtatcttaccgtttgagttggtgttttgttattcatatggaataaatgaatttggaacagtgtctgcattttcggtaaaataaatttgttgattcgccctttcaaaaata

SEQ ID NO: 8322 - DNA, 443 bp, Gossypium hirsutum
  Clone ID: uC-gsronu33B150d09b1
tttacaccacctatgtttgtttctttgggtgacgcaaatggaaagaattggacacttggttgtttgtttttgatcggtcattgcttgtcttggtctggttggctagtgttacaagcaccggtgctgaagaagtacccggctagactctcggttacgtcctatacatgtttctttggtctcattcagttccttgttattgctgcggtttttgaaagggatgctcaagcttgggtttttcactctggtggtgaactcttcactattctctatgcgggagtggtggcatcggggattgcatttgctgtacaaatatggtgcattgacagaggtggccctgtcttcgttgctgtttatcaacctgttcagactcttggtgtcgctattatgtcttcccttgctttaggcgaagagttctatttgggaggtattataggggcagtgct

SEQ ID NO: 8323 - DNA, 522 bp, Gossypium hirsutum
  Clone ID: uC-gsronu33B150d10b1
ttttcgcgtccgcccacgcgtccgattccgaagggggtttataaactatgccatgaagtggatataaaatgtattgatctttggactgcaatccagcaaagagacgactggaagacagtttgctttacggatggcatccatctatcctccgaggggagcaagttagtgggtgaagaaatattgaaagccctggcagaggaaccaagtttatgctggagatcattgccgactgaatttgatgaagattcagtctttgatcctgtcgatgaagaagggaagaacattaacatttcaaacctgtagttttccaccatgtgccaaatgggaataattccctcaagcccttatcaagtttggttgcctttttcgttttcctttaatgtttgacttctcctatagagaaacatatgattgcagagaggtcttcctagtatctattccatgcaatattaaactggaattgtaagtgggccacgggatggaaataaaatgaaattcctagcaaaaaaaaaaaaaaaataa

SEQ ID NO: 8324 - DNA, 502 bp, Gossypium hirsutum
  Clone ID: uC-gsronu33B150d12b1
tctatcgcgtccggggatgtaatgtcaaatgaagaggccggtcaggtagctcgccgcctactaatacggcgacggcggagggcattgatgggcgaagttgatgatagagtttcaccggcacaagcggtagctgataatctcacggcaatagccataggaagaagcagttgtgataatatttcggtcatcgttgtggatttaaaacccaagaggaaatcgccatccaatgcggtgaaaaaaagataaaattaaaaaagttggttctgcaaaccatattaatccacacattcaagtggttccataaattgagctgatttaaaataaaacaaaaaaaaatcatcaaaacggtacacatctatttcttttgtttttccaaatattatttctttttcccgatttctccttggtaaatttagtgggagatgggagatgttaggaagccttgtgtgtctttttatcaccactctttttttttttttcttgtttgcttgataataaaaca

SEQ ID NO: 8325 - DNA, 551 bp, Gossypium hirsutum
  Clone ID: uC-gsronu33B150e04b1
taacctttaacacccccacctctttatatatatagcgccaccattatagtctccaaaaaccagtaagaatcaaccacttcgataatggccatgcataacctagttcaagctcttgtttttgttgctgtttttttcaacacattggcacccacagtcgcaaatgttgaaggggatgctttgtatgcattgaggagaagtgttaaagaccctaaaaatgtgctcaagagttgggatccaaccttggtggatccttgtacttggtttcatgttacctgtgatgctgataatcgtgttactcgtctagatcttggaaatgcaaaattgaagggcagattggtacctcagttgggaaagcttgaacgtcttcaatatttagagctgtatatgaacaacttggagggttccataccagaagaaattggagggttaaaaagcttagtgagtttggatctttacaataataaccttactggatctattcctgcttctctttccaagctctccaatcttaatttcctccgattgaatggtatagactgacgggaagaatt

SEQ ID NO: 8326 - DNA, 519 bp, Gossypium hirsutum
  Clone ID: uC-gsronu33B150f03b1
gcgcccactcttgcgttttcatctacatttcgccccagaaattatagtaaaacagagacaatgaatggagcattgatgttgagttggattctgatcatctgcctctcccaagtagcagttcggagccaatactactcagatacccgaccatatcatcccaagccacctaaggtcaccaatcttcacttctttatgcacgaacatacgggtgttacagcagtcgtgctaacccaagctaacatcacaagcaataattcatcagtgacatttgccaccctagttgctgttaatgatcctctcaggactggtcctgagcctgactcagaggtgattggaaatgttcagggtattttcctcttagccggatcaaatgcattgagcacgcagtacatagaatttggatttaataccggtaagtttaacggcagctttctaagcgtattttcaaggggagaaccaaggcttgcggtggtcggaggaagaggacgattcatgatggcaaaagggactgcactattt

SEQ ID NO: 8327 - DNA, 579 bp, Gossypium hirsutum
  Clone ID: uC-gsronu33B150f06b1
gtttgttgagaattgtctaaagataaattatcatgccgctatacctctttgcactccattccattggatcaaagcttgaagattgtaaaggactatttgatagctgcaactgcaaaggactgtagtctgatgattagttttagaccaaaggaagatggtagactcccttctcacaatactgtatatctaggatcaactaaccaagcttttgagtacaaggtgtatttcattgatctggatctgaaacccctgaagaaaatggaggcttattacgagttagataagaaaattgttagctgctattctcagatggtgaaaactgagcatgaaacagataaagctgttacaataaactccaatggaagtgtacgagatcaaagatacgcattagaagacggtttgtttactgaaggttgtactggtaagtgcaagtagttcttattatatgttccctgaactgttgctgtaaacgtaaaggttgcaaggagccaagatgattaactcgttaataggctcgagttcttcctttcaccacttttttgggcttttggatttcccttggaaaataatctcttgatg

SEQ ID NO: 8328 - DNA, 386 bp, Gossypium hirsutum
  Clone ID: uC-gsronu33B150f12b1
tattaattttagttgcagcagcggcaaggagcaaatttgcataggtctcctcggtcctttgttttatttttctctttatatatttttttacctctactttggtgattgattataagattataacttgcatgctgatgaacctatattcactgaaattgatttgtgaagaaatctggaaaaagagtaaaccagaggaagaaaaccgctgaatctgtatgtgactgtctgacatagagtgctattatttccctctgcttagagatgaactaaaaagaaaggaatgagaaaaaaaaaaaaaaaaaggaactattgactatgggctaaccttttgtcaggttttctttggagtggccagtggttatgttggttgtataggagtgcctttt

SEQ ID NO: 8329 - DNA, 528 bp, Gossypium hirsutum
  Clone ID: uC-gsronu33B150g10b1
gtttctagcaagagaccagtcccagccccagcggtttgagtgcttgttttttgctttaaccatttgcggttcaattcctttgttcgattgttcctcttgcagcttggccatcagcagcagggtggatgtgggattttttacagtgaaacaacaaaaatggatatgtatcatccaagttcaaggctctcatcacaagaagaaatgcttaataatctcaatcgcaaaggtataggagagccttacctcgtcttgacttccgatcctaagcctcgtctccgttggactgctgacctccatgaccgattcgtcgacgccgtcacacaacttggtggccctaacaaagctacaccaaaggctatcatgcggacaatgaatgtgaaaggattgactctttttcacttaaagagtcacctgcagaaatacaggttaggtaagcagtcagggaaggatatgggtgagggaccaaacgatgggatatcagcttcatatcttttagaaggccctggaaccaataattctaccattaac

SEQ ID NO: 8330 - DNA, 467 bp, Gossypium hirsutum
  Clone ID: uC-gsronu33B150h02b1
ggcttattttcaaaattgcacatcagaagagccggtgggttttttaccaataccattggaggaaggaaatatcaaaggaattgtatgagttctgcttggaccaaggctatgctgaccgcaaccttattgctaaatggaagaagccgggttacgagcgtttgtgctgcttgagatgtatgcagccacgggatcacaactttgctacaacttgtgtctgccgagtgcccaagcacttaagggaggaaaaggctattgaatgtgtccattgcggatgcaagggctgtgcaagcggagattagattcaccttgttctttttccctagttttctaagtcaatgagagaagtttaaactgtagttgctgccacactgctcattaatttctgtaattttatttgcactgctgtagtttctgaatctgaatcttgcgatgatgctatgtctggagaacctgtgtacaacttgctg

SEQ ID NO: 8331 - DNA, 432 bp, Gossypium hirsutum
  Clone ID: uC-gsronu33B150h03b1
ccctcgtttccgatgaaaataaaacgttattgcgctaatgcttctataattgcaagatcatgaacctagattaccagggtagaaattctctgtttcacgtgaaaaaggaaaaagcttatttgtatagcatagaagtagggaaggcaaaaggtatttagtttcccatttcatattatttgtatttatcatttcttaaccctccaaagagatctatatcagtagttgatattgtagaaaaaaaaaaaaaaaaaaaaaaaaaaataggagacatttgactttaccgaacagacaaaaaactgaaaccgactgtccaacctgcacagaggatgaacggactccctattcaacttatgcaccttgtaccccgtggccctcgtctatcgctccggggggtgggccttcttgggagttagatcaaccctcaacacgacc

SEQ ID NO: 8332 - DNA, 492 bp, Gossypium hirsutum
  Clone ID: uC-gsronu33B150h04b1
gaagtgtcaaaacccaatattgtagaggtaaacattgtgttgaaaaatggaagaacagatggtatttgcatgggtaatgatattttgcctcgccatagcaccagtctatggccaacactactccaaaactattaagctaggtggtcgggtggaaaagaagacgcgactccgcttcttctaccacgattttcccggtggcaaaaatcctactacagtgctgttagctcaggccaacatcacccaggatttcttttccccatccccatacagcagcttgtatgcaatggatgatcccctcactatagggcctgaacgaacatccaccaccatcggaaatgcccaagggctctacatagcattaagtcgagatcctaacaagttcactgcggttttatacgcggattttgcttttactaccggcaggttcaatggaagctccttcagtttgttctcacgatatcccctcactgattttgttcctagccccgacac

SEQ ID NO: 8333 - DNA, 416 bp, Gossypium hirsutum
  Clone ID: uC-gsronu33B150h06b1
ccctctcgtccgaaaaaaaaaaaaaaaaaaaaagggggggatttataaaaaaaaatttgggaaaaaaaaaaaaaaaaaaaaaaaaaaaaaaaaaaaaaaaaaaaaaaaaaaacaagaagaaaaaaaaaaaaaaaaagggcgggccacaaaaaaggggcggggcttccgaaggcggcaaggagcctgagacctgtctggaggggccccaaaatgtaaatgagggggccaggactataaaccggggggggggggaaaacccaggggatgacaaaaaaaaaggggctggaaaaaaaaacccaacgtgacgacaaagggaaaaggaaaaggggcgaaaaaaacaaaggggcccaaaaaggggccccccaaaaagggaaagggaccccgcccggcaagggcaccaccacccggggggggga

SEQ ID NO: 8334 - DNA, 472 bp, Gossypium hirsutum
  Clone ID: uC-gsronu33B150h07b1
ttgttattataatcacgattgtggcgtcgtcagggggtcatcataacaacggtttgaatgaaaagacggaggagctgatgcagcagcagccgagatcgaagatcttggtggaaaagcggcctgatttggagtacgagatgaagagcagcttggatttcgatgcggtggaaacggtggtgtacgagcaaaaggagatagtacaagaggtgaaaacgacggtttttgaggcggagaccaatgtagcggttgtagatgatggagatggaggtgacgtgtttgctatctccaaatcggagtggaatcctcctaggagaatggatttgtcggagattccgttggatgttctgtttccggttgaaaaaccaccggcttcttctagattcggtcaccgtaaacctgttaaagccaatcctgaaggtggccgagcatcgaaagtggcgaaacccaaacgccatgagacactggagaacac

SEQ ID NO: 8335 - DNA, 572 bp, Gossypium hirsutum
  unsure (1)..(572): unsure at all n locations
  Clone ID: uC-gsronu33B150h08b1
ttctcgcgtccgcccacgcgtccgacagcaaagacgttttatgctgcgagcattttctttgagattattagccagtttggtcctcttcagcctgatcttgagcagaaacagaagtatgccgcctggaaagctgctgatattaggaaagctttgaaagaaggaagaaagcccacctgtggccctcctaatggtgatgaagatttgtctgttctatcaagtacacatagcggttcatatgatcatggacctggtgaacttccagttaccagtcccaggcaagattctgatccgtcaccacagttccatgatgaaataaataaccagcaccaagctaatattccaccgtcaactcagttccatgataagattgaccggcagcattctttcgatattttagcatcacatccttcatttcctcctcgcagttacccttctcatggacaatcctttccacaagatccncaaagacgctttcctntaccacctnccacaagcangtccgaagaatctacatatccccatgcataccaccatcaaccctattcacaagaaccgcaccacatttgcacata

SEQ ID NO: 8336 - DNA, 426 bp, Gossypium hirsutum
  Clone ID: uC-gsronu33B153a08b2
caatgtgtgatcctcgccatggcaagtatatggcttgctgtttgatgtaccgtggtgatgttgtgcccaaggatgtcaatgctgctgttgccaccatcaagaccaagagaactattcagttcgttgactggtgcccaactggattcaagtgtggtatcaactaccagccacccactgtcgttcctggtggtgatcttgctaaggtccagagagccgtttgcatgatttccaactcaaccagcgttgctgaggtgttctcccgcattgaccacaagtttgatctcatgtatgccaagcgtgcctttgttcactggtacgtgggtgagggtatggaagaaggagaattctcggaagctcgtgaggaccttgctgcacttgagaaggattatgaagaaagtcgtgctgagtcaggcgagggtgatgagg

SEQ ID NO: 8337 - DNA, 344 bp, Gossypium hirsutum
  Clone ID: uC-gsronu33B153a10b2
tgcaaatatgaagggttgtaaaaggttcgtgttgattgctgttggaggtcttggatcttgggatgagccactgaattctggtgaaatctatgattctttatcaaataaatggagtgaaatccagaagctgcctatagactttggggtcgtttgtgctggtgttgtttgtaatgggatgttttatgtttgctctgagaatgacaagttagcgggctatgacatagaaagaggtttctggattggaatccaaacctctgcatttccttcccacgttcatgagtactatccaaaacttttttcttgtcatgccaccttgattctgctgtctgtctctggttgcgagg

SEQ ID NO: 8338 - DNA, 574 bp, Gossypium hirsutum
  Clone ID: uC-gsronu33B153a11b2
tctctgtttctctttcttctctaattattgaggaaatgcaccgatcaaagttgttcaaatcgtgggtgaaagttttgagaaactaaaatggcgtccacattcagcggcgatgaaactgctccattctttggcttccttggggccgctgctgctctcgttttctcctgtatgggagcggcgtacggaacggccaagagcggtgtctgagtggcgtcttttggagttgattgtggccagtgtttgttatgttaatccatcgtcctcgtctttatggcttgtttttttggtttttatgtctcttattcttcctcttatttttgatctctttctttagttattctttcatttttatttctttttttttatttttcaatgtctatttttaactttattttatttttctcgtttttctatttttccttttttttacttatattttttttccttttttatctttattattctttctatattttctttttctttcttacttttttcatttctatctatctcttccttttttatcttttctcttcttttactcctctctttttcttataatggtatactttct

SEQ ID NO: 8339 - DNA, 564 bp, Gossypium hirsutum
  unsure (1)..(564): unsure at all n locations
  Clone ID: uC-gsronu33B153b04b2
gggttacattactcttttacgtggtatcctttattggattgctcaactccttggctcaaccgtcgcttgcctgttacttaagttcgccactagtggcctgggagtaccagctttcggactatcatccggcgtgggagcattaaacgcgttcgttttcgagatcgtgatgactttcggactggtgtacaccgtttacgccacagccgtcgatcctaaacgaggcaactngggagtgatcgcaccgttggcgatcggtttaatcgtgggagccaatattttagctggtggggcattcgacggagcctcaatgaacccagccgtttaatttggaccagccttggttagctggtcctgggaaaaccactgggtgtatttggtctgaccccttattggtggtggcctcgctggtcttgtctttgagtaaattttaattaaacatacccatgtactaacttccctatttttagtcaataaaacttcgcggttttaattttggtaatctttttttgtgtcttaattgagcccgtcgacttgttacttctcctattacatctatcttaatta

SEQ ID NO: 8340 - DNA, 548 bp, Gossypium hirsutum
  Clone ID: uC-gsronu33B153b08b2
tagtatcggaactggttacgatctctctgtcaccactttctctcccgacggacgcgttttccagatcgagtacgccgccaaagccgtcgataacagcggaactgtgattggaattaaatgcaaagatgggatcgttatgggagtggagaagctgatagcatcaaagatgatgttacctggttctaatcgtagaatccactcggttcatcgtcattccggcatggcggtggctggattagcagctgacgggagacaaattgtggcccgtgccaaatctgaagctactaattaccaaagtgtgtatggtgaacccattcctgtcaaagaacttgctgaacgtgttgcaagttatgtgcatttatgcaccctttactggtggctcaggccctttggctgtgggataattctcggaggttatgacagagatggtccccaattatatatggttgaaccatctggcatctcctatagatattttggtgctgcaattgggagggaaagcaagctgccaaacggaaattgaaagttgaagctgtcagaaatgacct

SEQ ID NO: 8341 - DNA, 453 bp, Gossypium hirsutum
  Clone ID: uC-gsronu33B153b10b2
tgatatacagacccagtgatggtcgccgtgcatcttgcaaaagaaaagctcttgaaggaaacgttgggcagtcctcttcgagtggaagttctagctacttccattgtgcagaaagtagcgccgggcatggtgtttcttctagttctagtgtaggaaacggcatgaatatatctgcctcctcgggacaggcacaccctagacttggtttagaggtgggaggatcaggttctgatgccaaccctggaccaatcgttttaccagctgcaaagggctcccacaggaacttccggctaagaataagtccatcaagcatacaggaaccctattgctcctcgggtattttctacaggtgatatgaacaggcgggtctgttatttcgccttcacagcaattcgcaaggctttcaactgatcattctttgcacataaggtcagcaccagtgctagataatgc

SEQ ID NO: 8342 - DNA, 505 bp, Gossypium hirsutum
  Clone ID: uC-gsronu33B153c03b2
cccacgcgtccggaaaatatctcaaatctcctcctcctcctcagaaatcttagtatcatcaccatggcctcaaatcccaaggtcttctttgacatgactatcggtggtcagcccgctggtcggattgtgatggagcttttcgcagattgcactcctcgcactgctgagaacttccgtgccctctgtaccggcgagaaaggcgtcggccgcagcggtaagcccctccactacaaaggctcctctttccatcgtgtgatccctaactttatgtgccaaggaggtgacttcacggccggaaacggtaccggaggtgaatccatctacggatccaagttcgctgacgagaacttcatcaagaagcacactggtcccggtattctctcaatggctaacgctggtcccggaactaacggatctcagttcttcatttgcacggctaagactgagtggctcgaccggaagcacgttgtgtttggacaagttgttgaaggcatggatgtgggtg

SEQ ID NO: 8343 - DNA, 462 bp, Gossypium hirsutum
  Clone ID: uC-gsronu33B153c04b2
gtttgtttattgaattctttccttcactttctctagaaaaagaaaatgtcttcaggttgcaattgcggatctaactgcagctgcggtgacaactgctcatgcagcaggaaccttaaccttggatactcggagaagacaaccagcactcagaccatcatctccggagttgcgccagtaaagatgacctttgagggaccagagatgagcactactgaatcaggacatggatgcggctgtggatcaaactgcaaatgtaatccatgcaactgctgaaaagcttgatgaaagccatagattatgaaaaaagaaagcagcaaaataacaggccctctgtaatgatttattttcaaggatggatgcgtgcaaggtctataattatgtctctgtctgtcttgggaatagaagctttgtttgtggtaaaaataatgtataagcaatttggttgggagcaaatttcctttt

SEQ ID NO: 8344 - DNA, 481 bp, Gossypium hirsutum
  Clone ID: uC-gsronu33B153c05b2
gttttgttcatcgaagctgtctcggattatgaagttaaggagttcgaacgagctccacggttcgtaactcagtggaggaacttcttgtcggtccacgtggcggatgtcttaaaaggggccccaccacttgtcgtccagctgacttggcttaaagacggcaatgctgttgtcggtgtcggcattaatcattgcctttgtgatggtatcggcagtgctgagtttcttaactcgtttgctgagttagcttccatgagtcaaaccaagttttctgagttcaagtttaaacctaaacctgtttgggatcgccaccttctaaaccctccgccaccattcaggccatcaagaaataaataataactcgcccagtcaccccgaggttcgaccgagtcccagacaatttcgggttcatggctcgtttctccaacaaaaacttgtcccacttcattcattttaaaaaaacaaatccttgcctagttaaaaa

SEQ ID NO: 8345 - DNA, 538 bp, Gossypium hirsutum
  Clone ID: uC-gsronu33B153c08b2
gtcaggaagctctccacaaagcttctatcgaaaatgccaaagcaaattcatgagatcaaggacttccttctcactgccagaaagaaaggtgcatgctctgtaaaaatcaagaagagcagagacgttgtaaagttcaaagttcgctgttcaaagtacttgtatacactttgtgtgtctgatgctgagaaggctgataagttgaagcagtctctccctccaggtttgagtgtccaggacctgtgaaaatagggccgctttgaattcatcatccaattactaggtgatgaaagctagattttgactttggttttatcatatttcatgcctttcaaactcaaaatttactgaaatggaggtcgagttactttttaatggttaatgaaagtgttttgcttttgggtgtcctatgctcttatgttttctcgtcttctggaaaactgaagatctttcacttgttctgcaagtttatgttgttttgacttgtggctatcaggatttgaattggattttttttaatacgaaaaaactgacttttcct

SEQ ID NO: 8346 - DNA, 441 bp, Gossypium hirsutum
  unsure (1)..(441): unsure at all n locations
  Clone ID: uC-gsronu33B153c12b2
tccacgcgtccgctcaattctttcatcccttgttttgcttcaacccaaacaaaacctaatctttttgaaaaaatggcaccaaaagctgaaaaaaagccagccgagaagaagccagccgaggagaagaaagccgtagctgagaaagccccggcagagaagaagcctaaggctggtaaaaagcttcccaaggaaggcggagcggctgccggagacaagaagaagaagagagttaagaagagcgtcgagacctacaagatctgcatcttcaaggtcctgaagcaagttcaccctgacatcgggatctctagcaaagctatggggatcatgaacagtttcatcaacgatatcttcgagaagcttgctcaggaagcctctaggctcgcgaggtacaacaagaaacccaccatcacttncaggggaatccagaccgctgttaggctt

SEQ ID NO: 8347 - DNA, 494 bp, Gossypium hirsutum
  Clone ID: uC-gsronu33B153d02b2
agcttattctgtttcttctctcagtgaaaaccccatcagttgattttttttttatttccatggcttctcttgttcttttattgtctgaacttgttcgtcaccatgaaccaaactttggtcttgtagcaccatctaccccttcttcttcatgtggtgcttcaatgtcttgtactgccattgatgccagcaagtacgaaccagagattgtagaagaagatccacaagagctaaaggtttctgttgacctcgtctggccatagtgttccattactatgatttgatgcatgcatgcatgcaagccagatttctatggtttctgagctcatttttggcgtgtcatcattttattacatgtacaaaactaggaagaataatgtctttatgtaacacaactgaacccaacttgggtttcaattaatgtatttaatctttttcattctctttgtagaatgattggtaatcgtttcttgaatttgaattgtccattcttatgc

SEQ ID NO: 8348 - DNA, 487 bp, Gossypium hirsutum
  unsure (1)..(487): unsure at all n locations
  Clone ID: uC-gsronu33B153d03b2
cgtgttattcttgtgtgcaaccatgcatgtagaaccgtgcagagttctcaggtggtggctccaagagctgaacccgatgacaacaccatggatatgctcttagttcacgggagtgggcgactccggttgatgagattttttgtgctactacagatgggtaaacacctttcactgccatatgttgaatatgtcaaggtaaaatctgtcaaaattaaggctgggaaatgcacgcataacggttgtggcattgacggtgagtatttccccctcaatggagaagtagtgtcatcgttgcttccggaacagtgcagactaattggtcacttccgtggccatcatgatgtctgatgaagagattttttatttatttgaaatgttcttgtcatatctagaatgcaaaaggctccctacangactcacggctctgtgagtatgcggagtatgcttaagacatatttngtctgaatattatattatatcacatgtg

SEQ ID NO: 8349 - DNA, 499 bp, Gossypium hirsutum
  Clone ID: uC-gsronu33B153d07b2
tgttccggttcatggacccaccttgaagactgccagggaagcagcaaacatcgccttatacggaagtgctatcggagctatcacaactgcaggttttgcctggaaatactcgaagagtttacatggtgctggactgtctttcgtaggaggagccgtttttggttggacatttggacaagaaatcgcaaatcatgcgtatcaactctacaggttggacacaatggctgcacaagccaaatttatggattggtgggaaaacaagtgccggaggtgatctttaaaaaaccttattgtgatgtcgaaagcagcacctggactcgctttccatttggttaaataatggcggcatgtcgaaaacataacgtttggtccaatgctttggcttttgttataaactttcgcatctgagtttgaaaggatttggagttgacttatttttcccttttggaagcaacttgacggaaccagttgtttacattacagtactttgaataaattt

SEQ ID NO: 8350 - DNA, 424 bp, Gossypium hirsutum
  Clone ID: uC-gsronu33B153e01b2
tatgaccactgtccattcgattactgctactcaaaagaccgttgatggtccatcaatgaaggactggagaggtggtagagctgcttcgttcaatatcattcctagcagcactggagctgccaaggctgttggcaaagtgttgccatcattgaatggcaagctgactggaatggcattccgtgttcccacagttgatgtctctgtagttgacctcacggttaggcttgagaagaaggcttcttatgaagatatcaaggccactatcaaggcggaatctgaaactaatttaaaaggaattcttggctacgtagatgaagacttggtatcaactgactttgttggggacagcaggtcaagcatctttgatgcccaggctggcattgcattaaatgacaattttgttaagcttgtcgcgtgggacgat

SEQ ID NO: 8351 - DNA, 355 bp, Gossypium hirsutum
  Clone ID: uC-gsronu33B153e08b2
cccacgcgtccgaccgggacccgcaaattgtagcttcttaaacattttgaaactcgactataacagcttgacgggttcgattcctccagtactcagtttgctgaataggataaaaacatttagcgtgtctaataatctcttgtcggggcaaattccatattttaatgttacattaacggcagaggattttgcgcataatcctggattgtgtgggaagcctttggatccttgtcagttgacttcaaaaggccctaaaactggaattattgctggggctgctgtcgctgggttgacggttgctgcaataggtgtggctattggtatgttcttctattaccgtagagtatttgttatg

SEQ ID NO: 8352 - DNA, 435 bp, Gossypium hirsutum
  Clone ID: uC-gsronu33B153f07b2
tgtttccttcacaatgaggtgtttaagactcaaagtttgtctatggagattcttggttctatggtgattttgcttgtaatacttacgtagctcgtaaacctgattaagttctatatttgtattcttatttttatcgattctttaaaatattcaaacttaagcttgaaatctgttttaaataagtaattctttgtattctttcaacagaatatttatttatttatttataagtttgtaaaaatatattttcatttaaaaaaaaaaaaaaaaaaaaaaaaaaaaaaaaaaataaaaaaaaaaaaaaataaaaaaaaaaaaaaaaataaaaaaaataaaaattaataaaaaaaaaaaaataattaaaataaattaagggggcggcccttttaagggatccaattttacttcccgggttttggccagattaattttttt

SEQ ID NO: 8353 - DNA, 440 bp, Gossypium hirsutum
  Clone ID: uC-gsronu33B153f08b2
cttctttcctcctagcccaaaaaaaaaaaaccctctttcctttctctcgttctttttcccgttcaatcatgtcttgcttcattagcaaatatgccgatgagttggctaaaaacgctgcttacattggaacccctggaaagggtatccttgctgctgatgaatccactggcaccatcggcaagcgtctttcaagcattaatgtagagaatgttgaagataacaggcgtgctctccgtgagctcctattcacaactccaggagctcttcagtacctcagtggtgttattctctttgaggaaaccctttatcaaaaaaccgcttcgggcaagcccttcgttgatgttttgaaggaaggtggtgtcctccctggcatcaaggtcgacaggggtcctcgtgagcttaacggaaccaatggcgaaactttcacccagggtctagat

SEQ ID NO: 8354 - DNA, 482 bp, Gossypium hirsutum
  Clone ID: uC-gsronu33B153f09b2
cttcgttcttccatctcctccgagatccgtaagaactctcatgttactaaccctaaggtaattgatttgctgctgtttaagggtatggaagagctgaacaacattgttgaacatgcaaagcaacggcaccacattatcgggcagtatgtgctgggtcgtcaagggcttgcacaggatttggacaccaaggatgaaggcacgtctgagttcctcaagaatttctataaaagcaactacttttaaacattccgctttcatggacagcttctagagatttgctttcgagcttttgacttccttcataataatgttcctatccgtgcctattggttctgtaattccatcgaatttttctcgtgttggttttcagtaatttggtgaaatgcataagtgaattctggtgaattgctgatcaggatagtgtattatattgccaaatcaaacttggcgtttttttcgttcaaaaaaaaaaaaataaaaag

SEQ ID NO: 8355 - DNA, 557 bp, Gossypium hirsutum
  Clone ID: uC-gsronu33B153g03b2
aattaggtgagaaagtctcgagcttggaagttaactgcttttcagcgcttggatttcacttgtgatgatgtgttggactgtttgaaggaggatagtatcatcggaaaaggaggtgctgggattgtgtacaagggacttatgcctaatggtgatcaggttgcggtgaaaaggttacccgcaatgagccgagggtcttctcatgatcatggattcaatgctgagatacagacactggggaggattaggcacaggcacatcgtgagactgttgggcttttgctcaaaccatgagacatatcttttgttgtatgaatatatgcctaatggaagtttaggagtggtttttcatggttagataggggtgtcatatgtcttggattcctaggtttttgattcctcgttgattcttataatgttcttttctttctttatctttttttgttctctctatatatctttttccatctctttatctttatctttctctcttactatctcttctttcactactgtattctttattttctcattctcattccttcatatatctatattctt

SEQ ID NO: 8356 - DNA, 437 bp, Gossypium hirsutum
  Clone ID: uC-gsronu33B153g06b2
cccacgcgtccgaaacattggtcgatgttggcggtggtaccggtgccacgcttagcatgatcgtctctaagtaccccaccataaaaggcattaacttcgatttgcctcatgtcattgaggatgctcctagctgtcctggtgtggagcatgttggtggagacatgtttgtaagtgtaccaaaaggagatgccattttcatgaagtggatatgtcatgattggagcgacgaacactgcgccaagtttttgaagaactgctatgaagctttgccagacaacgggaaagtgattgttgccgaatgcattcttcctgattaccccgatcctagccttgccacgaagttggttgtccatattgattgcatcatgttggctcacaaccctggggggaaagagaggaccgcaaggaattcaaggcactagcaacgggtgcgggat

SEQ ID NO: 8357 - DNA, 406 bp, Gossypium hirsutum
  Clone ID: uC-gsronu33B153g09b2
tcttagaaaatgaagggtctgcaggcacttatattggcaatggtaatggttatggcgatcgctacaactgatgctcaaagcatttgcaacatgccagcttcaggtttgatggcatgcaaaccagcagtgaccctccccaaccctccgccgcccacgtcaacttgctgctccgccctctcccacgctgacatgcgttgcctttgctcatataagaactccaagctcttgccttcccttggtattgacccaaaccttgccatgaaattgcctagcttgtgcaagcttcctcatcctgcaaattgttagttcctggttctccatatttgatctcaaatgtgagggaaaatcatgcttattataagcctctacttcacataattgtactgaccttcgggttttctttttc

SEQ ID NO: 8358 - DNA, 290 bp, Gossypium hirsutum
  Clone ID: uC-gsronu33B153h03b2
gcatgcttagcacgccgtttctgaaggtaccaaggccgtgaccaagtttacttcatcttgaaaaggctattagttgatctgtagttggggttagggttaggaggttgctttttaaattagatcggtgtggtttttatgtttatttttttgaaattactgcatattaattttgatataatggtttgtattggcgagatggatctacttgatcctgatatgactattgtagaaattaatgctattaacgacaacttaattttttggagcttaaacaaaaaacatttttttct

SEQ ID NO: 8359 - DNA, 424 bp, Gossypium hirsutum
  Clone ID: uC-gsronu33B153h08b2
ttagtactcgaagcgaagagacaaagatcgccatggcgcctcctgtaaaagcaataactagtcccgtgcctgatgcgtggtatccaaccctagccgtcttcatgctcgccattggtctttgcctcactgcttccttcttcatctacgaagcaacttcttccaaacgaaatcgcagtcttgcaaaggagctcacaactgggggagtggcatctgtcttcctgggattcgggtcactgtttttgctactatcagcccgcgtttatgtctgattttcatatattttttcaacccatttaaaaatttgctgagcagaatggttgtgaatggaggaacatggcttcgaccttgtaccctatgacttttctttttcgtaataatcagataagagtgtttctatggaaatttttggatacttttgggtttt

SEQ ID NO: 8360 - DNA, 367 bp, Gossypium hirsutum
  Clone ID: uC-gsronu33B153h09b2
tttttgtgggagttaaagagattattgcagcaatggcttctttgcaatgccagaaaaccattgagaaaggcttgggtcaaggatactatggtggcggttctagttggggaagccaggccactaaaatggagaacaaataccagaatggctatgcgatgtcttacagcgaacatgaacgccatagccaaatccgctgccccacctatggaatgagcgaatcctacactacttacggccaatctcatggcacccacaacggaaacgcaatgtcgaaaccccaatttcatggtcatgggaatggctacggcagccacatgagcaacgggatggcttacactcaagcatatggctctaaccatcacaacag

SEQ ID NO: 8361 - DNA, 517 bp, Gossypium hirsutum
  unsure (1)..(517): unsure at all n locations
  Clone ID: uC-gsronu33B153h11b2
agatattagtgctccaaaggcagctggttcctgttaaccggaaatttgacgtcatgtctccgggagaaacggtctcccggtcacctctagacaagcctctgaaccagcttactgaggatgacatttctcaggtcactcgtgaagattgccgccgttacctcaaagaaaaagggatgcggagaccgtcttggaacaaatcgcaggcgattcagcaggtgatctcgttgaaaactcttctagaaacgacgtctgattccgacgccgttgaagctcggaagaaactttaccctccctgcccggaatatccgcctcgcgtgcgtgtcgtttctgattcaaacgttctaccgagggaaatgacaccgaataacgggatattggttccagtttccgaatccgttccttgtcccctttcaaatccctcgaaatccgattnttccggcgacaattcttgccgaacggtcatctccggaaatgattctgttttttcaagattgcaggtgcagcaaaagagccagca

SEQ ID NO: 8362 - DNA, 584 bp, Gossypium hirsutum
  Clone ID: uC-gsronu33B154a05b2
ggcttattttcaaatgaaaaaagttcaacaatgcacacacggcaagctgtggaactcttgcagcgaagctctaaccttgaccgacaagaaagtttggcaaggctctcattatgcggatttcccagaaataattgaagatggggatgcgagtgagtttacacatgaatcagtgactgatgatgctgatattcatggttcagttgctggtcttgtgtacaggcgacgtgacggaactaagtggattgttgcctggagcaacccacaagctgagaacagcaaggtctatactgatatccagagacaacctgttcactgggggcaaatcaaaaccaaccttgagaaaagaggaaaaccaaaatttaaagttacaaagtttggttacaatgcatctattgaaattgatcccgtgagtcgttcacccacaatgaaggcatcatttgagttagaggcataactgccttatcgtcttcatcaagctgtggtggtaattaaggctatcaaaattaaataatagtgtgatgcttgctgctgcataccctgactactattataagaaaaagatttgatagccagtagaaccatta

SEQ ID NO: 8363 - DNA, 464 bp, Gossypium hirsutum
  Clone ID: uC-gsronu33B154a11b2
atcttattcgccatgcaactcaccattgccttaaccagggccttagtccttacgatgggcataaaacttgacttactacagatcatggtcaaaactatgccaaaagctttcctatgcgctaaagaattggcatacgagttggccaccaacatccccaatacacacgtcatgctagaccgcatgctacacctcctggctacctacttgattaccaattgctccttaagcagtttttcagatagtatagctgagagactctaggagagactccatggcttcgaacttttgaccaaaaatgagaccaggattaatttttgcgacattattttcaccatctatgacaaggaccttacaagagcctttactacagttaatactccgtgatagaaggctagactatacttcatattgccttttctaaacttatataaagttgtatttagatctaatagttgaatcagttt

SEQ ID NO: 8364 - DNA, 290 bp, Gossypium hirsutum
  Clone ID: uC-gsronu33B154b01b2
accatgctttcatagaaggaatatccacatggggggggaatgacatttatttgattactggaagaagggacggtagaaggagctttagatagggagtggatgagaatcaattgtgacagagaacagacaattaatgagaactctgcagattaaagaatctgggtcttgaaagaatgtgcatatgaattcttaattaatcttagaatgatatatgatccaagattgtaacgccctgatttattaaatcatgatgtgatgaattctgccataattaaggatatgcatcagag

SEQ ID NO: 8365 - DNA, 332 bp, Gossypium hirsutum
  Clone ID: uC-gsronu33B154b03b2
cccactcttccgcccacgcgtccggcttacctcttggctaatcccgaagcctgcaactaagatatagattgctttgaattctcatgctgcttttaaagagtggccattactttcaatggtgttttttatattttctttttccacttaaaacctaaactttcttatgattattttaataagagcggtggtggtgatcgagctttgatcatctttattttcaaaaataaagctaattataagcctttacttaacataatagtactgaccttagggatttattttttcatttaatttctttttatgtgttgtgtaaaaacaggaaaataaaaggg

SEQ ID NO: 8366 - DNA, 522 bp, Gossypium hirsutum
  Clone ID: uC-gsronu33B154b04b2
cccatcttttccgcccacgcgtacggcaaaagagggtcatggcacttttgtttttgtaagggagggcaccatctccgaccctgttaagggaaaacttgtcgacaacttcaagaacttaggggtccatttgctgttaggggatatgtacgaccatgagagtttggtccaagccctaaagcaagttgatgtggtgatttcctgaaatggggaaaggcaactatctaaccaagaccagatcattcttgctggacaaatccaaacactggcattacagtattttccatctccgtgcagtgctggcggaccctaatcaagttccacaaaacccggatccagacaagtgcgacggctgggattggtatgactgggataatctgccccaacctatgttttttacgcttgacgaaatggtacgaagtggcttcaacccctttccctccacttgacagctgcttaatgaatacgttttcttttcttatatattgcttgcgtataatgattccttgattacctttaatttcc

SEQ ID NO: 8367 - DNA, 441 bp, Gossypium hirsutum
  unsure (1)..(441): unsure at all n locations
  Clone ID: uC-gsronu33B154b08b2
cccacgcgtccgccaaccctccgccgcccacgtcaacttgctgctccgccctctcccacgctgacatgcgttgcctttgctcatataagaactccaagctcttgccttcccttggtattgacccaaaccttgccatgaaattgcctagcttgtgcaagcttcctcatcctgcaaattgttagttcctggttctccatatttgatctcaaatgtgagggaaaatcatgcttattataagcctctacttcacataattgtactgaccttcgggttttctttttcctttatttctttttatgtgttgtgtttcgattggtatcttatagtcgtgtgatttctcaccaataatcatatattagtattgtttccaaannaaaaaaaaannaanaaaaanaaattaaaataaaaaaaataaaaaaaaataaataaaaaataaaaatt

SEQ ID NO: 8368 - DNA, 263 bp, Gossypium hirsutum
  Clone ID: uC-gsronu33B154b11b2
ccaggtaaaattaaagaatgtatttgttcttttttttattaattccttctttttcactccaacaagaagtattgaatcccagttttctgctaagtctctagggtcatttcctgtttgtcaattgcttaagttaatcattggtgtgaaatgtgtaactttaatgtgtatattacaaataaacattacatctgttggttttatccgggatttttttttaacttattagcaataatttgtttaaaaaaaaaaaaaaaaaaaacaac

SEQ ID NO: 8369 - DNA, 529 bp, Gossypium hirsutum
  Clone ID: uC-gsronu33B154b12b2
cctatgcgtccgcttacactccttatttctaaaaggggagaatcctttaaccctcttggggctgctttactcttcccatagtcatgggggctcacccttgttttcaacctgtttcgaaatgtagcatcgagggaagatcaaatcagacggtggctgctgatttagatggaacccttcttgtgtcacgtagtgctttcccttactacatgcttattgccctcgaagctggcagcctgttaagagcactgcttctcttactatccgttccagtcgtgtattctacctacttgttcatctctgaatcttttgccattaataccttcattttcatctcctttgccgggttaaagataagagacatcgagctgggttccaggtctgtgttgcccaagttttatgcagacgatgttcacccgagacttggagagttttcagctcccttgggaaaagatacattattacccgaaatcctagaataatggtgggaccctttgccaagacatttctaagagctgataaggttttgaac

SEQ ID NO: 8370 - DNA, 283 bp, Gossypium hirsutum
  unsure (1)..(283): unsure at all n locations
  Clone ID: uC-gsronu33B154c05b2
actggctcgtcatgcctaagaccggaaagatgaattagagagtttgaaacatttactcactttctcaagcataagtgtnaatgtttnaaactttctaattcaacttaacatagtagtgaatggttattccttagaccggaaagttgctcctaacaaaatagtgcctgaccggttattgcttaccagaagaatatagataaggctttctacactatcatgtttttgaggctgctgtaactttaagtctatcatatttgcgaccattactttccattttaaccat

SEQ ID NO: 8371 - DNA, 417 bp, Gossypium hirsutum
  Clone ID: uC-gsronu33B154d03b2
cacagctttacgttgagaatgttttgacaagcgagagggagagaatgagatgctgtaatattgaattcaaatacctgatgcattcttcccaaactttcgtctatggaggaattcttcttgctgggttctttgtatatttcattgtcattttcttttcatcaccccccggtcaatgatctcaactccgaagattatcaggcatttgaaggtaagcttggtctctcatctttagggaacccatcttagtctgtacacatttcagaaagaagaaagttttgtaaaattagggtttctttgcttgcattaccacaacatggtataaacaaatagctgaatctttgctaaaaaaaaaaaaataataaatataaaagcattaagttttgataaagggaataaaaaaatttatttttattattt

SEQ ID NO: 8372 - DNA, 426 bp, Gossypium hirsutum
  Clone ID: uC-gsronu33B154d06b2
gctcttttcgtgctacgacttgtcttcaagaaccagtgtgggggacccgacagttgcgtttgagtttcagcaggcggactgtcactgatatagccggcgaaaaattatttgataccggcagtcctctgaggaacgtaatgctaggcgtttgcccccacgacgtctgcatcgtgtataatggagagcgaacagcagctagggacacgtgtgagctttgcttagagttacaatcagacaagctgcttttctgacaaatggtttgacagtaaataaatagcttattggtggtaatttactaatttacctatccggcttgtttccgatgaatgaaggtgaagaatttaccgaagttagtacgattgttatatgtattggtcgaaatctttactatgctgtcaaaattttttttcattgtatgattttccc

SEQ ID NO: 8373 - DNA, 405 bp, Gossypium hirsutum
  Clone ID: uC-gsronu33B154d08b2
ccctctcgtccgcattaattggctgcaaagctctcatctctctttgaccatgtcgtcgattaaaaccattaaggtcagcaatgtttctttacaagctactgagcgagacatcaatgagttcttttccttttctggtgatatagaatatgtagaaatgcagagtgacaatgagcggtctctaattgcctatgttaccttcaaggattcacaaggagcagagactgctattcttctttcgggagcaacgatagtcaatctgtctgtcagcatttcgttagctccagactacaaattgcctactgctgcttttgcaccgccttctccaatacaaaaccaaactcctgctggtgctgattcggcaatgcgaaaggcagaggatgctgttactggcatgcttgctaaggg

SEQ ID NO: 8374 - DNA, 314 bp, Gossypium hirsutum
  Clone ID: uC-gsronu33B154e02b2
cccatcttttacgtccacgcgtgcggtaatgatcgattcggcagagttgcggaggttcattccggccaaccgcagatttgtcggaaaaaactaaacactctctttcatatgcggcgatggcgattgcggggcctctcttaagtggctcaaaaggagtttgagctacaaagggtggggtggggttcccaaaatggccttccttgaatatgctccggccgccttaacacgggtccttcggcggttagaaccttttaaaaaaggaaggagtttcttacccccgcctggttctatttgtcaattaaacccctgaatgt

SEQ ID NO: 8375 - DNA, 488 bp, Gossypium hirsutum
  Clone ID: uC-gsronu33B154e08b2
cgtttacagttaaatccttttttcccttatattttcggaaaagatgcggaggttcattccggcgacggcagtattgtcggaaaaaactaaacactctcttccattgcggcgatggcgatggcggtgcttctctcaggtggctcaaaaggagtttgataacaaaggtggcgttgtggttcccaaaatgccttcctttgattatgctccgccgccttacaccggtccctccgccgctgagatcctctcaaaaaggaaggagtatcttagccccgccatgttctacttgtacaataaacccctgaatgtagtggatggaaagatgcagtatttgttcgatgaaaaggggagaagatacttggatgcatttggagggatagctacggtgtgttgtggccattgccatcctcatgtggtggacgccattgttaaccaaaccaagcgcttgcaacactcaactatcctttaccttatccatgccattgctgatc

SEQ ID NO: 8376 - DNA, 593 bp, Gossypium hirsutum
  Clone ID: uC-gsronu33B154f02b2
gctatcttattgaaaaatttgtgagcatgggattcagggctgaccatattgcgagtgtgattcagaggatggaggagagtgggcaagcggtggattttaatgccgtgctggataggctgaatgtgcaatcctctggtggtactcagagagggggatggtaaatgccactgcttagttgaatcgaccttgaatggtacttgaataaaaaaggtggttttatttctaatgtatatgttgggagggatatgagtatttgtatgatgcctatcaagcaaagacagctggacacgtgctgcatgctgaggactgggagatgacagatgcctgtcatctgagctatgactacctgagcccatcctggacttgtggggcaacttatgtgccaattgacctgtgccagatgtaccaattctgagcctgttgcactgctcgcttcgtccctagccgggatgggcaattgtgggctgtatgtgatttcgctgttcgcggggcagatgcatcatgactgctctgttctccttacaaaatcgcactcaaatttgatgattgcgctacttttgtctgagtcttgcttcaggcttcctctaccttac

SEQ ID NO: 8377 - DNA, 480 bp, Gossypium hirsutum
  Clone ID: uC-gsronu33B154f05b2
ggggcttcaaaaaatctcaacctgatggaatgggacaaactctggacaattaataagaagatcatcgatcctgtttgtcctaggcatacagcagtaattgaagaacgaaaggtactattgaccttaactgatggtcctgatgagccatttgttcgtattatcccaaggcataagaaatatgatggtgctggagagaaagcaaccacttatactaaaaggatatggatagactatgctgatgcagagtatatctcagtgaatgaggaggtaacattaatggattggggaaatgccatcgtgaaagaaataatcaaggatcaggatggaaacataactcagttggtaggtgttttgcatcttcaaggatctgtcaagacaacaaaattgaagctcacgtggcttgcagaaactagtgaacttgtcaacctttccttggtggagttctgttatctaataacgaataagatgctggaagaaggg

SEQ ID NO: 8378 - DNA, 585 bp, Gossypium hirsutum
  Clone ID: uC-gsronu33B154f06b2
caactaggcctatgcgcatagggccggctgctaacatgaagactggtgctgggcatcaatatccagcagcttcatcgcaagggactcagaacgagaatgatccaaataatacgactctatttgctggtaatttggattctaacgtgactgaagaccatctgagagaggtcttgagaccatatggtcagttggtgcatgtgaagattccacaaaacaagcgcagaggatccgctcaattagctgataggagttgtgctgaagaagcactccgaatactgaacgggactcagttgggtggacaaagtattcggctttcatggggtcgtagcacatcaaacaagcatgcccaagcagatccaaaccagtggaacgctggatattatggatacagccaaggatatggttacggctatggcgctgccccacatgaccccaacatgtactatggagggtattctgtgtatggaaattatcaaccagccacagcaacagcaacatgtcggttatagcttagtgctgatattaacgatccttcgtggctgctgatctcctctttactaggatcatgaactaatgctactggat

SEQ ID NO: 8379 - DNA, 372 bp, Gossypium hirsutum
  Clone ID: uC-gsronu33B154f07b2
ccctcttcgtccgcccacgcgtccgcccacgcgtccgatttacatccgccttatccgttgctctagcagttgtgtttcttgtcattactgttggaatagcaattatcaagttgattagcggaactgtaatgatgcctagattgcttcccgatgtcactgatttgacctcattctggaaactcttcaccacagtccccgttttagtcactgcgtatatctgccattacaatgtccacagcatagataacgaactggaagattcaacccaaataagaccggttgtgcgaacagctctggctttatgctcaactggttacataatgacatgctttttcggattccttctattttggtgaccgcacaatggatgat

SEQ ID NO: 8380 - DNA, 574 bp, Gossypium hirsutum
  unsure (1)..(574): unsure at all n locations
  Clone ID: uC-gsronu33B154f10b2
gacataaaaagaagctgcaagtagaagagctggagaggattgtcaggcttaaacaggcagaggctgatatgttccagcttaaggccaatgaggcaaaacgagaggctgagaggcttcaaaggattgcacttgcaaaatctgataaatcggaagaagagtatgctagcagttacctgaaactacggttgagtgaggcagaggctgagaagcaatatttgtttgaaaaactaaagctgcaggagtcctcacgggcatcgcagagtagtagtggaggtgacccttcacttatgtattccaaaatccgtgatctgctccatgggtacaatatcatccccgctaaaacagagtctcagccaaatgagcgccatggttttagagcaaatccctgactgtctgatgtgcgagttagaatatgttgctttgttggtaaattagtgtgttaaggtttgctgtttcattctaatgtatgaaaccttcaatgaattgtcagttaatagtttattatttgtcgtatgatatgttgtcttcatgtacgaacttncattctgtggcttcgaatgtgcaatgagaaatc

SEQ ID NO: 8381 - DNA, 398 bp, Gossypium hirsutum
  Clone ID: uC-gsronu33B154g02b2
cttgtttgttactcacttgtcggctccacttgcatctctctttgtttatcaatctctccctctctccctctgtctctcacttactttatgcagggaattcaggtggtttagtgagacaagaggcatagaattgggctttgaagatgtgaagcatttgatttctttttgctcgatgccatcgatattccttatactagttgagtttctttaggagctgctggactaaccttgataacttatattgttgggagaagattcaacttttctttttttcctttctttttcccacttatgggaaccctatattcttgatttttaagtcttggcccgcagcttatacgtttggggttatatttttttggttttttcatattcatttgtggattggggaaagatat

SEQ ID NO: 8382 - DNA, 449 bp, Gossypium hirsutum
  Clone ID: uC-gsronu33B154h05b2
ggcttattttcaaatgaaaaaagttcaacaatgcacacacggcaagctgtggaactcttccagcgaagctctaaccttgaccgacaagaaagtttggcaaggctctcattatgcggatttcccagaaataattgaagatggggatgcgagtgagtttacacatgaatcagtgactgatgatgctgatattcatggttcagttgctggtcttgtgtacaggcgacgtgacggaactaagtggattgttgcctggagcaacccacaagctgagaacagcaaggtctatactgatatccagagacaacctgttcactgggggcaaatcaaaaccaaccttgagaaaagaggaaaaccaaaatttaaagttacaaagcttggttacattgcatctattgaaattgatcccgtgagtcgatcacccacaatgaaagcatcatctgagttagagg

SEQ ID NO: 8383 - DNA, 573 bp, Gossypium hirsutum
  Clone ID: uC-gsronu33B154h10b2
cgcgtttgctagcttcatcttctctgttcgaccttcccaaaaaaaaaaaaaaaagaaagggaaaattcaggttgggagtattacacagctttgttttggttaactccttttcgtccaccatatttgcccccaatatgaagatcttgttctcgaaagttctaacgaacaccgatatacagaaaagattggcggttcccaacaattcactgaagcatttcgagcttgaaaatggtaattgctccaaatcatttgaagttaaagatgaaaacggattcacatggccttttcgttgctatgttcgtaacgacggtgcctacaagaagcctgttttatccagcggttggcgtcaatttgtccttaataaaggagttcaccagggggatttgattacactctatcaggatgttgaagcagaagcttcgtataagatcgaagttcagagaaaaatcaagttattaggcaaggagtgctggtataatctggaaccagaccatcctacagtgcgcacagcacaagataagagaaaaatcctgttatttggcaggagtgcggctttttttggacccagacacc

SEQ ID NO: 8384 - DNA, 454 bp, Gossypium hirsutum
  Clone ID: uC-gsronu33B154h11b2
aaaaaaaaaaaaaaaaaaaaaaaaaaaaggggaaaatttttaaaaaaaaaggggagaaaaaacccaaaaaaaaaaaaaggggctgccccttttggggttccatgtttccgtccccttgcttgcacacgtctagcttcttgtttggtgccccttaatttcatttttttggccgccgttttccaacctcctgtctggaaaacccttggccttccccactttattccccttgctttccttccccttttcccctgttggcctttttcctttttggcccttcccgttcgcccttcccaacccttccccatccttattggcttttgggcccccccctttttgggccctttaaccccgccctttgtggttgttcctcccatggtgcccgtttcatttgccagccccttaccccccgctctttttgttttcttccctccctttttttccctttttccggttt

SEQ ID NO: 8385 - DNA, 512 bp, Gossypium hirsutum
  Clone ID: uC-gsronu33B154h12b2
ccctctcgtccgatcaacgaaaatattcttgccaaaggtgcagctatttatggtgatgggtgtaaacatgtagagaaggagcaagaagatttgattaagttgttatccgaacaggttttggatcccttgagagcaatgagtgctggtgctcctttggaagatgctcgtcatcttgctcaacgctatagtcgaatgaggcaggaagctgaggcactggcagcagatatttccagaagacaagcaagaataagagaagcgccaattcctgaaaatgttgcgaagttgcatgctgctgaagcaaagatgcaggaactgaaagcaaatatggcagttctgggtaaagaagcttctgctgcattggctgctgttgaagcacagcagcaaagactaactctacagaggcttgtagctatggttgaaggggaaaagacttatcatttaagagtggctgcaattctttatgagattgaagctgagaaggtttctgagaaacagcgcaaagattctgctcc

SEQ ID NO: 8386 - DNA, 484 bp, Gossypium hirsutum
  Clone ID: uC-gsronu33B155a06b2
gtatttgatcgcgagcgccgccctctttccaaacacgggggtttttttgaaaaaatgggctcatgagagaagaccatggccgatcaacttacggacgatcagatctctgagttcaaggaggctttcagcctctttgacaaggatggcgatggttgcattactaccaaggagctggggactgtgatgcggtcacttggtcagaaccctactgaggcagaacttcaagatatgatcaatgaagttgatgctgatggaaatgggaccattgattttcctgaattccttaacctaatggcaaggaagatgaaggatactgattccgaggaagaacttaaagaggctttcagggtgtttgacaaggaccagaatggtttcatatctgctgctgagcttcgccatgtcatgacatatctcggtgagaagcttacagatgaggaagtgatgagatgatccgtgaagctgatgttgatggtgatgggcagat

SEQ ID NO: 8387 - DNA, 434 bp, Gossypium hirsutum
  Clone ID: uC-gsronu33B155a07b2
catagatccggcattttcgaaaccccgttccccaatgttatcctgcttctgccttcaaatcccggcagattaccagcaaaggtcgagtcctccagtttcaaacggaatgttgcccccaaccgcgaaacctggccggggcaagtgtacgaatgcagccacactcttggatataatcaaggacgtggagatcgctatttcttgccggaaaggtcgatcgggcactgctgccggcgacgtagctttcccgaggggaaaagagaacttggcttctgttcttaaacgctacaaacgcagattgtccaatctagttggcacacatgaaggcctcggttcacacaaggtcctgacatcagctcctctgtcggcttcttatggatcatagcttccgttctagtactactcactctgattcactagttgcaagctgttctgtt

SEQ ID NO: 8388 - DNA, 524 bp, Gossypium hirsutum
  unsure (1)..(524): unsure at all n locations
  Clone ID: uC-gsronu33B155a10b2
ttctctcattttatcactgccgctttgccagcagccgcgccacactcgagagagagctcgtcaaccatggccgaacagactgagaaagcctttttgaagcaaccaaaagtgtttttaagctcaaagaaatcttcaaaagggaagagacctggaaagggagggaaccgcttctggaagagcattggtttgggcttcaagactcctcgtgaagctattgaaggaacctacattgacaagaaatgcccgtttgccggcactgtttcgatcaggggtcgtatcttagctggtacttgccatagtgctaagatgattaggacaatcattggtcgacggaattaccttcattatatcaagaaataccaaaggtatgagaagaggcattcgaacatacctgcacatatttctccatgcttccgtgtgaaggaaggngatcatgtcattattgggcaatgcaggccattgtcaaaaaccgtgaggttcaatgttttgaaagtgattcccgccggatctttccgcgtgggaag

SEQ ID NO: 8389 - DNA, 552 bp, Gossypium hirsutum
  Clone ID: uC-gsronu33B155b05b2
ccttattcaaccaggtcaccatgagtggggctccgaccataacataatcgacaaatccaagatgtactcctacaagtaaagggagttcgaatagatattggttgtgttcgaaaggctctgaatcgatcgacaagcccaagcccaatatcttgatttcgaatggcaatgcaccgcggacccatatatatatcgtccgctaatacacgaccaattaatgtttggataaaaattctttccggaagcgtcctcttttgaggactcacagaaatccctcgggtggtgccacaatctgttctacgtacaacactgtgttgaactacttcaacaagtctgcgcgtaagatatccagcatctgatgttcgtacggcggtatccacaaccccttttcgggctccgtagcaagaaatgatatattctgttaaagacagagcttcgcgtaaattgctttgaatgggtaaatcgatcatttgttcttggggatccgacattaatcctctcatacctactaattggtgcacttgagatgcattttctctagcttctgaaaaagac

SEQ ID NO: 8390 - DNA, 544 bp, Gossypium hirsutum
  Clone ID: uC-gsronu33B155b08b2
ttctcattctgagtctggttccacaaactctgacgaagttcttattagtctgactggagatgctgacacaggtgctgttccagatcttcaagagcaggttgtgtggttaaaagttgagttgtgcaggttgctagaagagaaaagatcagctgtcctcagatctgaggagctggaaacggccttgatggagatggtaaagcaggataatcggcgccaattaagtgctagggtggagcaattagagcaagaggttgctgagcttcgtatggccctttctcagaagcaggaacaagaaaatgcaatgcttcaggtcctaatgagggtagagcaagatcaaagggtgacagaagatgctcgcagatttgctgaacaagatgcagctgcacaaagatatgctgttcaagtgcttcaggaaaagtatgaagaggccgctgcttcacttgctgaaatggagaaaagagtggtaatggcagaatcaatgttagaggctaccctacagcaccagtctggacaaagtaagtccaaccttctcacgatcatcaca

SEQ ID NO: 8391 - DNA, 490 bp, Gossypium hirsutum
  Clone ID: uC-gsronu33B155b11b2
ttccacgcgtccgcccacgcgtccgcgcaattcttaagtgccctgaacagagccggggtggtcaactctccatctaaaggaatgttcatagattcgtgctatgcccactgtcaagtaggaaagcagatacaatggtcaagcgatagttctccggtagtaagcaacatgaaaattgccaaggctgttggagactggtattatgagcggagccccatcaaaaagcttgactgcccttatccttgcaaccctacctgcccaaaagttgactctgattcataaatcctatacatataattatggactacagtttatttattagatggatattagtccattgtttatgtctatttatccatctataaatctctcttgttgttttattttaataaagaagcgtatgatcttggaaacatataaagttgcttgagcttgtatcattaccactagattgtagtggtatttttatttatgagatgtttccgtaattttc

SEQ ID NO: 8392 - DNA, 552 bp, Gossypium hirsutum
  unsure (1)..(552): unsure at all n locations
  Clone ID: uC-gsronu33B155b12b2
ggagcagaatgtggcacttgaccttgccagaagagaagcagagacggccatccgtgctcgaaatgatttcttggctgttatgaatcacgagatgagaaccccaatgcatgctattattgctctatcttctttactgcaggaaactgaattaacacctgaacaacgtctgatggttgaaacgattctcaagagtagtaaccttctttcaactctaataaatgatgtattggatctttcgaggctggaagatggcagccttcaactagaccttggaacttttaacctttttgccgtattcagagaggtccttaacttgatcaagcccattgcatctgttaaaaagcttcatgtttcattaaatttggctccggacttgcctgaatatgccattggtgatgagaagcacctgatgcanacaattttaaatgtcgttggtaatgctgtgaagttttcaaaggagggcagcatttcaatcactgctattggtgcaaaatcagaattactgagagattctcggacccctgaatttttccctgtgcctagcgataatca

SEQ ID NO: 8393 - DNA, 586 bp, Gossypium hirsutum
  unsure (1)..(586): unsure at all n locations
  Clone ID: uC-gsronu33B155c02b2
ctgctttggtggcgtgatttagaagccacaactcaatttcatataaagaaaaaaaaaaagagtgagatggatccagacgcagtagccaaggccttcgtcgagcactactactccacattcgatgccaaccgggccggtttagccaatctctaccaggaaggttccatgttgaccttcgaaggtcaaaagatccagggctctcagagcatcgtggctaagctcaccagccttcctttccagcagtgcaagcacaacatcaccaccgtcgattgccagccttccggctccggcggcatgctcgtattcgtcagcggtaacctccaactcgctggcgagcagcatgctctcaagtttagccagatgtttcatttgatgccaacgccacagggaagcttttatgtgttgaatgacatattcaggttgaactacgcgtgaagacgatgattaatcaagggatgggagtacaatgcctgaggatttaaaacacgtttttgcctatttaggcttaaatgaaatttggaattttgttttatttgggngttggatatgtttcgtgttccattatggtttccatatctcacccata

SEQ ID NO: 8394 - DNA, 567 bp, Gossypium hirsutum
  Clone ID: uC-gsronu33B155c05b2
aaaacaatcttccaccttaacccatctggccgctttgtcattggtggtcctcacggtgatgcaggtctcactggtcgtaagatcattattgacacctatggtggctggggagcccatggtggcggtgctttctctggaaaggaccctaccaaggtggacaggagtggtgcttacattgttaggcaggctgccaagagcattgtggctaatgggcttgcccgaaggtgcatcgtgcaggtctcttatgctattggtgtgcctgagcccttgtctgtctttgtagacagctatggaactggaaagattcctgacaaagaaatcctccaaattgtgaaggagaacttcgacttcaggcccggtatgatcaccatcaacctggatctcaagaggggtggcaatggccggtttttgaagacagctgcctacggacactttggaagggacgacccggacttcacctgggaaggtgtgaagcccctcaagtgggaaaagcctcagtcttaaaatcagctttggctgtcctcgaatgtttttatcttatacatatgatgccccccattcattttc

SEQ ID NO: 8395 - DNA, 567 bp, Gossypium hirsutum
  Clone ID: uC-gsronu33B155c07b2
tataataaaaaaaaaaaaaaaaaaaaaaaaaaaaaaaaaaaaaaaaaaaaaaatataaaaaatataaaaaaattaaaattacttacatttaaatacaaatctttttttttttttttattttggggcgcccctttttggggttccagctttcctcccccgtgtttgctccttttttttttttttttgtggtcccttttctttatttctttgcccctctttttccctcttttggtttgggaaacctttgtgttcccccttttttttctttttggggccttttcctttttgctcttttgcctattttttctatggtgtccccccttttctctttttcttacttttgcccccttctttgtggtttgtgttccccccttttttggtcttttttttcccggggttgtgtgtgtttccccccctgttttttttttttttccctttccttgtcgccctttcttttgttttttttctttttttttccgctctttgctcgttttcctttttttttttattggtgttttctttaggttcctttttggtttttcttctctccccctaattctttttttt

SEQ ID NO: 8396 - DNA, 524 bp, Gossypium hirsutum
  unsure (1)..(524): unsure at all n locations
  Clone ID: uC-gsronu33B155c09b2
agcagactgcaagctacagcattcgtttccagaaggagatttcaagctgggagagaacatatactggggcagtggctcggcgtggaggcccagtgatgcagtgagtgcctggtccgaggaagaaaaatattacgactatgcaaccaactcgtgccaggagggacagatgtgcggccactacacccaaattgtttggaagaatacccgacgaattggctgcgctcgagtggtttgcgacactggagatgtgttcatgacttgcaattatgatccgccgggtaattatattggcgaaaggccatattgatatggttcaatattccaattctaaggggtacttcactatacttgttcaatattttcgaaaatttgttctcacgatgctatctcactacttcattaaagctaacaagttttccgaaaactagtgaacaagtatattaaggtactcaatagaaatatatatatatatatgaatttgatgtgaacattatagtaatggntgtaatatgtatgccatttga

SEQ ID NO: 8397 - DNA, 363 bp, Gossypium hirsutum
  Clone ID: uC-gsronu33B155c11b2
tatacccagatagtcgtctcttcaccaaagtgctataccctggagatgtctttgttttcccactaggtctgattcacttccagttcaacatagggcataccaatgcggttgcctttgctgctctcagtagccaaaacccaggggtcgtcaccattgcaagtgcagtgtttggctcagacccggatatcaatcctgatgttcttgccaaggcctttcaactggacaagaaaattgttaaccaacttcaatcccggttttggtcggataacgacagtaggaattaatgttaacttctacagccccatcaaacttaactgtgtacccaattctctgctattgctaattttattttcaatttaattc

SEQ ID NO: 8398 - DNA, 574 bp, Gossypium hirsutum
  Clone ID: uC-gsronu33B155c12b2
gttttatcctgaagtgttaaaccctgattctcccgagtccccactaatatctccttgatggctttgagggcggcggcgacgagagcgatgttcgctggggcggctccccagggattcaggcgcatgtgttcaacagctacggctaattcctttatgccgcctccaattacggcgatgggcaacggcgagggaacccctggtcgagagcaagcgcctccaagtaccaacctctttgtctctgggcttaacaagcgcactaattcggagaaacttcgagaagccttttctcagttcggacgtgtaattgatgccagagtagtgactgatcgtgtatcaggatattctaaagggtttggtttcgtaagatatgccactatagaggaagctgagaaaggaagagtgggaatggatggcaagttcctcgaaggttgggttatatttgcagagtatgcaagacctcggccagaacgaactccgcctccgagcaacatggctaattcaaatggctataattcctatggccgtgaataacttagatctgaaacatgatttgtcattttttattttaatcaga

SEQ ID NO: 8399 - DNA, 429 bp, Gossypium hirsutum
  unsure (1)..(429): unsure at all n locations
  Clone ID: uC-gsronu33B155d08b2
tttatttttttttattcgttcgaacttaaattgtgtgtttttttttaatattgacccaaaccttgccatgaaattttttaaattgtgcaaaatgccctatattgcaaattgttagttcctggttctccatatttgatattatatgtgagggaaaatcatgcttattataagcctctacttcacataattgtactgcccncngggttttatttatcctttatttctttttatgtgttgtgtttcgattggtatcttatagtcgggtctcttttcacccattattcgctttttcttcatttttcctcgctcagctttttcttttacatctataaaaaaaaaaaaaaaattcctctaggtccttctttttaataggtccaagtttactttacccgggcatgcaacgataaaacttttttattgtgtcaccta

SEQ ID NO: 8400 - DNA, 599 bp, Gossypium hirsutum
  Clone ID: uC-gsronu33B155e02b2
ccttctcgtccgcccacgcgtccgcacaagtgttcatctggatggtggtagtcaccggtttatggctgtttgcggttacaatgtgtcggaattggggagagcttgtttgctttttttttttcattttaggatacgggtataacatttttattaggtatctattcctggatgttatcttcacggtaatttgttttgactaataatcttttatatttacttttatattctaattttttttttttaattttaattttattatatttttcttcctttcctttttttttctcttttttatttaatatatttatttattttttttttttgtttttgcttttttcttttttttctatttttctatatatttcttcttcttttatttattatctttttttttattattttttattctttttatttttttttttctcttttctcacagccttgtatttctaattctcccgctttttccaatttttttttcttatttttttttcttttctcttctcttcttttttaattagcgctctcctcctttttcttttataaatatcatttttaaatgttattttttcctttttacatctattacttcttctttt

SEQ ID NO: 8401 - DNA, 567 bp, Gossypium hirsutum
  unsure (1)..(567): unsure at all n locations
  Clone ID: uC-gsronu33B155e10b2
tatctctatcttctacaagccggcgaggaaaggaaaacctgagagggtgaaaaatgccagctggtcacggtctccgatctcggactagggatctgttttccagacccttcagaaagaagggttacatcccattgtccacttacctcaggacctacaagatcggtgactatgttgacgtcaaggtaaatggtgccgttcacaagggtatgccccacaagttctaccatggccgcactggtcgtgtctggaacgttaccaagcgcgccatcggcgttgaggtcaacaagcaggttggtaaccggattataaggaagaggattcatgtcagagtggagcatgttcaaccttcaaggtgcactgaggaattcaagctgaggaagctgaaaaatgatcagcttaaggcagaggccaaggccaggggtgaggtgattagcacanagaggcagcctgagggcccaaaacctggtttcatggtcgagggtgcgatgttggaaactgttacttccattccatacgatgttgttaatgatctcaagggtggctactagttctactctggttttttgg

SEQ ID NO: 8402 - DNA, 539 bp, Gossypium hirsutum
  Clone ID: uC-gsronu33B155e11b2
tctacgcgtccggtggttcctgcccttcccccaaccccaaacctaaacctaaacctaaaccaaagccaaaccctactccctccccatcttcttctggcaagtgccctagagatgctcttaaactcggtgtatgtgctgatttgctccgtggcttgctcaacgtcaccattggtacccctcctgttcaaccctgctgctctctcatccaaggtcttgctgatcttgaagctgccgtttgcctttgcacggcaatcaaagcaaatattttgggcatcaaccttaatgtcccactttccctcagtttgcttcttaatgtctgctcaaagaaagtaccctctggcttccaatgtcgctaaatcagttctctaaattctttctcttcttagtgctgcgtggttttgatgttcttaaggtccagtttgaagtgatcaatgttttctcggtaactgagtcgttaatctacgatgttgtagtggttgttccttttggattgattctgaataaatgtaacaccatataaaaaagaagatgtttaattt

SEQ ID NO: 8403 - DNA, 545 bp, Gossypium hirsutum
  unsure (1)..(545): unsure at all n locations
  Clone ID: uC-gsronu33B155f04b2
gtcttatacctttgtcccaacaacaatctcaattattgtggctggtcggttcagtgacagctcagatcctattgagagatttaaaaggataatgcgggcgactcaaggtgccctcattgtagcttccactcttcagattgaccttggcttcagtggcctttggcgtaatggtgcgaggtttttaagtccactttcagtcgttcctttggtatctctagctggttacgggctgtacgagtttgggtctcctggggttgccaaatgtgtggagattgggactcaaagagggctctttcgctatgatgttactgcctgtgaaaccaaggtgattcctggtgaatatggcttcnttgcccagctgaatgagggtcgtcaccttaagaagaggccaactgagttccgtgttgataaggttcttcagcccttcgatgggaacaagttcaacttcaccaaggttgggcaagaagaggttctcttccagtttgaagcaagtgaagatggtgaagttcaattctaccctaagtgctccattgatgctgagaaat

SEQ ID NO: 8404 - DNA, 483 bp, Gossypium hirsutum
  Clone ID: uC-gsronu33B155f05b2
cccactcgtccgcccacgcgtccgcccacgcgtccgattgccctggttttgcccaaagaaacaaactttgagtgggtttgagcttcatggcttacttccacagaaacccttgttccagtctatgaatctttgggaatggataaatggtactcgtgcatcaccagcagaggggtaagaacccagaaaaaaaccatgctgcttatctccataatccattgtacagaaagcctttttgtccgctgatagcttattagttttgttaggtactacatgacagaacgaacgttatagttttaaacttagattgatgaaaaaaaagtcatcactagttttgttggtactgtttgatttcaaatcctgtacataaagcaatatttcttttgtttttgtggcaaaaaaaaaaaaaaaaaataataaaaatataattataaaaaatataaaataattataatttaaaataaaatatttattttttatttttta

SEQ ID NO: 8405 - DNA, 551 bp, Gossypium hirsutum
  Clone ID: uC-gsronu33B155f07b2
tctatcgcgtccgcccacgcgtccgccattacagctccattaattcgtaaccaccagctagacacgttttattatattggtttaaccgggatcagtgtgggtggcgagttgctcccgattcctgagtcagcattccaaatggacgaatcaggtaatggtgggattatcgtcgactcgggaaccgccgtgacacggttgcagagcgacacctataatgttctccgtgatgcgttcgctaaagggacaaagaacttaccgtcagctgatagcgtggcgttgtttgacacgtgttacaatttgtctacgaagagtagcgtggatgtgccaacgttgtcattgcacttcccagagggtaaagttttaccgttaccggctaagaattacatgataccggttgattccgttgggaccttctggttcgcgtttgcgccaacgtcctcgtctttgtcaatcattgggaacgtgcaacaacaggggacgcgtgtcggtttcgatctgggcaacttcgcgtaggattcgtgcccaacaatgttaaagtaattaggttatag

SEQ ID NO: 8406 - DNA, 569 bp, Gossypium hirsutum
  Clone ID: uC-gsronu33B155f12b2
gttccgagtgacgaaatgcaggagaaagtgtctagggctcgtattggcactgaaaatcatttaccacaacctcctattctggaggctaactgcggtacgggaataggttcctcgagcaaccatcaggtgaacaagcatgatgagaaagaaggattggctgttgcagggaccattcccgttccagagcatcaagatgaaaatgatgttggaatggattgtttcacagatgcttatattgattctttttcacgtggtgactttctggaaatgaacgatctcgtcaaccatgtatcttcttcgagttccggtaattcaagcgctccaagcatgtcgtcagatgaatgtttcgactcaatggctttcttacaagatctagatcaagacctagttttggaacagaatgacatgggtaaaaagcttaatgtctctgcatccaacaggttggacgaggtggttttggttcccgctgcttaggatctgttgtagtattgaggcaacgattcgctagaatgaattgtaaaaacactactctgacctaatcagctataacaagagactaaagcatgctt

SEQ ID NO: 8407 - DNA, 565 bp, Gossypium hirsutum
  unsure (1)..(565): unsure at all n locations
  Clone ID: uC-gsronu33B155g01b2
ttctcataattgtgtttcccctctgcaaaggctttattcttcattcgcttcgttgaatttctatcttcttttgatctgaacggagtttggtaatccagttttcgtcttctgttgattcaggaaatcttagtttttgaattgcgtgactgaatgatctaatggagtctaaaggtgggaaaaagaagtccagtagtagtaagtctttattctacgaagctcctctcggttacagcattgaagacgttcgaccaaacggtggaatcaagaagttcagatctgctgcttactccaactgcgctcgcaagccatcctgatatactcacaagcgtgccgtctgaccactagtagtggttaataaaactgttatttgctttgttagttagttttagattatttccccgaccaacttcttcctcttctctcttcgtggctggtttctttcattgcgttctcctgatttggcgactttgtaattcggataaagtttgcagtccttggttgaatcacaatggcagtgtctgcaattggatttgaggttatgaaaaaaggtttngaattccttttt

SEQ ID NO: 8408 - DNA, 498 bp, Gossypium hirsutum
  unsure (1)..(498): unsure at all n locations
  Clone ID: uC-gsronu33B155g03b2
ggatgtcttccacttgcgagtccgtgttcacccattccatgtcttgcgtatcaacaaaatgctttcatgtgctggagctgataggctccaaactggtatgcgaggtgcttttggcaagcctcagggaacatgtgctagagtagccattggtcaggtcctcctttcagttcgttgcaaggacagcaacagtcatcatgctcaagaggccctccgacgtgctaagttcaagttccctggtcgccaaaagattattgtcagcaggaagtnggggtttcacgaagttcaaccgaactgattatttgaaatataaggcagagaatcgcattgtccctgatggtgttaatgctaagctccttggatgtcatggacctctagccaatcggcagcaggaagagcatctttcatgctgccgtttaagactgacacactgaacaagatgcagagtcttaatggtatcttattcactcgcttggtaaagacaatcggttggttaaagct

SEQ ID NO: 8409 - DNA, 501 bp, Gossypium hirsutum
  Clone ID: uC-gsronu33B155g04b2
ccctctcgtccgcttcccctctcttctctcttcttttcgttccttccttccttccttctggcaacaccactctctaatggcttcccttgctggttcatcaatctctatgcaacctcgccagaccctggctacaagcagggtttctgggttgaaattggtttcatttgtgaaccggggaagaagcagcctctcctttaggttgcgtccagatcgcttgcggatttcatgtgctgccaaaccagagacagtggataaggtatgtgaaatagtaaggaaacaactagccctaccaagtgacaaaccagtcacaggtgaatcaaaatttgctgaacttggagccgattctcttgatacggtcgagattgtaatggggcttgaggaagagtttggaatcactgtggaagaggacaatgcccaaagcatatcaactgttcacgatgcagccgagcttatcgacaagctctgaggcgagaaaagtgcctagaaacaaacccaggacct

SEQ ID NO: 8410 - DNA, 511 bp, Gossypium hirsutum
  Clone ID: uC-gsronu33B155h03b2
cctacttgtccgtggaagaccagctactatggaactgagacacttttggggtaccgaaaacgatcccgagttcaaaggatatcacgatgggaattcggaacctattggatttgggcacatcggccttaccgtggatgacttgtacaaggcatgcgagagatttgaaagtcttggagtggaatttgtcaaaaaaccaagtgacggttttgcattcatcaaggatcctgatggttattggattgaaatctttgatttgaaaggaattagacaaatagttaacagtttagcttgagttaatgcttcaccaaattcaggaaacaatgatatggcatatgttgtagattccaatgtctactctcatacgttaattcctttgctttccgaaacttgtcgagggacaaactcaagcgaaatcttaaatgaagcacatttcattctagttgtgtttggggttttcttcatggttgatatgtagaacaaataagggtgaaaataaagaattttgtaagag

SEQ ID NO: 8411 - DNA, 553 bp, Gossypium hirsutum
  Clone ID: uC-gsronu33B155h06b2
cggactcgtgggcggacgcgtgggcggacgcgtgggggcaatgataactccaatgcatttttaggagggtacagaccttctgaagagggagaagaaaggaagcaaactgaaaggcgtggaggatatggtgggcctcgaggttctttccgtggaggacgacgcggtggttttaatgatggagaatctggagagggggagcgccctcgcaggatgtatgatcgccgtagtgggactggacgtgggaatgagttcaaacgtgatggttctggacgtggtaattggggtagtcctactgatggaattgctccggagaccgaagaaaatgtccctgagaatgaaaagaatgttagcattgagaagcagtctggagaggaagatgccatggatgctggcaaggagaatgctgcaaatgaagctgaggagaaagagcctgaaaacaaggagatgactctggaagaatatgagaagattgttgaggagaagaggaaaagcttgcttgccctaagacttgagaaagaaagttgatacccaaagagttgagtccatgcaacaa

SEQ ID NO: 8412 - DNA, 365 bp, Gossypium hirsutum
  Clone ID: uC-gsronu33B155h08b2
tgtacgcgtgggcggacgcgtgggtgctatcttgcgtgtactgttcacagaggaagtaacttggagatggatttttaacccaaaaaaaggaccaggttgaaccttttgtgcaactaaaacagtgaatctactagtgaaggtaaggttgctatggcaacttgaaaggagttgtttcaaagtggatctgattaccttgacttgctaaactcaaaaagaaggggctcagtctttgattagcaagctgtattaatgtcagatgtgagatcaattacgtattttccttttgttgaacctgttggtatttaatagggtatggtacccccctttttgcttatattttaactcgccttggatgttattatacc

SEQ ID NO: 8413 - DNA, 520 bp, Gossypium hirsutum
  Clone ID: uC-gsronu33B155h12b2
gcattcccttgttttactcaaaaagatccctctccaagcaatggcttctaatcccaagggcttcttcgacatgaccgtcggtggccaaccagctggtcggattgtgatggagctctttgccgattgcactccccggactgctgagaacttccgtgctctctgcaccggcgagaaaggggtaggccgtagcggcaaacctctccactacaaaggctcatccttccaccgggtgatccccaatttcatgtgtcaaggaggcgactttaccgccggaaacggtaccggaggtgaatccatctatggagccaagttcgcggacgagaacttcatcaagaagcacacgggacctggcatcctttccatggcgaacgctggacccggaacaaacggatctcaattcttcatctgcacgaccaagacggagtggctggacggaaagcacgtggtgttcggacaggtagttgaaggcatggatgtggttaaagcgattgagaaggtggggtctagcggtgggaggact

SEQ ID NO: 8414 - DNA, 309 bp, Gossypium hirsutum
  Clone ID: uC-gsronu33B156a05b1
cctttgtgatcgaaacatgaagcaggtggattatatcagatttcatggctggaagaaagaggaactttgagggctaacatttggaatcaagcaaatgaggtgtttgaagagggaaaaaggaggctgtcgaatttttattacaaccatgcttttgagatcttttgaatctgaattatctttctctaatatttcgatgcattggtgttggtacttgttgtttcatacttttgcgtgttccattgtttgaaactttcattttcccaatgcaattcattcaagtgtggtttttaaaaaaaaaatatcctcctt

SEQ ID NO: 8415 - DNA, 198 bp, Gossypium hirsutum
  Clone ID: uC-gsronu33B156a10b1
tcctcgcgtccgcccacgcgtccgccaagttccaatttttattacttctgtgtgtttcctttgaaattcaccctcccaaataaattccccaactcgtccgagcttctgaaacagctgagaattcgatggactctttgggtccgaatcgtttatgatttctttgaaatttaccggcaattttgtgaacttagatgagga

SEQ ID NO: 8416 - DNA, 113 bp, Gossypium hirsutum
  Clone ID: uC-gsronu33B156b01b1
gtgtctattgaatcttaaaataccttttgttgaatgctttatgtttgctcaaaaaaaaaaaaaaaaaaaaaaaaaaaaaaaaaacaaaaaaaaaaaacttcccatatgtaccc

SEQ ID NO: 8417 - DNA, 293 bp, Gossypium hirsutum
  Clone ID: uC-gsronu33B156b07b1
attgtcatggcttcatcatctcctctttctcccattctcctctctctgtttctagtattcatttgtggggtgtcagctcaaacggctcccgcccctgccccctctggccccttgaatttcactggaatccttgacaaaaatggccaatacacctacttccttcagcttttggcacagactcaagttgggagccaagtacaaactcaactgaaaaccaccactgaaggctataccgtctttgctcccacagataatgccttcaacaacctcaaacctgggaccgtcaataacct

SEQ ID NO: 8418 - DNA, 250 bp, Gossypium hirsutum
  Clone ID: uC-gsronu33B156b11b1
gtatcagatcgcgagcggcgcccttacatttcttgtgttttctattcctaagcctgaaaagccccttcgcccatctctcctcattgttgcattatcttcaccatctctgtatatctttcaccatttgtcaccctagacattagttggaagtcttatcctacctgaggtccctttcttctgccttttttgtcgaaccctctttcagagacaaaacttgcaacatttaatccctgaataatggggatttaat

SEQ ID NO: 8419 - DNA, 129 bp, Gossypium hirsutum
  Clone ID: uC-gsronu33B156b12b1
tgataattcaaagactgtctcatcttacacagggttgcaagtgcctgaattagttttcaagtatgtctacgcttattattcactctttcttataaatacattctttatttattctttttaaattatatt

SEQ ID NO: 8420 - DNA, 537 bp, Gossypium hirsutum
  Clone ID: uC-gsronu33B156c07b1
cactgtcgtactgaaacagaacataatgattaaggctgtaagggctaacgcaccgggagctgagcacatggctactgatgccgaagtgaatgaatttgaccaagacccggatgacttgcaggggtgactatgacaatcttgaggtagacaattgcatgaatgtataattagcgactctcatgaatgtgttaacctgatttaaagtgatcctggctaatattgagttgaataccaatccttggaccggtctctgatgaatcggcttccagagatgaccatgacaggcatgaataatagacgagtgtgttaaatgacaggagagcatatggataagtggtggctgtgcatgtgaagctgaaacccattacgatcatctatattgtacttagtaaagggatagagggcgggcgccgtaccctctttttggacccaaggtcggctttggccggccgatccgggcgtaagacattgacaggttgtgagtttggctgggatctttgcttgcataatgtatataacttacaaatggttgtaaga

SEQ ID NO: 8421 - DNA, 389 bp, Gossypium hirsutum
  Clone ID: uC-gsronu33B156c08b1
ttgtcacctgctttgagccccaacgaagaagagatccttcacgtttttatattcgtcacttttatgttgtttattatgtctttttcttttttttcttattatctctatcactcttatttttttttatttcattttttcttttctatattattatttttataatctttatttttctctttttttttatcttattttttcattactttatcttttcttttcatttctttttaatttttttttattttttttcttttttattattctttctttattttttatttttttttttttattttatctttattactatttttttatttaatattatttattttatattctatatacattttttttcatattttctcttcacctttttttcttttttt

SEQ ID NO: 8422 - DNA, 428 bp, Gossypium hirsutum
  Clone ID: uC-gsronu33B156c12b1
tttagatcgcgagcgaccgtcctttatttttttccaactaaaattaggctttaaactttataacattatgggtttagcagcagccctcctcttcctcctcctagcagctccggcggcttttgccgagcaatacaccgtaggagacagcagcggttggaccacgaccggagattaccaaagttgggttcaagggaaaacattcaccgtaggcgacacacttttgtttacctacggtggcagccactcggtggaggaagtatccaagagcgactacgataattgctacaccggcattgctattaaatcctacagcgatgggaacactgtcatcacacttgtccaatccaggggccttgtatattaaatgccccatcataggttcctgagctggtggtctgaagcctgcctcaatgttgtctctttagtgg

SEQ ID NO: 8423 - DNA, 109 bp, Gossypium hirsutum
  Clone ID: uC-gsronu33B156d03b1
gatcttgcattgatccacacagcgaccttagtcttacaccgcacatcacgagaacagttagaagcgcaaaatttaaaaaccgtacacctctaaactattcacatatcta

SEQ ID NO: 8424 - DNA, 258 bp, Gossypium hirsutum
  Clone ID: uC-gsronu33B156d04b1
aaatggttaaaaaaaaaatagtatgtcaatcaaaattgatgcttattccataatcttatattttttttcagttttctttaatttatttcttatacttcacattattttactctcttacttaaatttatatttcaattttatttttatttcctttataacattattatatttaactactctctttacctttttaatttatattattttacttatttttatttataatttatacttatatctttcctttttcttttttat

SEQ ID NO: 8425 - DNA, 612 bp, Gossypium hirsutum
  Clone ID: uC-gsronu33B156d08b1
gatagtatatttctctcttcgtaaatcgtgtgtatattattgtctttgtaaaaatcgggatcctttatacaatgaaggtatacgggatttatagccattggtaacatgtgtattttatttttatatttattatattcttcttattttatttcaattttatatatattctatattttttaatatttccatatttatattttttttattattataattttatatcttttatttcttttttcctttacctaatattttttgtctttttctcatttatcttcttatcttcattttctttttcttcctccattaacttatttatttatattcattatatttattaattaaatttcttttttcttttatcttataaatttttattactttcttatctcttcttgtttcatatattttttatactatatttacaaatatattatctttattttcatataatacttatctttctacctactttttatctctaaataatatatctttacaaatatgtcttatatctctactatatcatcccaatctatatatacctatattacttttaactattcttccatcacttctatatcttccattctattatatcatattttcttc

SEQ ID NO: 8426 - DNA, 584 bp, Gossypium hirsutum
  Clone ID: uC-gsronu33B156d11b1
atcttttgaagttctcgaacaagttacagtcctcaaaacgattggcagccatgaaagttcatggataccctttgtcaacagttactcaaagggtccttgcttgcctttacgaaaaagatgttgagtttcagtttgttaacgtagacatggtcgctggcgagcataaatccccaaatttccttcccctcaacccatttggtcaagttccagcttttgaagaaggggacttgaagctctttgaatcaagggcaaccacccactatatcgcccatgaatacgccgacaaagggacccaactcttgttgccgggttctaacaagacgatggcagtctttcaattgtggaaggaagttgaagctcaccagttcgaccctccatcgacgaagctagtctttgagctgcgttacaagccccattttgggatgaccaccgacacggcggttgtggaagaatacgaagctaagtttgccaaagttttagatgtgtacgaggctcgtttggctgagtccaagtactttgcttgtgaccactttcaccttgccgatctgcatcacctccctactggtcagtacttgtggggagct

SEQ ID NO: 8427 - DNA, 522 bp, Gossypium hirsutum
  Clone ID: uC-gsronu33B156e01b1
cccatgcttccgatttgatgggcaggccaaataccctctgaaccttggtactacaaactcgggagctttaatttctgcaaaaggtgtacaatacttggagaggaaagtgtgtgtgatgaagccttcagtcagacttgatgatccacaagtggaaccaagtgtgagcttcgcatgtggtcttgccgactgcacttgccttggttacgggacatcttgcggaaatctcgatgcttgggggaacatatcttatgcctttaacagttactttcagaagaataaccagcgcgaagatgcctgcaaatttccaaatgtttcgatgatcacaaaagcagatccctccccaagagatggaaattgcaaatttaatataatgatccagccctattatggatctgcaggatggtacgcgcggaagccattgggattgacctttgttcttctcattttctcgttggttctgtgaattctaatgattctacttgagggtattcttgtgagagactgaaaagtgtatgaattaga

SEQ ID NO: 8428 - DNA, 441 bp, Gossypium hirsutum
  Clone ID: uC-gsronu33B156e02b1
cggctcgatatcatgttcaacaatgccggcactcatggtgacaacgaaacaagagtgacacacgccagcactgaagacttcaagaaagtgtttgatatcaatgtgttgggtggtttcttgggtgccaagtatgctgccagggtcatggttccggccaagaaaggttgcatactattcacatcaagtcttgcttcaaaaatcagcttcggtagcccccatgcatacaaggcatcgaagcatgccgttgcagggttgacgaagagcttggccgtggagttaggtgagcatggaattagagtcaactctatttcacctcatgcaattttgactccaatgttccaaaaatcaattgggatacccgataagaagaaggtagaggagatgattgctgtttatgagtgtttaaaggcacttgatttgataccttataattttcacatg

SEQ ID NO: 8429 - DNA, 899 bp, Gossypium hirsutum
  Clone ID: uC-gsronu33B156e03b1
cccacgcgtccgcggacgcgtgggccgctctctgatgtcatgcccgtcgacagtcccaacattcttcagacatcccaagattgcacgagcacagacgttcgagaattccttggagaatttactcaaaagctaagaaacattaaggccaggcctccattcaagattctcagcaaactctggtcacctaccgtactttctccagcacctgctcgggactagtaaaacatacctttaagccatggacttcacagggctgatagcttttcctttttctttattaccctgaaacataaaaataaaaaataaaaaaaaatctaaatatatatccctgatatttgtacattccttaaaaaatgtcctttttctgtttgggttttgcagcatataaagtttgaataccagcttgttgaacttgaatttataatggggctgttgaatcattaaaacaaatataacttcttcttatctcattttctatatatatctatttgggttgccttttataggatccagttatctacccgtgcatgcgttgttaactctttttattgttacacttaaaattatttacgtacgtttatatcatgcttgttcggtatatctgtgtttccctatttttcctttatctttctccttttctttgtataaaacaattgcttactctttcttactaattttatatctatggtattgcatttctttctccttaacttattcttgtttcttttattaaatgacatattacatttatttcaatttttttttcattttcatattttcttatcttatcataatttttatattcatatcatacttcataatctaactcttcttcttctcaatatttttactatttcatattctttttatattgttttatttttattttgttttctatt

SEQ ID NO: 8430 - DNA, 345 bp, Gossypium hirsutum
  Clone ID: uC-gsronu33B156e06b1
gttatagaagcggagagtaacatgaatgacttggtttctgagtaccaacaatatcaggatgcaactgcagatgatgaatagttctaggatgttgtgtaattatttatttatattttttttttattttttatttaatttttcttcattattttttcttatttttttcaattaatttatttatttttctttatatttttattaattattttttctttattacttttatctttcaatttttatataatttttatattttttaattttttttttatcttttatatattactttttttttatcttttttttttcaatttttattttattatctttacttatattaatatc

SEQ ID NO: 8431 - DNA, 370 bp, Gossypium hirsutum
  Clone ID: uC-gsronu33B156e11b1
ttatcgtggttttttaagttttcgtgaggagatccatgtccagctagaaagaataagcaaataatgctaagtttttattattattgataaattttagattgacattgttacattcaagaagcctacactagttcatatttagtacatatatactttcttaccatatttgctagtttttaaggtaattctcactgcatagatgatatgatttatgtgctttgagaaagactttgtttgtttgatacagtacatataaagcatctatgttatcggtttagtaattaatattggtttatttttagatcacttgcatattactttatttagttttcatgttatatttttctatttatatataataatgtcttaa

SEQ ID NO: 8432 - DNA, 275 bp, Gossypium hirsutum
  Clone ID: uC-gsronu33B156e12b1
gattaccatgctgaagttagcacaagcaaaaagataacagatgccaaacttgcaaaagattttcaagcagttttgaaagagtttcagaaggctcaacggtttgcagctgaaagagaaacttcatatttcccttttgttccccagtcagctcttcctgcaagctacacggtaggggagatggatgcatgttctgattaatgcgctgatcattgatgcccttcttgtcgataagatgacttttaggttgttttttctttttttatttgttttttttt

SEQ ID NO: 8433 - DNA, 328 bp, Gossypium hirsutum
  Clone ID: uC-gsronu33B156f05b1
aaaaaaaaaacaaaaaaaaaaaaaaaagaataaagggaaagctacgttgaaccaaaaggaaggggaaccgggggcagcggcgggaaaacgggcgaccagcgacgttttaaacgggagaaaacagaaaaggagggggaacaagaaacgaagaaacgcaaacagaaccagaaacgagacaaagggaaataaaagaaggacagaaagacaaagaggagaaggaggagtaaaaggcaagagagagaacacgcaaaagaaagaagagaaacgaaaaagaaaggaagaaaaaaacaagaaaaaaaaaagaaaaggaactataaagaaaaagaaa

SEQ ID NO: 8434 - DNA, 290 bp, Gossypium hirsutum
  Clone ID: uC-gsronu33B156f06b1
gatgatcattcctcaggaaccacatcgccctttcttccattttgcaaatactttccgtaagaatgcacataaggatcttctgtcatatataattctttcccattattaacgtacttatatgacttttctctttgtaggaggagatttatgtttttgatctcatacactttagatgtatctagttctataactttttttggtttttatgtatatatctaaacctatccttaatttactaagcattttatttaagtttatgtaattactttaacttatatttattttttaat

SEQ ID NO: 8435 - DNA, 490 bp, Gossypium hirsutum
  unsure (1)..(490): unsure at all n locations
  Clone ID: uC-gsronu33B156f07b1
gacataagttcacaaagaacccaaaagttgattacttttttgataacccaaaacacgaaaatgggtgcttctgaatcagttcctcaaaaatcaatccatgaatttacagtcaaggattacaaaaaccaagatgttgaccttagtatgtacaacggaaaagctcttcttgttgttaatgttgcctctaaatgtggactcactgattcaaattatacccagttgactgatctttacaacaaatacaaggaccaaggactggagattttggcattcccatgcaatcagtttttgagccaagaacctggtaccagtcaagatgcacaagaatttgcttgtacaagatacaaggctgaataccctattttccaaaaggttcatgtcaatggtccaaagacagagcctgtctacaagttcttaaagacanacaaatctgggttcttgggaaataggataaagtggaactttactaagtttttagttgacaaggatg

SEQ ID NO: 8436 - DNA, 288 bp, Gossypium hirsutum
  Clone ID: uC-gsronu33B156f08b1
ctctattcgtccgaaattccttaatttttttccaaatcaaaatcgcaacccaactgctgtagccaatcggtagagtagattgaccttacggaatgtttttgtttgaagttttattgccatagatattaaactgatatgtttttcagtgtcaacttttactttggttattttattgtataaagagttacttttttttttactacttagttttttttatcttatttatcttcatctgtttttagattttcttatttgtcttctttcttttgttagattttaatttttttt

SEQ ID NO: 8437 - DNA, 217 bp, Gossypium hirsutum
  Clone ID: uC-gsronu33B156f09b1
cccatgcgtccggtctgcttggatcagtgattaccagctatttgagttaatttgaagagtctgatgtgatcgtgttgaatttagtataattaatcatgtttaatgtcttataataattctttcttatttaattctaatctattttttctttacattgattcattttttttttttattttttctttatgttttattattttatcatttattcttatat

SEQ ID NO: 8438 - DNA, 552 bp, Gossypium hirsutum
  Clone ID: uC-gsronu33B156f11b1
cccacgcgtccgggtgaaacccgcaaatggaaggctgggacccgaatacgaagtcgacgctaacacagatcccgctactgacgacgaaggcgggtcccagagacggagcggcatggactcagcggctgaaggaggagtataaggctttgatcgcctacacgcagatgaataagtccaacgacaacgattggttccggatatccgcagccaatccggaagggactcgttggaccggcaagtgttggtacgtccataaccttctcaaatacgaattcgatctccagtttgatatccccgttacttatccggccactgctcccgagctcgagttgcccgaactcgatggcaagactcagaagatgtacagaggagggaagatttgtctgaccgtgcatttcaagccactttgggcaaaaaattgtcctaggtttggaatagcacatgccctgtgttcggaacttgacccatggcttgcttcagagattccgatcttggtcatatcgggtcgatctagcttatggttattcatccacatcttattagtctttcttt

SEQ ID NO: 8439 - DNA, 594 bp, Gossypium hirsutum
  Clone ID: uC-gsronu33B156g04b1
gttgtatgaacgatttcttggagaaataatatcatagtgttcattgtatgtatagttagattgaggaatgaaatctgtggacgatagtgtttcaagactttacccactgtgataatttttatttttatttttttttgcattttcaccttcttgatgcagaccatttcttttatttttattctatttttttatttatcatcttttttatatttttaatattttcttttcttctttttttctcttttcttcctactatttttctttctttttcttctcttattttttttatatttctttttattttttcttttattcattatctttcatattcttttcccttttcttatttaatttttatttctcttatcttatctattttatcttttttcattatttctttcttttttttttctcttttattttactcttattttctttatatctttttatttttttttctatattttcctattatcttttcatttctattttttctcaactctctttctatttttttcttctttttctccttttttttactttacttactttatttatatttttatcttttctctcctctccttcttttcttta

SEQ ID NO: 8440 - DNA, 489 bp, Gossypium hirsutum
  Clone ID: uC-gsronu33B156g11b1
ggaacatgtccaaagacgcaacaggcactcagcagccctgcccttacacctaattatgtattgcgtagtctaatagctcaatggtgtgaggcaaatggtattgaaccacccaaaagacccagcactcgtcccagtaaaactacatctgcctgctcaccagctgaacgtactaagattgaaattctcctccgtaagctcgcatccagcagtcctgaagaccagagaatggctgcaggtgaaatccgtcttcttgccaaacgcaatgcagataaccgtgtggccattgctgaagctggggccatacctcttcttgtgagccttcttttaacacctgattcacgcatccaagaacatgctgttacagcacttcttaacctttctatttgtgaagataacaaagcaagttatcatattctttggagcagttcctgttatagtccaggtgcttaagatgttgtgcattgtatcttgagaagatgcattatccac

SEQ ID NO: 8441 - DNA, 533 bp, Gossypium hirsutum
  Clone ID: uC-gsronu33B156h01b1
gtttcatgtaatgttcgcccacaaaccgcaccatgtgcaccatacttgctatgacaagattcaaggatgcgatttacttgaaggtgaatggggaaaagcttggaaccattattcagtctggcgttatgtgcatgatggaaaggctaaagttttaaagcagctagttgaagcgatagatcctagtaagaacttgatcactttcagagagatagatggagatcaactgaaagagtatatgagttttgtagccacgcttcaagtttcgtctaagaacaagggtagtggcagcatagtgcactggactgtgggaattcgagaaactgcaccaacgggattgcacattcccgagacttctgttgcaattcttggtggatgccttcaaggacattgacgttaatcttacacaaccaaactaaggatcgttaagaacattcgatgtccgtactgctcactactactacctggagcagtacttattttatttagaataaattgacagctcccttctttttttgtataattctaatatgtat

SEQ ID NO: 8442 - DNA, 394 bp, Gossypium hirsutum
  Clone ID: uC-gsronu33B156h03b1
atcatgatgaaaatgtggatgttttctctttagtctttctttctgtttgaaaaaacgatctccctagaattgttcacttgcgttatggaagctatcatcgaaacaatcatagcactgatcatcggcaacaacgagaaagtcgctaaccatcaaaactttgttcttcaaaagctctctttctggttcgctcccactacacgcccacctggtctactctctttcacttctggttcctaaaaacaaactctcatacaacttcgtttagctttctttttatttttgggggtgtttttatatggctgctttctatttcaacaacaacatttttttatctgggaattggtattctgggttcctcgatccctttttccgcgatttggaaccatgccatggg

SEQ ID NO: 8443 - DNA, 98 bp, Gossypium hirsutum
  Clone ID: uC-gsronu33B156h09b1
cggggggaccgcacgcggccgatcatgatgaaaaggtggatgtgctctctataatagttctatttgtttgaaaaaacgaacctgctaaaatgggcaat

SEQ ID NO: 8444 - DNA, 300 bp, Gossypium hirsutum
  Clone ID: uC-gsronu33B156h12b1
ttcatgcgtccgggacccagggcatgatccatctagcagatcctttggttgcacaaaatgagtatttatgtcaccaaatccttgattattcttttttaatatatgcatctttatctcattcttttcttctaaccttttttattttattatatttattattcttattatttatatatttctttatttatatattttatttttttatcttatatttaactttttttctttatttatattattcttctcattaatttaaattttaatatattatcttttacattacttttattaccttttaat

SEQ ID NO: 8445 - DNA, 480 bp, Gossypium hirsutum
  Clone ID: uC-gsronu33B157a03b1
aaccattctctctagcaaagtttattccctctttctttgttacaaccctctcactttccttgtcaactttgttcccaacaagcatcttgatgcagtcttgatttgttgagtagagttcaatttccttggcccagacttcagaaagattagtaaatgtctcccttcgtgttacatcataaactgtttaagatcaaagaaaacctcatattgtaattctccaaacaaattaagagcagaaatacatgcaaagtcataaaattgaccagaatgataaaagctaaatgttacattacagcacacttaaaagaggttagaattgaagaggcatctaatcttagtcatgtgaagatgttaaccacttatactgactacagcaaaaaaaaagctttagcagagtaaaacttttttacagataaaaaggaagtagaaaacatctaatcatttaatccaggccaaggcaatatgtaaccacagtagcta

SEQ ID NO: 8446 - DNA, 199 bp, Gossypium hirsutum
  Clone ID: uC-gsronu33B157a05b1
gagatgttggatgacaacgaatggcgatacagttacagcgctatcgacttgaaccgacacatgtctaaggcttacgtgagagagagattgtgctgatgtggatacaagctttagcaattttaatttagaagagatgttatgagagaataaacgaattgtacggagcatatttttgtgtgaagaagggttgttttagtat

SEQ ID NO: 8447 - DNA, 305 bp, Gossypium hirsutum
  Clone ID: uC-gsronu33B157a07b1
caattttgccatggactggttttcttggctctcaaaaactggcctggacccatcccttgtctacgagtacgcccttgctttctcccacaacgagcttgaagaagaagatatagtttatttcaaccatgagtttcttcaaagcatgggcatctcaatagctaaacacaggcttgaaattctcaagcttgctaggaaagagagagggctgaccccaagaccagttttcaggcttctattggcattccagagaaccaaatggagcttaggcaagtacattaggacatgggttcgtcgttaagaacact

SEQ ID NO: 8448 - DNA, 456 bp, Gossypium hirsutum
  Clone ID: uC-gsronu33B157a08b1
ggctttcgtagggtacggaacaacaaaggggtcagattacataatagtgaagaactcgtggggagccaaatggggagaaaaagggttcatacggatgaagaggaacaccggcaaagctgaaggcctttgtggtatcaacaaaatggcttcttatcccaccaagaaaaactgatcaacacctttgatttcttcctctttttaagctttttttttatttttatttttatttttctatgttcacaaaatttgctgcccaatgtccctttggttataataaaaattcctcataatttcgttttaaaaaaaaaattataattttatagttctttaacacttaagtattgtataaaatttctaaaattttttctcctttttaaaatatggggcgtttgttctagaggaaccatttttactttactgcgggcattagaacttcattgttctttttaatggtcc

SEQ ID NO: 8449 - DNA, 458 bp, Gossypium hirsutum
  Clone ID: uC-gsronu33B157b02b1
cccacttttccgcaatccctaatttattgtcagtacgaaaagaaacctttgattatttaattcccgttttctaatctttttgggaaatcggtagcaaaaaaatgtcgtcgtcggggaggaagatcacccttaagagctcggacggcgaatcattcgaggttgatgaagcggtggcgttggagtcgcagacgattaagcatatgatcgaggacgattgcgctgataacgggataccgttgcctaatgttacgagcaagatcttagcgaaggtgatcgagtactgcaagaaacacgtcgaggctcctaagacagacgatcgatccgccgatgacgagctcaagagttgggacgctgactttgtcaaggtcgatcaagccactctctttgatctcattctggcggcgaactatttgaacatcaagggtttggtggatctcacttgccaaacttgttgttga

SEQ ID NO: 8450 - DNA, 279 bp, Gossypium hirsutum
  Clone ID: uC-gsronu33B157b05b1
caagagtaccgccgtcgtttccctttccgccaacgctggcgatatcaagctacgcgcttccctgactgatgcgacattcatcaagggtcccagcctgaacggtttgactcttgctgttgaaaaacccggcttcttcatcatcgactacgatgtccccaaaaaggatttttggtttcagttcatgaactcagttagggttgtggtgaatgtcgtgaagcttacttacattcacggtagaatgtgacatacccggaccgtgttggacggtacactaacctt

SEQ ID NO: 8451 - DNA, 111 bp, Gossypium hirsutum
  Clone ID: uC-gsronu33B157b11b1
atagggagagcggggacgccccagcaggccccgccgcaaaatccggggcgagacaccacgcgtgcgagtttatatacgaagcgatgcccaatagtaatgggggtgtgctta

SEQ ID NO: 8452 - DNA, 534 bp, Gossypium hirsutum
  Clone ID: uC-gsronu33B157c02b1
gcaaagtttaaagagaaaaacatgaatgggatgcttcaacatttcacagtttcaatgtcttgtggtgggttttcatcatcatcttcatcagatgaggaatattcatcatcttcaatggcggctcaagtttcaccatttccaaggcctggaaggataagtagatcaatgagttattcagccaggatggtaaggagatcagaggcaattgtttgtcatccaaagagttcactagttgcagtgatgattcaagctattgctcatagggtgaactatgtttgggttatagaagaagattgtagcttggttgggattgttactttttctgatatgttaaaagttgtccgggaaagttttgaaaccatggcctgaaaaggaaaatgagatgagaaagtttttttgtttttttaataatttttggttgatcatctctgtcgatcgctaacaatgctgagagaactcaattgaggctggtgggagacgtattaaaaaatgaaaaagatttgtgtgaatattggaatttttttgtttgtttgt

SEQ ID NO: 8453 - DNA, 254 bp, Gossypium hirsutum
  Clone ID: uC-gsronu33B157c03b1
gccatggtgaagtttctgaaatccaacaaggccgtgattgtcctccaaggccgatatgctgggcgcaaagcggtgatcgttagatccttcgacgatggaacacgtgaccgcccctatggccactgtttggttgcagggataaagaagtacccgttcaaggtcaattcgcaaggatttcgtcaagacatcagcaaagaaattgtgcgtcaagtgctttgtcaagctcgttcactatcattacctgatgcccactc

SEQ ID NO: 8454 - DNA, 56 bp, Gossypium hirsutum
  Clone ID: uC-gsronu33B157c06b1
tggcaatattgtcccattgcttatcagagcaagaaataaaaggcaaattgatagcg

SEQ ID NO: 8455 - DNA, 517 bp, Gossypium hirsutum
  Clone ID: uC-gsronu33B157d01b1
ccattgttttttatgattctaccttttccactcaaaaacttgatcagggttttgattcctttccaaatctcttcacttttcttcaagaaagcatctttgttgttgttgctattaataatcttgttcctcgccttcttctcctttgatttcagttcttcaaatctttgtaaaaaaaaccagaaggaacccaaatatttaataccctcaaagagcaccatgaggatccatccgttgccgaagaaaagaaacatcaccgtccaatacgagatgaacccaaggaccacaaggtctcaagctgagaccttgttgaccggcgggtccaacaagaagctccggaggttaccccacatcttcagccgcgtcctcgagctgccttttaggtcggatgcagacgtggcggtggaggaaagccctgactgtttcaagttcgtggcggagacggatgggatgatcggcgatgtcgtgagggctcattacagttgaaatccatcctgtggttactaagattgtgattagg

SEQ ID NO: 8456 - DNA, 525 bp, Gossypium hirsutum
  Clone ID: uC-gsronu33B157d03b1
cccacgcgtccggaaaagatagtggagtaaagtgcaaaattacgatattttgcaccgaggtaagtaaacacgtgacttaatgtattattttgatattatttgatatatgttgagatttatttggaattaaaataaatgtttggcaatatcctaaaaatgttgttaaatcgggaaaggtgataaagggttgcaatatatgggttatgggttgaacactcggaataagccgaagtatgttgtatataaaagggtttgctgtgtgttttatttccctaattaatgactgttactattttctacttatttttctttattttattttagaattatccatttatcttttatttgaatatattttatttgtcctttttttattttctctttctattgttttcttttttgaatgatttgatatatattactttttttttttcatttctttaattttaaatcttttttttattctactaaaatttatcatattcttattattattttttatattttttaatacatcttccttat

SEQ ID NO: 8457 - DNA, 291 bp, Gossypium hirsutum
  unsure (1)..(291): unsure at all n locations
  Clone ID: uC-gsronu33B157d05b1
cccacgtgnccgctggtatctcaggtggtcatatcaatccagcggtgacatttgggctgttcttgggaaggaaattgtcgttgacaagggcaatatactacatggtgatgcagtgcttgggagccatatgtggggctggtgtggttaaagggttcatggggaagacaaggtatggtgcttttgcttatttatcgacttatctgtatatttatgtataattataatgtaattcattttcttattttttttatttttagcttatattatttatatttttacttatttttattt

SEQ ID NO: 8458 - DNA, 111 bp, Gossypium hirsutum
  unsure (1)..(111): unsure at all n locations
  Clone ID: uC-gsronu33B157d06b1
cccacgtgnccgtagcttgatgcattgccgtaaattatagatgctggtaacatgattttgcattgttgtctcatcctttgtagtaagtaggtaattttaatttttcagatt

SEQ ID NO: 8459 - DNA, 418 bp, Gossypium hirsutum
  Clone ID: uC-gsronu33B157d07b1
cccatgctttcgcccacgcgtccgcgaggtgagtagatacatttagcattgagaaggagcttattatatacttcaagatagaatttctgttatattttttatatttttattattaatttatttttaatttatatttatttaatatctttctttattttattaataatttttctttaatatacctttaaatctatttatttttatatatacaattatacttatttatatttctatttatttctaaatttctatttatataaacataatattatttatcatattaaatattaaatatttataccccatatgttatataaatggtttttatatttattaatccttatttttaattaatattattattttatatttttattttattatccataatttattttaataaatatttataaattta

SEQ ID NO: 8460 - DNA, 61 bp, Gossypium hirsutum
  unsure (1)..(61): unsure at all n locations
  Clone ID: uC-gsronu33B157d08b1
caaaactanaatgagttcaatgctcggaagccggaagaagtgaacatttttcgtggactta

SEQ ID NO: 8461 - DNA, 454 bp, Gossypium hirsutum
  Clone ID: uC-gsronu33B157d11b1
caaaatgttaaacccaatggcgatcccaactcagttagtcctctcctttctcctcctttctttttcctccgtcgttttttcagacggtgaagattgcgtttactcggtctacataaggacgggatccatcatcaaaggcggaaccgactccatcatcggcctacggctctacgatgccaatgcctactcagtggagatcagcaacatcgaagcgtggggtgggttaatggggccaggatacaactatttcgagaggggtaatttggacattttctcaagtaggggacgttgcttggatgcccctctttgtgccatgaacttgacctccgatggttcgggtgagcaccatggatggtactgtaactatgtggaagttaccatgactggcgtcccttaaccttgttgcctgtatcagttatggtggagcattggttggccctctatcccctacttt

SEQ ID NO: 8462 - DNA, 217 bp, Gossypium hirsutum
  Clone ID: uC-gsronu33B157e05b1
aacccattaacccatctatcgacatggaccgacccagattcgtaatcgattctgccgaagtcgaacagatggccaaacaatcacggcaaacggtgctccatctcctgccgtcgttggtcaaatccgcccaggccttagcccgtccgccaatctcgaactaccacgtcggcgccgtcggggtcggctcatcgggtcggatctttttcggagtcaatct

SEQ ID NO: 8463 - DNA, 498 bp, Gossypium hirsutum
  Clone ID: uC-gsronu33B157e06b1
cccacttgttcggagttattccctcaatgaatatcactttcaggacctccattgaagcttcaagaagtggttagaggtgtaagacccatgcctcttccagaaatggcaaatctactcaacagtttccggttaatgatttgtcctgggcttgatccaaatcctaataatctagttgcaagcactaccttctactcggagagtacgcatgccatgctatgtttgatcagaattgaaacagatcctgcagacagaacccagttgcgaatgacacttgcttcaggcgatcctacattaacattcgagttgaaggaattcatcaaggaacaattgattagcattcctactgcttctcctcagtcaccagcaccagcaccagcaccagcaccacctcccgcagtttaagcgaccccacaaataccaccgaatgatcctgcagctctactagctggtttgctgccgtgaaaatggaagatttgttaagttttacacttagaaacc

SEQ ID NO: 8464 - DNA, 334 bp, Gossypium hirsutum
  Clone ID: uC-gsronu33B157e07b1
cccacgcgtccgtaccaatcaatatcctctaattctaaagctaagagttttaagttaacgaagcatttgggtcgtttcgaagtaatggaaacttcaggaaaagtaaagaagggagccggaggaaggaaaggtggtggcccgaagaagaagcccgtttcaaggttctgtcaaagctggtctccagttccttgttggtaggatcggactgtatttgaagaaaggaatggttcttcgcttggatggattgctggtatgaatgagcaagtttgttctctgatggtttgcgatctattttggtttattaactcaatattcttgggtttcttcttttgta

SEQ ID NO: 8465 - DNA, 181 bp, Gossypium hirsutum
  Clone ID: uC-gsronu33B157e08b1
gtagtaccgaccctctcatcatcacattcactttatttaggcttcctattttttttcttttttctttccattgaataagtcttaaagaaacttaaaccccttcgtattatcagttcataccctatattcccatactccttgttgtcaacatcaaaaaactcaacttttctgtttacttact

SEQ ID NO: 8466 - DNA, 279 bp, Gossypium hirsutum
  Clone ID: uC-gsronu33B157e11b1
cccatgcgtccgcggacgcgtggggaacattttcatccgtaaaatattttgtgataaaaaaattaaaagcattaataactggattaagtaacgacaaataaattattaaaaaagtggtggcgtacaacacatagttagaaggggtatcaaataaaaaaaaacggccagaaacgtggggcctaaaattttggaaaccgatagagaaactttaataaagtggatcatccattaccattttttatagactaatttaagataggtgaaaaataaataaattaa

SEQ ID NO: 8467 - DNA, 567 bp, Gossypium hirsutum
  unsure (1)..(567): unsure at all n locations
  Clone ID: uC-gsronu33B157f02b1
gactgttttaactcatcaaggttcaaaagttgtcactgatgtcctacaacaacgacttggtgtcaacagggcggttatagaatatatgagcacctagaagtctttgagtgctctcggataatgtttatcagggaagtggcatgtttctctattcgcaatgatcctttatgagatgcttgaaggagaaccaccattctcgaattatgaaccttatgaagcagctaggtatgcagcagcaggacacacgaccttcttttcgttcaaaatgatacctctctgaactcagagacttaacagacaattgatgggctgtcgatatgaatcaaagaccttcttttttgtatattcttaagaggcttgaaaagatgtatgaaaaaaaatgtctgctcagatcattgtgtgaggatatacaatacatcgtattcaagatttgatgtagctgatgataaaccttgcgtttccaccaatcacctccaagctcccccatttgtgccgatggatggtactgtaaatagactcagtaagttgcttgttatagattntaccataactggttttcctcaaaaa

SEQ ID NO: 8468 - DNA, 474 bp, Gossypium hirsutum
  Clone ID: uC-gsronu33B157f06b1
ggaaaactcggaaagacatgaaccgtatggttgctttttacaaaggattaacaacgtgggctagatgggtgaaccgcaatgtggatcctttgaaaaccaaggtttttttcacagggcctttcttcaacccattatgagggaagggatcggaacatgccagcagagtactgctcctgacagacatccccattcgtcgggatgagaaacgctgcaggtacacctatggcttgtgttgcagcttaggtgttccatccgaattggttattgggacgcgctctgtagcggatacctggttgctggtgggatagctgttaataacccagcactgtttgcattgaagacatcagttgtagcctttccttgtgatcaataacattacttttttgccagtcagctgtttattcaccggaagcttttgataatcttactatgtacaggaaccttaatgattgtatagaaattctttgcgcaaac

SEQ ID NO: 8469 - DNA, 666 bp, Gossypium hirsutum
  unsure (1)..(666): unsure at all n locations
  Clone ID: uC-gsronu33B157f11b1
ggattttctaatgcggcctaaatacagtggaaagtatctgaggaagacgatttgcatggtccttggggatcgaagacttcatgagactttaacctccgttgttataccgaccttcgacatcaagttgcttcaacctaccgttttcacaacctttgaggcaaagatggatccttcaaaagatgctttgctatctgatatttgtattgctacagcttcagctccaacttattttccagcttatgcatttcatacaaaatattctgaaggaactgatagggaatttcacctggttgatggagggatagctgcaaataacccagcactgctagcattgaagccaacaggggtagcctttccaagtgagcaagaacatgaagtttcgcagggacaagcccttaactacgagaatcatttgataatctcactaggcacaggaacctccaagatgggaaagaaatacgatgcgaaaacggcagagaagtggggaattcttggatggctttacagtgaaggaagctctccattagtggatgctttcacttatgctggagcagacatggttgaccttcacatgtcattgattttcaagggcattaaatccgagcatanactatctcggattcaggatgacaaattaagcgaggatgattcatcaactgataaagc

SEQ ID NO: 8470 - DNA, 549 bp, Gossypium hirsutum
  Clone ID: uC-gsronu33B157g01b1
acgcggccggcgatttttttagggtgaaactccgatgttacgctgaccttaggcaagtatggctataaggttcgagttggtcggatcttcatcactcatggtccacgcatgaacattgatgatggtcgtgtcgttagcaatttcatatgctcaggcactccgaacagagcgtgtgactgatgaatcacctgaaacacagacacggagatggtgatatgatgccgacatggcatgacggctgactccgactaatggaaggagagaccaccggagcaatcaatatggggaatcgctgtgacttcaccatgctcgcgcttgcagaatccgcgaaggagcttatcgatcctgaggtgaagatatcgatggtggaaaacactcccgatgatccacgacaaggaagacgcacataaccaatgcagaagaggcgctcggatgggagccacaggtgaagatgcgtgacgggctaacgcttatggaggatgattttcgtaaagggctcgtggtccaaagaagaactgattgaagtgattaacagcaaccgagtttcaa

SEQ ID NO: 8471 - DNA, 691 bp, Gossypium hirsutum
  Clone ID: uC-gsronu33B157g02b1
gtttatcatcgggcaaaaaccaattaaacccgcacttaggaaataaaaaccataaaggaaaagagagtaaaaccaccttaagccaaattaagcaaggcagaaaccaacaaaatagtcagccaagtagcttccatatccgatgaaaggatgaccaaaatgtgaaccagaggaaacccaaaagctttgagtccagccatggagattccaagaaccttctccattttcaaagccttctacgacaagctgtgatgacttcgttagcaaattctttgatcccttgctatcaacatcttgacagaaaccgaaacctcatcgacccaaaatccagaccgctgacttctccttccttccatcgccagggtatgggccactccattaactaaacgggaagaaacaggtaacatatttcgtcaaaacacttttccaagttacacatttggtgaatattggtcagataaccctctcttctactgctccttctaaatcttcttctttgtcaccatctttgccatcatctctagtctcatcctcctcttacttttcaccacttccaccacattatcattgtaacatcatcatcatcatcatcataatcataacataacataatcataatatcaatacttatcattatatatcaccatcaccatacatttttgttcaatgaaaaattagatttatattctataaa

SEQ ID NO: 8472 - DNA, 679 bp, Gossypium hirsutum
  Clone ID: uC-gsronu33B157g03b1
cccacgtgatcgcccacgcgtccgtaaaattagaagaatagaatgcaatcatgatcggagaaaatgatccgtagtattgtggttcgtgcggactgctaagagtttggtgcatgtgaagcggctaccatggaagttcctagggaatcgtgctcttctggttgaggggatggctgttgaagtttatttgggatgcccgtaattgccttttcgggtcttcggtcgggaatgctgctggtatgttcaaggcattgccttgatcggaggaaacgttggggtttaaccaattgttcactaatccgagttcgctgttatggtctttctcacaacggctttaagattcgaagacacgaaatttcggatttttattggttttgtttgcttggtagaatgattctaaaaacagactatagattcttcttacactctttcaaaagtgctaacaaaaaaatatctttttttgagtggtgatgtttatatacacttatgatccaggttcgtttaatttcgacttgaagaatcgatcccttttgttcttttttttcgtgttctttagtttgttgtatttccttggtacctttgttttaattttcgatttctgtttttggattgaaattcttctaatataaactcttctttctcttttttatgcttatgtcatctctcttttttctctttcttt

SEQ ID NO: 8473 - DNA, 523 bp, Gossypium hirsutum
  Clone ID: uC-gsronu33B157g05b1
gcgtccactcgtcgggcaggaacggaaatcctctgaggatgaaaattgccacatgctcacggtctcagatcttaagatagctattgtgggtagacacgctctagctaaacttaaaacggacactgcagcctatacttatttctatttaagcctttccttgttatacatttcagtttgagatcttgtaaacttttaccgactttttttctcataattgttacttatggctcctgctatcaaacctctctatctgaaattgatggttgactttttaatttgaaaaaaacaccataatgataaatgttatagatttctattattttattatgctttttttatacttctatttttatttagggtttccgttttaaaggtcccaaagtttacgtacgtctgattgctacgctatatcttttttattgggtttccttaatttctatacaatgccccttctttttaaaactatcttccctgggaatacccttgcgatacccatcttaattgcttggtattaattcccctt

SEQ ID NO: 8474 - DNA, 392 bp, Gossypium hirsutum
  Clone ID: uC-gsronu33B157g06b1
cgcgccaacatggaagctgattagactaacttaaaaaaatgctttttctttttaagagcaaatgatgtcaaaagacccgaaagctggtataaaaggcgcgagctgcgctaaacgtaagagaggacacggcagcctaaacgtatcatgtatttaagccatgcctaggtatacattacagcctgagatcttggaaactcacaccgactttttttctcataagtgtaacttatggctcctgctatcaaacctgtctatctgaaattgatggttgactgttcaatctggaaaatacacattgctatatatacgtaaaagatctattaaacacagaatatcaataattaaacccaacaagtaataacgggtggcccgttttaaaggaatccaagctt

SEQ ID NO: 8475 - DNA, 340 bp, Gossypium hirsutum
  Clone ID: uC-gsronu33B157g09b1
acgtgccaaactttaaatacggtaggacggtaaaaaaagaaaaaatgagctgtgtgaataaattccgatttggggaaagcttgaagccgacttatctgcattaagtgtgtttgcttaactcgtttcttctccctagatggtgctgtttcatcttgctgtgactggtgaacctttctggttttaatgccggtactacatggcttccatgctcatgcccttggtgatctatcttaacggcatgcatgttatctggatccgatttaaagtttgctgtcaaagagcatggtgctccctaggattacaaccgtcatgctgttgttctaagatatttaagttttga

SEQ ID NO: 8476 - DNA, 349 bp, Gossypium hirsutum
  Clone ID: uC-gsronu33B157g11b1
cccactcgtccggaaaagacgggcatcgcttaatgattttgataggttcaagctcatgttggcaaagattaagaaagctggaatcgttaggcaggagctagctaaacttaaaaaggagacggcagcctaaacttatttctatttaagcctttccttgttatacatttcagtttgagatcttgtaaacttttaccgactttttttctcataattgttacttatggctcctgctatcaaacctctctatctgaaattgatggttgactttttaatctgaaaaaaaaaactgaatgatggaaagaaataagaatgaaaataacccagcactgatagcatagaaaacaaaaag

SEQ ID NO: 8477 - DNA, 82 bp, Gossypium hirsutum
  Clone ID: uC-gsronu33B157h02b1
ttcagtagtacaatcgaacccagccgacaccttgggggtggtcatcgaaggaaacatcaccactttgaccgaaccttcacta

SEQ ID NO: 8478 - DNA, 57 bp, Gossypium hirsutum
  Clone ID: uC-gsronu33B157h07b1
tacatgagttcatttgaacccagaacatcaactttgggttgaatataggaggaaaca

SEQ ID NO: 8479 - DNA, 536 bp, Gossypium hirsutum
  unsure (1)..(536): unsure at all n locations
  Clone ID: uC-gsronu33B158a02b2
ctttttctgggactgggacccaaggtactacttactaggtgttggcctcagagcagggttacggggaggtcgaagagctttgtgttcgtattacacaattggaagcccctcagcaagaaagaggacagtaagaaagtcaagagcagacttagccggaccgatataaaaggattctcctcccttaacatatgttggagggactgccgatccaatttcaagagacccggcctcactttcattaccatgcctttgcccaagtgacttcgtatctcacctgacccggtctcacatcctttagtcgctcagaacacgaaggacggtcaagcatgctctcgtgaaatcccaactttcatccgagacttcaaggataggaataaagcagctatcaagatcaaagcctttttcgcacagcacaggagggaagtacgaccagagcccagggaaagacttaagccaagactgattccttcaagaaaagctgttaaagcattaaacttttnctccttgttcatatgatagacacgtgcctcgagggg

SEQ ID NO: 8480 - DNA, 278 bp, Gossypium hirsutum
  Clone ID: uC-gsronu33B158a09b2
taataataaaaaaaaaaaaaaaaaaaaaaaaaaagggggtttttttataaaatttataggggaaaaaaaaaaaaaaaacaaaaaaaaaaaaaaataaataaaatacaactaaataaatttaatttaatcatttattttctggccgctcctttttggagttccctttttttccccccccttcttcccctccattacttttttttttgtgccccttaatttaattcctttgccccctttttctcccctcctttcttagaaaccccttggcttcccccctt

SEQ ID NO: 8481 - DNA, 465 bp, Gossypium hirsutum
  Clone ID: uC-gsronu33B158b04b2
ctcttattttccttcctctctttttcttttaatttttaggtctcatgttctgaaaaattgcaaatcttttttttggggattgatttctcaattcttttgaaggaaccttaagagggacatggaagctgttttacaaaccagagggctactttcattgccacctcatccgaccagagttagaagccttttgaacccatcacaaggcttaaagcacaggctttttgcctcaaaacccttaggccttaatgggttatctctgtcttataaaagagttccaagcgtcgtagcaaaaccaaatggtttatcccctaaagaaaagagctttatttgcaaggctgaggctgctgctgcagctgatgggcagcctttgttcggtgaaatcccgacgccaaagttcttggggactgagcttgtgactctcaagaagattatcccacttgggttaatgtctttttgcatcccttt

SEQ ID NO: 8482 - DNA, 524 bp, Gossypium hirsutum
  Clone ID: uC-gsronu33B158c02b2
cccactcgtccgggtacgtgctaaagcacagtgcaaccggagaaattatcataaaacacctgaataaggagcaggaggctgatcagagcaacttccgtgatcctgaaacctctgcagagttggaagttcaagaaaaaatgcccttactcgaatggtttgccaacgagtacaagcgctttggttgttctcttgaattcgtcacaaacaaatcccaagaaggatcacagttttgcagaggcttcggtggcattggaggtatcctccgctatcagcttgacataagatcattcgatgagctatccgatggagaagtttacgaggattctgactgataaagcactgcttaaagatggcatgatggcttgagagcctatagagccctgatgtaatgcttcgtgtttttacttatttcaccttttaatttcaaaaactatagacactgttggtttggtttttgctgaattgtgctgtctctgtcaattggattgtgattgcttgtaatcaggaaccgttcattgtttttt

SEQ ID NO: 8483 - DNA, 494 bp, Gossypium hirsutum
  Clone ID: uC-gsronu33B158c03b2
cgttgttgtttattacgataaattgttgtctggggaaagtgggattggactcatcgaccggttcgatgcttccaagtttccgactcggttcgccggtcagatccgggggtttacttctgaagggtatattgatggaaagaacgataggcgactcgatgattgcttgaggtattgcattgttgctggtaagaaggcacttgaagatgctgatcttgggggtgataaattatctaagattgataaagagcgaaccggagtgcttgttggaactggtatgggcggtcttactgtgttctctgatggtgctcataatctaatagagaagggtcatagaaaaaaaacaccattgttcattccttttgctataacaaacatgggatctgccttgcttgaattgagcttggtttcatgggttccaattattcgatttctaccgcttgggcatcgcttcaattattgctttatgctgctgctcaatacatccgtcgaggtga

SEQ ID NO: 8484 - DNA, 276 bp, Gossypium hirsutum
  Clone ID: uC-gsronu33B158c06b2
cccacttgtccgcccacgcgtccgggtgttttcaccagggtagctataggattcagcacggggggaagggaggtgccaaaaaagttgtaatttcagctcctttggcagatgcacctatgtttgtggtgggagtaaatgagaatacctacaatccgagcatggacatagtttctaatgctagttgtactaccaattgtctagctccactggccaaggtggtccatgaggaattctgatttgctcagggttttaatgtcaactgtccacgcatctaca

SEQ ID NO: 8485 - DNA, 440 bp, Gossypium hirsutum
  Clone ID: uC-gsronu33B158c08b2
ttcacgcgtccgctcttcactccaaaagagtggtacaaaagcttgcttggattaaacggaattgtctaccacccagatggctacttaattgtaattcatactctcagcggaaatttgtttaagattgatctagccaagggagatgaagtgaagttgattgaagttgccggtggtccactagcatttggcgatggtttagagctgatttctcctactaagcttgtagttgccgccggaaacccttctgggagattggtggagagcaccgatggatgggagacggcttccgtcgtggcaaagtttaagggtcctatgcatcgtttagccacggcggcgactgtgaaagatgggaaggtttatctcaaccatatgtttggaatggggtaccccaggaagacacatgccctctgtgagtttgtttctctaacttgaaattgaac

SEQ ID NO: 8486 - DNA, 505 bp, Gossypium hirsutum
  Clone ID: uC-gsronu33B158c12b2
ttttataaaaaaaaaaaaaaaaaaaaaaaaaaaaggggattcttttataatatattttgggggataaaaaaaaaaaaaaaattaatatcttcatatttttatagaggcctctcttagaggttcaaatttcctcttttttttccacctcttctgggggccccttttttagggaccccactttttcccccccggctttccgttccttttttttttttttgggccccctttatttattttcttggccccttttttcccccccggggtcttggaaacccccgggttttccccattttttttcttttgacacctttcccttttttcccggttggttttttaccaaaaggccccccccttttcccctttccaaaaatttcccccccctattgggtatttggcccccccccttttggggtctttttaccccgggggttgtgggggtttcccccctattgtgcccctttttttttcacggcccctttgcccccccctccttttggttttctcc

SEQ ID NO: 8487 - DNA, 531 bp, Gossypium hirsutum
  Clone ID: uC-gsronu33B158e03b2
cagtatctcaaactcccaattcccaaagctcaaaatcaaaaaacctaaatcagatctaacatttttttgtcaaaatttaccgcaaaagatatggctctagaatgggtagtgctaggctacaccgccggcgctgaagccatcatgttgctcctcctcacagttccaggcctcgacggactccgcaagggcttgatcgccgtcacacgtaacctcctcaagcccttcatgtcggtggttcctttctgcctcttcctcctcatggatatatactggaaatacgagatgcgtccaacctgtgacgccgatacctgtaccccttccgaatatctccgtcaccagaaatccatcatgaagagccagcgcaacgcgcttctcatcgctgccgctcttattttgtactggcttctttactctgttactaaccttggatgtaagatcgagcagttgaatcagcgagttgagaggcttaagattcgcgattgagataagtgctgcgaattttagatctgttgtatttgggctacttctttt

SEQ ID NO: 8488 - DNA, 531 bp, Gossypium hirsutum
  unsure (1)..(531): unsure at all n locations
  Clone ID: uC-gsronu33B158e05b2
cccattcgtccgcttcaaagcaaataaaactttgaattgttcatacaaaacaatgaaaacccacttttttcccctggtttttctcctcatttttttcttagcccaaggtctgaaccccaaatgtgccatccaagaccatggctcaaacctgcaagtgttccatgtttacagtccatgctcacccttcaaaccctcaaaaccactctcatgggaagaggatgtgctgcaaacgctagccaaggaccaagccagggtgcagtttttgtccagcctggtggctaagaaatctgtggtgcctatagcttcaggcaggcagattgtgcaaagcccaacttacattgtgaaggccaatattggaaccccacctcagcccatgcttatggccatggatacaagcagtgatgctgcttgggtgccttgcactggctgcattggctgctcttctactgcttttgactttgctaaatccaccactttcaagacccttggctgccaagctgctcaatgcangcaggtaccaaaccccacttg

SEQ ID NO: 8489 - DNA, 291 bp, Gossypium hirsutum
  Clone ID: uC-gsronu33B158e08b2
tttgctgccaatgtgttgcagagtacaaatggtgcaacttatacagtgggtgactctactggctggaaagtccctaccaataatgatttctacgatgattgggctgataacaaaatcttcgttgttggggatgttcttgtgttcaatttcactaccggacaacacgatgttgcagaggtgacggcatctgcttacgatgcgtgcaccactgccaatactatatgaaccgggagccccggtccggcatggttcactgttaacaggcccggcgatttaacttcattcgcgctg

SEQ ID NO: 8490 - DNA, 526 bp, Gossypium hirsutum
  Clone ID: uC-gsronu33B158e09b2
tcctcgcgtccgcccacgcgtccggggaatcagtctttggtatcggtgatataagacaatctcaggaatggctaggaaatcggtggataaatttgaaggaaaggcatgatcttgtgagtaccatactctgggccggaaagcaagacgtaagcagatcctataatttcaataccgacaaaaacaccatttgtgagagtggacagtgtggtaaagaagccactgagtgtaaaggttctgctgttgaaccaggaaatgagagggcacaagatgcgagtgttgttccagatctttcaaaggatgatcggctttctcagttgaagtggaagtcatctaggaagagaaaacgtgtgacttcgacctgtgtacggaagctgaattgcagtcgaaacctcatcaaaagcactgcacagtcagttgcttgtgaacgatttttgattcctgcatccttaaaagtcgataatgagaactgcaagaacataggtgatccgttatttagttcttcagtagtaccgtagtaacaagcttg

SEQ ID NO: 8491 - DNA, 255 bp, Gossypium hirsutum
  Clone ID: uC-gsronu33B158e12b2
aaaacatacaagggggattgcaaagtccaaggaataaaacttgaaatcaagggaggaaaataaaaatacaaataaagtgcaactccatggcctaggactgtaaagcaatgttatcaatggaaatagtacctattgcaaaaataaaaccaaaagcgtttctaggactactaaggcactttaaaaaggaaaatgcacaacttgagcaaaccatcatatgggggataaagtaacttttttaaagccaaactctaaaat

SEQ ID NO: 8492 - DNA, 486 bp, Gossypium hirsutum
  Clone ID: uC-gsronu33B158f12b2
ccttcgcgtccgcccacgcgtccgaaagcccctcagggttctagggtttttgcggcaccaccaacagaagaaatgggtaaaggaaccggaagctttggaaagagaaggaacaagactcatactctctgcgttcgatgtggacgtcgaagcttccatctccaaaagagccgttgcggtgcttgtggctatcctgccagccgcatccgaaaatataactggagtatgaaggctattagaagaaaaaccaccgggactggccgcatgagatatcttcgtcatgtgcccaggagattcaaaactggctttagagaaggtactgaagcagctccaaggaagaaggcagctgtagctgcttcataagtttaattgtggtgttttcttttcagattcctataaacacaagttttgtgtttttatcaactgtgttacttttatttttcatgtaatatttacaaatgggaagttttactatgttatgaatttttc

SEQ ID NO: 8493 - DNA, 267 bp, Gossypium hirsutum
  unsure (1)..(267): unsure at all n locations
  Clone ID: uC-gsronu33B158g02b2
acggactangccggtgaggatgtgacaatgaaggtgatatcattttctcaacaaggaccaagagctatttgcatcctatctgccaatggagtaatttcaaatgttacacttcgtcaacccaattcttctgggggcactcttacgtacgagggtcgctttgagatactttccttgtctggatccttcatgcctacagaaactcaagggacgagtagtcgatctggtgggatgagtgtatttttggtaagtgctgatggccgttttgta

SEQ ID NO: 8494 - DNA, 299 bp, Gossypium hirsutum
  Clone ID: uC-gsronu33B158g08b2
tgatagtaagaacaggaggaaggtttaaaacccaagttaaaggcattacattgggataaagtacgagctagctctggtcgtgaaatggtgtgggatcaccttagatcaagctcattcaagttgaatgaagagatgatcgaaacactattcgtcgtaaatccgaactcgaaaccaaatcaaacgacaccgcggaccgttcttacatcaccaaaccaagagaatagagtattggatcctaaaaaggcacagaccattgtatcttttttgaaagcactcaatgtgacagtggtggaattttt

SEQ ID NO: 8495 - DNA, 499 bp, Gossypium hirsutum
  Clone ID: uC-gsronu33B158g09b2
tggttatcgaccagttgcttaatgttgagaagcagatgcgcttcgccggcgatgtcgctggaaccaagaaagcggttactgacattttgctgctttgctttgaagctaaagattggaagtctctcaacgaacaaatcgttaatttgtccaagaaacgaggtcaacttaagcaggcagtaactgcaatggttcaacaagcaatgcagtacattgatgaaacaccagatctcgaaactcgtatagagctaatcaagaccctgaacagtgtgtctgctggaaaaatttatgttgaaattgagagagcaagattgatcaagaaacttgcaaagattaaagaagaacagggccttattgctgaagctgcagatttaatgcaagaagttgctgtggaaacttttggtgccatggccaaaactgagaaaatcgcctttatccttgaacaagttcgcctctgcttagatcgtcaggattatgttcgtgctcaaattcttttcaggag

SEQ ID NO: 8496 - DNA, 413 bp, Gossypium hirsutum
  Clone ID: uC-gsronu33B158h08b2
ttttctaggttgaaattttaaattaaagttcagaggcgaactgcggttaattttgcccaagtgcttgttttcttgtaggtaatcgtccaccggccaagattccagttccattgccatcatctcgttcaatgaagagtgatgagttattaagtcggccactgcagcttactgaacagggccatattcttgaagtggctattgaggcagctgcaaatgccataatcaatatgagagatattttgaatgattgggatagcacagttggtgacggtgactgtgggtcaacaatgtataaaggggcaacagcaatccttgatgatatgaaaaatactatcctttgaataatggcctcaaaacagtgaatgaaaatggatcatctgtgagaagagctatgggaggaacctaggggggtc

SEQ ID NO: 8497 - DNA, 514 bp, Gossypium hirsutum
  Clone ID: uC-gsronu33B158h12b2
ttcttgcgtccgcccacgcgtccgggagaagtactgggacatccagagcttggaatacttgggtctaaacgccattggtttgaagggtcaaagtcctgcatttttagctcgtctaaagaatctgaaactcttgtatcttggatattacaactcctacgacggaggaattcctcacgagtttggatcattgagtcaactccaactcctcgacatggcagcctgcaacctcaccggcgagattcctgtgagcttgagcaatttgaaacacttgcacacgttgttccttcagcagaacaatctgacgggccgtattcctcctcaactctccggtttgatcagcttgaaatcgcttgatctttccataaacgagctgacaggggagatacccttgagtttctctgccttgcaaaacattacactcatcaacttgtttaaaaaataatctctacggtccaatcccatcattctgtggtgatttttcccaccttgaagtgcttcaacctggggggaacca

SEQ ID NO: 8498 - DNA, 561 bp, Gossypium hirsutum
  unsure (1)..(561): unsure at all n locations
  Clone ID: uC-gsronu33B159b03b1
gtttttcttcgctcgcttctctctttcgtcgaactgcgcgtaataatcgctcatatttctcgcagacgtgaagaatggggctgtctttcacaaagctgttcagccggcttttttgccaagaaggagatgcgtatattgatggttggacttgatgctgctggtaaaaccaccattctttacaagctcaagttgggagagattgtcaccacaattccaaccattggtttcaatgtggaaactgtggaatacaagaacatcagctttactgtctgggatgttggtggccaggacaagattcgtccattgtggaggcattacttccaaaacacacaaggactcatttttgtggttgatagcaatgatcgtgatcgtgtggtcgaagccagggatgagttgcacaggatgttgaacgaggatgagttgagggatgctgtgctactggtatttgcaaacaagcaagatcttccaaatgctatgaatgctgccgagatcactgacatgctnggccttcattctctccgtcagcgccactggtacatacagagcacatgtgccacttcc

SEQ ID NO: 8499 - DNA, 559 bp, Gossypium hirsutum
  unsure (1)..(559): unsure at all n locations
  Clone ID: uC-gsronu33B159b10b1
tgttgtaagaagataaagggggaaaaaccaatggggtttgcttcattcgccggtcgagttttctttgcttctattttcatcctctccgcttggcaaatgttcaatgaatttggggttgatggcgggcctgcagcaaaggagttgataccaaagcttgatcttgctaagaaacatatatcatctcaactccatgtaaatttgccagatatcgaagttagacaattagtcgcaactgccatcattttgaaaggactaggtgctattctgtttgtatttggccatggattcggagccttactcctgtttgtctacttgttggttagcacaccacttctctatgacttctacaactatcgtcccaatgaaccccaatactctgttctgcttggtgatttcttgcagtgtgttgcgcaatgtggtgcattaattttctttgtggngatgaagaactcgatgccaaagaggcactaatgagggatggcccggagcatatagctacttagatgtaatcaaagaagtaaaattttggcactctcctgtaataccttgcaggtctatc

SEQ ID NO: 8500 - DNA, 351 bp, Gossypium hirsutum
  Clone ID: uC-gsronu33B159c06b1
tcgttcctttggacggagcgttgatgaaacaatgaggactctcttggccttgctttttgtgcaggaaaatccagatgaagtatgcccagctgggtggaaacccggagagatatccatgaaacctgaccctaagctcagcaaggattactttgcagcaatttgaggtatagcctagaaagcagaaggtatgtgttgcgtccattaggattgactaaatgagtttttgtttttcaatgtatcttttttgttttaaagaattgcttagccttggatggcaatataaaagtatggggaaataatcaaatattaatgtttggattgtgtcttttgttaaaaaaataaatatattga

SEQ ID NO: 8501 - DNA, 71 bp, Gossypium hirsutum
  Clone ID: uC-gsronu33B159d01b1
cgttatcgtatgctataaactcgacctaaacaaaaggggtgaatcttgagcacattttggaaaaaaaacaa

SEQ ID NO: 8502 - DNA, 550 bp, Gossypium hirsutum
  unsure (1)..(550): unsure at all n locations
  Clone ID: uC-gsronu33B159d07b1
gttttgttctcctatgataattatgtcggttcaactccttcattgtacatttttaatgacatgaacgagccttctgtgtttaatggacctgaggtgacaatgcccagagatgctttacatcttggtggagtggaacatcgggagttacataatgcctatggatattacttccacatggcaacagctgaaggccttctaaagcgtggagatggtaaggacagaccttttgtcttgtccagagcattctttgctggaagtcaaaggtatggagcagtctggactggtgataattcggcagattgggatcatctcagggtttcagtcccaatggttttgacgcttggtcttactggaatgacattctctggggctgatgttggtggattttttggcaatcctgagcctgagttattagtgcgttggtatcaacttggtgcttattatcctttctttagaggtcatgctcatcatgacacataaagacgagangcctgggttgttggtgaacgaaataccgcacttatgagagatgccatacgaattcgttaca

SEQ ID NO: 8503 - DNA, 509 bp, Gossypium hirsutum
  Clone ID: uC-gsronu33B159d12b1
tgattctacttaacgcaaatagttcgagtttcgtaatcaatggctttaccgaaccaacagactgttgattatccgagctttaagctcgttatcgtcggcgatggaggcactggaaagaccacatttgtgaagaggcatctgactggagagtttgaaaagaaatatgagccaacgatcggtgtggaggttcaccctttggacttcttcactaactgtgggaaaatccgattctactgctgggatactgctggacaggaaaagtttggtggtcttcgagatggttactatatccatgggcaatgtgctataattatgtttgacgttactgcccgtttgacatacaagaatgttcctacctggcaccgtgatctttgcagggtgtgcgagaatattcctattggtctatgtggtaacaaggttgatgttaagaacaggcaggttaaggcatagcaggttacattccacaggaagaagaatctgcaatactatgaaatctcagccaagagcac

SEQ ID NO: 8504 - DNA, 575 bp, Gossypium hirsutum
  Clone ID: uC-gsronu33B159e08b1
ttctctcacaaatccccttcgctcttcagtttcttccccacaaactaagaagaaaaagtgaagaggaacaaaaatggctgtctcttcggccacattttctacttttgtctcggccccatacggtgtcgttcttgggcaaaccctcttctttccgccttcttcatccaactaacgtgcacatggtacgaaccctgactcaagccacggcttcaaagactgacaccggtcccaggaagccacgtggcataatgaagccccgccctgtgtcgcctgagatgcaagctctcgtgggagtcccggaaatccctcgaactgaagttcttaagcagatttgggcttatattaaagagcacaatcttcaggacccctataacaagagggttataatttgcgatgacaagctgaagaagatattcggaggcaatgatcgtgtcgaatttcttgaaatcgccgggttgattaatcctcactttctttgatggattctagagaaggcgagagagagcaaaatcagtttgcaaaatatgcatatatacctgtgtctattggagcctatcttttttggtgaaatattg

SEQ ID NO: 8505 - DNA, 547 bp, Gossypium hirsutum
  unsure (1)..(547): unsure at all n locations
  Clone ID: uC-gsronu33B159f02b1
ccttcttttccgcccacgcgtccgaagaataaaaatgaaattaaagaaaaaaagatgcaacccatagaaatgaaatccagatcataatgagagactcctttcttttgttttccattcataaagacagaagctaagacgaaaaaaagaatcgacccttcgagtattccaccaaattgcctgagaaaactgagagtaagagggacatatatatgttatgaaatacccatctatattgaattgcgaatacagaaatgataaaatatttttggaccaaataaaaattaatatgggtctccgatagagacgaaagacggataaacaaacaagaaaataggtaaagacccttcgatttaagaatctgtatctatatctactaaattcaacggtttcgcataaaaagaaagcatataaataaacgaaagaaaataaacaaatgaaagaagggggaaaggagggagaaagggggaaggaggggcatcctatgagatcctaatctcagacacataagggatatgcgaaatgtagacgctcngacttattgattgag

SEQ ID NO: 8506 - DNA, 56 bp, Gossypium hirsutum
  Clone ID: uC-gsronu33B159f09b1
cctaataaaaaaaaaaaaaaaaaaaaaaaaaaagggaaatttttaaaaaaaattta

SEQ ID NO: 8507 - DNA, 554 bp, Gossypium hirsutum
  Clone ID: uC-gsronu33B159g03b1
gatttgtgcttcctgccttgaatggaaaattaactggaatggctttccgtgttcccaccgttgatgtttcagtggttgacctcacagtaagactagagaaagcagccctttatgatgaaatcaaagctgctattaaggcggcgtccgagggagaattaaagggaatcttgggttacactgatgaagatttggtttccactgacttcgtcggtgacagcaggtcgagtatctttgatgcaaaagccggaatagctctgaatgaaaattttgccaagcttgtctcttggtacgacaatgaatggggctacagcacccgtgttgttgaccttatcattcacgtggatgctgttttgaaagctaagtaagttggtcggctggattgtctcggcagctgtatgtaatttacggatcgatccttacctgttccgtattatggtggggccatgagttaaagaaatagccttgttagagtcttatgtcaatagtttacctctttattgttaaataaacgaatctgagttcttcactttaatctttcgtgcgagaaaatactc

SEQ ID NO: 8508 - DNA, 534 bp, Gossypium hirsutum
  unsure (1)..(534): unsure at all n locations
  Clone ID: uC-gsronu33B159g10b1
gtctccctttttttttttttttaataaacagtaaaatatatgtactagtaacaaagaaaacagaaaagaattcaaccaaaaaaactagttacacggaagaatctataaacccaatccaaagaaataataagatgcaaaatctcgaaatctcaatgaacaatactgcatagctaacatgtcaacctaaggtcaagcagtaggtggagctggtggggctgatgtnagttttgttgttaccaccgccgccgccaccgccattgttttcccatggtctaacagtgaacaacaccacaaataagacgatcaccagcaacagtatgatagcataacaagtccatttccgggtgtttttctggtaattcctagctgtttgaagcntctcagttcctcctctcacaaatgaattagccctattcacatggctctcgatatcatccaattgctctccttgagcctgaaccagcaccgncatgtcaagaaacttgatgcatttcctgagattcttctccataacctagcagcatcatgcctttc

SEQ ID NO: 8509 - DNA, 564 bp, Gossypium hirsutum
  Clone ID: uC-gsronu33B159h07b1
tttttgatagttttgacatggacaggactctatgtctggttccaccagatggtgaatttcctgtcatgaactaccgaatgacgcaggaatttaagcctcctttccggatttaattgtttaattgaagaagctggacagcttaaagctgaagtgattattaaagtacgcgcggagttcccttcaaacattactgccaacacaattgctgtacaaatgccacttcctaaatatactactagagctagttttgagttggaacctggagctgttggacaaagaactgatttcaaagaagctaacaagaaacttgaatggggattgaagaagatcgtgggtggatctgaacatacacttcgtgcaaagctgacattttctcaggaatcacatgcaaacctcacaaaggaagctggtccagttagcatgactttcacaataccaatgtataatgtttcaaggcttcaggtgaaatacttgcagatagcaaagaaatccagctcctataatccatatcgatgggtgagatatgtcactcaggccaattcgttttgtgctcgatatgatact

SEQ ID NO: 8510 - DNA, 389 bp, Gossypium hirsutum
  Clone ID: uC-gsronu33B159h12b1
tttttcaatcacttgaaaaacgcagctgcagggggatctctttaggtggttctgatgctcttgaaaaaagtgacacctgtgaggagctcgggggtgtcccatgaagaacacgagggggtaattttctactacactctatcacttcccaaaactctgatcatgctcgggaacacaattatgtgattatattatcacatgtggtgatatttgtgtgtgccatgtgcctgtgctgaaatatactccaatgtgtgcctcctagaaatggggtctctcagaatttctcggaactcgatctgaattcttgatgagtctcgagctcacatcaatatagtgtaatggagacacattgtgtctcagaataaaaaacacaaacctattatacttattat

SEQ ID NO: 8511 - DNA, 436 bp, Gossypium hirsutum
  Clone ID: uC-gsronu33B160a07b1
taataaaaaacaaaaaaaaaaaaaaaaaaaaaggagaaaaaataaaaaaaaaattggggaaaaaaaaccccaaccaaaaaaaaaggaaacacaagaaaccaaacacgggccggccacttcagaggtcccaaagcgcggcccccaagcacgcgcccctggccccctttaaacagcgcccccacggggaaaacccgggccgtacccaaccaacgcggcgagcggaaaaccccccgcgggcccccagccaaaaaaccgaaaaggcccccccctatcgcccgtcccaacagtagcacagccggcagggccaacggcccccccccccgagcgcccacccaaacgcggaaggggacgcgccccgcacagggggaccgcccccgtggcaggggccggaccccccccccgtcccaaaccccccccactgccaaggccccccccc

SEQ ID NO: 8512 - DNA, 494 bp, Gossypium hirsutum
  Clone ID: uC-gsronu33B160b04b1
gtgattgcgggaaacaagtatatttgggtggatttgacactgcttatgctgctgctagagcctatgatcgagcggctattaagtttcgaggtgttgatgctgatatcaatttcagtctctgtgattatgaggatgatatgaaacagacgaaggatctgagtaaggaagaattcgtgcatgttcttcgtcggcagagtactggtttttcgaggggaagctcgaaatatcgaggagtaacgttgcacaaatgcggcaggtgggaagcacggatggggcagttcctaggcaaaaggtatatttatcttgggctattcgacagtgaagtagaagcagcaagggcttatgacaaggcagctatcaaaagtaatggacgggaggcagtcaccaactttgagctgagtacatatgaaggggagatggtctttgataccaggaacaaaggcaatggtcacaaccttgatctgaacctggggatatctccacctgttagcgat

SEQ ID NO: 8513 - DNA, 348 bp, Gossypium hirsutum
  Clone ID: uC-gsronu33B160b06b1
cccatgcgtccgacatgcttaaaacaccattgaaaagggctggttgtccggcaacgtgtccttaaaaaatatatcccctgtttttttctttttggctactcctatgttgttttaatgttagttttgtttttgttgcttatggaacatgtaaaccaacatgaagtttggctgtttcttcattgtggttacagttttaagggtagaaaactcaaaagtgcctcatttccatgttgtcttgagccatttgttctatgaaatctcggatttaatttaacaggcccctttcttaaggaagagatcatgtatttgaaaggtttgaaagtcattgctggagctgaacagccaggg

SEQ ID NO: 8514 - DNA, 515 bp, Gossypium hirsutum
  Clone ID: uC-gsronu33B160b11b1
tttcgcgtccgctttgattggctttcgcatcagctccatggatcgggcccagctcctcctcgtaggattacctctcttcctcttcgccaccgatctcttcagcctcttcactcctccgcccccaaagccgccgtcccatcaccatcaccaccatcatccccacctacccaaacctccactcaatcctgaaaccctagatatttctttacagaaacccagcgctattggaggaatcggctatggcagcacggttaatatcaatttctgcgcttcatgctcttacaggggaactgctgtgacaatgaagaagatgttagaagcccagtttcctggaattgatgtaatccttgataactatccaccatcattgccgaaacgtttgctttcgaaagtggttccagttttccaatttggagttatagggattatgatggcaggtgaacagatttttcctatgattgggattacgacaccacctccgtggtattattccttgcgtgcaaccaggttcgggt

SEQ ID NO: 8515 - DNA, 554 bp, Gossypium hirsutum
  Clone ID: uC-gsronu33B160b12b1
tttctcgcgtccgggctgttgtaaggattcgctttgcagataaccacacattagagcttacatttcatccatccgagacacttcagagcttggttgaccttatttctaaattgattgctcgaccagatttgccattctacttatatactacgcctcctaagaagcaaataaaggacatgacacaggatttcttctctgccggtttcattcctggtgcaatcgtgtatttttcatatgatctgccaaaaggtgaggatgctgcagctgcaaattcaggcccctttcttcaggaagagatcatgtctttgaaaggtttggaagtcattgctggagctgagcagccagagtcacttcaatctgcccctgagcctgcttctgccagtgcagtgccatcccctgctgtgcacgagagcaagcctaccgagaaaaaacctgccaagccaaagtggttcaaaatgtgagcttcggcacatgatctcaacattaatagatttcgagaagcggtaacttgattgcagatcaaatgataagtttgttcaatgcagtgactacag

SEQ ID NO: 8516 - DNA, 468 bp, Gossypium hirsutum
  unsure (1)..(468): unsure at all n locations
  Clone ID: uC-gsronu33B160c02b1
gattgtactgacctatctctctcaccctctgatcgcctcaaggtttccagccttggttttggtggaaatttcaactccttttttggtgcctctgtttcaactagatcttcttcattacagaaatgcaactcaaggagtatccaacccatcaaagctacagctactgaaattcctcctacaattccaaagtcacggagcagtggcaagaccaagattggaatcaatggttttggtcggattggaaggttggttttacgaatagcaacttcaagggatgatattgatgtagtagctgtcaatgatccttttattgatgccaagtacatggcttatatgttcaaatatgattcaactcacggaccctttaagggaactatcagagttgtggatgagttcacatggnaaattaatggcatgcangtacaggttgtaagcaaaaggactctgcagagatcccttggggtgagt

SEQ ID NO: 8517 - DNA, 436 bp, Gossypium hirsutum
  Clone ID: uC-gsronu33B160d01b1
atgctttatctccggagttgcgccagtgaagatgacctttgagggaccagatatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggtgaaaataatgtataagccatttggttgggagcaaattgtccttttctccaaaggatttttgctgctcattcatggtgacttggtttatggttttatctgttgttgttaaaatcttataaaaatatatatcggttgctgctcttggtttgtatcattgctaatt

SEQ ID NO: 8518 - DNA, 527 bp, Gossypium hirsutum
  unsure (1)..(527): unsure at all n locations
  Clone ID: uC-gsronu33B160d06b1
gtaataagtatcagaaagcttgatttcagtcctaatgggatctttaccatagtttatgttaacgatctcaagaactctcccggacctggaaaaagggagctcaggcaagctaccaaccaagcccttcacttgcttcaggacaattatccagagtttgtggccaaacaggtgtttatcaatgttccatggtggtacttggctttcaatatgatgattagtcctttcctaacccagcgaaccaagagcaagtttgtgtgtgcaagtccagccaaatcatctgatatccttttcagatatattgcgcctgaacaagtaccagttcagtatggtggattgagcagggacggtgaacaagaatttacggttgctgatgctgcaacagaggtgacaatcaaaccagcaaccaaacacagcgttgaattccctgtaactgagaagagtacagtggcgtggtaggtacgagttgtggagtgggacgtgaactatggagctgaacntgtgtatacagctgacgatggatacaccgt

SEQ ID NO: 8519 - DNA, 480 bp, Gossypium hirsutum
  Clone ID: uC-gsronu33B160d12b1
ccctagtacgcatccgcggacgcgtgggcaagaccaggggatgattatcaaccacattatgcggttgccctcccctcgtgactacggaaacggaagctcttcttggttttggtagtgtcataacaatgatcatttcaatttgtatacacctacccctgtcaatgtcttggacttactagaccacgacgaccacgtctctcttgattttgtttggcatggctttgcctaaccttgtaatctctgcactcctttttgtcacctcaattattgttttctactttggattgtattgcaacatttattatttttttactactttccctgttatccttctttctttggtgttatattacatggattgggattgcattgctataattaataattgagtatcccttattcctcccgtttccctctattctagtctaatttattcataaaagtaaataaaagtttagtccaaattaagattatgctttt

SEQ ID NO: 8520 - DNA, 458 bp, Gossypium hirsutum
  Clone ID: uC-gsronu33B160e03b1
ggtgcgccgcctggtgccgccgcgcacataattggcgggaccgcacgcgtccgctttttagtggggggtagaactgctgaataaagcttgttttagtgtctttttaaacatgagactgagacactgttatcgtttatgcatgatcagatgaagcaaagatgtgtggaacagttcaaagaaagaactttggggattgaacagattgacgtggggggggcgttttaaaggatacattctaaagtgcgcgaggcagcaacaccttactttttttatagggtgccctaaatcgattttcagggcgcgcgtttaacaacgaagggacgggaaaaaccctggggtaccccaactaaatcgcttggaggaaaagccccttttggccagctgggatataagcaaaaaggcccgacccgatcgcctttccaaaaaattgcccaccctgaatggcaaagggaaccccc

SEQ ID NO: 8521 - DNA, 384 bp, Gossypium hirsutum
  Clone ID: uC-gsronu33B160e07b1
attaataaacatacacaaaatcggacgaggggggcgatttaaaaggatattcgggccgaaacccccagccggccgatccgaacggaagacattgacagggggggagcttggctgaagtcggacataatgtaaaagataacgcaggactactaatatgaacataacgagaccagaaatcacgggtggaacaaaaggaaaaaagcacgggagatgcaagaccccagtaccaacacgaaccgagaaagcgaggccaatcgaatcatcagaccctctgaacaagaagcaagaggagtcagaaaagataccacagggataacaacgctagaggcaaccaaacgaacatagccaccgaagattaaagaacctacaaattggctcctaact

SEQ ID NO: 8522 - DNA, 552 bp, Gossypium hirsutum
  Clone ID: uC-gsronu33B160e08b1
tcttacgcgtccggaccacaccaacaccaacaatggtgttgtttcgtcatctggggtcctacaaagccaacatcttttgatgtcaccaacgacaacctcttcattcaatttcgactcatcttcttcgtcttcaccatcctccatgaattgtttccagttctcaaaaacaacctatcttgtgaagatggaagagcacaatttctttactgcagatgaagcttgcaatttcttctctgatgagcaagctccaagtcttcaatggtgttacccggagcaatggaactaaaagcagaagccaaaatgaacatgtatgtaacaaaatgctaagaaataagccaaaaaagcaaagttgggtatctaaaatgaagctccaagagtgttgtaaaatgcgaattacgtaacaagttaaactactaataccgtgaaagaaagagaaaaatggggatttggagctgaagaagaggcacagagatgggttgatatggccgtcgaaagagggcttaaagcatatggcgacaccaggcccggcgtgcgggaatgataggtcgtatt

SEQ ID NO: 8523 - DNA, 544 bp, Gossypium hirsutum
  Clone ID: uC-gsronu33B160f01b1
gctggcacgccggcacggaccgggacggaatggccggatcgacccgtccgacttaattattgtatgtaactaatatggaccatgctgatgctgatgaccttggtttgggggggaacaagattagcgacagcaccgtacatgctggaggtagagtagcttgcggtattatcggtctgcaagggtgaaactacagtcctggtgagcgggaataatacattgagtggagatgcaatggcctacgagcaaactctgtatgtgaactaggaagtttgtgaataaaagtaaaagaacccttgttttgtgttggttttcagactcaaaggagtgtggtctcttaacggatgctttagccatttatagtatgctgactattgctgaatgcttaattttggtgctttacttcctggtaaggctatgatgattcatgaatgcttcaagccattttcatggttaattgtgcatgaaacccatcttttatctttgtaatttgactaataagtcgacaatatttggaagttgggtttcgattttagcatagcaacca

SEQ ID NO: 8524 - DNA, 539 bp, Gossypium hirsutum
  unsure (1)..(539): unsure at all n locations
  Clone ID: uC-gsronu33B160f06b1
gtgtgttcgaggtgtcgaaaccggaaggaagttgctgttctggattgaaaaccgtgttgaaaacgggccctgagtgtttatgtgaggcttttaagagcagtgcttcaatgggtgtttcattgaatgtcactaaggcctctacattgcctgctgcttgtaaagtttctgctccttcttctacaaactgcgctgcatctgtcactcctgctggtgccccagatgtggaaccatcagcaacagcaggtgcacccacaacattctctgcagcaaatgaggtagcaccaacaccagctccgggaatctcaggctctgcggtgctttcggtttcggccggatctattgtcgtaggcattataagtatgttggtgtcgggctacgtactacgttaaaaacgttacggattattggacatgagagtgagagagagattattgtttattgatgtgtggttgtaatagatttatgtttcattttgtggngttattggaaactctatgagctttggaccatcctctaaaatttagtgctatagtgttcta

SEQ ID NO: 8525 - DNA, 421 bp, Gossypium hirsutum
  unsure (1)..(421): unsure at all n locations
  Clone ID: uC-gsronu33B160f10b1
ctttgttaactcttctatgtctactacaacacgaaattttcaatttcagtttggagattgggaagccaaggcttcacaacaaaatggaggatgattttctttcaacttacttggtggcatacattgaaaaagagagagctgaagaattttcaattctttttttgcnnaaaaaaaaaaaaaaaaaaaaaaaaaaaaaaaaaaaaaaaaaaaaaataaaaaaaaggggagggtgtttagaagaatcaaaagcttactttcccttccctagggaagaaaaaacaatgcttttgggtaacgtaaattaaattcaatggccgtggcttaccaacccaatgactggaaaaacattggcgtttacctaaataaatttcttggcagcgcatcccattttctttaggtgccttattatcaaaaaggcccc

SEQ ID NO: 8526 - DNA, 528 bp, Gossypium hirsutum
  Clone ID: uC-gsronu33B160f12b1
gtttaagatctctctctcactctttctctctcctgtcttccctgatctcattagatccattcaaagggcaacaaatcatcagaggaagaagtaaagcaaattaagaaaaatggcagcaacattaggagactcaagctcctggtccactgctcttgtcaagatttcaccttatactttctccgccgtcggtatcgccattgccatcggcgtttccgtcctcggcgccgcctggggaatttacataactgggagtagtttgattggtgccgctattaaagctcctcgaatcacttccaagaatcttattagcgtgatcttctgcgaagctgttgctatctatggtgttattgtggcaattattttacaaacaaagttagagagtgttccttcatcacagatatatgaaccagagtctcttagagctggatatgcaatctttgcttcaggaattattgttggatttgcaaaccttgtttgcggattgtgtgatggataaatggaagagctgtgcgctgtctgatgcacaaa

SEQ ID NO: 8527 - DNA, 544 bp, Gossypium hirsutum
  Clone ID: uC-gsronu33B160h08b1
caattaaattatctcccaattttgctggtttagttttctttatttttcctctccttgatcgttgttagctgcaaaaaggttacgtcagaaatggattttttcttcagaggcctaaatgaggaattttcatcttcccaaatggacattcttagatgtccatttttgagaaacattaacgagccaactaacttttccttctcgtctgccttgccttttcccatgccggtacgaggagccaaaggaccaatatttgaagatggacccaatttcgacatggcattcagctttttccatggacgtgacggagtagttccgctatctggacaatcatccttgcgtattgagaaagctgagaccgaaacagccccaccaaagttcaatcctttggctgcaaaggcagccaccattagtctctcatcctttggaccgggagggcctttcagttttgatgcattttctaataagtggaacaatcagaaagggaaagggaataggaaaatcgtccaagaaagagtcttcttcacagggtggaaaatcgaatcac

SEQ ID NO: 8528 - DNA, 166 bp, Gossypium hirsutum
  Clone ID: uC-gsronu33B162a02b2
gcttgttcgtactcggaggaaacgcttctccttccgccgatgacttgaaggttattctcggatcagttggagctgaggctgatgatgataggatagagtagctattgtctgaagttaaaggcaaagatatcaccgagcttattgcaagtggaaaggagaagtataa

SEQ ID NO: 8529 - DNA, 401 bp, Gossypium hirsutum
  Clone ID: uC-gsronu33B162a03b2
cctactcgtccgccaaaacttagctgttagagttggagaatcaagccaaaaaccaaagtatttggcaattaaattgctgtaccagggaggccaaacagagattgtagccattgatgtagctcaggttggttcttcaaattggaatttcatgaaaagaaaccatggggcagtgtgggatacaagtagggctccaaatggtgcattgcagtttagatttgtggtaacatctggatatgatgggaagtggatttgttctaaaattttctttcctgttttcatgtaaaaatattagtcttttcaatttttcatttcttctttaatttcttcttttcattttttttttactttttttattcattattttccttctctcatttttatattttgtttttttttctttt

SEQ ID NO: 8530 - DNA, 383 bp, Gossypium hirsutum
  Clone ID: uC-gsronu33B162a04b2
gcgtcttccgcagcggtaagcccctccactacaaaggcgcctctttccatcgtgtgatccctaactttatgtgccaaggaggtgacttcaccgccggaaacggtaccggaggtgaatccatctacggatccaagttcgctgacgagaacttcatcaagaagcacactggtcccggtattctctcaatggctaacgctggtcccggaactaacggatctcagttcttcatttgcacggctaagactgagtggctcgaccgaaagcaccttgtgtttggacaagtttgttaaggcattgatgttgtgaaagccattgagaaagttggttctatgcattgaagaactttccatccccttgattgttattactgtctacaggtcttt

SEQ ID NO: 8531 - DNA, 365 bp, Gossypium hirsutum
  Clone ID: uC-gsronu33B162a06b2
cccacgcgtccgcggcgtgctattgaggctgagggaatgccctacacctatgtgtccagtaactgctttgcaggctattttcttcctgatttgtcacagccaggagccactactcccccaagaaacaaggtggtgatcccaggcgatggagatcctaaagctgttttcaaccatgaaagtgatattggaacatacacaatcaaagctgttgatgaccccagaacattgaataagatcctatacattaggcctcctaaaaacacctattcatttaatgagatcgttgccttgtgggagaaattgattggcaaaacccttgagaaaacatatgtttcagaggacccactttttaaaccgattaaaga

SEQ ID NO: 8532 - DNA, 349 bp, Gossypium hirsutum
  Clone ID: uC-gsronu33B162a09b2
tctacttcttcttgttcccttgattttacctcactgtctagccaaccaaataccacaggaatgggtgtggaattcgaaaacagtaattgtacgaacctcgtgttcacatatggcaccttgaaacggggctttgccaatcacgtgctccttcaagatttgatgcgaacgggagacgccgaatttaaaggcacttaccggtccatggggaggtaccccgctggttgggggccaataccccgggtccttttcttcttaaaaatggttggtttgggactccgagtaacggaagagctgtacgccgtgtcagctcgggggctggaccggttggacaaattggaaggcacgagtc

SEQ ID NO: 8533 - DNA, 187 bp, Gossypium hirsutum
  Clone ID: uC-gsronu33B162a12b2
cccacgtttccgcggggtgctattgacgcctcacgggagcggatgcagcttgctttcctcttacactcttctctagctcatttgatgctggctgggcttctgggatctcagctacggtgatccaaggtttgttggatatgttggtggaggggggtgcaaacactgtcaaccagcgtgaaacttgaag

SEQ ID NO: 8534 - DNA, 450 bp, Gossypium hirsutum
  Clone ID: uC-gsronu33B162b10b2
cctacgcgtccgcccacgcgtccggcagggtgcttcaaatggcttagacaaaatagcagacgggaggcgctccctggtacttgttgtctttgttggaggggtaacatttgcagaaattgctgctctcagatttctcagtgcccaggaaggaatggcatatgatctgattattgggacgacaaaaatggtcaatggtcattcattggttgaaacattcttagagacaatcggttaactcgttcgaatgtgtgttggcttttatgaggttttttgtttcccaatatttctctccaacaaccactgaaaatcataattatggcgtactgggcagtgaggctgaaaatgtgaagtgtttggtcagaggaaaattgttgtgcacagccagggtatttatccatctattttggatttatttgattttaacagcttggaccattcaatggagatgat

SEQ ID NO: 8535 - DNA, 318 bp, Gossypium hirsutum
  Clone ID: uC-gsronu33B162b11b2
ttaatataaaaaaaaaaaaaaaaaaaaaaaaaaaaaggggaaatttaaaaaaaaaattggggtttaaaaaaccattaccaatttttaaaataccctttcttcctttcccttcatctttcttggtcttccttttttctattgccttaggggggcgccccttttgggggcccccgtttttcctccccttggtggcaccttttttttttttttttggggtccctttatttcatttccttgccctgttttttccccctcctcgccttgtaaaaccctggggttctcccccccctttttccctttgggggtatttcccttttt

SEQ ID NO: 8536 - DNA, 352 bp, Gossypium hirsutum
  Clone ID: uC-gsronu33B162c02b2
ctcttctggggttttcctgcttgttcctctcttaattgcgttctatattgaggatgggttgtactaagaaaactctggctttccttttgatgctggcttttgtgggagtctctcttggtgcggttcacaaagtgggcgattccaccggctggactagtcttgggaatattgactacctcaagtgggcttccaccaagaatttccatgttggcgactctcttctttttcagtacaacccttaattccacaaccgcgatgcaagtgacccacgactatttccagtcatgcaacgtaacatctgccatcgcctcctacacctctggatccgactccgttaccctcaaaaggcctg

SEQ ID NO: 8537 - DNA, 330 bp, Gossypium hirsutum
  Clone ID: uC-gsronu33B162c06b2
cctactcgtccgagattatgaaaaaaagaaagcagcggggataacaggcctctgtaatgatatattgtcaaggatggatgcctgcaaggtctataattatgtctctgactgtgtcttgtgtaatagaagctttgtttgtggtgaaaataatgtataagccatttggttgggagcaaattgttcttttctccaaaggatttttgctgctcattcatggagacttggattatggatttatctgttgttgctaaaatcttataaaaatatatatctgttgctgctaaaaacgactctgtaggaaggcacattaccttgaaaccaagaattaag

SEQ ID NO: 8538 - DNA, 453 bp, Gossypium hirsutum
  Clone ID: uC-gsronu33B162c07b2
catatacaataaaaagtgccgaaatctagcattgtagtatgatctgcagctgacgctggacaagctgaggcccttaaagcacatgaagctgagtttatatcaatgctcataaccgctaccgctgtcaaaggctcggccatggataacaacatgctaactgacaatggctctacaacaccggttgtgataggacctgtatcagctgtcaatgctctttttctgttagaccaaccaccgtgccgatcccggcgaggacaccagcgattcagcggcatcgcagccacatttaccatgctcgaggaaagatttccacgacgaaaactccttcccaacaatttttacaaaaccctacaacttttcaaccgattttgggattggcccttaactattcatacttcttattaataacattgttattcccttctaaatcctttatctttcattctttcataa

SEQ ID NO: 8539 - DNA, 502 bp, Gossypium hirsutum
  Clone ID: uC-gsronu33B162c12b2
attccatatatacgtaatacttaatttttcattagtttccatttttaacgaagttgtattttattttatttatttaattttttttccttctctgccatgtcaatggcgggggagacggggatggagcaattaacgtcgggagcaagcaatcgtataatccccatcttaagaacgctaagaataccgctcattttccttcaatcaataatactgtatctcctcctcttcctcttccctcgccgacgccagacggcggtcggagctgccgatgaggcgccgcagttgcaggctaaaaccgcgaggcggaggtcggtatggaggcgggaagaggaggacacgttgagaaggagagctttagcggagggttgggacatggggttcgaaaccgccgacggagaggtccggtgtcgatggggcacgtccctgttttttggggtccgaagaaatgccttgttttgccgatcttggttgccggccgtcgatgaattgagggaattttgat

SEQ ID NO: 8540 - DNA, 428 bp, Gossypium hirsutum
  unsure (1)..(428): unsure at all n locations
  Clone ID: uC-gsronu33B162d04b2
ccctctcgtccgggaactcttgttgctcaaaanaaaagaggggataattttaaaaaaatattggggttttattaattaaaaaataattaaatatattatatttttgtgtgtttttattttttttttaagtttggttttttttaggggtttatgtttttgggggggggggcttttttgggggtcccgggtttccttcccctgtcttgcgcgttttttttttttttttgggggcccttattttcatttccttggccgggtttttccccctgggggcttgggaaaccctggggtttcccccttttattttttttgcggcagttccctttttggccggttgggtttttagggagggggcccgcccggttggtctttcccaccttttggccccctttattggcaatgggccccccccttttgggggccctttt

SEQ ID NO: 8541 - DNA, 367 bp, Gossypium hirsutum
  unsure (1)..(367): unsure at all n locations
  Clone ID: uC-gsronu33B162d08b2
tattaaatgtaggattttggatcctgggtttgatttacttcatagttttcatgtgattttaagcagagtactaataaaaaaaggggggggggcataatgaatgattttagcacgaaatatcaattgccttttttttatcttccattgtatgatgacattttttcccactgtaatcatgtttcttgtcttgattgaagttaaaataggttgcatatcatgaaatattcatgaaaatattttcacctttattatgtacgaagcactggtactggtaggtagaccctgaaattagcgtattacataatgaattaattgtcgtttccttttactacttcatannnnaaaaaaaannnaanaaaaaanannn

SEQ ID NO: 8542 - DNA, 469 bp, Gossypium hirsutum
  Clone ID: uC-gsronu33B162d11b2
cccacgcgtccgcccacgcgtccgcccacgcgtccgcccacgcgtccgaaaaaattaaactcgaattgacatgatctaaaatcaaatttatgcatccaatcgacaagtctagtttaaagacatttgtagagagatcgatgattaggagtgttcaaatagttaaccgaaccgaactaatattaacaaaattaaccaactttttaatcctttaatcattaaccgaacccaaatttttttccaaaaaattagctaaactaaaatttatatgtttttgttttttgattaaaacaagtataaaacatatataaaaatgaattaattacccggtttcgaactgaattaaccgataattaaacttttaaaaatcattagttgacctccgaccgaattaaatcagttaaccacccgattaatcaaattggatcgattcaatcggttaatttagttttaaccgaaatttgaacacttc

SEQ ID NO: 8543 - DNA, 480 bp, Gossypium hirsutum
  Clone ID: uC-gsronu33B162d12b2
gatgattgggagcactactccaaactaaccaatggaatcggagaaaaagttcagattgtaggagatgatcttttggtcaccaacccaaagagggttgcgaaggctattgctgaaaaaaacttgcaatgcccttcttctcaaggtcaatcaaattggatctgttactgaaagtattgaagctgtgaaaatgtccaagcaagctggatggggtgtgatggccagccaccgcagtggtgaaacggaggatacttttattgctgatctttcagtcggtttggccacgggccaaattaagaccggagctccatgcaggtctgagcgtttagccaagtacaatcagcttctgcgaattgaggaggagcttggtgcggaagctgtctatgccggagctagcttccgtgctccagttgcaccctattaagatgcttgtttagatgataatgtgctgagacttgatgcgtgcggcaaaacttcaatggt

SEQ ID NO: 8544 - DNA, 52 bp, Gossypium hirsutum
  Clone ID: uC-gsronu33B162e03b2
atttgttgcacaatcaatatccattttggagcttgctggtgtaatagaaaaa

SEQ ID NO: 8545 - DNA, 451 bp, Gossypium hirsutum
  Clone ID: uC-gsronu33B162e06b2
cctactcgtccgggagccaagaggaacggtagccgcccacgccatttctgcaagagcagtgggtctattgctcgtcatattctccagcaattgcagaatgtgaacatcgtcgatcttgataccgaaggtggtaggaaaatcacatcgaatggccaacgggatctcgatcaagttgctggaaggattgcagttaccctctgagaaatttcactatatggattgagttaagaaaaattagtttgttcgcaagattactgttttatgagatggtgttaaaatcagttctgtttgtgtccatgtctggtatcttccattctatatctagaatttttgttttcaagttcattatggcttttttgttgactatgaccttaaaagttttgaaacttgcttttagaaaaatttactagtgaaatgatcccgggagacataatgcttgggtgcaatatgg

SEQ ID NO: 8546 - DNA, 366 bp, Gossypium hirsutum
  Clone ID: uC-gsronu33B162e08b2
agaaaagttatgagctacctgatggccaggtaataaccattggagcagagcgtttccgttgtcctgaggtcttatttcaaccatcgcttattggaatggaagctcctggaattcacgagaccacttataactccatcatgaaatgtgatgttgatattagaaaggacttgtacggtaacatagtgcttagtggtggatccaccatgtttcctggtattgctgatagaatgagcaaggaaatcacagctcttgcaccaagtagcatgaagattaaggtggtagcacccccagagagaaaatacagtgtctggattggtgggtctattttagcttctcttagtacattccagcagatgtggatatcaa

SEQ ID NO: 8547 - DNA, 490 bp, Gossypium hirsutum
  Clone ID: uC-gsronu33B162g12b2
gccatggcaaatgctgcttctggaatggccgtgcgtgatgactgcaagctgaagtttctagagctaaaggctaaaaggacataccgcttcatagtattcaagatcgaggagaaacaaaagcaggttgtcgtggaaaagcttggtgagccaagtcaaagctatgacgatttcactgctagcctccctgccgatgagtgtcgatatgctgtatacgatttcgactttgtgactgctgagaattgccagaaaagcaggattttcttcattgcatggtctccggacacatcaagggtgagaagcaagatgatttacgcgagctcaaaggacaggttcaagagagagttagacggtattcaagtagagctgcaggcaaccgatcccaccgagatgggactcgatgtcataagaagccgtgccaactaaatcggagtctccgagaggcatgggtatttgaattcttttctgcttttgcttttagtgaaatgtaata

SEQ ID NO: 8548 - DNA, 356 bp, Gossypium hirsutum
  Clone ID: uC-gsronu33B162h03b2
aaatcatctaagaagtcgcgcgtcaaatttgtttgctggtctcattgagctcctccattgttatatcttacgcccaaactcaagtcttgtccaacattataattaatgtctcgagaattttcctatatacaatcaccaattgcgatgcctttcaatgaaatactgtatctcatgaaaaaaaaaaaaaaaaaaaaaaaaaaaaaaaaaaaaaaaaaaaaaaaaaaaaaaaaaaaaaaaaaaaaaaaaaaaaaaaaaaaaaggggcggcccatttaaaggggccgggtttattaaggggcccatgttacataaaagcttttttatagtgtcccctaatttaaattcactgcccccgtt

SEQ ID NO: 8549 - DNA, 61 bp, Gossypium hirsutum
  Clone ID: uC-gsronu33B162h11b2
accacgcgtccgacgcgacccagatcgtaacggtgagcgtgagcagcttggtggtgtgaag

SEQ ID NO: 8550 - DNA, 377 bp, Gossypium hirsutum
  Clone ID: uC-gsronu33B163a01b2
catttctggagctatcccattttcgctctttgtgattctactcctactatggttctgcatctcggttccactcaccttagtcggaggatacttcggagccaaggcacctcacattgaataccctgtccgaaccaaccagatccctcgagaaatcccagctcaaaaatacccatcatggctgttagttcttggtgctgggactctacctttcggtaccctttttatcgagcttttcttcatcatgtcaagcatatggatgggacgcgtgtactacgtcttcggctttcttctcatcgttatggtccctctcgttgtggtttgtgccgaagtatcattggtgttaacttacatgcatctctgcgtagaagactggaaat

SEQ ID NO: 8551 - DNA, 359 bp, Gossypium hirsutum
  Clone ID: uC-gsronu33B163a03b2
atcatgatcttccttccggaacattatatataaggcgccttgtatcaacttaaatggggagccataaatcacaaccagcaacacttcaatcaatcatcagcagctgcatacccaccaccaccaccctgcacggcgccaggaccctacgtgactgcaccgccggccggttacccgatgagcaaagacgagtacagtcagcaaaatccggctgctgtcgaaaccaagtccagaggtgatggattctggaaaggatgttgggctgcccttagactgtgattgccttctggatgcatgcttttgaagcttttattttttgttctttccattgggggtcatatattctgttacaaagatggatt

SEQ ID NO: 8552 - DNA, 522 bp, Gossypium hirsutum
  Clone ID: uC-gsronu33B163a05b2
cgcttttccattcactccgttcacccttttttttcattttgcctgatttttcgagttttagatttcttatataatcaactacctaatcctctcgctctctcaaccacaagctaactagcaaacacccacacatactaacatctatggggagttcagggcagcaagtctcctggaaattggcggatcacccaacacttccaaaggggaagacccttgctctcatcgttctcgatggctggggcgagtacaaacccgatgagtacaattgcattcatgttgctcaaactcccaccatggattctctcaaacagggtgcccctgaaaagtggagattaatcagagctcatggtaaggctgtagggctccccacagaggatgacatgggaaacagtgaagttggtcacaatgctttcggtgcaggtcgcattttcgctcaggggctaagcttgttgatattgctcttgcctctggaaaatctatgaaggagagggatcaagtcataaagcgatgctttgaaaagga

SEQ ID NO: 8553 - DNA, 59 bp, Gossypium hirsutum
  unsure (1)..(59): unsure at all n locations
  Clone ID: uC-gsronu33B163a10b2
tanataaaaaaaaaaaaaaaaaaaaaaaaaaaagagaaattttgaaagcctttgtggga

SEQ ID NO: 8554 - DNA, 436 bp, Gossypium hirsutum
  Clone ID: uC-gsronu33B163b08b2
ctacgcgtccgatttataacaagaaggttttgaatgcttacccttacccttggttgacttcaactttgtcccttgcctgtggttctttgatgatgttgatttcatgggctacaaggattgctgaggcgcctaaaacagattttgagttttggaagactttgtttccggttgctgtggcgcataccattggacatgtagcagcaactgtgagtatgtctaaggttgcagtttcattcactcacataatcaagagtggtgagccagctttcagtgtcctggtttctagcctcttgcttggagagagctttcctcctgcggtttacctctcccttgttcccataattggaggttgcgctcttgctgccttacctgaatctaattttatcttgtaccgatttttgggatgttttttttaaatcttttatttcattttttt

SEQ ID NO: 8555 - DNA, 524 bp, Gossypium hirsutum
  Clone ID: uC-gsronu33B163b09b2
ttttagcaaagcaaaaaaaaaaaaaaaaaagggaaaaaattggctatgcaattcaatcccatcgcttctcaaactaagaaactcccttcatatgctcttccacccatggcaagtcttagatctcccaaggtttctatggtctccactcttccacctcgctccaaaggggttgaagatctgaaacggcctttcatggctccaaagctggtacaccaggcttcccacaccatgccacctgagaagattgaaatctttaaatctttggatgattgggctagggataacattctgattcatcttaaacaagttgataaatgttggcaacccaaggattttcttcccgatccttcgtccgatggatttgaagatcaagttagagaacttagagaacgggcaaaggagattccggatgagtactttgtcgtgttggttggtgatatgatcacggaggaggcccttccaacttaccaaactatgcttaataccttggatggaactcgtgatgaaactggggctagccctac

SEQ ID NO: 8556 - DNA, 77 bp, Gossypium hirsutum
  Clone ID: uC-gsronu33B163c03b2
gacatggtatttttcgtatagagtaacgtcaattcacttgactgcacggcgaaagacatcgccgaggctgactaagg

SEQ ID NO: 8557 - DNA, 461 bp, Gossypium hirsutum
  unsure (1)..(461): unsure at all n locations
  Clone ID: uC-gsronu33B163c05b2
atttttaccagactgcaaactctgatattgcgccaagagaatccacagctcgaggacaatgctgtcgagagtatttcaaagttttgtcacgatctgcaggacctggacctcagcaaaagtttcaagcttagtgatcgctccttgtatgcattggctcgcggttgtcctaaccttaaaaagcttaacatcagtggctgcacatcattcagcgatgaagctctcgcgtatttgactaatttttgtcgaaaactaaaaatattaaatctgtgcggatgtgttaaagctgcaactgaccatgcactgcaggctattggacgaaactgcaatatgttgcaatctttgaatctgggatggtgtgacaatgttnggtgatctcggagtcatgagtttagcatacggatgccatgatctccgatgcctggacctgtgtggntgtgttcgtataacagatgatagcgtga

SEQ ID NO: 8558 - DNA, 500 bp, Gossypium hirsutum
  unsure (1)..(500): unsure at all n locations
  Clone ID: uC-gsronu33B163c06b2
attcagggatcttccacaagaagaagtgtgagaagaggcgcattcgagtttacatggaggggtgctttgatctcatgcattatggccatgccaatgcgttgaggcaagctaaggctttgggagatgaattggtggttggggttgtaagtgatgaggagattattgccaataaaggtcctcctgttctgcctatggaagagaggctggcacttgttagtggattaaagtgggtggatcaagtaatagcaaatgccccctatgcaattactgagcaattcatgaacagtctgttcaatgagcataagattgactatataatacacggtgatgatccttgccttctccctgatggatctgatgcttatgccttggcaaagaaagccggccgctacaagcagattaaacgcactgaaggtgtctccagcacggatattgttggaagatactttgttttgtaaggatactganggngtggagatcatactagcacactttgaatg

SEQ ID NO: 8559 - DNA, 487 bp, Gossypium hirsutum
  Clone ID: uC-gsronu33B163c09b2
tgcttaatcatgaactgcactgttggagtggtcagaactcgcctcgaggggccgaaacagtgttctattcatgtattgccatcagaaatgggtcagaaccttaaagctttgttagaatctgaagttggttgtgatataacttttcaggttggggatgaggcatttaaagcacataagttgatccttgctgctcgctcacctgtttttagagcacagttttttgggcttgttggggatcctaacattgataaagtagttgtgaaagatgttgagccttctgtcttcaaggcaatgctcttgtttatttactctgacaagtttccagatatacaagagattacaggctctgggtctacgtggtatgtctaccaacatggtgcagcatcttttagctgccgctgatctgtacaatttagataggctcaaagggttgtccgaggcaaaaattgtgtgaaaacttaatgctggcactgtggcaacgaccctt

SEQ ID NO: 8560 - DNA, 522 bp, Gossypium hirsutum
  unsure (1)..(522): unsure at all n locations
  Clone ID: uC-gsronu33B163d05b2
atttttcctgaaacctaaggaaaaatcataaaagaaaaaaatgcacccattgtcttcaattcgacagcttcgccattcttctacttcagtattgcttcaacgctttagcatcttcaattgggtgtttcgagcttcttccaaccgccctgcttttctcggaggttcaaagagtttcagtgctggtgcacattcttctgagaatgttggaactccggagaagaattttgatcaacagacaatgaaggataatgtctctgctacacgtgcttcaactttccagaaattttttggtcctttaggtgcacaatctactggtcaaacagatttcaggtcaggcgggaattacaggtctatggatgttttgagggaagcaatagatgcagatagaatggcaaactttaggggttctcaatttcggcaagaccatatcgagcaaaacaaacattntgcacacataaagatcatgcgcaacaatacctttgtcaccgtgacggattccgatggaaataaaaaatgtgggag

SEQ ID NO: 8561 - DNA, 505 bp, Gossypium hirsutum
  Clone ID: uC-gsronu33B163d09b2
ttttaagaaaacatttccttagagcataaaagaaagttaagaacatggctattgatgctgaaattgagttcccaaccattgagttacgttcatcggatttgaagcgaggaaccgaagggtggaaccgtttgtgcaagagggttcgagaggcttgtgagacttttggttgtttcgatgtggtgtacaaaaagatatcaacaaaaatccgagaggatgcatttgaattgcagaaagaactagttgaggtcccagtggagaggaaacagaagaacaccagtcccttgccttgccatggttgggttggaccatgcgagcaggtttctatgttgtatgaaggctttggagtcgcagatgcctccaactatgattctgttaacaactttgctcaacttatgtggcctaatggccagccacgctttactgacactatacataccctagcgacgcaaatggaggagcttgacaagttaatttggttaatgctaactgatagttacggattaca

SEQ ID NO: 8562 - DNA, 512 bp, Gossypium hirsutum
  Clone ID: uC-gsronu33B163d11b2
ttttggatcgtagaagtgcatttgcagttgttttgatttgttttgtggtgaccgctgtcggtggtcaatctccggcagcctcacctactaaagctccgccggccgcgactactcctgctactgctactgctcccgctactgcccctgttagcaaacctaaatcaccggctccaactgctgcccctaccacttccccaccaacttcttcaccaccggttgcggctccggagaagtctgcggcggttccagccccatctaaatctgctccgtcttctcctccggctgctgcgccggtgagttctccaccggctccagtacctgtgagctctcctccagccagatcgcctcccgttgctgcaccgacgactccaccagagagctcggcctctcctccggctcctgttgcggcaccaactactgctgaggttccggccccagctccaagcaagagcaagagcataagcatgaaatccaagaaacaccatgctccggcttcttcacctgatatgctt

SEQ ID NO: 8563 - DNA, 513 bp, Gossypium hirsutum
  Clone ID: uC-gsronu33B163e07b2
tatcaccacaaaaagaagagcaagatgtcttcttcatcgcccgccaatcaagtgagggcctctcacatcctcatcaagcaccaaggctcccgccgtaaggcctcttggaaggatcctgaaggtcgcgtaatctccaacactacccgagatgccgccgtctcacagctcaaagccctccgtgacgacatcgcttctggcaacgctaagttcggtgaggttgcctctcgccactccgattgcagttccgctaaacgcggcggggatctcggtccttttggtcgaggccagatgcaaaagccatttgaggatgcaacatatagccttaagattggtgagataagtgacatcgtggatactgatagcggagttcacatcattatgagaacaggttgattattggtgataatacctggatatgttggcaattagttcggtgtgttggataactgtattcaagaatgttctgaaattaatgtcgatactgccctatgtcaatttgagtgatattttaca

SEQ ID NO: 8564 - DNA, 469 bp, Gossypium hirsutum
  Clone ID: uC-gsronu33B163f05b2
cttactcgtgggcttagatctcagaagatggcccgtaccaagcaaactgcgcgtaagtcgactggtgggaaggctccaaggaagcaacttgctaccaaggctgcccgtaaatctgccccaaccaccggtggtgtgaagaagcctcatcgctaccgtcctggaactgttgctcttcgtgaaattcgaaagtaccagaagagtactgagcttcttatcaggaaattgcctttccagaggcttgttcgtgaaattgcccaggacttcaagactgatttgcgtttccagagccatgccgttcttgctcttcaggaagctgcagaagcataccttgggggtctctttgaagacaccaacctgtgtgcgatccacgccaagcgtgttactataatgcccaaagacattcagttggctcgtaggatcaggggcgagcgtgcttaatttcaagtgtgttgatcacttaacttagaat

SEQ ID NO: 8565 - DNA, 517 bp, Gossypium hirsutum
  unsure (1)..(517): unsure at all n locations
  Clone ID: uC-gsronu33B163f06b2
cccacttcgtccggcagactaaattccgtcttaacaattatggattgcctgaacccaatatcgtcaaagtactgtttcaacatctaaaacattcttgaaaagaccgaccgatttcgagaagacggtggagaaagtgaaggaaatgggctttaatcctccaagcatgtcattcgtattagccgtcactgtcttgaatttcatgcctaaatcttcgtgggatagaaaactagatgtgtataaaaagtggggttggtctgaaaaagaggtaatagaagcttttcgaaagaatccttcgtatatgatagtgtctgaggagaaaacagtgaggagaatggattttcttgtgaagggaatgggattccacctctgttattgccaggcgcccccgtgttttaacacanagcttagagaagaggattgttccgaggggtttgtttggtagagatttgttgtcaaagggtttggttaagaaggaatgagcgtgcaggcactgttcgaggcttcagaaaagtcgttc

SEQ ID NO: 8566 - DNA, 404 bp, Gossypium hirsutum
  Clone ID: uC-gsronu33B163f11b2
ttttaaacccatcatcgcaggtggtccttcattggtccaccgtggacggtggtttgggcagcatcgaacgggcttttcagcccttgatcaagccacgtttgaaggccaagccttcaaggcctgggcgatcgagatcgggaggcttctccctctccctttggagttcgaacccgatgatggagggaggagttccggcgacgcgattcggtaagttcctgttcccctccttttttatttatttcaaacctcttttttataaagaaaaagatttgcaaaataactaaaataaaaacaaatggaaaaataaaaaataaaaagataaaaaaaataagaacaaacaccttttagatttcttttctgctttcgatttctctgaaaatatgtgtaatacaaatttttttaaa

SEQ ID NO: 8567 - DNA, 521 bp, Gossypium hirsutum
  unsure (1)..(521): unsure at all n locations
  Clone ID: uC-gsronu33B163g03b2
gtggatcaaaggttgcaggtgtcggataaaacaatggctgcaatatttgcagcagagaggaaaataaatgacacgggatcagccgtcaaatctagcaggtacataactgccggtacagcttggctaaacggtgcgtccagcaaagttgcaaaggctgggcaggttgctggtacaaaaaccaaagaaaagttcaacctagccatgtcaaacttgacagccaaggatggaattgcagtgtaagatggaaatttatggtgttaaggtcgcatggcatctcatcggatgccttgtaacaatgtttcatcgggtggagattcttgtggtagagtgcacaaagttgtgttcagttttgggtattgtggtgtatttgatttgaggttttgtttacaatattattctttgattagtagagggtattgtgttgtaattttcaagccttttagatttggttntcagctcaagaaaaaggaaaagaagctgtaattcatgttagcattctgcactctcactctttttttctg

SEQ ID NO: 8568 - DNA, 494 bp, Gossypium hirsutum
  Clone ID: uC-gsronu33B163g06b2
gcttaacgaactttagatactaatatctcgatctatgctcaacttttttatctaaaatcagtttcgttcatctaattattcatatacgcctaattcacaaccttcaaactagacaaatctactcaattaatcgtattgacatttttcgatattttttaggcgattttcacaaaattcatttaaacatgaaaaatccataacgaaacttaaagataagtttaaaaaccttctaatcacgctaaaacaagttgaaaaacactttggaaccaagttttgactcaaaatcccaaaatccaccattaatggcttgattttcgatttttatttaaaacgtgcaatttgagggctaataatttagatttagagtctaaataacattaaaaaaatagatacatgaataattaccttttttgaaagaatggatgagttttgacgtaaattcgagaaacccatgtttggagatgatgaaatctatagaggtttgggtcctttta

SEQ ID NO: 8569 - DNA, 480 bp, Gossypium hirsutum
  Clone ID: uC-gsronu33B163g10b2
tttacgcgtccgatcagataatgcccccttgtacttcaattcggaccagggaagtaactccatcaattgttccgactatggctggggagaacagggtgccagaactcctgaaatatcatccattcttgaagcttctgtagtgggtgaagagtttcttgaggatgctaaccctagcaagaagctgaaaccaagttctgacaatcttatgcatgctgaagagaactccgcaaagaccttgtcggacgagctgttggctttggacaaccagatgaaatacttccaaatgccaccatttattgaaggaaactgggacgccactattgatgccttcctcaatggagatgcaacacaggatggtggaaacccgatggatctttggaactttgatgatttccctgccatggcggaaggtgttttctgaacgaactttccataataactagtgggttgaaaataaagcacatgaatttggtcaaaatc

SEQ ID NO: 8570 - DNA, 520 bp, Gossypium hirsutum
  unsure (1)..(520): unsure at all n locations
  Clone ID: uC-gsronu33B163g11b2
tatatgtctcaaccaccacggaattcccatattgggattttaaacaaacaaaactgagagagcttctcccctgccaattcttcatttcttcatttatacacttgctctaatctctcaaacaatggattcttcatcatcatcatcatcttcaggtccctcacctctcgatctcatgtcggctttagtcaaggccaaaatggacccttccaacgcttcctccgactctgctgctcaagtaaccaccgtccttttcgagaacagagagttcgttatgattttaactacctccattgctgtgctcatcggctgcgtcgtcattttgatctggcgtagatccgcttctcaaaagcctaaacaaatccagcttcctcttaagccttcgatcattaaagaaccagaacttgaagttgacgatggaaagaaaaaaaagtcaccatcctcttnggtactcaaaccggcaccgccgaaggcttcgctaggctttagtcaggaggcaaaagcacgcttgaaaagcgacttt

SEQ ID NO: 8571 - DNA, 336 bp, Gossypium hirsutum
  Clone ID: uC-gsronu33B163h05b2
ctttctcgttcggccatcccaagaactgagctactatggctatatggataaattagtatctatacaataaaaggtgcttcctactcatgttctatgttcttgtatgttcttgtatgttatgtaggaatgttatcttttactagcgagaatgcttatggcagtactcattggaatgtctattctatgtcttcttatttctcaatgagcaatatcctgatttcaatacaaatattccaactgacgactgcaggattacttatcatagacattcttgtattcctgcaacccttgcaattgtaaatgattagagaccaaagccaaagctccctggaagca

SEQ ID NO: 8572 - DNA, 323 bp, Gossypium hirsutum
  Clone ID: uC-gsronu33B163h11b2
tctcatgcgtccgatcgcctttggtcgctttgatggttccttcagattggggactggcaaggcctaccttgctgagtttatctcaactttggtgtttgttttcgccggcgttggctctgccattgcttacaacaagttgacaactgatgcagccctagatcccgatgggctagtcgccattgctgtttgccatggatttgctctctttgttgcagtggctatcggtgccaacatctcaggtggccatgtcaaccctgcagtcacttttgggttagctcttggtggccaaatcaccatactaactggcatcttttactggattg

SEQ ID NO: 8573 - DNA, 514 bp, Gossypium hirsutum
  unsure (1)..(514): unsure at all n locations
  Clone ID: uC-gsronu33B163h12b2
ttgtaaggctaaaaaggcaaaggaagtagtggagggagtagaccctgataagaatgtggtcactttcagagtgatcgaaggagatctaatggaagagtataagagctttgtaatcacgattcaagtttcgcccaagagcgagggtagtggcagcgtagtgcactggactttggaatacgagaagctgcacggtgggattgcgcatcctgagactctgctgcaattcgttcaagatatctctaaagacattgacgcccacctcacccaagcaagctaaacagtatcacatgttgctattgttgccgctacttgaagcactgttcatctatttaatgaataaagtgacttcctttctcatgtattttgatctgaatatgtatgtttagatcaatatgcagtcaaggggagggagctttgtattttcttgcatgtttgtctttttaattctgtatgaattcaatgtatcctatgcttttattnngtgtctaatgaatataagtaagtatgatttcgt

SEQ ID NO: 8574 - DNA, 293 bp, Gossypium hirsutum
  Clone ID: uC-gsronu33B164a06b2
accatttctttcgctcaattcttagtacataatcacatggtttatgataagatatataagggtttgttttctgtcaaatattttatgatttgttaagcttggtgagttttttgtgcagattgagaaagcagtttctgtattctttggtataaaaatacttgaacaattacatgattgtgaaaaggattttaaatagttgcagtcttttttgagcttgctctttaaattgaaatatagaaaatcaaatttattacagatgaaataactataaaattggcgcccccttttggtgg

SEQ ID NO: 8575 - DNA, 238 bp, Gossypium hirsutum
  Clone ID: uC-gsronu33B164a07b2
tgccctcgcgtccgctccaaaccatgtggttggccgggtaattgtgagctaagctttcattggctttgataaatccacctacactatgtttgtggcttctgatcaatttggtaaggttcctctctattggggaatcaccgccgactgatatgcggccttagctgataatgctgaattgctgaaaggtgcctgcggcaaatatctcgctcctttccctcaaggctgtttctactccaca

SEQ ID NO: 8576 - DNA, 306 bp, Gossypium hirsutum
  Clone ID: uC-gsronu33B164a11b2
ttaaatagaaagcagcaaaataacaggcctctggaaggatttattatcaaggatgggtgcgcgcaaggcccataattatgtctctgtctgtcttgtgtaatagaagctttgtttgtggtaaaaataatgtataagccatttggttgggagcaaattttccttttgtccaaaggatttttgctgctcattcatggtgactcggtttatggtcttatctgctgttgttaaaatcttataaaaatatatatcggatgctgcttttggtttgtctcacaccccaatcaataggattttattctttttctt

SEQ ID NO: 8577 - DNA, 235 bp, Gossypium hirsutum
  Clone ID: uC-gsronu33B164a12b2
ccacgcgtcctttcatgcgtccaatccatttcaagtgttccagggggcgaacataaaccacactggggagcggcaattccaaaggccaatgctccttcacgagcattggaccgagcgcgataaccagggcttttcaaccccgtgcttgaccctaaccttattgtccgttcctacataccaagcacgtccattcacggagagtcctttcgtgtgattctcgattcgatctccaaca

SEQ ID NO: 8578 - DNA, 292 bp, Gossypium hirsutum
  Clone ID: uC-gsronu33B164b08b2
ttcatacattacctacaaaatccgtgcttgacctttattagctatttttcttgccgatggcttcttcaccaaaacaaacgtattactaactccttaaagccgtaccctacgacgaagcacgagcatggggttttattagcacgacataatgtacaacggccatagcgcaaagagcgcaacatcagacatagcaggctcaccacaatgggggagcaggacgattctagcaggacaaaaccatttcggagacctggtcgtgttggacagaccctatgaccttggacatcatcgt

SEQ ID NO: 8579 - DNA, 106 bp, Gossypium hirsutum
  Clone ID: uC-gsronu33B164b10b2
ttaataagtattgactgtgcagccacctgtacatttgcgtaaaaaagaaaaaaaacacacaaaaaaaaaaaaaaaagggagaacgaaaaagaggagccgggcgtcc

SEQ ID NO: 8580 - DNA, 167 bp, Gossypium hirsutum
  Clone ID: uC-gsronu33B164b12b2
tacatgtcaagtcaatattccgatggtggcgatccaaatgggtggtggtttgctgataatggcggtggcgacagcgcttccacaaccattgtttggatcgtggtggggatattaatagctgttttagttcttgtggtggcttattatgtggcaaagaaaggcatatg

SEQ ID NO: 8581 - DNA, 488 bp, Gossypium hirsutum
  Clone ID: uC-gsronu33B164c02b2
ggtttgttcttgctgtaccctctacaactgttgatgaggaagagaaaaggaaagctcgtcttgcccgattttcaccatattccaaacctgacaccattgaaggagaaaaaaagaaaagcaagggcaatcaggttttcggatcccctgtcaacttctttagcacaggaggctcctgttgctggaaaggctgctggaggactctaaataaaaattaccatagttagaaggtctagtgtcctaacagcttgtgattcgctcagcagcttccttacaatgttttatttctaacatcaaaatttaagatgcaatactccatctccagatgaatttctaaagaattggcaacggtcttttggcagtttggaaggtgttttacagcgtttaattatttggtgaggcctattggaatcaacaaccaccctggagtgtttacccttttttaaatctcacaaaaatgcatttgaaattccggagtattggctcttaat

SEQ ID NO: 8582 - DNA, 511 bp, Gossypium hirsutum
  unsure (1)..(511): unsure at all n locations
  Clone ID: uC-gsronu33B164c08b2
tacttgttctagatcgcgagcggccgccgcctgcgtctctctcttcatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgaaggttgttgacattgttgacactttcaggcttcaggagcaaccccctttcgacaagaagcagtttgtcgtgttcatcaagaagttcatcaagaacttgacaccaaaactggatgcggaaaagcaagagtccttcaagaaaacattgagggagcaaccaagtttttgctttcaaattgaaggaccttcaattnttcgtaggagagagcatgcatgatgatgga

SEQ ID NO: 8583 - DNA, 72 bp, Gossypium hirsutum
  Clone ID: uC-gsronu33B164c09b2
tacatataaaaaacagaaaaaaaaaaaaaaaaaggaaagaaaaaaaaaaaacaggaagcccaatatatatag

SEQ ID NO: 8584 - DNA, 456 bp, Gossypium hirsutum
  Clone ID: uC-gsronu33B164c11b2
ttctctcgtccgcccacgcgtccgcccacgcgtccggttttcaccatggattccatccaaggccttccttcaggtggtgccgcaactgtagctacctccgttatgccagcttctctccatgattttcttgaagtcgtctttcaggacaacgaaaacaccctgcaatcctggcatcttgatggttatgatttttgggttgttggtttcggctccggacggtggaatccacataaacgaaaaacttacaatctagtcgatgctcttacgagacacactacccaggtttatccaaattcttggacagccgtattgatctccatggacaaccaaggtatgtggaacctgaggtctgcagcatggggaagacaatatcttgggcaacaattttacttgagagtctttgatcctgttcgaagtctcaccaacgaatacgggattccctctaatgtcttactt

SEQ ID NO: 8585 - DNA, 519 bp, Gossypium hirsutum
  Clone ID: uC-gsronu33B164d04b2
aataataataaaaaaaaaaaaaaaaaaaaaaaaaaaaaaaagaaaattttaaaaaaaatttaaagttatataaaaacaaaattttcctatattcttttaaaattttcagtgtctttattgttttacttttacattttttcttctatattctgtcctagcttttttttttattatattttcacaccatttccaactatcttatcaccattttcttatttttctctgtatcattccttttatttttccacttatttttctccttactttatacttactttttcatccctcatttttttaccttattcaacaaatctcatactctctttcaaatttttttttttttctttgtttatcttttgacctctttttttgtcactattccccctgttccttttagttctaacaacttctttttttctttattttgcccttctttcttttgactttttcaccattcttttttttcttccctttttttaattttcctccctttattttaaattttatttctttttccta

SEQ ID NO: 8586 - DNA, 417 bp, Gossypium hirsutum
  unsure (1)..(417): unsure at all n locations
  Clone ID: uC-gsronu33B164d06b2
atgttgtgtttgaatcttctggagttgaagaaactaggagtcctgttacaaatggtagccgaagccacactaacagacgctatcatgataagacagctagtgtaacaactaactctggtcattccagtaagactgccctcattcgtaagcagattcgggcctaatcaggcattggggccaccgccaaagtccccggggcttcaaagttgaaagtcatatagatattgaaggtgtagtagaggattcaatctcttcaagttggaaaagccaaggcttagcacttcttcaagtggaatgttatttaatgttgcattccatggtcgtttatcttagtcggaacttgaatttggtgttattgaaacagggctntgtaggtaccttgtgtactagattctttaaccatgattgttaattatt

SEQ ID NO: 8587 - DNA, 391 bp, Gossypium hirsutum
  Clone ID: uC-gsronu33B164d07b2
tgtttttgagcacagaggataaaatccaatttacagaaaatcaaagagtcaagagctggacagatatgatacttacagatgagatagttaagagaggaaaatgtttcatattttaaaaaaactagcaatctttttggcatctaactgttgtgaagaaatctagattcagttttctatttatagccatttgggagtatggttgctcaattctgtagaaaaattttgttacaattatcattatgtttacggtttgtttttgtgaaaaaaaaaaaaaaaaaataaaatatatacataaataataaattaaataatatataaattaaatatatataaaaattaatatttaattaattttatttcataaattattattttttttatctcttttttt

SEQ ID NO: 8588 - DNA, 509 bp, Gossypium hirsutum
  unsure (1)..(509): unsure at all n locations
  Clone ID: uC-gsronu33B164d09b2
ttcctttcgtccggttgaattatgcacgggtgaggcattgtttcaaacacatgagaatctggagcaccttgccatgatggagcgggtgttgggcccactacatcagcacatgttgaagagagtagatcgacgtgcggagaagtatgttagaaggggtagactggattggccagatggtgctgcatcaagggagagtatgagagctgttcttaagctacctcgtcttcagaacttgataatgcagcatgtggatcattcagctggggatctaatccatctattgcaggggttgcttaggtatgaccctattgataggctcactgctcgtgaagctctaaggcatccgttttttagcggngacaacaagtttaggcgatgagcatgcgatatgcttcatttttataaattgcatcaaacattcagttacatgaaaattgtatcattagttggattgaatatacttctttattaattaaaaaaataatatcaaaaaaataaattttatatta

SEQ ID NO: 8589 - DNA, 468 bp, Gossypium hirsutum
  Clone ID: uC-gsronu33B164d12b2
ctcctcccataaccctactctcctctcttcgagaccaaatttctgacgcaatgagcagatccggccaacctccagatctcaaaaagtacatggacaaacaactccagatcaagctgaatgctaatcggatggttgttggtacacttcgtgggtttgatcagtttatgaatctagtggttgacaacaccgtggaggttatcagaggaaatagcgttgttactgttgaagcacttgaacctgtaggcagaatgcagtgattcggttttttctactggaaattccggaatcacttgatggtatctcttccattctctggtggttggataacatagatgctggcctcctaggttgtgatggactattaaatttagttaagaactcataggaactttagactggttttggtggattctgctccttttccttatctgtaccggattgattgccttgagcattccgaataggttt

SEQ ID NO: 8590 - DNA, 84 bp, Gossypium hirsutum
  Clone ID: uC-gsronu33B164e01b2
aaattattttaaaaaaaaaaaaaaaaaaaaaaaaaaaagaaaaaaaaaaaaaaaaaaaaaaaaaaaaaaaaaaaaaaaaaaaaa

SEQ ID NO: 8591 - DNA, 162 bp, Gossypium hirsutum
  Clone ID: uC-gsronu33B164e08b2
gttttagatcgcgagcatcatccctgtttttctttctgtttttggctttgtcttggtgtctgtatgttgaaaatttaatagaatctacgccttttactttgctttaaaaaaaaaaaaaaaaaaaaaaatttaaaaaaaaaaaaaaaaaaaaaaaaaatataa

SEQ ID NO: 8592 - DNA, 122 bp, Gossypium hirsutum
  Clone ID: uC-gsronu33B164e09b2
ttataataaaaacaagaaaaaaaaaaaaaaaaaaggggagaaattaaaaaaaaaatggggcaaaaaataaccacaaaaaaaaaaaaaatactcctaataacttcttacgaaatatgggccgc

SEQ ID NO: 8593 - DNA, 367 bp, Gossypium hirsutum
  Clone ID: uC-gsronu33B164f05b2
tagttaatcatttgtctatgaaattcggtattgcaggtctttgtagcagtactctatttgatattatcatggccgtgctagtggaagatcaaggaataatgattgctctaaggaagaaacgaaagctgctgaagaaagagaccctgcactgtatatagatatgtacattgctcattgaattttaaaggagttctagcatgtcaataacatacggtagcccataatttatggagcaaagggaggaaaggtatggccttgctgatacacaatagggcggctcatgatgtggatggggatgttcatcctggagccaagattgcgagcgggatatagtttgatcatgctactggagttattgttggagaga

SEQ ID NO: 8594 - DNA, 455 bp, Gossypium hirsutum
  Clone ID: uC-gsronu33B164f06b2
gtctgcttcaaactcgaggcaggtgaatgctgttaataataacgaaactaataccattggatatagacaatatgatccagagcctcccactgatgagaatatcaatgcaatacttgaggaggaagaggctctaattgctgctcacagaaaagaaattgaagacacaatggagattgttcgtgaagaaatgaagcttctggctgaggtggaccaaccaggcagccacattgacaattatgtgacccagctgagcttcgttctttcacgcaaggctgctagtctggagagtcttcaagctcgccttgcccggttccagcatcgactgaaagagcaggagatactgagtcggaaaagagttcctcgttgatgccagctctttgttctctgctttcattgctgcatcagactctgtccatcgatgcacggagctgcattagggtcttgagaggaaattc

SEQ ID NO: 8595 - DNA, 415 bp, Gossypium hirsutum
  Clone ID: uC-gsronu33B164g01b2
gcttgtggtgtcgaaagatcgtattcgtattcggaatcggtgtcggagccgatgaagaaactcacgaaactgccagtgtagctgtgaatcctacgaatgcgcaatcagttaccgccactttaaaaatctttattgtttactactccatgtatggtcacgtggagaaactggccaagcggatgaagaaaggggtcgacggcgtggaaggggtagaagcggttctttatcgggttcccgagacgctcccggctgatgtgctggaccatatgaaggtgccgtcgaaaaaccccgaggttccagagattaaagcggcggaattggcgcaggcggatggggttctgtttgggtttccgacgaggtttgggtgtatggcggctcagatgaaggcgtttttcgattccagtggacagttttg

SEQ ID NO: 8596 - DNA, 426 bp, Gossypium hirsutum
  unsure (1)..(426): unsure at all n locations
  Clone ID: uC-gsronu33B164g04b2
aagccatcaccggccgccatgtttcgctcgatatagcgtctgtttcagtgctttctccgttgtgtcgttgatggggttcttctttatggagaaaagaaaggcaaggaaatctcagcagtagtgtgatatattatggttttaagaaccctaattaaacctttgaaaaggatttttatagtaatgggtttgatttgcaagtcttatttactttctttgtgtttttaatcctagatgagttaagttgaatggttgtgttttagtgggaatggggtgaataaaagagttgggattatctatgatcatctccttgttatatattaaagttgaaaattgtctttttgttaaaaaaaaaaaaaaanataaaaaattaaaaaaaaaaaaataaaaaatataatataaaaataaaaaaatataaaaaaggggcgg

SEQ ID NO: 8597 - DNA, 489 bp, Gossypium hirsutum
  unsure (1)..(489): unsure at all n locations
  Clone ID: uC-gsronu33B164g05b2
tgagctttcgtgtttgtctattgaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggtgaaaataatgtataagccatttggttgggagcaaattgtncttttctccaaggatttt

SEQ ID NO: 8598 - DNA, 440 bp, Gossypium hirsutum
  Clone ID: uC-gsronu33B164h09b2
aattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaaagctttgttggggtgaaaataatgtataagccatttggttgggagc

SEQ ID NO: 8599 - DNA, 499 bp, Gossypium hirsutum
  unsure (1)..(499): unsure at all n locations
  Clone ID: uC-gsronu33B164h11b2
tcctttctcagcttaacaacaacaacaaaaaaatggctggtttcatcactccaaccatcttaaaaatattccttatcatctctttgtttcaaatctgtttgggtgtacgaaagctgagtgaagtggttgaggagcagcctcagctcttgaaataccacaacggtcctctcctttcaggcccaatcaccgtcaatctcatttggtacggcaagttcaagccttccgagagggctattatctctgattttgtcacctccctctcttctaacccttcttcaccctctctaaaagcccaacccacggtggctcagtggtggcggaccaccgagaaatactaccatctcgcctctaagaaatcgtctctttccttgtctttggggaagcagatccttgatgaacactattcgcttggcaagtctctcaagaagaaacanattggtgagttggcctcaagggtgaccaaaagtatgctattaatgttgttttaacagcatctgat

SEQ ID NO: 8600 - DNA, 233 bp, Gossypium hirsutum
  Clone ID: uC-gsronu33B166a03b2
cccacgcttcctttaagttttggtggaaaagaaatgaggtctctgcttgaagaagaccaaatggggtctgaataaggtgatggggattgtgtgggagatgatatttcgccattggtgcagtccagttttgctgcatctggttttcaattaattaatcaaaaaaaagatgattttcactttctaaaaaaaaaaaaaataaaaaaaaaaaaaaaaaaaaaaaaaaaataataaaa

SEQ ID NO: 8601 - DNA, 404 bp, Gossypium hirsutum
  Clone ID: uC-gsronu33B166a06b2
cccacgtttcctttccacgcgtccgctgctttgggagctgagattattggaactttcgtacttgtctacactgttctctcagccaccgaccccaagagaagtgctcgtgactcccacgtccctgtattggctccccttccaatagggatcgcagtgttcatggttcacttggctaccatccccatcaccggtactggtattaaccctgcaaggagttccggtgctgctgtaatctacaacaactacaaagcctgggatgaccactgcattttctgggttggtccatttgttggagcacttgcagcagctatatatcatcagtacatccttagagcagcagctatcaaagctttgggatccttccgcagcaaccccaccaactaaaaaaaaaatcaacccaaata

SEQ ID NO: 8602 - DNA, 519 bp, Gossypium hirsutum
  Clone ID: uC-gsronu33B166a07b2
gtttattctacgtttgatacgccttgcaatggaagccgttatccactaagaaagagaaagtggttaatgagcatgatttatactaggaaggaattttcctttttatggtttatccttggtgacgaagtccttgaggagaaaagaaatggaatggtcagtttctgctgcaatgcataacaattatattgagaagctgaccagtgcctgctttgtaacacacattttacacgtaaaccaccatagtacctgtcatggtatgcacatatgattaatcaagatgagttgtaacaatatatgaaaaagattggtgccaaattctatggtagaggtccaaatgagtttactggaataaaatctctttttcttttttccctctagagtcagatatttatgtaccgtaaacatgttttgctaatggttctaaaattcagaatgtggcaggtgctgatgtttgagggagacatcattctattatcttcaagttggccactttgatgcttgatagttgattaatatggg

SEQ ID NO: 8603 - DNA, 483 bp, Gossypium hirsutum
  Clone ID: uC-gsronu33B166a12b2
cccacgtttccgctgactcaaattgttggacttgtcctagtggtacaggatttatgataagaggaaagacttacttaaaagataatgccaaaataatgggttcagatccccttctcaaactaatagctgttgactggttcaaagttgatacagccacagataaaattgcattgcatccaaggtctctagttcagtcagatgctggaaaaaagcttccatttatccttgtgattaatctcgaggtccctgcaaaaccaaactatagtttggtcctttactatgctgctgaaaggcctgtgaataaaaattctttattgggaagatttgtggatggaacagatatgtttcgtgatgccagatttaaactgataccaagcattgttgagggctattggatggtcaagcgtgcggttggaacaaaagcttgcctacttgggaaaagctgtacctgcaagtatttcagacatgacaactttcttgaga

SEQ ID NO: 8604 - DNA, 510 bp, Gossypium hirsutum
  unsure (1)..(510): unsure at all n locations
  Clone ID: uC-gsronu33B166b02b2
cgcagattcttttgtcctgttatccttacctgaacaacgccacggccaaacctgaagacgactgctgtaacccgatcagacaaaccgtcgccaaagatcttccttgcctttgcaacctctataacgaccctaatacacttgcttccttcaacgtcactgtcccggaagctctcaggatctctcgtgaatgcggggtcagtactgatctcagcgcttgcaacgccacttctcccacctctgctccatccccgccaggacaatctggaggtgctgacaggatagcattgactggagttatcaccttattcttagtattggtctctatagcaccgtattaaaagtgatatttctttatttggaatagtcccgtcagagtgaataatacagagatgcttcagactaggcaccccagtttgaatatctctagagattttaactgtttgcttgtatttaattgcttgatgaatatcagnggtggccagtgttctacttttatcacaaacccttttt

SEQ ID NO: 8605 - DNA, 498 bp, Gossypium hirsutum
  Clone ID: uC-gsronu33B166b07b2
gttttcttagaagaagacaaggcatggatcgaacagatcaagcaaaaacttcccagtttggaatcgtaccatgttgagtatgtaaccaaagtccaccaagcagatgatctgctagagacgggaatgaaggaggagtgcaaagtggtgggtgatcctagattctccaaatgtgacttagcactcaaagggttcccaaacgagatatatgacatagaatgggatctgatcatggttgatgccccaactgggttccatgatgaagcccctgggagaatgaatgccatctacactgcagggctgatggctaggaatagagaagaaggggagactgatgtgttgtgcatgatgtgaacagagttgttgaagataagttctcaatggcttttctttgtgaaggctatttgagggagcaacaaggattactaagacatttcaccattcccagtcacaggtctcgctctggaagacccttttgtccttgattctttcaatttcgag

SEQ ID NO: 8606 - DNA, 484 bp, Gossypium hirsutum
  Clone ID: uC-gsronu33B166b09b2
ctttgtttgtgaaagaaattctaattccatttccttttctttctagattttttgtgggttgtgtccattaaccttctccagcaattaccccaaaacagctagacaaagcttttatagtctttgacgcgaaagctaaagctaaactacataaagggtaagagtgtggtagtcctactccggcccccacgatgtccaattcagagactgctgctactaacggatcgttaatggacccaccgagacatcaggcgccggcagccaatggttcactcgcagttaaaaagcctcccaccaaagaccgtcacagcaaagttgatggtcgtgggagaaggatcaggatgcccatcatttgcgctgctcgtgttttccagttgacccgcgaattgggtcataaatccgatggtcagactatcgagtggctgttgcgtcaggctgagccttctattatagccgtcacttgtacagggacgactcctgtagtttt

SEQ ID NO: 8607 - DNA, 530 bp, Gossypium hirsutum
  unsure (1)..(530): unsure at all n locations
  Clone ID: uC-gsronu33B166b10b2
ctttcattagcaatggcaattttggggttttttgcagttgtgttacttgttcaagtcgtcaactttgttgatggttttccatggaatcatcatcatagtcatcgtccccatcgtggatatcatggaccatggatcaatgctcatgccactttctatggaggtggtgatgcgtctggaacaatgggtggagcatgtggttatggaaacctgtatagccaaggatatggtgtcaatacagcagcattgagcactgcattggttgacaatgggatgagcttgggtgccatgttacgagctgaggtgcgtgaatgacccgcattggtgcttgcctggttccattgtggtcaccgccactaacttctgcccacccggtggctggtgtgaccctcctaaccaccactttgacctctctcagcctattttccagcacattgctcagtacaaagctggaattgtccctgttatttacagaagggtaagatgcangagaagtgggggaataagattcaccattaatggccattcttact

SEQ ID NO: 8608 - DNA, 552 bp, Gossypium hirsutum
  Clone ID: uC-gsronu33B166c02b2
cccacgtttccttgaatgcatactttgattagagacagggatatttctaagcatgattttgtcttctattcagatcggcttattcgtctggtggtggagcatggtcttggacatttgcctttcaccgagaagcaagtaataacgccaacagcatcgatatatactggggttgatttttgcaaaaagttgtgtggtgtttccattattagaagtggtgaaagcatggaaaatgcattacgtgcatgttgcaaaggaataaaaattggcaaaattctgattcaccgtgatggagatgatgggaaacagcttatctatgagaagcttcccaaggatatttccgaacgacatgtcctccttctggatccggttcttggtacagggaattctgcgaaccaggccattgaactactgatacagaaaggagttccggaatctcacattatattcctgaacctcatctctgcgcctgaaggaatccattgtgtttgcaaacggttcccatccttgaaaatcgtcactttagagtatgatgttgcactaaatgaggaattc

SEQ ID NO: 8609 - DNA, 253 bp, Gossypium hirsutum
  Clone ID: uC-gsronu33B166c05b2
attgactttattttggaggcaactatgattacggtaatggagattttgagcattggaagatgtgtaccaaaccatgccacccataataaggcccttttgccccatgcattatctaaattttaatttaagctactgagaatgtctcatttactacatctccgccaataatttatctgttgatttttccctttattttttttaatgcagttgtgtttgtgttttttctaaaataataatataaaattgtattcct

SEQ ID NO: 8610 - DNA, 95 bp, Gossypium hirsutum
  Clone ID: uC-gsronu33B166c07b2
ctctcacttgctgggatgggtacaaacagtgttggggggaggaggaatcttcagatgtccttaacaggcgacctgtgatatgccctaaatatgat

SEQ ID NO: 8611 - DNA, 254 bp, Gossypium hirsutum
  Clone ID: uC-gsronu33B166d03b2
attttctttgttttggtatcagtaaggaattggaatgtaataatattgattcatataggaggaaaaggttctctattgattcaaatgctgtacctatgggatagggatagagaaagaggaaaaaccgaagatttcacatagtgcttttgatcgaaaaatcaatctgatttatttcgtacccctcgctcaatgagaaaatgggtcagattctataggatcaaacctatgggacttagggaatgatggaagggaat

SEQ ID NO: 8612 - DNA, 112 bp, Gossypium hirsutum
  Clone ID: uC-gsronu33B166d05b2
aaaaatatattttatacaaaaaaaaaaaaaaaaaaaaaaaaaaaaaaaatttgtaagaataaatcggtaatgtaaaaaggaaaagacaataatagaatgaaacccagacggg

SEQ ID NO: 8613 - DNA, 524 bp, Gossypium hirsutum
  Clone ID: uC-gsronu33B166d07b2
gttaagtcaacgctagtaaacgttgaaaacctaaggacccatttgctcgaattcttgtccctctctgaccccgatgtccttgctcaaatgccccctcttcaacgcgctcaggctttcttcacccttgccaaagccaccactactcttttcgctttgaagttgagatgcagtggagtgcacccagatgaacatcctattaaatcagagcttgagagattaagcttgtatcaagagaagctagagcgtttcatagagttaagtaaagcaccgttgcgaccttcaaccaccttgaactctcaggccgcaacccgtttcattgagcattcgttaccagacctgacccctgagcagaggcaaagtatgaggcaaatcagtaaaggggaggggccaacgataaaatattctggtagtaatggtaaaaagaagagaaaatatcaatcctctgaaaaacaatctgttgaagatgctgctaaagaattcctgagaggcagctcgtgagctttttgtgataaaaagatggttta

SEQ ID NO: 8614 - DNA, 394 bp, Gossypium hirsutum
  Clone ID: uC-gsronu33B166d10b2
gttttctttctcgacgagttgcctattcgatcgccgcgtgccagtcctttgcctgcttacctcacccgaaagggaggctttgattaggctacccgtcaaggttgtttagtttacgtatgtatctttctttctttctctcttggtgtaagctacgtgttgcgtttctattggtggttatggttgagatcgacggtctcaggtgacgaactcgttttgctaaaaaaacccgttttaaaagaaaaaattgctcttctctataaattagtgaggtaattctgcgtctagaattttctttttattttttacttgaatgtatttgtacaaaggtttaggaaaaaaatggaaaattgcattgtagaactatgaataatataatgtttacttttatttgctg

SEQ ID NO: 8615 - DNA, 592 bp, Gossypium hirsutum
  Clone ID: uC-gsronu33B166e02b2
cccacgcttcctttaacaatatggtgcgtgtgactcagggtgtaatggtggtctaatgacctctgctttcgagtacaccctgaaggttggtggacttgagagagagaaggattacccttacactgggaatgaccgtggtccctgcaaatttgacaagaccaaaatcgctgcctctgtttctaacttcagtgtcatttctgttgatgaggatcaaatcgctgctaatttggtgaagcatggtccccttgctgtgggtatcaatgcagttttcatgcagacatatatgggaggggtttcatgtccttatatttgctttagaactttggatcatggagttcttctggtagggtatggagctgctggttactccccaatccgctttaaggacaagcctttctggatcataaagaattcatggggagcaaactggggagaggacggatattacaaaatatgcagaggtcgcaatgtttgtggagtagactccatggtctcaagtgtggcggctttgcatacaaagtctcagtagccattgcctgtaaatgactgatataagtaacggtcatattagtatccgtcagtatgtcttatc

SEQ ID NO: 8616 - DNA, 524 bp, Gossypium hirsutum
  Clone ID: uC-gsronu33B166e08b2
cttacttgtgggcggacgcgtggggttcagatgatgaggatgaggagacacctaagaaggttgagtcgagcaaaaagagaccggcagaagctgcaacacctgtttctgcaaagaaggctaaacctgcagcgacacctcagaaaacagatggtaagaagggtggtcacactgcaaccccacacccatcaaagcaagctgggaaaacttctggaaagagtccaaagtctggtggtcaattctcttgtggatcttgtagcaagtcctttggttccgagggtggtctagagtcccacaagaaggccaagcatggtggcaaatgagatgatattacatgctcttatgtgcatgtttaatttttgagagattatgcttttcttagtaaactggtagtttattgtctaaaaaaggcaattgagtccccttgcttctgattgaaagcttattgttctggcaaattatatatttagggtgtaatggtgcgtatctcaaaatcgttactattttagtcgtgttttttttttctg

SEQ ID NO: 8617 - DNA, 497 bp, Gossypium hirsutum
  Clone ID: uC-gsronu33B166e12b2
atttgatttttggcgtttctttcacatcattcccttgtctttcgaaatatttcctcgctctctcttttatcctcactttctcagccatcaaagacacccttttcttctcttaaggttgtaaaagatggcagatggtgaggatattcagccacttgtttgcgacaatggaactggaatggtgaaggccggatttgccggtgacgatgctccgagagccgtgttccctagcattgttggccggcctcgtcacaccggtgtgatggttggtatgggccaaaaagatgcatatgttggtgatgaggctcaatctaaaagaggtattttgacattgaaatacccaattgagcccggtattgtgaacaattgggatgatatggaaaagatttggcatcatacattttacaacgagcttcgtgttgccccagaagagcacccggttttacttaccgaagctccccttaacccgaagctaaccgtgagaagatgactcaaatatg

SEQ ID NO: 8618 - DNA, 154 bp, Gossypium hirsutum
  Clone ID: uC-gsronu33B166f01b2
acatgttattatgttaggcatatgctttatatgatgttgactgttctattctatgtgcttgagaatacattttatgtaattcgaatcttatttgagtttctcaaaaaaaaaaaaaaaaaaaataaaaaaaaaaaaaactgccataacaaccgct

SEQ ID NO: 8619 - DNA, 443 bp, Gossypium hirsutum
  Clone ID: uC-gsronu33B166f11b2
gtttgcttgtgtgtagtgaaagattctgctaactacttggatcacatcaatgggaagaaacatcaaagagctttaggcatgtccatgcgagtagaacgggcatcccttaaacaggttcaagagcgatttgagcaattaaaaaagcgaaaacctcctggaagcttcacagagcaagatcttgatgaacggatcatcaaacagcaggaagaagaggaagagcgaaagcgccaacgacgagaaagaaagaaagagaaaaagaaagagaaggccgcagaagaggaacctgaaattgatcctgatgtggcagctatgatggggtttggtgggttcggatcatctaaaaaatgatcgcatttgtttatgtatgattacatattgttttatttgactctagttattcaggcttttggtggttgactgacttgtaaggtttcccggctcag

SEQ ID NO: 8620 - DNA, 522 bp, Gossypium hirsutum
  Clone ID: uC-gsronu33B166g01b2
gtattattatgtctgtgcttttggataggatcaagaaggcttaccagaggaaccctaatttggctagcttggttgtagaccctgagtttgctagggagatggttcagaggcaagctgcttggaggagagttgtggggttggccatgtctgctgggatcagcacaccatgaatgggtgctagtcttgcctatttcgatacctataggcgtgcaaggctcccggccaatctcgtgcaggcacagagggacttgttcggggcacacacctatgagaggatcgatcgtccagggtcatttcatacagagtggaaaaagtccgctcaaaagattaatgccggtgttggtgcactcaattgaggtttctgagtttagtttgttgtactgtggctttacttgtttgtttcaaatgagcattggttatgttatgtttttatgttggaataggattctaccttggcataccaaggatgttcaagcttgaagtttttctttttctttaaataaaatgcatgcctaatgagtc

SEQ ID NO: 8621 - DNA, 88 bp, Gossypium hirsutum
  Clone ID: uC-gsronu33B166g02b2
aaaaattttatttataaaaaaaaaaaaaaaaaaaaaaaaaaaaaaaaaaaaataaaaaaaaaaatatatgtactatagattcttaaac

SEQ ID NO: 8622 - DNA, 542 bp, Gossypium hirsutum
  Clone ID: uC-gsronu33B166g04b2
aaaaaatttatttaaaaaatggttctgctagacaaaatgtgggacgatgtagtagctgggcctcaacctgaacgtggtctcggcaggcttaggaagatcaccacccagcctttgtccatcaaagatgaaggagaaaagaaaaagtaccagaggtcgttgtcgctgccgaatagtccagtgtcaggtccgacacccgtgacaccgacgactccgacggcgcgtaaggagaacgtgtggaggagtgtgttccatccgggtagcaacctagccaccaaaagtataggttctgatgttttcgacaagccacaacccaactctcctaccgtctatgactggctttacagtggggagaccaggagcaagcatcgctgagagggtggcgactgacaggcggctagcaggctgctctcgtgagccagggctgcatgtaaatagtgtgtcttctcttttcttttctttttaatgttctattttgcctgctttgtctcttgatgctattttgatgtctcgagtaaccgtagaaggtgttttaagagctgact

SEQ ID NO: 8623 - DNA, 490 bp, Gossypium hirsutum
  Clone ID: uC-gsronu33B166g05b2
ctcagcttcaattggttatcaaccgatctgccttacctcacaataggaccgatggtttcttatgattagcttgtcctttcattaccatcaatattatctgcaataagcttctgtagcaaacattgtatgaaatactacccctttcttctgaattctgaataatcacgacagaaagccaatatatcaggttagcctgttactgtaccttcaacttgatgttttctgtactcatcaatttgcagtgaagacttgatataggattctgtcagttccctgtactgctgttaatttcccttcctcccatcccttttttagtcgcttcagtttttctattacaatgtttatcttttgatattgggagtaaaaggatgctgtttttgcctcatatcaaaaaaaaaatttttcttatttcattatttactactaattaacttttctatataatttcttttctcttatatccattactctttatttctaactggggggg

SEQ ID NO: 8624 - DNA, 246 bp, Gossypium hirsutum
  Clone ID: uC-gsronu33B166h02b2
cttccctcctatttttcaggaaaatatcgtcgccgtgatccaaaactcagcccaccgtctccgacagtgtcaacccgtaacccaatctctcaaatatggatcgatccagattcgtaatcgacgccgtcgaagccgagcaaatggccaaacaatcaggcaagacggtgctccaactccttccttctttggtcaaatcagcccagtccgtagcccgcccgccgatctcgaagtaccacgtcggggcag

SEQ ID NO: 8625 - DNA, 565 bp, Gossypium hirsutum
  unsure (1)..(565): unsure at all n locations
  Clone ID: uC-gsronu33B166h05b2
cccacgtttccttccacgcgtccgcccacgcgtccggttttggttctttcatacaagtttcaagcaagtcctacagtgaagctaagagaagagaaattgaaatccttgaggcggcggtccaatggcggagaaacctcaaccggtcgtcgttcaatactgtcaagtctgcggtttacccgccgaatactgcgaattcggatccgaattcgataaatgtaagccctggttgatccaaaacgcgcccgacctgtacccggatctcctcaaagaagcgaatgctaaagaagctgataaagtttctgatcaattacaatccactggcatctcttctgctgattcaggtagtagttcagaagctaagcaagaggaagttaaacgtcttcctggtgggaaaattaaaaagaaagagaagaaagaagttgtaattgaaaaggttgtgcggaacatgcgcaaatgtataactactgtaaaaggcctggaactttttggtgtaaaattaagcgatgcttcaaagaaacttgggaagaagttngccacaggggcctctgttgtaaaggggccactg

SEQ ID NO: 8626 - DNA, 526 bp, Gossypium hirsutum
  Clone ID: uC-gsronu33B166h08b2
ctctccgttgtgtttgcttacttgtatggcagccaatttgaagagtggagcagggatcgccagcttggggaagcgacttcttaaccgcacctccactcgcacccgtactgttttcatctccacttcttcacctaccaggagtcctcacgcgtcggcatacgacaagaacctggatgatcaggtccatgcgactgtggctcctgatgatgcgattcagcctcaatcggacaagtactgggctcctgacccgcggacaggggtatttggtcctgctacggagcaacttaacgcatctgcgggtggggagcagggcacccattccagtggtgcaaactcggtcctggaggaaaaggcgtggttccgccccacatgtattgaggacttggagaagccacaccatcactaagtcactgataatgagcctactactatatagtctataggtaacacatagacaattggtgtcgcttgctgggatcacatacacttggacaacgttttaatggttcatggtatatttctacct

SEQ ID NO: 8627 - DNA, 343 bp, Gossypium hirsutum
  Clone ID: uC-gsronu33B167a02b1
tacttcttctactcctagattgatagatgggattctgctcaccaaatttgacactattgatgataaggttggagcggcgttgtcaatggtgtacatatcgggagcaccggtgatgtttgtcgggtgtggccagtcatatacagacctgaagaagcttaacgtcaaatcaatagtcaagacactgctgaaatgagtgaatgcacggtgtgggataaaagaacgaaaaagaaaaactcataaatgcattttcaatgctccactcttttaaaaaaaaaaaaaaaaaaaaaaaaaaaataaaaaaaaaaaaaaaaaaaaaataaaaaaaaaaaataaacaaataaaa

SEQ ID NO: 8628 - DNA, 480 bp, Gossypium hirsutum
  Clone ID: uC-gsronu33B167a05b1
cccatgcgttcgcccacgcgtccgggttctaagtaagattccaaggggaccattaaaggagaaaaagaaggattagatttaccggccaagatgtgcttttgctaggtttctgacatacatttggtagctgccttccgtgaaaatgtgttatttactatatatcctgtatcagttagaaccctgttttaatctttttccggttttagtacacaatgggttcaaaaagtttgatgaatttggcatctttttttctaaatcttgcttagttggtttttgatatggattcatattctatgtgacgatatgtttttataattgatggtggttggaatacattgagttgaaaggttttcaaaaaaaaaaaaaatataaaaatgcttttaataaaatttttttataaatattatcaatattttctaaaaagggccttctggacgaaataagggcctttgttattcttgatacaattttttttatatt

SEQ ID NO: 8629 - DNA, 317 bp, Gossypium hirsutum
  Clone ID: uC-gsronu33B167a07b1
agaagaaacacaaaataatgagtgatattaatttgtagataaagatagtattacatagtcgcaaaaagcgacctagtacacaacgcacaactctaaaattaggataactcctctgctatccctacggatggattttaaacatccatttttattctgtagctatcattattttggcttccactagctgatgaacattccatgccaaaatttcacttgacgctgctgcagtcagtgctagggctgatcttgtaagggatgttgacaccgcacttgcctggtagtccgcttgcaaggccaaagttgatgccaggaatgcc

SEQ ID NO: 8630 - DNA, 533 bp, Gossypium hirsutum
  unsure (1)..(533): unsure at all n locations
  Clone ID: uC-gsronu33B167a08b1
gggagttaaagagattattgcagcaatggcttctttgcaatgccagaaaaccattgagaaaggcttgggtcaaggatactatggtggcggttctagttggggaagccaggccactaaaatggagaacaaataccagaatggctatgcgatgtcttacagcgaacatgaacgccatagccaaatccgctgccccacctatggaatgagcgaatcctacactacttacggccaatctcatggcacccacaacggaaacgcaatgtcgaaaccccaatttcatggtcatgggaatggctacggcagccacatgagcaacgggatggctcacactcaagcatatggctctaaccatcacaacagccctggaaaacaccaaggccctgggtatggcagtggctttgggggctaccctcccaaaaaccatggaatgccgcatagcccaccgcaccacggcggcaaactgtcaggcccaggcaacgggttcctgaagccccaagcataccgnccttggagaagcatggcctacggaatga

SEQ ID NO: 8631 - DNA, 354 bp, Gossypium hirsutum
  Clone ID: uC-gsronu33B167a09b1
tcccatgcgtccgcccacgcgtccggtttaatcgaaggagctggccacttcgaaatggaaggccctgcttttgatgctgagatggtgaaatgtatccttgaatttattgcctctttgtaggacaagcaaccagttcttgtactagttgcttgatgaattttgcattgctttttcattaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaataaaactaattttaaattaaattctcacatttactttttttatatcatcattaattctctatcctttcttaactactat

SEQ ID NO: 8632 - DNA, 411 bp, Gossypium hirsutum
  Clone ID: uC-gsronu33B167a10b1
ttcctttcgtccgaaagagtccattttgtgaggaacttgattagggaagttgctggttttgcaccatatgagaagaggattactgagcttctgaaagttggtaaggacaaacgagcgctcaaggttgctaaaagaaagttgggaactcacaaaagggcaaagaagaagcgtgaggagatgtctagtgtgctccgcaagatgagggctcaccctggaggtggagaaaagaagaagtgaagctctctggtgacaagtcaccttgatgatttcattagagaactttgtttagcatatgttttaacgtattggtttgagactgaaaactatgcactgaatctcgtttgtttaattttataatgtatgctaaatttttgtgtttaaaaaaaaaaaaaaaaaaaaaaaataatataa

SEQ ID NO: 8633 - DNA, 493 bp, Gossypium hirsutum
  Clone ID: uC-gsronu33B167a11b1
tcggtctcgtccgcccacgcgtccgggaacactaaagcaaaaaacaagcgaatatggaggctggagatggaggcgctgaccgagtcgttgactcaaaggatttacaacaacaaagcaaagccttcgataaactcactgaccgtgtcgaagatcgacagcttgattcttctcgtgcccaatcggccatggcatcgattgcagcctcggctgaagcagaaaagaatgctatgagattgagagagaaagaattagctgctgttaaaatcaacgccggtgaagttgacatattggcaacgaattagaggtggacaaaaagggggctgagagaacactccgtgagcacaagggcgatgccattgctggcattcgatcattgcttcactagaccgagccggcgacaaatgatatcactctaaactatttagaatcattgaattcgggtttaaaggcggtggcagttatgcttattggtttcattcaaaagatgtaaaag

SEQ ID NO: 8634 - DNA, 540 bp, Gossypium hirsutum
  Clone ID: uC-gsronu33B167b08b1
ttcatgcgtccgatcccccgcccctaaaaaactctcactcatataatttaaattcgaagaatctgctacatcaaagggaaatcacaaatcccatttctcttccttacatcttttctttccttttcaacaattgcatcttttgcttttgatcccaaattctgggtttcctcttctgtccatcaatcaattcatactagttactcgaaatcgttaattttaagttgaagaaaaatgggcggtggtagggaaggtgaatcaagtgacaaagggctgatttctcatcttgctggctatgccgccggacattatccttcgcctggatcctaccctccacaaggatatcctcctcaaggatatcccccacaaggatacccaccggctggatatcctccaccagcgggatatcctcctcatggcggatacccacctgcaggatatcctcctcatggaggataccctcatccacctcatggtggatatccaccagctggttatcctggacacggatctcatggacctgtgatgggaggattattaacc

SEQ ID NO: 8635 - DNA, 497 bp, Gossypium hirsutum
  Clone ID: uC-gsronu33B167c02b1
ctgtttcttttgtttgttccacagaagtgattattggttgagaaaacatggggaaggacaagcataagcctgatgataagggtctgttttcacatcttgctcatggtggtcatggacaccctcctggcggatatccaccggctggagcgtacccccctcaaggctatccaccagctggctaccctcctcaaggaggatacccccctcacggctatccaccatctggctatcctggtgcatcccattcagggcacagtggcatgggagcgctgcttgcaggtggtgcagcagctgccgcagctgctatgggggctcaccacgtgtctcatggtgctcatggtgctcatggtgcttatggtgctcatggtgcttatggcgctcatgggtttggtcatggtcatcatgggaagtttacacatcatggtggtgggaaagttaagcatcatggggggaaattcagcacgggaagcatgggatatttagcaccggaagatgga

SEQ ID NO: 8636 - DNA, 466 bp, Gossypium hirsutum
  Clone ID: uC-gsronu33B167c03b1
cttttgatttagtttcagtggagagaagggagaccatggataggagatcctgctgatgttattcttgatgacagctcgtctggcacagccaatacctcatgaatcacaaccttgaactgtgttttcagttcattcctgaagctcggggttactttgctcgaaactctatcccgacctaaccatgaaccaattttattacaggattatttgtattaattaagtacagggatggacatggagcatgaggaactgacttgcctcactgttaattatagtaaatacaaagagctgcccaacgagaaaaacgaaattggctatagaccatgtatctcacagatagtgatgatagattataagctggtcatatattatttagataagagatgaatatggtcatttatatgtaactctgtacaaattggacatcacttaattaattattaattaagtattgagtcttttttag

SEQ ID NO: 8637 - DNA, 565 bp, Gossypium hirsutum
  Clone ID: uC-gsronu33B167c07b1
ttctgtttcgttaacaggcagttgatttacaatttccccgaagaactctttgcagatgcaggcatacttgctattgagcatgctgattttgatgggatagaacgtctggctttggtaacaggtggtgaaattgcttcaacctttgacaacccagagtctgttaagcttggacattgcaagcttattgaagaaattatgattggtgaggacaagttgatccacttttctggtgttgaaatgggtcaggcttgtactattgtgttgagaggggcaagccatcatgtgctggatgaagctgaaaggtctctgcatgatgccttgtgtgtgctgtctcagacagtcaatgatactagggtattgcttgggggtggatggcctgagatggtaatggcaaaggaagtggatgaattggcacggaagactccggtgaagaagtctcatgctattgaagctttctcgcgtgcgcttgtggccatcccacaattattgctgacaatgctggtctagacagtgcagacttagtagctaaagttcgtgcagagcaccacaaggagggatgcaatgc

SEQ ID NO: 8638 - DNA, 471 bp, Gossypium hirsutum
  Clone ID: uC-gsronu33B167c08b1
ctctggcaggttgaagttccacaaaatcgaggaaacaaaagaatgcaacgatggcatttcgtgtcaacatctgtaatgatagtccggttatggtcttcttggcttgttcgtgaaaccactgaaaaaatcgactttgctcccgagggtgttaccaagcttcatcttgatgctcctgatgataaattaatggagttcatcccaaaatttgatgtgattgttatttcttccggccactggtttgccaaacaatctgtctatgtcttgaacaacgagattgtgggaggacaattatggtggccaaatggatctcctcccatgaaagtcaacaatgtcgacgcatttggaatatctgtagggacaattttcttcgcaatttttacacaccctaattacaccggtctgactatcgtacgttccttttctcctgatcattacgagggcggtgcttggaatacgggtggatcatgtact

SEQ ID NO: 8639 - DNA, 415 bp, Gossypium hirsutum
  Clone ID: uC-gsronu33B167c11b1
tttataaccctaagccttacataaaatacaaggtattgaaagagaagttggacaaagaaagagaaatgagtctgctttcgaatgcagattggggaccaatcgttgttgcagtggtcttgtttatcctcttgtcgccagggatgatgttccaattgccaacgaggacaagggtgatagagtttggcaacatgtgcacaagtgggatagccatcttggttcatgccataatatatttcagcttattcaccatcttgatcatggaaattggtattcacatacatgtttactagttgatccaaaatctcaacaaaaagggtaggctcttctttggctcctttccttaatttgtcttcactgttatttcattgatgtttgtaagaaaaaatttgaatagtgtaatgatgaaatctatttc

SEQ ID NO: 8640 - DNA, 533 bp, Gossypium hirsutum
  unsure (1)..(533): unsure at all n locations
  Clone ID: uC-gsronu33B167c12b1
tctgtctcaattggcttcaatctcattgagcatgttctttgccacatagtgaggaaagagaggcctggtgctgttttggttttcatgactggttgggatgacataaattctctaaaaggtcagcttcaggctcatcctctcctaggtgaccctagcaaggtgttgttgcttgcatgccatggttccatgcctagctctgagcagaggttaatatttgaaaagccagaagatggagtgaggaaaatagttctagctactaatatggctgagactagcatcaccatcaatgatgtggtttttgtggttgattgtggaaaggcaaaagaaacatcctatgatgcattaaataatactccttgtttgcttccatcttggatatcaaaggctgctgcccggcaaagaaggggaagagctggtcgtgttcaaacctgcgagtgttaccatctttantcccaaatgttttacgatacttttgctgattatcaacttccagagcttttaaggacaccattgcagtctttatgtttgcaaat

SEQ ID NO: 8641 - DNA, 506 bp, Gossypium hirsutum
  Clone ID: uC-gsronu33B167d10b1
tttatttttatccctgaaaacagaaagaggccgccgttgtcgttcctgcagcagaacagcaaaagaagcaaagcaatggcaaggatcaaggttcatgagttgcgacagaaatcaaaaaccgatcttttggctcagttgaaagatctcaaagctgaacttgctcttcttcgcgttgctaaagttaccggtggtgcacctaacaagctttctaagataaaggtggtgaggctgtccattgctcaagttctgactgtaatctcacagaagcagaagtctgcattgagggaggcatacaagaagaagaaattcttgcctctcgatctccgtcccaagaagacccgagctatccgcagaaggcttaccaagcaccaggcatctttgaagaccgaaagggagaagaagaaggaaatgtacttcccaatgaggaagtatgccattaaggtgtagggtaggatctctcacattctatttacatatcgattcgctctttactttctagcatcgtc

SEQ ID NO: 8642 - DNA, 511 bp, Gossypium hirsutum
  unsure (1)..(511): unsure at all n locations
  Clone ID: uC-gsronu33B167e07b1
tctattctgaccttgctggacctgaatattttgccaagtacaagactctcatctatcttgccggctctgcatctgctgaggtgattgctgatgttgcactttgcccctttgaggcagtcaaggtcagggttcaaacccagcctggtttcgctaggggtctgtctgatggtcttcccaagtttgtcagatctgaaggtgctctcggattgtacaagggttttgttcctctttggggccgacagattccatataccatgatgaaatttgcttcttttgaaactattgttgagatgatctacaagtatggtattcccactcccaaggagcagtgcagcaaaaatctgcagcttggtgttagttntgctggtggttatgttgctggtgtcttctgtgctattgtttcgcatcctgctgacaaccttgtctccttccttaacaatgccaaaggagcaactgttggggatgctgtgaagaagcttggattatggggtctgtttacccgtggtcttcc

SEQ ID NO: 8643 - DNA, 564 bp, Gossypium hirsutum
  Clone ID: uC-gsronu33B167e10b1
tttgttttaggtctgagaaacaaaagaatttgaaagctttaaaagataagaatagagaaggtttaggtgaagagaattgtgacgaagataagaaagaagagggttgggttaatggtggtcgtggacctttaatggctgcttcacaaggttcaattggttctcaaggaagtggttcttcaggcatatctgaacttgacagccaaccacctcaaggaacttacaaatgccaagggtcaagaagccctacgagtgtgcaatctacaacacaaaccgagcaaaaaccaaacatcatcaaccccggaaagatatcaactcagaaatccgaaaagttagccggaatcacagcaaagaatcaacataatcaaccaggagtagatgaaaaaagacttcgggcaagtttgaagaacataatggaagacatgccatgtgtgtcaacaacaggagatggtcctaatgggaaaagaatagaaggatttctttacagatatagaaaaggtgaagaagtgagaatagtatgttgttgtcatggcagtttcctttcttccgccgagttcgtaaacatgc

SEQ ID NO: 8644 - DNA, 640 bp, Gossypium hirsutum
  Clone ID: uC-gsronu33B167e11b1
ttatatttatattcatagagacatcaagcctgacaacctgctacttgataaaaatggtcatatgaaattatcagattttggattatgtaaaccattagattgcagtaatctccaggaaaaggattttaccttagcaaagaatctcagtggggctcttcaaagtgatggacgacctgctccaccaaaacgcacacaacaagagcaattgcagcattggcagaggaacagaaggatgcttgcatattctacggttggtacacctgactatatcgctccagaggttttgctgaagaaaggatacggaatggaatgcgattggtggtctcttggtgctatcatgtatgaaatgcttgttggatatccacccttttattctgatgagccaatgtcgacctgtcggaagatagtaaattggagaacgcacttaaaatttcccgaagaagcaaaactatcccccgaagctaaagatcttatcagtaaactcttatgtaatgttgagcaaaggctcggcacaaagggcgctaatgaaattaaggctcacccatggtttaaaggtattgaatgggacaaatgtatcaaatgaaagctgcattatttctgaagtcattacgagttggacacgcaaaattcgagaatttga

SEQ ID NO: 8645 - DNA, 599 bp, Gossypium hirsutum
  unsure (1)..(599): unsure at all n locations
  Clone ID: uC-gsronu33B167f01b1
ccctttcgttcggtacactgtgaaatggaaggaaactgatactccttttgagaagaggatggagagatattccatgtcttcttctttgccgcatcatttagagattcattggttttcaattatcaactcttgtgtgacggttctccttttgactggtttccttgcaacaattctcatgcgggtcttgaagaatgatttcattaagtacggtcaagatgaagaagcagctgatgatcaagaagagactggatggaagtatattcatggagacgtattccgtttcccaaagtacaaatctctctttgctgctgctctcggatctggaacacagctgttcactttaacggtcttcatttttatgcttgcactggttggtgtcttttatccatacaacagaggagctctatttactgccctggtggtaatatatgcccttacgtcagggattgcaggctacgtagcaacttctttctactgtcagcttgaagggacanactgtgttaggaatcttgttttgactggctgccttttctgtgggcccttgttcttacattctgcttccttacacagttgcattgatacagtgaactgcacactgc

SEQ ID NO: 8646 - DNA, 88 bp, Gossypium hirsutum
  Clone ID: uC-gsronu33B167f08b1
tctgagaacccacacgatagtagtactgtactgtccacttttatacaaaatgactatcatttaacgacagaaaagaactagacacatt

SEQ ID NO: 8647 - DNA, 363 bp, Gossypium hirsutum
  Clone ID: uC-gsronu33B167f09b1
ttaatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggtggctgtttaaaaggatcaagtttctatttcctggagttgcaactttttatttttttattggggctcctaaaaaaaattagtcggccccggttttaaaaacaattaatgtgggaaaaaccttggttttcccaattttattttcttttgcgaatatcccctttttaccaaattgggtaattagaaaaaaggcccccctctatttgctatttcaaaaaagtgttcaccttatatggtta

SEQ ID NO: 8648 - DNA, 530 bp, Gossypium hirsutum
  Clone ID: uC-gsronu33B167g07b1
tttctatgcgtccggtcgcttacaagaatgtaatcggtgcacgccgtgcttcctggcggatcgtctcctccattgagcagaaagaggagagccgtggtaatgaggatcacgtcactctaatccgcgattatcgggccaagatcgagtctgagctctcctctatctgtggcggtattttgaagctgctcgactccaggcttatcccttcggctgctgctaaagactccaaggtcttttatcttaagatgaagggcgattatcataggtatttggctgagttcaagactggagccgaacggaaggaagctgctgagagtactctcactgcttacacagtccgtcaagacattgccaacgccgagttggctccaactcacccgatccgtctcggactggctctcaattctctgttttctactatgagattcttaattctcctgatcgcgcttgcaatctccaaaacaggcatttgatgaagcaatcgctgaagtggatactctaggcgaggaatcatacaatgacagcacact

SEQ ID NO: 8649 - DNA, 516 bp, Gossypium hirsutum
  Clone ID: uC-gsronu33B167g08b1
tttccattcgtccggttatttttgcctaagttgtttacattgattatgtatgcaaagaagaggctcgatttttgataaattgtagaacaaaatttaatgtttgaaagaacaaacatgcttgagggcaagcatgagctaagtagggggagttgataaacacattaatttacataattcttgtatctaatttggtttatttctgaattaatccctgcttaattggtgtttttatgatttaatcttgtcagggatgcaattggtcaaaaacgagcaaaaaggggccaaattgaaagacaaatcattgagttggggccaaatcataaagatgggaaggccaaagatttaacatcaattttgactttataaaaagttaaaaatagaatatattattctattttgttttattattttattaattttattttaatttattaatttaggattaaagctattttagtaactctatctatataataggggctttagttcttaaaaatcatctcttgtctttgattc

SEQ ID NO: 8650 - DNA, 619 bp, Gossypium hirsutum
  Clone ID: uC-gsronu33B167g10b1
taatttattaaaaaaaaaaaaaaaaaaaaaaaaaaaaaataaataaaaaaaaatatataaataaaaaaaaaaaaaaaaaataaaaaggatactttacttaatggtttctagttctttctttgttttttttgtttgtttttggtttgtttgttagctccatttcttttttttgttgtcctgtttttttgttttcttttttctttttgattactctttattattctatttgtgcgctattttttttttttttattttttttgttattttcttctattatctaatttttcttttgtttttttttttctaaattttttgtatgtcattatttttattgtgttctttctttctattaacgtttttctttgtctgtaatttgtatattttttactcttttctatatttttttttcttttatatgttgtccttatttcctattcttgttcattttatttttctttttggtcatgtaatcctcttgtttgtttttgttgttgttttttgctaggattatttgttattgattttttttattttgtttcttatctgttttttttttactgtctgtttatttactctgattgttgttttgttgtattttacattgtatgttgtagttttt

SEQ ID NO: 8651 - DNA, 551 bp, Gossypium hirsutum
  Clone ID: uC-gsronu33B167g11b1
ttcctctcgtccgcccacgcgtccgggcggcttctgcttctatttactattttctcactctcctactcctttgtgccatcccttttaccttctccgagctcgttaaagagcagcctctggtgttgaagtaccacaatgggccactcttgaaggggaagatcaccgttaatctcatctggtacgggaagttctccccaacccagcgctccataatcgtcgatttcatcaactctttgagctctgccgtcaaacccaagattccgtcggcgtcgttttggtggaaaacgacggagaaatacaagtccggttcctccactttggtcgtgggcaaacaaatcctcctcgaaaattacccgctcggtaaaatccttaagaacccacacttgccagcgttggccgggaaattcaacggcgtaggtacggttagcgttatcctcacggccaaagacgtcgccgtcgatgggttctgcatgaggtgcgggactcacgggtcgaaccgggttggtcgggttcgaggtacctttatctgggttggaaactcgagactcaat

SEQ ID NO: 8652 - DNA, 515 bp, Gossypium hirsutum
  Clone ID: uC-gsronu33B167h04b1
atttttcactatgtcatctatctgaccaggtcttgggcctcactcctcactcagatgctactctcataaccattttgcttcagctcaatgatgtccatggtcttcaagtaaggaaagatgggaattgggttcccgttaaaccactcccaaatgccttcattctcaacgttggagacatcttagagattttaacgaacgggacgtaccgtagcattgaacatcgtgcgacagtgaacccaaaaaaaggaaaggctctcgtttgcgacattcatcggagtgggggctgggggagaaatagggcctgcacccagcttggtgtcaaaacaaaagtctgccatgtttaggagggtgaaagttgaagaatactacaaagggatgttctctcgtaagcttcaggggaaatcttatcttgattacatgaaaatagaacaggattaaggacgatgtgttgtggtagttatatataataagggaagtgcccccaacatgttataaagatttgcatgtgtgcatgt

SEQ ID NO: 8653 - DNA, 418 bp, Gossypium hirsutum
  Clone ID: uC-gsronu33B167h06b1
ccctttcgtttgcgatggcatccactcccagtccagacattcttgtgtaagctctgaacttctttatatctaaagaggttcgagatcaagatatcgcttatggacttcctggaataagcttacaagggcatgaaatagcatggtggcggatgaaggagaactggaactctatcataaacaagcatattggagggctcctcacacattctattcctgacattatatcaccgttttgcatcaatgagaaagctgatgaggttgaagaatttttccaaagccgtgtgactacttcatttgcactgaattcgaaccaaagctttgagcatgttcggatcaaagcaaggctgttggaagcttatagcagagcggcaacccttttaagacctactctagcaattagtttgtatggtatgctaac

SEQ ID NO: 8654 - DNA, 503 bp, Gossypium hirsutum
  unsure (1)..(503): unsure at all n locations
  Clone ID: uC-gsronu33B167h07b1
ttcctttggggcgatggggtgattctcgaaatccatcgtatggtgcactatccgactatcatttcatgaggccccgtgcacgtgacaagaaacttcaggaagaatgggctactcctttgaaaagcattgatgacattcaagagaaatttaaaaaccattgtctgggtaagttgagaagtagcccttggtccgagttggatggtcttcagccagagacaaagatcatacatgaacagctaggaaagatcaatttgaagggcttccttaccatcaatagccaaccagccgtcaatggggaacgctctgattctccatctgtcggttggggtggcccaggagggcacgtttaccagaaggcttacctcgagtttttctgctcactggataaattagatgcactagtgaaaaattgcaattccttttcatcattgacctatgttgctgtcaacaaaaagggngaattgttatcaaacattggccttacagatgtgaatgcagtaact

SEQ ID NO: 8655 - DNA, 85 bp, Gossypium hirsutum
  Clone ID: uC-gsronu33B167h10b1
ttccatttcgtccgaatggcagagcatccttgtaaatgcttttcaattctggtagatactgtaaataaagagatttgagttttgc

SEQ ID NO: 8656 - DNA, 370 bp, Gossypium hirsutum
  Clone ID: uC-gsronu33B167h11b1
ttaatttgataccgatcccacaaccgaccacagttgggttatggtgcgaagatgattctacttacgtcgcatggcggccacccgagattgttcgtgatcttctatcctaattacttcaaagcacaataatatatctaactcagagagacaactcaacacttatgagttctaggaagaatgtaccggatagatggtaatttgccaatgagtacaccaagaaaggtgaaaaacacttgctttgtgagatccatacaaggaaaacagctcatccacaagtgactgtagcgttaaacttactacaaccaccaccaccgtcatttacacacacatatcaccaatggataataaatacctcattatggctaccttt

SEQ ID NO: 8657 - DNA, 309 bp, Gossypium hirsutum
  Clone ID: uC-gsronu33B168a02b1
cccattcttccgaattatgtctctgtctgtgtcttgtgtaatataagctttgtttgtggtgaaaataatgtataagccatttggttgggagcaaattgtccttttctccaaaggatttttgctgctcattcatggtgacttggtttatggttttatctgttgttgttaaaatcttataaaaatatatatcggttgctgctcttggtttgtatcaaaaaaaaaaaaaaaaaaaaaaaaaaaaaaaaaattaaaaaaaataattttattattataaaaaatttattattatattattttattaaacattat

SEQ ID NO: 8658 - DNA, 506 bp, Gossypium hirsutum
  Clone ID: uC-gsronu33B168a05b1
cccattcttccggtggattcttataagtggagcactggggggtatctgcatttttggtccctttatttcttttcaagcatatggctactacaatatgtgtctaggacgttcttccgatgaaatgaggccttggtgtaaagcacgaataccattgctatacaattacattcaaagtcattattggggagtgggattcttgagatacttcagatttaaacaactgccaaactttctattggcatctccaatactgtctttggcagtttgttcaatcatctattatgcgaagtcaagacctgaaatagttcgatcattgggttttcaagcttcagttgaggagaaacgtatcatggcagtaattttttcttctcagaaaccacaaagatcaaacgacacccaattgtcagagaaatattcttctaggaagcaacgaaatcataatcttaaatcgaggaagaaaataagccaaggagaggatcttgccgagggcacatacgatcatggat

SEQ ID NO: 8659 - DNA, 460 bp, Gossypium hirsutum
  Clone ID: uC-gsronu33B168a07b1
ctaaaaaaactcaaaaaaaagtaaacccagtgttagagagaggaagtgttaattgaatgctctctaaaacttcacctgatatggcctcctttccttgttccagggtgaggagtgggctttgtgtctggccaggtaataggcaactttgcattagaaagggtcttgtgtatggctttatgcacttactatcaattccctttaaaaccttgtgtggagcgagtcgatctcttagggttgcagagttttgcagtgtttccaatatgtcttcctcattacaaattgaattggtgtcatgtcttggagacaactatgcatatcttttacatgatgtggacacaggcacagttggagttgttgatccttcagaagctgtgccaattattgatgctttaagtcgaagaaactggaacttgacttatatattgaatacccaccaccatcacgaccacactggtgggaa

SEQ ID NO: 8660 - DNA, 361 bp, Gossypium hirsutum
  Clone ID: uC-gsronu33B168a09b1
gtattgctttcaaaattgaaggaccttcaattgttggtattatagagcatgcatgatgatggatgcttggtgtttgcttactacaaggatggtgctgttgacccaacatttttgtactttgcatatgcattgaaggaggtcaagtgctgaggtttgaagcaaagaaaaaaaaagtggttgctgaagaatttagtcctttttattattgcttttgtctcttgttttcagtactctgctaaagacataaattatttgtggtttttgatgtttttgttttaattgtttgttgttttatcatggaatggtttctattttttatgggttggctaaaaaaaaaaaccattctaaattttaaaattcc

SEQ ID NO: 8661 - DNA, 385 bp, Gossypium hirsutum
  Clone ID: uC-gsronu33B168a10b1
taataaaaaaaaaaaaaaaaaaaaaaaaaaaaaggggggatattgtaaacaaaaagggggtttccaaaaaaccaaacccctggcttcccccatatatcttttgtctcgttacaaccaaaatggggtcccttttcgggggttcaccatttccttccctgggcaaacccttgcaattccttatttggggggccgtgaaaaaaaattccctttccccctgttttacacattgggaatgggaaaaccccgtgggcccccccaaaaattgccccggccaaaaatccccttttgccccccccttaaatgcccaataagcccccccggttttcctttttcccaaattggtaccctttatatttgcaaggacccccccccctgctcttttatt

SEQ ID NO: 8662 - DNA, 381 bp, Gossypium hirsutum
  Clone ID: uC-gsronu33B168b01b1
cccatgctatcgcccacgcgtccgcccacgcgtccgcggggctttttaccacgcgttcggtgttgtggggagacggtctttagacccgatctttcaccttcattgatgaatgtgtcgaaggtgtacttagattgacaaagtcagattttcgcgaacctgtgaacattggaagtgatgagatggtcagcatgaatgagatggcagaaattgttcttagctttgaggataaaaatctttcaatccatcatattcctggcccagagggtgtccgtggtcgtaattcagacaatacgttgatcaaagaaaaacttggttgggctcctacaatgaggttgaaggatgggctgagaaatacatacttttggatcaaggaacaaattg

SEQ ID NO: 8663 - DNA, 518 bp, Gossypium hirsutum
  Clone ID: uC-gsronu33B168b02b1
gggtttgtcggagagtatgaaccacttccaacaccggtgttaaccttcgagactcgtgctcctaaggaatcagcccttttcacaaagttgcagcatgctgctgatgttcatcctcgaaaggatgatgctactcataggacgaccccggttcctgcaactgatgttcgaaaggatgttggaacttataggaccccagttcctgctaagccacatcctcttgatgtccccgtttctgaatcgaaatcctcttcattttgttccgcaaatgggtcaacatcagaagggaggccatctttgtttactccaccagctatgccatctgttccacctattagaagagatgagtccagcaatgctgccgctgtcgctgctcgtgcatggatgtctataggagctggagcctttaaggaagcaaatgaaaactttggcacttcgaaaggaaaaatatccgcagattcgttatacaaccccgctagggaacttcatccacaagcttcacaagttcgagggcaattccc

SEQ ID NO: 8664 - DNA, 537 bp, Gossypium hirsutum
  Clone ID: uC-gsronu33B168b07b1
ttcgttattctaaaaaaagaaaaaaacctacaacatgggacccttgttctccgtcccattcttaaccttcctcttcttccatttctactcagtcccgaccctcagttcctacgtatacgacactagcgccaccaccaccaacgtcatcaactctacagatttcattcgtacaagctgctacgccaccttgtatcccgatatttgctatacttccctttatggctatgccaacgccatccaacaagacccagctcgtctagctcgtgccgccattagtgtcagcctctctaaagctcgtaacatggcagtctacgtctctaacctctcccgggaagccgattacggcgccgacccaagagccagcgcagccttgcacgactgtttctcgaacatgggtgatgcagtggatgaaatccgtgggtcgctgaagcaaatgcaacgggtagtggctccaggttcggagtctttcaggttccaaatggggaatgtccagacatggatgagcgcggctttgacggatgaggagacgtgtaccga

SEQ ID NO: 8665 - DNA, 104 bp, Gossypium hirsutum
  Clone ID: uC-gsronu33B168b10b1
ttattcgtccgcttgtatcagatgcaaaaaaaggagaaaatttgaaatttgttctgttaaaattggaaacctgctgcttgaaaaaaaaaaaaaaaaattaaaaa

SEQ ID NO: 8666 - DNA, 493 bp, Gossypium hirsutum
  Clone ID: uC-gsronu33B168c01b1
cttattttttactttgtgttataatgcactcaaatgacaacagtgatcttttatcatcaatgtcacggttatctgctgaagcaaagaaggatcaagctgttcagcatgcacttgcagttcggtcagcagtgacttcaggaaattatgtcttgttctttagattatacaaaacggcacctaacttgaactcctgccttatggacctttatgttgagaaaatgagatataaggctgtaagctgtatgtctcgttcttatcgtcctcaagtacctgtttcgtacattgctcaggtgctgggcttcagcagtggtgtgcttacaaatgaaagaagtgacgagaaagagtcggatggattggaggactgtgttgactggttaaagacacacggtgcatgccttggtggggatagtaatggagagaagcagcttgatgcttaggcattatcttcaactctctacatgccggaccctgaagatgctgtaacccatggcga

SEQ ID NO: 8667 - DNA, 521 bp, Gossypium hirsutum
  Clone ID: uC-gsronu33B168c03b1
cccacgtttccgcccacgcgtccgcccacgcgtccggccacgctttcgctctcttcttaggtctgctgtatcttagttcttgattaattagccaatcacagcagccatgtctctcctcaatgatctcatcaacctcaacctcagcgacaccactgaaaagatcatagccgaatacatatggatcggtggatctggtatggatctgagaagcaaagcaaggactttgcctggaccagtgacggacccttcaaaactcccgaagtggaactacgatggttccagtaccaatcaagcacctggagatgacagtgaggtcattctttatcctcaagctatattcaaggatccatttagaaaaggaaacaacatcttggtgatgtgcgatgcttacacaccagccggcgaacccattcctaccaacaagagatttaatgcggccaagatctttagccaccctgatgttgttgctgaggagccttggtatggtattgagcaagagtacactcttcttaaaaggatac

SEQ ID NO: 8668 - DNA, 376 bp, Gossypium hirsutum
  Clone ID: uC-gsronu33B168c07b1
tgtcttactcgcttttctcttcacccttacttgggggctctttaccttctctcaagcctgcttcaacacatctgaatcccaacatgatgtcacccccgaaaaatcccgtaccgatttttcccgaatcgaccccgaatccgccatcccttctcccagcgagaaaccccactttgaaccccccaaattactcgacttcaagcacgatgatgatgccttcggcgatgccttcgttcctttgaccaaaaacaggtttaaccctggcaaccggcactttccaaggcgttccttgattccgttccggcacaaggacaactggcggtttcattaaccgttcaagcctttgaaatcaccctttccataaaaaccgcttaatttt

SEQ ID NO: 8669 - DNA, 178 bp, Gossypium hirsutum
  Clone ID: uC-gsronu33B168c10b1
agtagatgaaggagtacaataagaaggaagccaaagtctatggcaatatgtttgcggcgggatgaataaaacagctcccaaagaacccgcaccaatgaccatagatagcaaagcgtaggtggtggacacgtgacggtttgatgccttgggtgtttttttttttttccctaaaaatggg

SEQ ID NO: 8670 - DNA, 396 bp, Gossypium hirsutum
  unsure (1)..(396): unsure at all n locations
  Clone ID: uC-gsronu33B168c11b1
tgnttgnctattgaattctttccctcactttctggaggaaatttatgacttcaggtggctgttgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataaatatgtctctgtctgtgtctt

SEQ ID NO: 8671 - DNA, 542 bp, Gossypium hirsutum
  Clone ID: uC-gsronu33B168d03b1
ccgcattattccgctttctttttatctgtgtacttattgacccctatcagtcaactgtcaatcaggttcctttcttttctgtcgatccatctccaaagtttattgcttaaggatcctttcaatcagtgattctggtgtgttaccaggggcggatgtaaagcctttaggcttggcacttggtgcccatgtgtgttccagagggatgttagcctacaagctaggcagttgatgcccaatttttgtagattaaggtttgtggaaatggacgatcgaatcaactcaaagaatcattctatccagatatcttttggttattttttatatgtttatctttgggttatatggcatgtaataggtgtgttttgttaatgttttgaatatttactacatgtgttacatatgagattgatccaaagatgattaagcttagtattagcttgcttgtgtatgtgcccttaatcatgtgtgaatatggtcatataaaattgtttggtcaatggatataaacgttatgaagtatttgaatcatggtatgaatgata

SEQ ID NO: 8672 - DNA, 509 bp, Gossypium hirsutum
  Clone ID: uC-gsronu33B168d05b1
gagtttttatgtacaaatgtgatggctgcaatgactacggtaaggttatggaagcgccttaccatacgatgggctcctaacattcttacaattgccttgaaaagatttcagagcggccgatttggaaaactcaacaaaagagtcagctttcctgagacgttagatcttagcccgtacatgagtgagagtgaagatggggatgattccaatatttacaaactttatgcggttgttgtccatgtggatatgttgaatgcatccttttttggtcattacatctgctataccaaagatttctctggaaactggtacagaattgatgactgtaaggttgcgagggctgaattggaagaggtactttctcagggagcatatatgcttttatatagcagggtctctgcacgcccatcgtgtcttagaacctctggaatcaactctgaagcagatcattgcttaaaggaacagattgaatgtgtacctggaaaagagttcattagctctcccagtcg

SEQ ID NO: 8673 - DNA, 527 bp, Gossypium hirsutum
  Clone ID: uC-gsronu33B168e03b1
aaactatttcactctcacattaaatattgttagtgagacaatgtcgtcttcagctctgataagtaagcttgaggcagatgtagagattaaggcttctcctaagcagttccatgaaatgtttgcccacaaaccgcaccatgtgcaccatacttgttatgacaagattcaaggatgcgatttacatgaaggtgaatgggggaaagtcggtaccattgtccattggagttatgtgcatgatggaaaggctaaaaaggcaaaggaagtagtggaagcagtagaccctgataagaatttggtcactttcagagtgatcgaaggagatctaatggaagagtataagagctttgtaatcacgattcaagtttcgcccaagagcgagggtagtggcagcgtagtgcactggactttggaatacgagaagctgcacggtgggattgcgcatcctgagactctgctgcaattcgttcaagatatctctaaagacaatgacgcccacctcacccaagcaagctaaacagtatcacatg

SEQ ID NO: 8674 - DNA, 548 bp, Gossypium hirsutum
  Clone ID: uC-gsronu33B168e07b1
aaagcatatgcattggctgactctaggcgcgattcatcttgttcttcaacagttatttcactgcttgaaaatgccttgaaatgcccctcagataatcttcggaaagggcaagctcttaataatctgggaagtgtcttggttgattgtgggaaattagactcagcagccgactgctacattaatgcccttaaaatacgtcacacgagagcccatcaaggccttgcacgtgtccattttctcaaaaatgataaggccaccgcatatgttgaaatgaccaaacttattgaaaaggctaaaaataatgcatccgcatatgagaagaggtccgagtactgtgaccgtgaccgtgacctcacaaaggcagatcttgagatggtcactcgaatagatccactcaaggtatatccttaccggtatcgagctgcagtgttaatggatagccccaaggagaaggaagccattgcagaactgtcaagggcaattacatttaaagcagaccttacgttctacacctacgagctggcttccatgagcatgttggtgatgtc

SEQ ID NO: 8675 - DNA, 555 bp, Gossypium hirsutum
  Clone ID: uC-gsronu33B168f04b1
gcttttgttacaaaagcttataactacattcataaggggggacttaaatcaaagcttagtgggagcagctgttcggaacaagcaggatatatttagtttgctgggggttgactatatcattgcaccattgaaggtattgcagtcactcaaagaatcaattacttctcccgacgagaagtactcttacgttaggaggttgtccccacagtctgctgccagatatgatttcaccgccgaagagctcacaaagtgggatcaactaagccttgcatcagccatgggacctgcattggtggagcttctggctgctggactggatggatacgttaatcaagcaaagcgagtcgaggaattgcttgacaagatttggccacctccaaatgtctaaagtggctcgtctccgtctcaaagcatctctcgtgtggcatagaataagacggtggtggtaccctgctccattatgttgttttaacaaaacttgcttcatttgctgagaactttagctggttttaaattattgaatgctaatcctttatattctctcgtatcaatgaa

SEQ ID NO: 8676 - DNA, 490 bp, Gossypium hirsutum
  Clone ID: uC-gsronu33B168f08b1
ttcatgcgtccggtttgctgggggttgactatgtcgttgctctatagaaggtatggggggtcactcaaagaatcaattacttctcctgacgagaagtattcttacgataggaggttggccccacagtctgctgccagatatgatttcaccgccgaagagctcacaaagtgggatcaactaagccttgcatcagccatgggacctgcatcggtggagcttctggctgcaggactggatggatacgttaatcaagcaaagcgagttgaggaattgctcgacaagatttggccacctccaaatgtctaaagtggctcgtcttcggttcaaagtatctctcgtgtggcatagaataagaaggtggtggtaccctgctccattatgttggtttaacaaaccttggttcatttgctgagaactttagcttggtttaaaatattgaatgctaatccttcattatctctggtatcattgaacaagatggtgttgatgt

SEQ ID NO: 8677 - DNA, 470 bp, Gossypium hirsutum
  Clone ID: uC-gsronu33B168f11b1
aataaaaacacaaaaaaaaaaaaaaaaaaaaaagaagaaatttataaaaaaaaaagcgctctaaaaaccccaacccaaaaaaaaaaacccacccacctacccctaccaaccaaccccactcccccccccctcctccccccaatcccactcccctgccccactcttacccaccccctcactggccaacccccccccctcccccacccactctacctccccctcccaccccccctcttccaccttccccaccccccccaaatccccccccctacaaccctccccaccttcccctcccccctcaacccccactgccccccgccctctctcccaccatccccccccccctccccttctatcacccccccacctaacccttcccccttcccaacccccttacccccccccccttcctccctctccccccccttccccccccaccttccccaccttccccccccagccccaaaccc

SEQ ID NO: 8678 - DNA, 507 bp, Gossypium hirsutum
  Clone ID: uC-gsronu33B168g03b1
gcggtggtacatggccagattctaagggacctcattacggtgatggttctcggccaatgatgcaagacctctggctgttgcttgctttgatatttcacagtttattcagcaccatcctgctggtagggtgatagtgaatgacctcaaggccaaggaacgggtgatgaagttgatgaaccacgagagtgcggaggttaccaagaatgccttactctgcatccagaggcttttcctcggcgccaaatacgccagctttttgcaggtatagtttcgtgttgttgtgtgcatggtcatgtctcattctacaatgcagctagtgaatatatcgtaagtaaattcggcttcggctttgttgggtgttatattttcatcggatatattttgataatgcaaaaggaagattattttcctttctgtcaaaaacttaaaatgctactctgattctgagaatgtgcaatagaaaatactacttctaaatatgttaatttatttaattttgccttttgc

SEQ ID NO: 8679 - DNA, 64 bp, Gossypium hirsutum
  Clone ID: uC-gsronu33B168g04b1
aaatttttataaaaaaaaaaaaaaaaaaaaaaaaaaagggggaattttaaaaaaaaagggggtt

SEQ ID NO: 8680 - DNA, 557 bp, Gossypium hirsutum
  unsure (1)..(557): unsure at all n locations
  Clone ID: uC-gsronu33B168g05b1
cggatgcttgggatcagagccgcagctgccgccagggccatggtgaagtttcttaggcggaacaaggcagttatcgtcctccagggtcgatacgccggccgcaaagccgtcattgtcagatctttcgacgatggcacacgtgaccgcgcctatggccattgtttggttgcagggataaagaagtatccgagcaaggttatccgcaaggactccgcgaagaaaaccgccaagaagtcacgcgtcaagtgcttcatcaagctcgtcaattaccagcacctgatgcccacgcgctacaccctcgacgtggacttgaaagacgtggttaccgtcgatgctctccagaccaaggacaagaaagtggccgcttgtaaggcaactaaggagaggtttgaagagaggttcaagactgggaaaaacaggtggttctttactaagctcaggttttaagtgttttattggaacatgttttatgcttaagtagttttatcgaacaattttgaatntaatgacggattttgaatctgtttggataagatatttctgggttattattttgg

SEQ ID NO: 8681 - DNA, 437 bp, Gossypium hirsutum
  Clone ID: uC-gsronu33B168g07b1
tttcccatctgcatcaatggttaagtattcccaggagcccatttacccagccaagtcggccaaggctaggggaaacaacttgcgtgttcacttcaagaacacccatgagactgcctccgccatcaggggcatgaagctcaagagggccaaggtgttcctcgagcacgtccttgcgcacactgaggctgttcccttccgtcgcttcaatggcggagttggtcgcactgctcaggccaaggcctacaacacttgcacccaagcccgctggcccaagaagtccgtggagttcctccagagactcatccagaacgctgaggccaacgctgagagcaagaacttggatgtcaacacgttgtacatttcccaccttcaagtcaacagagcccccaagcaaaagaggaggacataccgtgcccaccgtcgcattaacccttaca

SEQ ID NO: 8682 - DNA, 456 bp, Gossypium hirsutum
  Clone ID: uC-gsronu33B168h01b1
gaccttatttgaagaaaatggccaagagccaagactggtggtttaaggagttctcaagggccattactctcctctctgagaacaatcctctcactggtagcaagggtgagatcaggaagcaatgcaatcttgcaaacaagcttcactaaaatgcctcgccaaagagaaagccgagtgtggccgaataaaatgtttgtttactcagtttcttttccaagagacgagtttgttaatgtgcaggtgagtaatggtgcaatggtactggtttgtaacgatcgatccattgcatttttcttttagcataagccaggttgccttctcttgatgttggtcatgggcttggtggatgtagggatggatgtaatatatggtatgtaaggatggtggtgactgtgtatgatgccatgaatttaaatgatttaaaagtatgatgattcatgcttaatccctcctttt

SEQ ID NO: 8683 - DNA, 465 bp, Gossypium hirsutum
  Clone ID: uC-gsronu33B168h03b1
attttactgaatgtgttggtaaaacaaccgcttacgggtgtcatattagtgcgaaaacgccgataaaccaaagaaatgaaacagaaaaacgagaaagctcaaaacagattcttactacaaaatggcagcaaatgcaaagctttcttcagtttaattatgggtgtttgcaattgtggtgcctaaactaaatccacctcctccctcctccttttagtttaggaaaagaatctctacttcataatttctagggtttcgtttctttgccatctcatttcctcggctttttttggatttaggcggggattggaatcaatgagagatcaattgaattcggatctgtttgacccgagaactgagatggtcccagatttttcgcgaggggcgtctagctccgatggtgatttcggtttcgctttcaacgatagtaatttctccgatagacttcttcgattgagattatgggtg

SEQ ID NO: 8684 - DNA, 557 bp, Gossypium hirsutum
  Clone ID: uC-gsronu33B168h06b1
gaacattattcaaggccaaccaggatggaaacctctcaccgtattactgctactacgaggaagcctctgatcaagctagtctagtctagtttagtgtagctttaagcagttcaaatcttcaagtgaatcacactaaatttaaactttcaatttcgtcaagctggtgggtttcatggggtagtgggaatggtgcagtaacaagagaggtgcccgctttgacaagtgtaccaagtagttaggcctaccttagagcagccttgtgtaggacaattgtacaaatagtgtgtgaaaattttgaaaatgatccaaaaggagcgaagcatgagtaagagtggctttcattttgaatcattcctcttccccttgttttaatatgcttggcagccgtgatttcaaggacagctctgctggttgagtgaaaggataggttagctgtaagcaaatagaagatagcagtgtggtcaaaccgcagttgccgcccttcataagtgaattgggccctttggtattctccttcatggctgtggttgtcacaagaaaatgataggatgcctttt

SEQ ID NO: 8685 - DNA, 519 bp, Gossypium hirsutum
  unsure (1)..(519): unsure at all n locations
  Clone ID: uC-gsronu33B169a02b1
aagctctttcccgtaagcaaaccacaaaggaaagcttggagaagtgttaaagaccctaaaaatgtgctcaagagttgggatccaaccttggtggatccttgtacttggtttcatgttacctgtgatgctgataatcgtgttactcgtctagatcttggaaatgcaaaattgaagggcagattggtacctcacttgggaaagcttgaacgtcttcaatatttagagctgtatatgaacaacttggagggttccataccagaagaaattggagggttaaaaagcttagtgagtttggatctttacaataataaccttactggatctattcctgcttctctttccaagctctccaatcttaatttcctccgattgaatggtaatagactgacgggaagaattcctagacaacttaccaagctcccaaatttaaagatctttgatgtctcaaacaatgacttgngtggtacaatccccaccacgggttccttctttagtttttaaaggaagttttaaagatat

SEQ ID NO: 8686 - DNA, 561 bp, Gossypium hirsutum
  Clone ID: uC-gsronu33B169a10b1
tgtaatttgtctttgtacacagcactcggaggggttcgtttttcagcgtgtttaccggtgaccatcgatgtgggcacaaataatgagcagttgttgaaagatgagttctacattggacttagacaaaggagggcaaccggacaggaatatgctgacttgctacacgagttcatgagtgctgtcaagcagaactatggggaaaaagttcttatacagtttgaagattttgcaaatcataatgcttttacattgcttgcgaaatacggcacaacccaccttgtcttcaatgatgatatacaggggacggcatccgttgttcttgctggggttgtcgctgcattgaagttgattggtggtaccctagctgaccacaaattcttgttccttggtgccggggaagctgggactggtatagcagagcttatagctctcgagatgtcaaagcagacaaaaatttctgtggaagagacccgtaagaaatctggcttgtggactcaagggactgattgttaacttttgtagagaatcactttaacacttcaagaaaccatgggctcatga

SEQ ID NO: 8687 - DNA, 519 bp, Gossypium hirsutum
  Clone ID: uC-gsronu33B169b03b1
aaataattcaatgttatatgaacgaaagtggagcatctgaagaagaagctcgtgaccacataaggaaactaattgatgcagcatggaagaagatgaataaagatcaaatggctaaatctcctttctcttatacgtttattgaggttgctatgaaccttgcaagaatatctttattgatgtaccaaaatggtgatggtcatgctattgaagataaagaaaccaaggatagagtgttatcattattcggtaacccaatttctttacccaaataattaagaacattggaattattttccaaactgggcgaataaaatgttagtttttggtttagtgtgccaaatcattttatgatattttaatatggtgtacaataaacttatggtagagtaaggactaccctaatacatgttttcttttggttcggaagaacttgccctttggtctgagcaaaatgtgcgatcacagacatggatgagtgttaaggaagtcaggatgtttgccatcattggtggatcaatc

SEQ ID NO: 8688 - DNA, 544 bp, Gossypium hirsutum
  Clone ID: uC-gsronu33B169b07b1
tatgggcttttggtgggatgatctttatccttgtttactgcactgctggtatctctggaggacacatcaacccagcagtgacctttgggcttttcttggctaggaaggtgtccttagttcgagccatattttatatggctgctcaatgtttgggagccatatgtggatgtgggctagtgaaggcattccaaaagtcatattacaacaagtatggaggaggagccaacagcctcgctgatggatacagcactggaactggttttgcagctgaaatcattggtacctttgttcttgtctacactgttttctctgcaactgatcccaagaggaatgcaagagattctcatatccctgtcttggcaccacttcctattggatttgctgtgttcatggttcacttggcaactattccaatcaccggcaccggtatcaaccctgctcgtagttttggggccgctgttatctacaaccaggacaagccatgggatgatcattggatgttctgggttggaccattcattggtgcagccattgctgcaatcta

SEQ ID NO: 8689 - DNA, 384 bp, Gossypium hirsutum
  Clone ID: uC-gsronu33B169c04b1
ctttcttgtccgcccacgcgtccgaactgtgtctacttccaatactgttaatagcagtatggaaacccttccatttgtcttcagcttagctgctgcaatatttgcttatgcactttggttccatatcatagccaggaggttaaccggtccgagagtgtggcctctagtcggtagcctaccgtctcttttcgagaaccggaggcggatccatgattggatggctagtaaccttcgagcaactggtggcttagccacgtatcaaacatgtactattgctcttcctttcttggcttggaagcaagggctctatactgtcacttgtcaccctaaaaacattgagcatatcctcaagaataggttcgataacttacccaaagggcccaa

SEQ ID NO: 8690 - DNA, 535 bp, Gossypium hirsutum
  Clone ID: uC-gsronu33B169c09b1
agtacgcgtccgcccacgcgtccgcgcggctccatttctcgttccctcaatatcaaagtaaaaatgaaggtggtcgccgcttacttgctcgccgtactcggaggaaacgcttccccttccgccgatgacttgaaggttattctcggatcagttggtgctgaggctgatgatgataggatagagttgctattatccgaagttaaaggcaaagatattaccgagctaattgctagtggaagggagaagttggcttccgttccttctggtggtggtgctgttgcggttgccgctcctgcaggtggtggtggtggtgctgcacctgcagccgaggccaagaaagaggagaaggtcgaggagaaggaagaatccgacgatgatatgggtttcagcctcttcgaattagctagccaaagcaaatatcaaggttttctagggtccttcgtccgtaagtttccaatgttttggatcctgaaggtgaccatgtttaacttcttctcggattttgttgagaaagtttagttaatgacataacatt

SEQ ID NO: 8691 - DNA, 554 bp, Gossypium hirsutum
  Clone ID: uC-gsronu33B169c11b1
gtaaccggtttctttaggtccgatcccggcgttgcatagtttgatgatgagtgttgtttcggctatcatattcgccggaatcctcctttccaccgccgcagaaataaaagaaaccagatggttttggcggagaacaaaaaccccatttcaatggcttctttgtttcccactcggaacccgtccctctggccgtgtatttttctggtcatatatcttttacctttctcggttcctccatatgttccgtacaatcttctccatttttaaaaccaggaaactcaccttcttccaccttttcaacaactccattttaaccattatgtctttcatttggcttgaattctcacaatcgtttcaagtattggctattttattcaccaccctcgtttactccgccgtgtacggctaccggttctggacggcgatcgggctgagaagtgcttgtttcccttttgtccttaattgtcaaattgtgttattaagctgcaatttggtgtgtcatattggagttttaacgttacattttatgaaaggtgggtgtaatggaattggag

SEQ ID NO: 8692 - DNA, 526 bp, Gossypium hirsutum
  unsure (1)..(526): unsure at all n locations
  Clone ID: uC-gsronu33B169d02b1
aaaagaaanagaaaaaaaaaagaaaaaaaaaaaaaaaaaaaaaaaaaaaaaaagaaagaaaaaacgaaagaaaaaaaaaaaaagaaaagaggaaaaagaaaaagaagaaaagaaaaaaagaaagacaaaaaaaaagaaaaagaggagaaaaaagaaaaaaaaaaagagaaaaagaaaaaaaaaagaagaaaaagaaggagggaaaaaggaaagaagacaaagaaaaaagaaaaacacaaaaaaagaagaaaacgaaaacaaacaaagaagacagaagaaaaacaacaggaataagaaaaaagaagaaccaaagaaaaaaagagaagagggaaagaaaaagaaaaaagaagaggaaaaagaaaagggaaagagaaaaaaaaaacaaaaaaaaagagcaaagaaagggaaaaaaaaaaggaaaaaaaaaaaaagaggaaaaaaacgcaaaaagaaaaaaaagggaataggaagagaaaaaacagaagagaaagacgggaaaaaagagaaaaaagaaaggaagaaaagg

SEQ ID NO: 8693 - DNA, 551 bp, Gossypium hirsutum
  unsure (1)..(551): unsure at all n locations
  Clone ID: uC-gsronu33B169d10b1
aatatatattactactctttttctacaaattcacttccacattttctgaaacttaaaaaagaaagatgggattacaaagccagctgaacgacgtgtcctcagattcgatcccgcttcttctcgtagcaataatcgctaactgcgtcggttatctccgaagactcctctttgcttccctccatttgattggccttctcccttgcccagaccagcccactaccatcgacgatgttggagtccttggctccggtctcgccagtctcatcgtactcgccgagcagctcaacttaaacaaggctttctcctacaaatactgtggcggcggggtaggaaagggctctgattgtgttgtgtgcttgtgcagcctaagagatggggagcaggtgaggaaactcgattgctgccatgtatttcataaggattgctttgatggttggcttgatcaactaaaatttaactgcccggtttgtcgatcccttctcaaaatcgatcagcgcgtgggtttcacgctgagacgcgtcngtcaagattgcttgcctggttttttttgg

SEQ ID NO: 8694 - DNA, 360 bp, Gossypium hirsutum
  Clone ID: uC-gsronu33B169e04b1
ctttttcgtttgccgcagcctcccttgcaccatttcaaaccctttttcgaccggccacaacgacgacgacggcgccacgacggtgcgctaccaccggtgtactgaattagagttcctggactgtgcgagggcgacgttcgcgagatacggggctggtgagagttcgtgcacaaagacagttgctgcggcgccaaggctgggaaggaggctgctgctgctgcactgaggcgaaagggcttagatgggtatattgggctaggatagattcagggctaggcttatgggaccgggtattaatactggcgagccatgtgaacgtgcagcaggtcggaattgggctgtttatcttgacgacaagag

SEQ ID NO: 8695 - DNA, 336 bp, Gossypium hirsutum
  unsure (1)..(336): unsure at all n locations
  Clone ID: uC-gsronu33B169f01b1
cgnctaattagaaatagaaacagagggttaaaaacaagtgcgactagaatggcatttatttgttgtaagttctcaaaatttcttttacatattaatttttgggagttgcaatgtaaataaaaagaattgggggttattatactaatggttttagagaatccatttgtatatttcatttggtgctgtaagttttgttctttgcctttctatggatgcaagcattgttgtaatgttttaaaattttcattcttctgctctccagtcgggtgagccctcgatcatcattttgggcttnaaaaaaaaaaaataaaannnaataaaaaaaattaaaaatag

SEQ ID NO: 8696 - DNA, 517 bp, Gossypium hirsutum
  Clone ID: uC-gsronu33B169f03b1
gcactacggaggctttatcatgtagggcttcatgctataaagaagttggggagtataagaaggctgtagctgactgttcaaaggtgttagagcacgatgagagcaatgtgtctgtcctcgtacagcgtgcactcttgtatgaaagcatggagaaatacaagcttggggccgaagatctgagaaccgttctgaagattgatcctggtaatagaattgcaagaagtactgtccatcgcttggctaaaatggcggactagaaggtctttatgattcatttgtttgtattagctttcttcacgtaggttgatacctttttgccctcatactatgaacagaattaagggggaataataacctttttccctggatacatgtgtcttttcaatatgtctcgttgcggagggttttcgtggttcaatattatatcttggcttggttgtgatttggaattggcttgtctttgatatttctagatagcttttggagcatgctttcggaacaaatatatattggttcg

SEQ ID NO: 8697 - DNA, 532 bp, Gossypium hirsutum
  Clone ID: uC-gsronu33B169g01b1
gtttgctgatttttatccttccattaaaccgcttcagctttttagtggtatgaagaccaaagttgagaagatgcataaggagaatgataagatcatcgcgaacatcattaaggaacatagagagagaagggccagagaaaagagcggacaagcagaagctgaacaagaagatctcgttgatgtgctcttaaggattcaggaggagaatgagttccccttggctgacaagaacatcaaatcagtcattgtggacgtttttggtgcgggaagtgaaacatcatccacaaccgtggagtgggcactctccgaaatgataaaaaatccatgggtgatgaaggaggcccaagctgaagtaaggcgagttttcggaccaaaaggaaacgttgacaaaacaggccttaatgaactaaaatacttgaaagcagtcattagggaaaccttccgaatccgcccatccgggccattgttgctcccaagagaatgtcaccaagcttgcgaaataatggctaccattgtccgaaaaaaacagagt

SEQ ID NO: 8698 - DNA, 533 bp, Gossypium hirsutum
  Clone ID: uC-gsronu33B169g04b1
cccatcgtccgattaaaatggagaaaaaattgcagcttaagttctttcatttcaccctcttcttcctttttcttcttattgtttgcatttaatattgtgggtgcttttggtactaggaaaacactatccatggaaggctctaatgcaccaaacggtggttccaatggtgctactggttcagcccatggtcctaactgggactacagttggggatggggttcaagccctggtagtggatggggatatggttctggttcagggaggtctactaatgggttcgggaggggttacgggttcgggtttgggtctggtactggttcaggttctggttctggttatggttatggagtggggggatgctaatggcggccaattatgactttggaagaaagctttactcaacttattgtggtctgcaggtcacccacacttttgcgaccactatacatacttatggaacacatatggtggagcttaaccatattaatttggttaatgctaattgatagttatggattaggagatgactcatt

SEQ ID NO: 8699 - DNA, 486 bp, Gossypium hirsutum
  Clone ID: uC-gsronu33B169g08b1
tggtcgcgtccgcccacgcgtacggatacgggtacggaaccctttaattccttctttcttttccttcctttcgattgagtttcagagaaaaccatggagtttagacctttagaaatcaaagttatctccgccaaggatcttaaagacgtcaatcttttcactaagatggacgtttacgtcgtcgtttcgatcaacggtgattctcgcacagcgcaaaggactccggtcgacaaggacggtggttcaaacccagagtggaattacaccgtgaggttcaccgtcgatgaagctgccgcccgtcagaatgggcttaccgtcgtgtttacccttaaatcacaacgtcagcttggagataaggatatcggtacggttcaagttcccgtcaaggaattgcttgataacggtgatggaaaccggaaaggtcaaaataatctaagttacgctgttaggttggctaatggtaaagctaaaggtgtgttgcattta

SEQ ID NO: 8700 - DNA, 470 bp, Gossypium hirsutum
  unsure (1)..(470): unsure at all n locations
  Clone ID: uC-gsronu33B169g09b1
aatactgtgctgttttagcctcaagtatatgttgttgtgcaagataatggtgagccaggccgatgatgttgctagtataatatcatccaaggcagggctacagtatgtggggcctgaacttgatgctatgaaagctgttgctgacgcccatgccaaacgttccctgaagcttttcgagattgctcttcatgatttcaaggctcaactagaggaagacccaattgttcacaggcacctttcttcgctatatgacactctattggagcagaacctgtgccgattgattgagcctttctcaagggttgagattgcacatattgctgaactgattgagttgcctgtagaccatttggagaagaaactttctcagatgattcttgataagaagttntcagggacgctggatcagggtgctggatgcctcgtcatctttgacgatcccaagaccgatgccattttccctgcaacat

SEQ ID NO: 8701 - DNA, 529 bp, Gossypium hirsutum
  Clone ID: uC-gsronu33B169g12b1
tctatgcgtccggttccgaccggccgatcattacaaggtactcaaatctaacgttgatgctttgaatttgatccaagtgggtctaaccctcaccgattcttcgggtaatctgcccggatccgaaaacggaacccggttcatctgggaattcaatttccgtgatttcgacgtggagcgagatcctcacgcgccggattccatcgagcttttgaggaggcaagggattgattttgacaagaataaggaaatggggatcgactcgcttcggttcgctgagctgatgatgtcgtctggactcgtgtgtaatgactcagtgagttgggtgacatttcatagcgcctatgattttggatatttggttaagatcctgacccgacgagatttgcccgagaaattagacgagtttttgacgattcttaaagtgttcttcggtgaccgagtttatgatttggaacacatgatgaagttttgtaacagcttgtatggtgggttggaccgagttgctcggactttagatgtgaacccgggc

SEQ ID NO: 8702 - DNA, 407 bp, Gossypium hirsutum
  Clone ID: uC-gsronu33B169h07b1
ttctattcgtccgctttgtttcatcggcacactgaaacctttagaatctccaaagctacgtcgtttctgaagtcatgggacaaatcctagaaaaaatccatgggaaggaatggagaaagagacagattaggaaaatcagtgataaggtttttgagcgtgtcaaaaatcaatcaggaagagctactttgacatttgaagatctatatatcgctgtcttgctggtgtataatgatattaataagcgtttgcctgggccgcactttgatccaccctctaaggaccaaatcagatcaatgatgcaggagtgtgacttgaaccttgacggacaaatcaaccatgatgaatttgtgaaattcattcagaagcttacaaccgacacattggttgtcgttagtcagggactgctt

SEQ ID NO: 8703 - DNA, 527 bp, Gossypium hirsutum
  unsure (1)..(527): unsure at all n locations
  Clone ID: uC-gsronu33B169h08b1
tttattatgccgtcattgtccaaactcagtgatgatcagcttaaatcgctcatccttttccatgccttgcccaaatactatgcccttgccgacttcaatgacctcagtacaaaaggccctatcactacacttgctggtgggcaatacactttgaatttcaccgatgattccggcactgtgcacctcgattcaggatggagcaaaacaaaagtagccagcgctgtacattcgaccgatcccgtcgcaatatatcaggtgaataaggtccttcttcctgaggctatctttggtactgatatacctccaacgcctgcaccatccccagctcctgatattagcccagctgctgattctccatcggcagactcgaaagaaggcggttctccgtcgaaagctttgccatcggattcagctgctcataaggttatgaagttgagcatttggagtcatctggttttgcagtctttagtgggntttgtctgctattttataatagacttcttttgagtctaattatgttcgtgggg

SEQ ID NO: 8704 - DNA, 469 bp, Gossypium hirsutum
  unsure (1)..(469): unsure at all n locations
  Clone ID: uC-gsronu33B169h10b1
cctctcgtccgggacattcgctttaacaggaatgctagatcgttggatgtataggcttattgaagaagtgactaaagcaagcggtgggcgtgcatatcggtagaagagtttgggttcagttcggagtgcaagaacaacagcaactcacatctaatgtgtctcgatgtctcaaaaaaatcaattacaatgcagagtggggataggcagaagaatatacatatatatatatataccccgctggtactctatggttgttgctgtggctttccttaattattcaatgcagtgttgggtcggatattatgggaattaagatttcttttaagttgtatcatttttgtaatcctaaaatcaaaaggaacaagaaagaaagaaaaaaggggtttgggactagctattaacatgcacacctcttatgtttgatttttatgaccaaaatttgtcaattgtctcanaaaaaaaaaactta

SEQ ID NO: 8705 - DNA, 499 bp, Gossypium hirsutum
  unsure (1)..(499): unsure at all n locations
  Clone ID: uC-gsronu33B169h12b1
ctacgcgtccgacgaggaaggccttccaatatacccttacgaacgtctcaaaataacatcaaccgatcccgtttctgagatagatgtgaccagacgagagacatacctgtcatccgaggagttcaaggagaaattcgggatgaaaaaagacgcattctataaattgccgaagtggaaacaaaacaagctaaaaatggctcttcaactgttctaagtcccccctttgattcatctgtgctatttattcaaaacccgctttcaaatgagagtgcagtgggaagaacccgaacccgttttctcaggatcgaaaaaaaaagggacagcatcagtgcatatttagctgcttctgctcccctaagaagcttttggtttttctcttttttgggtcattaatagacatatctggatttcaacccccccccctttttttctcatctggttgtttggatgtctagaanaatttgtcctttttcttcttggcttttctttgttgtttctg

SEQ ID NO: 8706 - DNA, 395 bp, Gossypium hirsutum
  unsure (1)..(395): unsure at all n locations
  Clone ID: uC-gsronu33B170a06b1
tactcggcccccaaattatttgcccaccatacgggctagagcaaaaaagtgtggcctttttagaaaacgggccgggcctcgggcactactttttcggnccgggcccgggccggaccgatatactacatggatttattcttttaattttaaaatatttttttacatacttgtataatttgtgctaaacatttaaaaatttttaaaataatatacttaatgctctttaattttaaaataatcctaaaatactttttttaattattttaatcttaaaatatttttaaaatacttttttaattttttaaaatttttaaaataaaaatgggccgggctcgggtttatgatttttttctcgggccgggcctgggcaaaatcttaggcccatattttggggc

SEQ ID NO: 8707 - DNA, 236 bp, Gossypium hirsutum
  Clone ID: uC-gsronu33B170a09b1
aactcgagcgccgccctttttttttttttttgtagggataaagtgacatttaatatctgatcttagtattttttcaatttggtctctaaaaaaaaaaaaaaaaaaaaaaaaaaaaaaaaaaaaaaaaaaaaaaaaaaaaaaaaaaaaaaaaaagcgcccaaaaaaaaaaaaccaaacttttctaaggggtaaaaaaaatcaataaattctccccactgtcaccaaaatttaaattg

SEQ ID NO: 8708 - DNA, 547 bp, Gossypium hirsutum
  Clone ID: uC-gsronu33B170b03b1
ttatttttttgtttttccactttccgacactttcttggcagccaaacacactaaaccctcaagtatatcgtaaaatggcgaagaagaacacggagaggaaagtaaacgtgtcgggtaaacctaagcactcgctagacgtgaaccggagcgatggcaagaacaattcaagaaccgccgccacggtgcgccgccttaagatgtacaacacacggcccaagcgtaacgctaaagggaaaatcttgagtcatgagtttcagtctaaagacctaccgaatacacgtatccaacctgatcgccgatggttcgggaatactcgagttgtgaatcaaaaggagctagaattttttcgagaagagctccaaagccggatgtcaagcaattacaatgtcattttgaaggagaagaaattgcccttatctctcttaaaggaccatgctaagcaagctagagctcatcttctggacacagagcctttcgagaatgcatttggacctaagacaaagaggaagcgcccaaagctcctagctgtagattatgagtctttact

SEQ ID NO: 8709 - DNA, 54 bp, Gossypium hirsutum
  Clone ID: uC-gsronu33B170b04b1
aaaaatatttaaaaaaaaaaaaaaaaaaaaaaaaaaaaaaaaaaaaaaaaaaaa

SEQ ID NO: 8710 - DNA, 403 bp, Gossypium hirsutum
  unsure (1)..(403): unsure at all n locations
  Clone ID: uC-gsronu33B170b06b1
atcangtgctacaagttctaggcttggcttaatgacaaaattgcaattttggttcaggtttgagtatcatttgcgggttcttgtttagggtaattttgatcatagactggaaatctgttggttatgtttttgtaatgtttgattatttttattattaaaaatattaattatcatttgaagttaagctgggcatatttgtatttatggccctttgctaaagaagcaaaattatgcttttcactttgtgtatctgatttcacaaattttatgcaaagagctaatcgagtatgctaaatagggactcgttcggaattaaacgtcaacattgtacttcttttttatcaaaaaataaaagaaaattacctcccaaaatagaaagaacggaaacatcagcgggcggccg

SEQ ID NO: 8711 - DNA, 525 bp, Gossypium hirsutum
  Clone ID: uC-gsronu33B170b08b1
atttttgctacttcaataactatagcctgacacagccacgtcacttttgcaagacttgtcggcggtattggactagaggaggagctcttaggaatgtcccagtaggcggaggatgccgaagaaacaagaagaagaaaagcagtagtagctcaaaaccctcgggttctgctgagaggcaaagtggttcaaattcaatcaatactgttattccttctgaaatcactgctcacctgccacatcaaacacctcatttaccttttatggcttctttgcaaaatttttctcagtatggtataggaaatattggcttaaactttggtggaattcatggtcagataggagcaacaagtggcggtagtgagcgatctgatatggggtttcagataggaacaaactcagacatgagcaatgccattttatcagtaaggtcaggctctcatcagcagttcccattcattgagccaactaatggtttatatccattacaaagtgagtatataggggcatcaccttcaatggtggaag

SEQ ID NO: 8712 - DNA, 265 bp, Gossypium hirsutum
  Clone ID: uC-gsronu33B170b09b1
taagtcctggttgtgtctgtgatgtctgcaatgggggaggagcagatctgtgctctgaaggacattggtcctaagtaatttgagattttattttcagacttttattgcaattttagattataacttttttttttttttaagaactttaatagctttgtgtcttggaatttgggtttttttttattttttttattttaatatatctggatacgagaaaaacaccattgctgttaaaaaaaaaaaaaaaaaacactaacaaaaaata

SEQ ID NO: 8713 - DNA, 568 bp, Gossypium hirsutum
  unsure (1)..(568): unsure at all n locations
  Clone ID: uC-gsronu33B170c03b1
cccattcgtccgctttcatctcttcttctcttgttttcaagctttagaaatggagacgaaacacccaaaacttgaaaaaccagaccaaatagtttggtccttagaagaagaagatgtctcagttcattcaaagtcttacacatgttctttctgcaaaaaagggttctcgaatgctcaagctcttggtggtcatatgaacatccataggaaagatagggctaaacttagggaatctttcgaagaaaacgtactttcttcagatataacactcgatcgagttcaagttcaagttcaagatcgttatctaatttcggaaatcatattagaatctagtggagagaaaaaagtttctagggatgacaatggttctggtgccagccctaaaggaaaagatggggtcggagagaattcgggatcgagtcatggttcgtcgtctcaggtagaattggatcttgagctacggttaggacccgactctcgagcctcatgagggtctttatctatgaaatggatagtatcttatcgcgggcgtactccaacaatccttgcatcaatngaaaagctgatc

SEQ ID NO: 8714 - DNA, 378 bp, Gossypium hirsutum
  Clone ID: uC-gsronu33B170c04b1
tcttgtttttcgcccccatttattttatttttcaaacaaattttcccttcaattttcgtataatttcctaggaaaagaaatatgagagagtgcatttcagtttacatcggccaggccggtattcaggtcggaaatgcttgctgggaactttactgtctcgagcatggcattcagcctgatggccaaatgccaagtgataagactgttggtggaggagacgatgctttcaacacctttttcagcgaaactggtgccgggaagcacgtacctcgcgccatctttgttgatctggagcctactgttatcgatgaaatgaggactggtacgtaccgacagttatttcaccctgagcaactgatcagtggcaaagaagatgct

SEQ ID NO: 8715 - DNA, 571 bp, Gossypium hirsutum
  Clone ID: uC-gsronu33B170c06b1
ggctaggtgataggtgctgttcatggggttgttgaatgcttgtttataaggtatgtggaggatggaatgagtgaagaattggcttacaaaaacactgatcagtgcataacaggaattgtgtcaaagaccatttcaacaaagggtatgctagctgtatacaactcattgaacgaggaaggaaaaaaacgatttgaggccgcttacagtgcctcatattatccttgcatggaaatcctatatgagtgttacgaagatgttgcaagtggaagcgagattcgcagtgttgttttggctgggcgtcggttttatgaaaaggagggtctacctgccttccctatgggtaaaattgatcagacacggatgtggaaagttggtgagcgtgtccgagcaactagagcgaaagatgatttaggtccactgtgccctttcacttctggggttttttgggcgctaatgatggcacaaatcgaggtcttgagaaaagagggccacttgtactcagaaatcataatgagagtttgattgagctgttgattccttgacccttcatgcatgctcaggagttttttta

SEQ ID NO: 8716 - DNA, 80 bp, Gossypium hirsutum
  Clone ID: uC-gsronu33B170c09b1
taataaataacacaaaaaaaaaaaaaaaaaaaaagaggggggatttattaaaaaaaagggggggatatggacgacaggtc

SEQ ID NO: 8717 - DNA, 548 bp, Gossypium hirsutum
  unsure (1)..(548): unsure at all n locations
  Clone ID: uC-gsronu33B170d05b1
gctattagatccctattagccatcttcctcctcctttccttcctctccatatcaaccgcaacatcaactcgaaaaacccgaacccgaaatccatgcaagagcatggtgttttatttccacgacataatctacaacggccataacgcaaagaacgcaacatcagccattgtaggttcaccacaatgggggaacaagaccattttaacaggaaaaaaccatttcggagacctggtcgtgttcgacgaccccattaccttagacaacaacttgcattcgaaaccagtgggtcgagcccaagggttttatatctacgacaagaaagacatattcacagcttggttgggtttctccttcgttttcaattctacccaaaataaaggaagtataaacttcgccggtgctgatccgttgatgaaccagacgagggatatatcagtgattggtggaacaggtgatttcttaatggctcgaggagtggctactntgatgactgatgcctttgaaggggaagtatattttcgtcttcgaactgatattaatttgtatga

SEQ ID NO: 8718 - DNA, 462 bp, Gossypium hirsutum
  unsure (1)..(462): unsure at all n locations
  Clone ID: uC-gsronu33B170d06b1
cactcgtgnaacccgcctcttcctcctcctctttactttaaggtcattttgctttcacaaatctagagaccagagctccaaaagattgaatttttaacccctcaaattaaaatccttcctttttcgcgttttcggttgaaaatttgtataaaaaagagggtgatttagaaacaatggatgctgattcatggagtgctcgtctttcttcagcttctaagagatatcaatcggctcttcaattacgatctgatatgcttatggggtttgaagaaattgatggagaagatgaaataagagaggagtttcgatgccctttttgttcagagtatttcgacatcgttggcttgtgttgtcacattgatgatgagcatccagtggaggctaaaaatggggtttgttcagtctgtgcaatgagggtgggtgttgatatggttgcgcatataaccctacaacatgggaata

SEQ ID NO: 8719 - DNA, 483 bp, Gossypium hirsutum
  Clone ID: uC-gsronu33B170d11b1
gaccggccgtattcccggtttcctacctccttttgtctgggcttttcttttagctcgggaagtggcgattttcagtagaaaaaagcttgggagttgaaatctgatgtgggcgactttaagatcccgatatctgcatctatctgcaactacgttgccttcctcctctctcacaaatggctcgtggaagctggggttttcaggtttaaatcagacgttctcttcatccactgtggagagaataagcaatgagttgctgagcctgcaagaggtggagaaggttctaagcgacgtgagagcagacgacgtggcggtggttccggttggtaaccaatgcgattgggcagatttcatggtgattgccaccggtaggtccccgtggcacgtcaagaacatcgcccaagccctaatttacaaggttaagcagaagcaaaaaggagctaagaggatggtattacccagcgtgcaagggcaagagacgggaaa

SEQ ID NO: 8720 - DNA, 575 bp, Gossypium hirsutum
  unsure (1)..(575): unsure at all n locations
  Clone ID: uC-gsronu33B170e04b1
ctcatttcttcccaaacccttgaccgataacttatctttttacgacaaaggggttatcacttccaaaactgcctaagaaaaacaaactatctctgccgattgaagaaatcaagaaagatggcttgattcagctattttcagctgaaaatctggtgggagatgcttcatagcccttccctgtgcaagatcgtattcaatccaccaaaattttttaaaaagccagaataataggattcctatcatctttcttttatctttgtccatcgaaactcagttggtttgtttgtatatgtttgctgtttgttgattaggtttgaactttgaagggaagaaaagaaatggacccagtcacagctcatggccgccctgttcctcctcctttcctcacaagagagcttcatctaaatccgcaccatcaattcttgaatcaccgccaacaatataactcagaagacgagcccaaccgtggcaagaaacgagatcgacangaagcagcagcaaccaccacaaacgacacgagtgaaagcaaagaagtagccatatatgaaggtgaaatcacaagaaaaccacgaggc

SEQ ID NO: 8721 - DNA, 469 bp, Gossypium hirsutum
  Clone ID: uC-gsronu33B170e08b1
ttcattcgtccggaaccttctcaaaggttcatggctgggagactgatgatgttgcagagatagccctgaagatttcacagtggccgaaagcttctggaacatacaagaggactactgttattactcagggtgcagatccagtaattgttgccgaggatgggaaagtgaagcagttccctgttattttgttacccaaggaaaagcttgttgatacaaatggtgcaggtgatgcctttgttggaggctttctttcacaattggttcaagggaagtccattgaggattgcgtaagagctggttgctatgcatccaacgttatcatccaaaggtctggctgcacatacccagaaaagcctgaatttaaataaagctagtccactttcctgatctcctctccgctggtgttttcaagtttctgattgtaagaaccctcttgctagcatttgatctttggaatttgtttttattt

SEQ ID NO: 8722 - DNA, 509 bp, Gossypium hirsutum
  Clone ID: uC-gsronu33B170f07b1
ttactcgtccgcttaattacaatggtaacaaaatcagttcaacaactactgttaatgaaaaaggacatcttgggtttgttaaggtgaatatggatggaaccccaataggaaggaaagttgatttgaatgctcattcttgctatcagagtttggctcaagcacttgaggatatgttcctcagatctactaactcagttggtgcagagaaggaacaattaaccaaggcttctaagcttttggatggatcatctgaatttgttttgacttatgaagacaaagagggagactggatgcttgttggagatgtcccatggaggatgtttgtgagctcggtccgaaggctccgaatcatgaggacctctgaggctaatggacttgccccaagattccatgatagcaatgaaaggcaaagaagcaagcccatttaggcacatcaacgccatgagtcatttaaattccttaaagaagactagtacaaaaaaagaatccacaggttgaacacagaagct

SEQ ID NO: 8723 - DNA, 491 bp, Gossypium hirsutum
  unsure (1)..(491): unsure at all n locations
  Clone ID: uC-gsronu33B170f08b1
tttctacaccgtaccctcgccggaaacaagggggaaaagggtttttctttgaaattttgctgcttccacaccatgttggaatacgaatggggaaacccctcttcaatcatgttatcgggtgaagagaccgcccaagaacccgaccccaatcgtcagcttttccatcactatgccaccaccaccaccaccaccaccacccaccaccaaccttacaacgaaaccctcctttctcatcacaaccccactgttttttctcaccaaaacctcttccataaccctaaccaagctcaacccccacaacaccctgctactcttcattccttgtacgacccgcactcctactctgccacctncgcttactccactacccacgcttccttgctctcactggacccagtttttgccgtccgagggagcggaggcggttactttctcgttcccaagaccgaggaagtttctagacctgttgactttactgccaagattggtct

SEQ ID NO: 8724 - DNA, 516 bp, Gossypium hirsutum
  Clone ID: uC-gsronu33B170f12b1
attgttacccctgatgatatattgctcaagcagaagctggatatacttgctgctagtcatccgaatcttaaggtactctacactgtagacaatccaactaaaacttggaaaggaggtgctggattcatttcaaaggatatggtcacaaaatgcttacctggtcctgctgaagatactcttatccttgtatgcggtccacctggtatgatggaacacatatcaggtggtaaggctaaagactattcacaaggagagctaaccggcatactcaaagaactcggatacactgagcaaatggtttacaaattttgagtatagaggaattcaaggatttgaagagacactctcatagggtttcaacataaattttgtgtaataaagcttcctgaaagaacaatgaattgggcaagatttaaatcccagggtatcgaataatatttgtagtgaaacatacaatgtaaattactacattttcacaggcttgtactagagaaatcgtgacacagagcttttttt

SEQ ID NO: 8725 - DNA, 541 bp, Gossypium hirsutum
  Clone ID: uC-gsronu33B170g06b1
cgggatttttggatttggaagaatcggacgtttggttggcagagttgttcttcagaggaacgatgttgaactcgtcgccgttaacgatcccttcatttccaccgattatatgacatacatgttcaaatacgacagcgttcacggtcaatggaagcaccatgatcttaaggtcaaagactctaaaaccctcctcttcggcgaaaaacccgtcactgttttcggaatcaggaaccctgaggagattccatgggctgaagccggggctgagttcgttgttgagtcaactggagtgttcactgacaaagacaaggctgctgctcacttgaagggtggtgctaagaaagttgtgatatctgcccctagcaaagatgcacccatgtttgtaatgggtgtaaacgagaaagactacaagccagagcttgacattgtttccaatgctagctgcactaccaattgtcttgttccccttgctaaggttatccatgaccgatttggaatccgtgagggtctcatgactaccgttcatgccattactgcaaca

SEQ ID NO: 8726 - DNA, 521 bp, Gossypium hirsutum
  Clone ID: uC-gsronu33B170g07b1
attttgccaaagttcttttcttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgttctgtctgctagggaaggcatcgtttcgttgggaggcccttatattcctctcaaaactggaagaagagacggtagaaggagcagagcagatgttgtggaggagtatctttccgaccacaatgagaccatctctggcgtt

SEQ ID NO: 8727 - DNA, 403 bp, Gossypium hirsutum
  Clone ID: uC-gsronu33B170h04b1
acatggatgatgccggcacaacgacagcataggcaccgggtgggtttttatgaacatgacggggactatgactcagcaccaaaagtgcaatgtgcccagcaggaagaaatgtttgcgttcaatgttctgcccctcttattttatagcatcagccaccttagatcactacatatccggaacttgtatgcggttttgtctgcaaccagcacattaaaacggtgttttggctctttattttttatttttgcgttcatctgagcatgatgtgatattttacctcgacatttcaaggatctatctactatggacagatgctatatttgattattatatataagtatcttggaatgcctacttcaaaaaaacaagctcgcactacattctgagaaagatgtctctttct

SEQ ID NO: 8728 - DNA, 480 bp, Gossypium hirsutum
  Clone ID: uC-gsronu33B170h06b1
cccgttcgtaaataacctcgtcaaaatacaccgcacaagagtgggattttgaatggagagggctaggatacaccctcggaaactaaagacatcatgttgctcctactcacagttccaggcctcgacggactccggaagggcttgatcgacgacacacggaacctcctcaagcacttgatgttggtggatgctttgtgcctctttcttcacatggatatatactggaaatacgagatgcgttcaaactgggacgccgaaacctgtacccataacgaatatctgcgtaaccagaaatacatcatgaagagccagcgcaacgcgcttatcatcgctgccgctcttattttggactggctactttactctgatactaaccttgatgctaaaatcgagcagtggaatcagtgagcagagaggcttaagaatcgcaattgagataagtgctgcgaatattagaactgttgtattagggctacttct

SEQ ID NO: 8729 - DNA, 172 bp, Gossypium hirsutum
  Clone ID: uC-gsronu33B170h08b1
tccatgcgtccgactgaaatgaacttttataggggtggtgccttttttgggatactctatcagtagcacctgtgattgttgtgttttggaaaacaggtcccttttgaacttattaaagatatcaagacttttgtttatgaaaaaaaaaaaaaaaaaaaaaaaaaaataacaa

SEQ ID NO: 8730 - DNA, 550 bp, Gossypium hirsutum
  Clone ID: uC-gsronu33B170h11b1
cttatcgtccgcctccctcaaggtctcgacccttaatggaacctcagcttccaagggcatcaccaacatccaccttaacgtcaccgccaaaaacccgaacaaaaagctcgtctacatttacgacccaatcaccatatctcttatcacaaacgacgagatcgatataggggagggttccttgggctccttcgtgcatggcaataaaaacacgactcttttgaaagctgccataacaagtagcaacaggcaagaacttgatgaggcttcagctggcaagttaaggagcggtttgaagagcaagaagggtctgccattaaagataaagctggacactaaagtgaaagcaaagatgggagcactgaagacccccaaggttgggattagggttgtttgtgaagggattaaagctactgctcccaaggggaaatcagcaacaatagcttcaacttctaatgcaaagtgtaaggttgatttgaggctcaagatctggaaatggactttatgattatgagagctcacgattagaaagaatgaagaagaaaaggtttgc

SEQ ID NO: 8731 - DNA, 273 bp, Gossypium hirsutum
  unsure (1)..(273): unsure at all n locations
  Clone ID: uC-gsronu33B171a02b1
acccgcccaatcgaacgcgctgcttcccttggctaacaaggtgtattgatttaaagagcaagacagggaagggcaaatgccaaaaaaagaagaagaaangagacagagacggaacaaaaaaaaaaaacaaaaaaaacaaaaaaagaacacaaccaacacaccaacaacaacacaacaaaacaacaaaaccaaaacacaaacacaaacaaacaaaaaaaaaaaaaacaccaaaaaaaagcagaaaaaaaaaaagaaaacagaagaacacacaac

SEQ ID NO: 8732 - DNA, 468 bp, Gossypium hirsutum
  Clone ID: uC-gsronu33B171a05b1
gaacatatagccttctcatggccccatccattttcgttctcctgctaagatcctctggcgtaccatgcgtggcatgcttccccacaagaccaagcgtggggcagctgctcttgctcgattgaaggcttatgaggggattccagctccatatgataagacaaagaggatggttattcctgatgctctcaaggttttgaggcttcagaaaggacacaagtactgcttgttgggcaagctttcctctgaggttggatggaaccattatgacaccatcaaggagctcgagaggaagaggaaggaaagagctcaagtggcatatgagagaagaaagcaactcactaaacttagggttaaagccgagaaggttgctgaggagaagcttggtgcccagttggaagttattgctcctatcaaatattgattcaaagatgattgaaacatactggttacgtttcagtgcacttccat

SEQ ID NO: 8733 - DNA, 77 bp, Gossypium hirsutum
  Clone ID: uC-gsronu33B171a08b1
ctagtactagccccggagcggccggagtagacgagttgtgcttttcgacgctggcacgcgatagcacccctataccc

SEQ ID NO: 8734 - DNA, 233 bp, Gossypium hirsutum
  unsure (1)..(233): unsure at all n locations
  Clone ID: uC-gsronu33B171a10b1
cgacttcatgccggacgcgtgggaaaaaaaaaattttttttntttttaaaaaaaaaaccgcacaaacccccaaaacacccccaaaaaaagaacaagaaaaaaaaacacccggaaaaccacaannccaggcgccgcccgctttaaccgcccccctcttttctgccccccccctcccccatctcctcttgcttctaaggccccccaaactccaattcggacccccgtttttcccc

SEQ ID NO: 8735 - DNA, 504 bp, Gossypium hirsutum
  unsure (1)..(504): unsure at all n locations
  Clone ID: uC-gsronu33B171b05b1
cccactcgtacgcgacactatacttaagccgctgttgttctttgattaggtgatggcaacgatgcatgcattttcgacgttgatgatacactcatctccaccattccttacttcaagaaacatggttttgggggagagaaggtgaactcatcttctttggaggcatggatggaagagagcaaggcaccagctctcgaccacacattcaagctcttccatgacattaaagatagagggatgaaaatctttctagtctcttcaaggaaagaaacccttagatctcctaccgttgataacctcattaatgttggataccatggatggtctaggctcttcttaggggtttcgaagatgaatacatgcatgtggaacaatacaagtcccaagtgaggaaaacattaatggatcaagggtaccgcatatggngaatcgttggagatcaatggagcagcttaaaggggtttgccagaagcaaagagaacatttaaggctgccaaattccat

SEQ ID NO: 8736 - DNA, 517 bp, Gossypium hirsutum
  Clone ID: uC-gsronu33B171b06b1
ctggcttcttgctcttcctctgtttaatccccttcgttttgttgtggcccttgcatgtctatcaccaaaagcaccctcgtgaacttggttatcctcagcctcttcaccgtgtcattgagtctcacagttggtgtgagctgtgcaaataccgatggaagaatcgtgcttgaagcgctaattttgacagctgctgtggttgcatctcttactggctacactttctgggcatcgaagaagggcaaggacttcagctatctcggaccgattttgttcaccggccttattatcctcatcttaactggtctaatccagatgttcttcccgctcggcccaacatctactgctgtatatggtggaattagtgcgttgattttctgtgggtacatagtatatgacaccgacaacctgatcaaacgcttcacatatgatgattacattttggccttcgtcactctttatttggacatcctgaatttgttcatttccatttacgggttctgagatcccggggatacta

SEQ ID NO: 8737 - DNA, 528 bp, Gossypium hirsutum
  Clone ID: uC-gsronu33B171b08b1
gctttttgatacgactacatgccgaatttgagcttgcattcacatcttcatggacaccattcatcggaatgtcttcttgattggacccgaaggatgaacattgctattggctctgctgagggaattgcctatcttcatcaccattcgaccccacacataatccatagagacatcaaagctagcaacgtgttactggattcagaattccagcctcaagttgctgatttcgggtttgctaagtttgtcccggacggtgcaactcatgtcactactcgagtcaagggcactctcggctatcttgctcctgaatatgctatgttaggaaaagcctcggagagttgcgatgtgtacagctttggcattctattgctagagcttgcaagtggcaagaaacccctcgagaaagtgaatagaacagtgaagcgatcgatttctgaatgggcactgccattagcttgtgaagggaagttcgatgaaatggcagacccaaaactgaacggggagtatgtggaagagagttaaaaagat

SEQ ID NO: 8738 - DNA, 289 bp, Gossypium hirsutum
  Clone ID: uC-gsronu33B171b10b1
aaacccgccgatgcgaaacccccacaaaagcggacaaacacaagggggaaaataaaagaaggcaacccaacagggcaccaacaacacgaaagatgacagaggacaaaaaccacaaaagcaaagaaaaacggaaaagggggaacaagaaaaaaaacaccaacccaggaggcacggaaggaagaaagaagagaacaagaggtcgaccacacaggcaaaggccctagaagacataaaagaaagagggaagaaaaggcacagaggaacttaaaggaaagaaacccctaaaaga

SEQ ID NO: 8739 - DNA, 417 bp, Gossypium hirsutum
  Clone ID: uC-gsronu33B171b11b1
atcattttaatccaataaatatcaaattaaaatatttttaaaaagtgtgcaaagccgcaaaggaaaacaaaacaaggcgcgaaaccttaattccatcaaaataattcaaaggaaaatatctgcagaatcataatggagaattatctctttctgttctcgcttgttcttctctttggtcttttacccttttcctctcaaaccccaaaccctaaaaaccccaatcccaaacctccgctcacccaggcacacaccgagcttataaactatggttttccgatcggtcttcttccggcctcggtgacgaagtacactcttaaccaaacatccggtaacttcgccattgatctcggtggcacgtgcaagatcacgcttccgcctgacaactacctggctacttactcgaagcgggttaacggg

SEQ ID NO: 8740 - DNA, 217 bp, Gossypium hirsutum
  unsure (1)..(217): unsure at all n locations
  Clone ID: uC-gsronu33B171c02b1
cccaatcgtaccatcatcactcatctctgntagctttgtttttttttaactgcaagctcggttcatagctcacagccatagaagcatcaacaatgtggagaatatttatatattttaaatatattttttttttatattcattttcaattaatgtaatactatttataatttaaaaatacactatttatatatactatacctatccttatttatcact

SEQ ID NO: 8741 - DNA, 378 bp, Gossypium hirsutum
  Clone ID: uC-gsronu33B171c05b1
cccactcgtccgcccacgcgtccgcccacgcgtccgcgcgcctgccgtgtttgtggaaatccccatgccatcatcaggaagtacggcctcatgtgttgcaggcagtgcttccgtagcaatgccaaggaaatcggattcatcaagtaccgttgaagaattttgtatggtgtaaagtaggaaggactttgtccctctttgagccttttgtactatgttcttatttttattttttttgaatttgaaagaacaagatgctgttttgttttggtgaattactaaagtgattgttgaactaagaatactttggggtttcttaatgaagtaatcatactggtttaatttggtatttttctttaataatataaaatattctatttt

SEQ ID NO: 8742 - DNA, 96 bp, Gossypium hirsutum
  Clone ID: uC-gsronu33B171d03b1
tcgaggaccggacggaattacggtagagttaaaaccagaataaaaccaaaaaggaaaaaaaaaaatgtaaattaaaaaaaaaaacgggaagccccc

SEQ ID NO: 8743 - DNA, 412 bp, Gossypium hirsutum
  unsure (1)..(412): unsure at all n locations
  Clone ID: uC-gsronu33B171d06b1
ctacgtcaagcccgaaggagtgaaccatttcatgagcctgtacattgaaggagaaggcctaaaggaccccgattcccgcaggaanngnnnttctgttccctcactcttccctcccctcctcccccttttcccccttctcctcctcctttccccctccaccttactctccttctccactctccccttcctatcccctccctcccccttattcctccctcccctcccctttctccccttccctcctctacccccaccctcctccccctcccctcccgctccccctcccccctccccccctcctcccttccctcttcccctcccttctccttctttttcttctctctcccctcccccctcttcttccccctcttccctctccccccctcccccctttcccccccccctcaccctc

SEQ ID NO: 8744 - DNA, 399 bp, Gossypium hirsutum
  Clone ID: uC-gsronu33B171d10b1
gtcacgaagccgcgatcgaaaccccacgcgaccgggggaacaagggggggaaattaaaagagaaagccggagacacccccaaaacaaaaaaaaaaaataaacgaaacacaaaaagaaaacagaaaaatcaaaaaaaacaaaaacgaagtaaaaacaaaaaaacaaaaacacaaaagacaaagaaaaaaagcaaacaaacacaaaaaaaaaaaacaaacaaaaagagaacaaaaaaaaaacaaacaaaagaaaaagaagaaaaaaacgacaaacaaaaaaaaaacaaaaacaaaaaaaacaaaaaaaaaacaagaaacaagaaaaaaaagcaacgacaaaaaaaaaacaagacaagaaagaaaaaacaagaacacaaaaaacaacaaaaaaataaaacaa

SEQ ID NO: 8745 - DNA, 528 bp, Gossypium hirsutum
  Clone ID: uC-gsronu33B171d11b1
atggtttttacatcctcttaacgatatcctctgtttgcagttaataaaagcaaatcatggctgctaccacagtcccagccgccgcaaggcagctatctcctaaagaagccgatatccagatgatgttggctgccgaggtccatctcggtaccaagaactgtgatttccaaatggatcgttacgtcttcaagcgtcgcaatgacggaatttacatcatcaaccttggcaagacctgggagaagcttcagcttgcagctcgtgtaattgtcgctatagagaaccctcaagatatcattgtccaatctgcaagaccctatggtcagagggctgtcttgaaatttgctcagtacactggttgtcatgccattgctggaaggcacactcctggtacattcactaaccaactccagacatctttcagtgagcctcgccttcttatcctcacagatcctaggaccgaccaccagcctatcaaggaagcagctcttggaaatatttctaccattgctttttgtgacacagactcac

SEQ ID NO: 8746 - DNA, 347 bp, Gossypium hirsutum
  Clone ID: uC-gsronu33B171e02b1
gtcatactacacggctggacacagggaaggagtattacccatacaccaccaagaaaaggcctgttgagtcataaatcttgcatgtctctgttgagaaggcacttccagtgaaacgtgagataatcgatcctgttcgatgatctgtctttgttttttgaagatataatcatactcgcggactccattttgctttttgctattcacttttaaagtgaggatgttggtttgaataaaaatgcatccgaatttatggaattcttgacgacgaattgttgcatttgttaaatattggtgcctgttataatgagtatcgttgttaatgaaatgaaagagaagatctttgcctt

SEQ ID NO: 8747 - DNA, 501 bp, Gossypium hirsutum
  Clone ID: uC-gsronu33B171e05b1
cccatgcgtacggaagacatgaagcttgttatgcagcggtccgactgaccggacgtcatggatcctctcttgcccagcgacagcgagggcaactcaccagctgtgtatctcgaggcccgctctccgacatggcagcgcgaagccgacccgtctccgcggtctccagacgagtgggagcacgtggcggcgcactactgccccgtgccggagcgcgagcaaccagccgcctcaggcacgcgcgaacccgatgaaggcgacgagccgcaccccgctgcgtacgacagcgcgtcggaaggcagtcaggtcgagcaggaggcttgctgcgatgacgacgcggacggcgtgcctgacaagccgcttgcgcgcgccgcgcctgtgtctgccgtccccgcctcggtggcggcggattcctcggaacaaccggtgcgcctgaacgtggagggtcaggtgttttacaccagcgcctccaccctgctcaagtttccggggagctggctggcg

SEQ ID NO: 8748 - DNA, 324 bp, Gossypium hirsutum
  Clone ID: uC-gsronu33B171e07b1
ccatgcgccgcccacgcgtccgatagttttggccatcgctatttatcggaaactgaaaaatacgacttgtcatcggtgaggatgctgaagtccggtgccgctccgttgggtcaagagcttgaggatgctgtgaaagtcaagtttcctggtgccaaatttggacagggttatggaatgacagaagctggaccagttctagcaatgtgtttgggatttgccaaggaaccctttgaaatgaaatccggagcttgtgggactgttgtaaggaacgcggagatgaaaatcgtcgaccccgacaccggtttgtccttgccgcggaaccag

SEQ ID NO: 8749 - DNA, 553 bp, Gossypium hirsutum
  Clone ID: uC-gsronu33B171e12b1
cccatgcgtccgcccacgcgtccgcccacgcgtccgtccacgcgtccggtcgattttattggacgatcctgtgaatggtgagaaagaagctattccaaataataattcagctaggggttatgaagttattgatgccatgaaggctgccttagagagtgcttgccccaacactgtttcctgcgctgatattctcgctattgcatctgagcaatctgtcagcaccctggcaggcggtccttcatgggcagttccactaggaagaagggatgggttcacagcaaaccggacactcgccaactcaaacttgccaggtttcaacaatactctcgaccgattaaagaacaggtttagcaatgtggggcttaacaccagcattgatctagtagccttgtctggtgctcacacatttggcagagctcagtgtttaacttttaccagtcgattgtacaattttacgggagtgggtgatacagatccgaccttgaacaccacatacttggaagaactacgccaaatatgcccacagggtggaaatagtagtgtgttgacaaat

SEQ ID NO: 8750 - DNA, 572 bp, Gossypium hirsutum
  Clone ID: uC-gsronu33B171f03b1
aaaaaaaaaaaaaacaaaaaacacaatataagaaaaaaaaaaaaaaaaaaaaaaaaaaacaagaaaacaaacaccaaaaacaaaaaaaagaaaaaaaaaaaaacaacaaacaacacaaaaaaaaaaaaaccaaagaaaacaaagaccaaaaaaaaagacataaaacaaaaaaaaaaaaaaacaaaaaaagaaaaacaaaaaaacaccaccaaaagacaaacgaacaaaaaaggaacaaacacaaaccaaaaatcaaaacaaaaacaaacaaacagaaaaagaaaagacaaaaacaaaagaacaaaaaaacaaaaaaccacaacaacataaaatagaacaaccaaaaaacacaaaaaactaacaatacacaaaaccaaaaaacaaaacacacaacaaaagaacaagaaaacaaaacctccacaaagaacagaaaaaacaagcgagaaagcaacaaaaaatagacaaaaaaacaaacacaaaacaataaaaaaaacaacaagaaaagaaaacataaaacagaaaaacaactcacaagaagcgagaagaaaacagaaaaaaagaaaaccagccac

SEQ ID NO: 8751 - DNA, 479 bp, Gossypium hirsutum
  unsure (1)..(479): unsure at all n locations
  Clone ID: uC-gsronu33B171f08b1
gttacgaaaccgcacgtaaaaaaccccnngaggccaaagaagnaaaggtgtgnnatttaaaaggaaaaaccggggaagccccacaaaacacaaaaataataaaaataaaaaaaaaaaaaacacataaaaaaaaaaaacaaaacaaaaaaacaacaaaaaataaaaaacaacaaaaaaccaaaaaaaccaaaacaaaacgaaataaaaaacaaaacaacgaactcaaccacaaaaaaaaaaaaaaaacaatccaacaaaacacacacaaaacacaaaaaaacaaccaaacgaaacaaaaaaagcaaaaaacacaaaaaaagaaaaccaaaaaaaaacagacacacaaagcccacaaaaataaaacaagacaacaaaaaccaacaaaaaaaacacaaaaagcgcaaaaaaaaaaactacaaacaaaaaaccaaaaaaatcaaaaaaaaattagaataaacaaaaaaaaaccaaaacaaaaa

SEQ ID NO: 8752 - DNA, 580 bp, Gossypium hirsutum
  unsure (1)..(580): unsure at all n locations
  Clone ID: uC-gsronu33B171f11b1
gttacgaaaaccgagcgtaanaacacaanaaanancnaaaaaaaanantggaaaaaagtgagaaaagaagcaggggaaaacacaaaaagaaaagaaaccaaaaaaaaaacaaaaaaagacaaaagaaaataaaacgaaaaaaaaaaaaaaaaaaaaaaaaaaacaaaaaaaacaaagaaagaaaaagagaaaaaaaaaaaaaaaaaacaaaaaaaaaaaaaaaaaaaaaaaaaaaccaaaaaaaaaaaaaaacagaaaaaataacaaaagaaaacaaaaaaaaaaaaaaaaccaaaagagagggaaaaaaagaaaacggaaaaaacaaaaaacgagaaaaaaaaaaaaatgaagatgggacaaaaaagaaagaaaggaaaggaagaaaaaaacagccaaaaaaaaaaaaaatacaaaaaacaatgaaaacaaaaaaagaagcgaaaaaagagaaaacagcaagaaaggaaaaaaaaacggaaaaggaacaaccggaaaaacaaaaaaagaatcaaaaaacacgcataaaaacagaacaaaaaaaaagaacacaaaaaaaaaaaaaaactggcaaaaaaga

SEQ ID NO: 8753 - DNA, 530 bp, Gossypium hirsutum
  unsure (1)..(530): unsure at all n locations
  Clone ID: uC-gsronu33B171g04b1
gaccggccggattccgggttgacttacgcaaccgtgaatattaacaacttangngaaagcnaaagggggcaattaaaaaaaaaaaccggaaaaccccaaaaaaaaaaaataaaaataaaaaaattaataaattaataaaaaaaaacaaacataaaataaaaagaaaaaaaaataataaaacatataataaaaataaaaaatcaacaaaacaaaaaaaaaaacaaataaaaaaacacaaaaaaaaaaaaaaaataaaaaaataaataaactaaaaaaaaaaaaaaaataatataaaacacaaaaaaaccaacaaaaaataaaaataaaaattacacatataaaaaaaacaaaaataaaaaataaactaaaataaacaaaaaaatacataaaaactaaaaataaaaaaaaaaaaaataaaaacaaaaaataacaataataataaatataaaaaaatatacaaaaatataaaaataatacataaaaaattataaaaaaaaaataaatatataataataatcaataaaaataca

SEQ ID NO: 8754 - DNA, 347 bp, Gossypium hirsutum
  Clone ID: uC-gsronu33B171g06b1
aaaaaaaaaaaaaaacaaaaaaaaaaaaaaacaaaacaaaaaaaaaaaaaacaaaaaaaaaaaaaaacaaacaaaaaaaaacaaaaaaaaaaaaaaaaaaaaaaaaaaaaaagcaaaacaaaaaaaaagaaacaaaaaaaaaaaaaaaaaaaaaaacaaaaaaaaaaaaaaaaaaaaaaaaaaaaaaaaaaataaaaaaaaaaaacaaaaaaacaaaaaaaaaaaaaaaaaaaaaaaaaaaaaaaacaaaaaaaaaaaaaaaaaaaacaaaaaaaaaaaaaaaaaaaaaaaaaaaaaaacccaaaaaaaacaaaaaaaacaaaacaccaaaaaacaaaaaaaaaaaa

SEQ ID NO: 8755 - DNA, 97 bp, Gossypium hirsutum
  unsure (1)..(97): unsure at all n locations
  Clone ID: uC-gsronu33B171h07b1
ctcatcnagtccccgccgtgccagaagcagaagccgtatttactttcgcagtagatcacgatcacctgataagagagaaaggagtttttcgcttgaa

SEQ ID NO: 8756 - DNA, 484 bp, Gossypium hirsutum
  unsure (1)..(484): unsure at all n locations
  Clone ID: uC-gsronu33B172a04b1
ccccgtacggaattgctgggtttacccattcgcacgcccacgcttcngattttcttcaagaacaaagaaanggctaatcctgtgttcactcgcgtccacagtctccgcgcgcgttcagatgagacccttcttgcccacaggaacgagattttggccttgctctcaaggatcgagggcaaaggaaaaggaattctgcaacaccatcaaattattctagagtttgaagctatccctgaagagaacagaaagaagctcgctgatggtgcattttttgaagtattgaaggctagtcaggaagcgatcgtgttgcctccatgggttgcacttgctgttcgtccaaggcctggggtttgggagtacattagagtgaatgttcacgcccttgttgttgaggaacttactgttgctgagtatctccacttcaaggaagagctttgtgatggaagttcaaatggaaactttggtttggattggattttgagcc

SEQ ID NO: 8757 - DNA, 463 bp, Gossypium hirsutum
  unsure (1)..(463): unsure at all n locations
  Clone ID: uC-gsronu33B172a05b1
aaacntcctcctttctttgganccctctcctccaccgccaccagtccctgacccgagctctctcttgccttcaagtttcgtacagacgatatcgggaaattgtataaggtagaacaatgccgaaggtgaagacaaaccgtgtaaaatatccggaaggatgggaattgattgagcctaccctccgtgaactacaagcaaagatgagagaagctgagaatgatcctcacgatggtaagcgaaaatgtgagacgttgtggcctattttcaaaattgcacatcagaagagccgctacatttttgacctataccatcggaggaaggaaatatcaaaggaattgtatgagttctgcttggatcaaggctatgctgaccgcaaccttattgctaaatggaagaagccgggttacgaaccgttgtgctgtttgagatgtatgcagccacgggatcacaactttgctacaac

SEQ ID NO: 8758 - DNA, 433 bp, Gossypium hirsutum
  Clone ID: uC-gsronu33B172b06b1
aattccggggctgccactcgtccggaaatcagtcgggttcttccaactcctaacgggaatactgatgatgaatttcggagattaaaacgcaggttcgagacatggaagaaagagtacaagttgcgattgaaggaaaccaaggcaagactacataagcgtggatatgagtcagacaaaactcgaagaaaatggtgggagaagctaggttcaagatcctgattgaatcccagtttgaaatgatcatctccgttgattggagaattgttgccaaaattacctgtatcagttctcgggtacggttagctaacatttatggcaacgaacataaatgtttctggcagtccatggacagggagagagacattgtatttggatatctcaccaatttttggtacttgttgggaggaattatcatgtgcatagacaaattggg

SEQ ID NO: 8759 - DNA, 119 bp, Gossypium hirsutum
  Clone ID: uC-gsronu33B172b08b1
ttctaagataaaaaaagtgaaatcaacttgtcagaaggaagaagatatgggaagcgagtcatacgaggaagccattgcagctttgtcgaagcttcttagtgacaaagctgatctcggga

SEQ ID NO: 8760 - DNA, 75 bp, Gossypium hirsutum
  Clone ID: uC-gsronu33B172b09b1
cttatgtctcctgttcattgtgctttgtctgctacttttttgatttattgaatgagatggactaaatactgatcc

SEQ ID NO: 8761 - DNA, 400 bp, Gossypium hirsutum
  unsure (1)..(400): unsure at all n locations
  Clone ID: uC-gsronu33B172b12b1
gcccacgcgnccgagaaaggcctgagagtctagaatcagaaaagggggagcccaatccagacgtaaatgtcaaagggctgaatcagcatacatatgaagctggaaaagaatgcaagacacagattgcaagtgaaaaccaaagcagccatcttgcagatgggaaatctgttgccatggaagaggaagaagttattctcttgaagcctcttacaagacataattcagcaccaccctatgggaaaattcatagcgaaaaagaccctgcgtctccaaacgaaatggaggaaactgttccttccgatgaatgtttgcgccgtgctacgtccctactaatagcgcaaaaccaggccaattctgatgcttcagattttcaatctgacatctcgaatttcaagcgcag

SEQ ID NO: 8762 - DNA, 351 bp, Gossypium hirsutum
  unsure (1)..(351): unsure at all n locations
  Clone ID: uC-gsronu33B172c06b1
ccaaagcctccgtttcccaacccagnggcagnngggcaaaggagggacttggngagccacacgccgcagagcccccccccccacacggannacgaccaaacccccaaaagcaccgagaaagcaaaaaacccacccgaagaaggcggcgaccgggagaggaagaacccgcggaaggcccaccaaggcccagaccgcagggccacccggaagcccaaaaaggcaaccgacccaccagnggaggccatngcaacctncacaaccgacgaaccnggcccctatgagacattcatattctacaccgtgctcacgagcatcatatcgttggatagaggttcccttacacaaaagggc

SEQ ID NO: 8763 - DNA, 160 bp, Gossypium hirsutum
  Clone ID: uC-gsronu33B172c08b1
gccatggttttctcgcacgcgggcgaataatgccggattgagtgacaacaaagccagtggggagcatctcagatgacattgtgttggcaatatttgctgcggccatgattgtagtgccagaatccatgttgcatgttataagaggttgtcctgcattgct

SEQ ID NO: 8764 - DNA, 523 bp, Gossypium hirsutum
  Clone ID: uC-gsronu33B172c09b1
ccctctcttccgaaaaatctcagattttctgtcaaggaaaatatggaatcgagcaggggtcaaggtggcatccagcagttgcttgctgcagaacaagaagctcagcatattgtcaatactgccagaaatgccaagatggctaggctgaaacaagccaaggaagaggctgaaaaggagattgctgaatatcgagctcaagtggagaaggagtttcagaggaaactttccgagagcagcggggattcgggtgctaatgtgaaacgccttgagaaagagactgaagcaaagattgaccacctgaaaaatgaggctgcaagaatatcagatgatgttgtccaaatgcttctcaagcatgtaacaactgtaaagaattaggccccttgagatggcaaacattcaatatatgttactgttgttcccctgcatgatgtaatattggctttggtgccctcacctggcttagactctggtgagtaaattagaccctttttatcaaataaatcagtttgagaacatgtaggac

SEQ ID NO: 8765 - DNA, 68 bp, Gossypium hirsutum
  Clone ID: uC-gsronu33B172c11b1
ctctattttccaaccaaaaaaaaaaaaaaaaaagaaaaaaattaaacaaaaaaaaccaaaaaacccac

SEQ ID NO: 8766 - DNA, 293 bp, Gossypium hirsutum
  Clone ID: uC-gsronu33B172d04b1
tcccacgcttttcgcttgtacttccctccttactatcaaaacctctctactacccgtccctgttcagctgctcctctcgcctcagtagtcgctgccgcctccactagcttattctccaccaatgcatcactcccttatacagccacccccgcaggtgaaaagaagtactactcggatcctaaagttaaacccagggaccccaacaagcgggtcttcgaggcttacggtaacgctgctgctttgtctgtgcagatgggtgcttacaggggcggtcctacaacattcgcggtggt

SEQ ID NO: 8767 - DNA, 106 bp, Gossypium hirsutum
  Clone ID: uC-gsronu33B172d05b1
cccgggacgacccactcgaactaaaaaaactttaatttctaaaacacaaaaaaaaaaaaaaaaagggacgggggaaaattaaaagaacgaaaaccgacggcccccc

SEQ ID NO: 8768 - DNA, 400 bp, Gossypium hirsutum
  Clone ID: uC-gsronu33B172e04b1
tcccacgcgtccggatgttaccatatgcttaacatgtctcatttcaaggatgattccagtccaaacgcttgggattactctgcctgggttcgcacttatgccttattcttggaggagaggctggaatgttttcgtgtcttgaagtaccttgtcacctttaccatatattaagagtattaatgttgttacaactggtactaaaaaaaataagagtaatttgatacgtaatccaaaatacttaaaaatatcgtatgaaacttatagaatccaaatagatgatgttaaaagttatatcatatgataatattgaaatgaatctatcattttctaatgcacaaaaaataatcccaaaaaaaacaatagcactatcaaatttagtttataacatccactcctaaaa

SEQ ID NO: 8769 - DNA, 401 bp, Gossypium hirsutum
  Clone ID: uC-gsronu33B172e10b1
acgcctttttctcttattgcctcgaattcttaatcaggttattgaattaaatcgcgagatctgagcaatggcgacagattcatcaaatggggaacaaaagacaacctcaaagccaccacctttgccatctccattgcgcttttctaagttttatcagtccaacatgaggatcctggttactggaggagctggttttattggttctcacttagttgacaaattgatggaaaatgagaaaaatgaggtgattgttgctgataactacttcaccggatccaaggacaatcttagaaagtggattggccatcctagatttgagcttattcgtcacgatgttactcaaccgttgttggttgaggttgatcagatttaccaccttgcctgttctgcttcttcaattt

SEQ ID NO: 8770 - DNA, 102 bp, Gossypium hirsutum
  Clone ID: uC-gsronu33B172f11b1
ttcccgggacgtcccactcgaacgaactaaactccaaaacaaaaaaaaaaaaaaaaaaggggggggggttaaattaaaggaagcaaacgaacccaccccaac

SEQ ID NO: 8771 - DNA, 476 bp, Gossypium hirsutum
  unsure (1)..(476): unsure at all n locations
  Clone ID: uC-gsronu33B172g02b1
gagaagacnaggnggggagggggtaatttaaaaaaaggaacgggcccaacccccaaaaaaaaaaaaaaatgaacaaaaaacaaacgaacaaaaacaaaaccaaaaaaaaaaaaaaaaaaaatcaaaaaaaacaaaaaacaaagcagacaaacaaaaaaaaaaaaaaaaaaaaaaaataagaatatacaataaaaaaataaagaaaaagaaaaaacaaaaaagcaaaaaataaaaaacaaagaaaaaaaatcaaaaaaaccaaacaaaacaaaaaaaaaacacacagaaaaacaaccaaaacaaaatataaaaaaaaaaacaaacacaaaaaaaaaaaacaaaaaaaacaaacaaaacaacaaacaaaaacaaacacaaaacgaaaccctaaaaacattacaaaataaaaacaaataaaaaaaaaacacaaaaaaatcacaaacaaaaaacagaaacaaataagacacaaaacacaa

SEQ ID NO: 8772 - DNA, 501 bp, Gossypium hirsutum
  unsure (1)..(501): unsure at all n locations
  Clone ID: uC-gsronu33B172g04b1
aaaaaacctcaaatcntaaaaaaaaaaaaaaaaaagaaaggggaagggtttaattaaaaaaaacggacgggcccaaacccaaaaaaaaaaaaaaaaaaaaaaacacaataaacaaaaaaaaaaaaaaaaataaaaaaacaaaaacaaaaaaaaagacgaaacgacaaaaacaaaaaaaaaacaacaagaaaaaaaaagaaaacaaaaataaaaaaaaaaaaaacaaaaaaaaacaaacacaaaaaaaaaaacaaaaaaaaaaaagcacacaaaaacacaaagaaaaaaataaaaaaaataaaaaacaataaaaaaaagagaatataaaaaaaagaaagacaacaacaaaaaacgaaaaaaaaatcaaaaaaaaaacatagaacacaaaaaacaacaaaaccaacaaacaacaaaaaaaacaagaagaaaaataaaaaaaaaaaaaacacaaacaaataaataaaagaaaaaacaaaacccaaaaaaaataaaaaaaaaata

SEQ ID NO: 8773 - DNA, 240 bp, Gossypium hirsutum
  Clone ID: uC-gsronu33B172h06b1
aaaaaaaaaaacggaaaaaaccccccacccaaaaaaaaaaagaaaaacaaaccaaaaacaaaaaaaacaaagaaaaacaaaaaaaaaacacaaaaacaaccaaaaaaaacacaaaaaaaaacacaccaacaaacaaaaaaccaaaaaaaaaaaaacccaaaaaaaaaaaaacaaaaaaaaaacaaaaaaacaacgaaaaaaaaaaaaacaaaaaaacacaccaaacaaaaaaaaaaacaa

SEQ ID NO: 8774 - DNA, 146 bp, Gossypium hirsutum
  Clone ID: uC-gsronu33B172h10b1
acgccttccgcttaattagttatacatagtaatgctttttgctgtgattgaacttgttcaaatggtttcgtttcgcttcatcttaagacgctatttcagctttcgacatgtttttgtccctccctttattctctctttctcttctt

SEQ ID NO: 8775 - DNA, 395 bp, Gossypium hirsutum
  Clone ID: uC-gsronu33B178b04b1
atttctgctgccaagaagaaatgagattgcatttgatggtatcagagccttttgattttggttatctttgtagtttggtacttgcagttttttagaccaattttgatgtgtgttcatttggttgagactgtcatctgcatacggattgtgtgtttgctttttccgtgtcaattttagttgaattccttcaaaaaaaaaaaaaaaaaaaaaaatacaacaaacaaaaagaaaaaaaaaataaaataaaaaattaatggggggggcgatatagaatttttgttaagactttgactggaaagaacctttacatgttttgtagagagtccacataccattgtatatgggacggggtgtcccccttgttgggattggaaatcccctggccttacccaact

SEQ ID NO: 8776 - DNA, 522 bp, Gossypium hirsutum
  Clone ID: uC-gsronu33B178b10b1
tttttcggatgcccatttgctcccggcaaccgccgtgggtcaaaaatctggtgatgctataagagactacttgttttcaaatcctaacccaactgtcaccattctttttgaaggaaccaaagttggcatagaaccatcaccggtggtggctgcttttagctcaagaggaccaaattctataacctcggagatattgaaaccagacatgattgctccaggggttaacattttagcagggtggtccggtgcagtaggtccaacggggttggctacggataccagacgagtggattttaacatcatttcaggaacttcaatgtcttgcccacatgttagtggccttgcagggttgctgaaggcggctcacccagattggagtccagcagctatcagatcagctcttatgactacagcttatacggaatacaaaaacaagcagaaaatgcaagatattgcaacggggaaaccatccaccccgttcgaccatggtgctgggcatgtggatcctgtttcagcgcttaa

SEQ ID NO: 8777 - DNA, 513 bp, Gossypium hirsutum
  unsure (1)..(513): unsure at all n locations
  Clone ID: uC-gsronu33B178b11b1
tctttttgcgtccgcccacgcgtccgcagagacgaagcagggaagtaaaagttttgaccttttgagaaaaatcctgtgagaatccactctctccatagtttcttcaagcaaaccctacgatggcggacgacgactataatgatatggacatgggatatgaggatgagccaccagagcctgagattgaagaaggagctgaggaggatttggaaaacaataacaacgatgatgttcctctagaacctatcgaaaccgaagacaaagtagaccaagatgctaaagacaaaactactcgtaaaacatcaaagtatatgaccaaatacgagcgtgctagaatcttgggtacccgagccttgcaaatcagtatgaatgcacctgttatggttgagtctgagggtgagaccgacccacttgagattgccatgaaggagcttcgagagcggaaaataccctttaccataagacgctacttgcccgatggaagttatgaagattggngagtcgatgagttga

SEQ ID NO: 8778 - DNA, 525 bp, Gossypium hirsutum
  Clone ID: uC-gsronu33B178c03b1
ccttcttcgtccggttccttccttcgccgtctattgcttttagttgcctcgatttcaagtgaatcagaatgggtaaggaaaagactcacattaacattgtggtcatcggccacgtcgattctgggaaatcaaccaccactggccacctgatttacaagcttggtggtattgacaagcgtgtgattgaaaggttcgagaaagaagctgctgagatgaacaagaggtcattcaagtatgcttgggtgcttgacaagctcaaggctgagcgtgagcgtggtatcaccattgatattgccttgtggaaatttgagaccaccaaatactactgcactgtgattgatgcacctggacaccgtgactttatcaagaatatgattactggtacgtcacaggctgactgtgctgttttgattattgattccaccactggtggttctgaggctggtatctcaaaggatggtcagactcgtgagcacgcattgcttgcttttacccttggtgtcaagcacatgatttgctgttgca

SEQ ID NO: 8779 - DNA, 518 bp, Gossypium hirsutum
  Clone ID: uC-gsronu33B178c06b1
gtttttctttaatctactttcgctatggctaatagacgttcccaaactcacaagtttgggctttgaaaattactttgaatttcactgtttggcatatttagaactaagagattgtccattgctaaaaacattcatctctaaatgtgtacccggagatgaacctcaaattggccaacatgtacaagcaagtaacttggaggttcataactcatctctcctcaatgaaaaggttgttttccctagtttgaagaacttgtggattcagaattgtggttcgttagaagaaattattgagctacaaggactcattccagatgaatcacagtcaacatcagctgctcaatctattgtggctgaaacagtgacaaccaagtttgtatttcccaaactaataaaccttggattggataaggtgccaagattgaaaagtttctgctctaggatgcataccaccctgtggccttcattgaaacatatgagcgttattgaatgccccaaagtacagatatttactcgac

SEQ ID NO: 8780 - DNA, 519 bp, Gossypium hirsutum
  Clone ID: uC-gsronu33B178c08b1
ttttcgcgtccgattcccagtagcagaacagaaaaaagaggtcttccgtctcatattcttcgatcctctggaaagttgtagaccagagcaagaatacattatggctggacatagtgattcaagttcgtctgaaaagaaatcaagtgaagccatgaatgatgtaccgacctttagcacggagaatatgcaaaataacatgaaagttatatattacagccgaacgtttatgtctatcatcggaggagttattgctggaattttagggttcacaggctttatggggtttatcttttattttcttgtcatggcaattacttcaattggactcatagcaaaggcaaagttctcagtccatttatattttgatagctggaaccggattatactcgatggtttcatgggcggtcttatgtcattcgtgctattttggacatttgcctacgacattgtgcatatattctgaagaagaatctgcaacacctcaccacctcaccggaaagagaagccaagtcgttgccc

SEQ ID NO: 8781 - DNA, 290 bp, Gossypium hirsutum
  Clone ID: uC-gsronu33B178d04b1
tcttctcgtccgcccacgcgtccgcgttccggttgggatgaatgccacgaagtgcgtgggcagcaaacttggaagctaagaaagtagcaaaggagttggtgaaactacaaaagccttcggaacctgattttactgctgaagacgcagattgatatgtaatccatgaagttatttttatatttgctgctacgtttgattagaagatctgaaaccactatacccaatacatagacattccagtcttggcacaaaaagcttacatggatatactcgctgggaacttgccacat

SEQ ID NO: 8782 - DNA, 406 bp, Gossypium hirsutum
  unsure (1)..(406): unsure at all n locations
  Clone ID: uC-gsronu33B178d07b1
tttgtatgtatatttagttgcatgcatcttccgccattaagggaagagtgtaaaataactttttaaaaaaataaaaaaaatacaaaatacaaaggtttcatagctgttcaaacaagagttccaaataacaaaatgaaacaaaacaattatgcgaggagaataaagcaagaataaatatcatcatataatattcgttaacctagttttttattaccaattttatctttatgaagcctcactcaaaaattgattttactcaataattaacccagtaaaattattggcctaaacttaatttacctattatattgtatagctccgaaattgaacctaaattattagaatcactttataaaaataacttcacttgccctcaatagaaactccctaattaaagcctaangng

SEQ ID NO: 8783 - DNA, 459 bp, Gossypium hirsutum
  Clone ID: uC-gsronu33B178d11b1
gtctaccatatgtgagggagaggcaatagttgggagcatgactgttgcaccaaacgagaagaatccccgagatgttgatataatggtaaaatattcattgagtggtcggcgttgtgcggtttcaagagttcaattctacaagatgcgctgatgtttctcactactatttttatccaccaccaccataaatttatggcctaggctaaagcatgaagatgctactcctattttaatgcatttgtattctaacattcctcaactgcttgagaatattggttctttcatgtggaatgtaacatttgttgccctttaattttcattgattctttaccatgtttgcatgagtaaattaggattaaaaaaaaaaaaaaaaaaaaaaaaaaaaaaaaaaaaaaaaaaaaaataaaaaaaatataaaaaaaaaataaaaaaaaaatattacaaattaaataattttag

SEQ ID NO: 8784 - DNA, 197 bp, Gossypium hirsutum
  Clone ID: uC-gsronu33B178d12b1
ttcttacgcgtccgctattatccttaaaagtactggatcaccattgcaattcaccaagagcattaatattgtcactactagtactaaaagaaataagtgtaatttggttacaaaaaccaaaaccttgaaagatatggcaagaaactttggaatcgaaatggatggtcttaaaagttgtatcatatgatattcgaatg

SEQ ID NO: 8785 - DNA, 531 bp, Gossypium hirsutum
  Clone ID: uC-gsronu33B178e04b1
aatttccaaaagaaagaaaagcatcaacaacaacaagaaaaagtccatacacttaagggaaaaaccagacaagagagaaaacaagaaaaatgggtgttctggatcatgtttcagatctgtttgactgttctcacagttccaagcacaagaaacgtaagcagttgcagacggtggaaatcaaggtgaaaatggactgcgaaggatgcgaacggaaagtgaaaaaatcagtggaagggatgaaaggggtgacacaagtggacgtggagcggaaggccagcaagttgacggtcgtcggatatgtggacccgaagaaggtcgtggcacgagtggcgcatcggacggggaagaaggtggagctatggccctatgtgccgtacgacgtggtggctcacccatacgcccccggggtttacgataagaaggctccggctgggtacgtccgcaacgccgaggacccgcaagtgtcgcatctcgcacgtgctagctccactgaagttaggtacaccacagctttcagcgacgaaaaccctg

SEQ ID NO: 8786 - DNA, 259 bp, Gossypium hirsutum
  Clone ID: uC-gsronu33B178e09b1
gtttacttcaataatctatgctcatctttttttggttttggattctctttttttaagttcttacatttcacagagagggtcttgaaaggtatcaattttttcttcccctcttttgttttcctttttccctcgtttttcctccatccctccctgtgtaatattgttaggctctgtgctttcaagaggagtacgaataaaaataaaccttttttttttcttcttttccccaggtgaagtaatagcgcaaagtcccgcccag

SEQ ID NO: 8787 - DNA, 457 bp, Gossypium hirsutum
  Clone ID: uC-gsronu33B178f01b1
ccttcttgttcgggacactatggcaaggcattgaccggcctttctctcactagccttgcgaatgtgagtgaaaagggcttctgggtaatgggtaatggtcatggactacagaaattgaaatctttcacagttacatcctgccgtggagcgacagattcgggacttgaagctgttggaaaaggttgcccgaatttgaagcagttatgcctcagtaaatgccctttcttatctgataaggggttgtcgtctttagccaaagcagccggttcactagagtgcttgcaactggaggagtgccacagaatctcccagtttgggtttttttgctcccttattaactgtggtgcaaagttgaaggttatttcctttgcaaactgtttaggcattaaggacctaaactcgggattgccacctctatccccttgtgaatcccttagatctttgtccatccataact

SEQ ID NO: 8788 - DNA, 351 bp, Gossypium hirsutum
  Clone ID: uC-gsronu33B178f02b1
ccgccgaaagcacagggtgtttggccatggctctgaaggcatggacgtggggaaagcccttgaaaaagtcaggagctagcagtggaagaacttccaagcccgttgctgtcactctctgccgacagctctcttagagacgaaaaagagaactatgtgttaagctgggatgttgtctaatgcctagaatattcaatgactgtcatttagactcttttatggtgctgtttttatcatcactgggttaggtggttttcaagaacttgctttatgtaggttttatgattaactaccattaaataagatactctttttcatcatcaagctaactcttgacgatggatcttaataaaa

SEQ ID NO: 8789 - DNA, 443 bp, Gossypium hirsutum
  Clone ID: uC-gsronu33B178f05b1
cctattcgtacgcccactcgtccgcttttctttatgggacttatttaaccaaatccgtgcagtttttgttcccagtgaccctttggggtgctttttgttatcatagccactcctccttcttcagatggggtggcttcaatccctgttttctccattgatgaaactctggtttcgtctccactcatctcagagaaaaaggagagggatatacattttgtatgaagatgtgaaatcttgcccttgtgaggatgtgcatgctttatggcacaatactgggggaatcaaatgcacctgctaaaacattgaactgatcaagaaccctttttctgggtatgattttttctaaagaagcacacctgttgtacataaatatatgtatatatctatatgatatatccgctttcgggtgagtgcattatacgagcatgtatccattatgagaa

SEQ ID NO: 8790 - DNA, 435 bp, Gossypium hirsutum
  Clone ID: uC-gsronu33B178f07b1
ttgtgattacccgctgagtttaagcatatcaataagcggtggttaaaaattaaagtgggtttactcataacaaaactaacctataatataagcttgtgactgcggggacttcaccagccattgctcttagcttgcatcattttgagacaacctgtcctgttgttgattcgatcgcctcaatatgctgtcctgcgtgccaccattaacgataagacggtccctgccccccttcttcccatgcattttcatgattgttttataaggccttgtgatgcttctgtgctgttgtactcaacgggaaccaatattagctgaccaagatttgcctgcacatctttctttgcatggcccccctgttatagaaactgcaaagacagaagtcgaagcagcttctcccggtgtagcctcgtgagctgatattttggcttctgccgc

SEQ ID NO: 8791 - DNA, 488 bp, Gossypium hirsutum
  Clone ID: uC-gsronu33B178g03b1
tattgctatccttaatgatggtaccattaggactatatccatggctagagtgaaaccatctgcactgccagacagttggaagttaggaaaaatctttgcaactggaattattcttggtggttacttagccatgatgactgtcattttcttttgggcagcatacaagacagacttcttccctagtacatttggggttaaaagccttcataaaaccgaccgcaaggacataaaaatgcttgcttcggcagtatacctgcaagtgagcattatcagtcaagctctcatatttgtaacacgagcaagaagttggtctttccttgagcgtcccggttttttactggttttggcttttgtcgtagctcagctgattgctacattaatagcagtatatgcaaactggggttttgctgcaattgaaggaattggatggggccgggcaggtgtgatatggctttacaaccttatctttacattccacttcatttatc

SEQ ID NO: 8792 - DNA, 516 bp, Gossypium hirsutum
  unsure (1)..(516): unsure at all n locations
  Clone ID: uC-gsronu33B178g04b1
gcttctctttcggctaccttcacacaagttacaaagggaaagtaccacaagttcgtgcactgtgaaaaaacttcccacattcaccatgattgacaggtgcagaactgtgactgcactgaccgcagccgatgcacgaatggaaacagcaacaccatgatcattgagactgagaagagctacattaacactgctgtgatggatgctccagctgagaacgatggcaagtgcaagagcggtactggctgcagctgcacagactgcacctgtggccactaactcaacatacaatggtgatgcttcagggcatggcgtatatagggatctaaataatgaattccaggctgtatgattggcctgttgtaggccgtgtggtgactcatatgtgtgagctgacctttgtatcctgtactatgatgcagtggctatgctgatggccttatctggaaacgaagtatccttaatctgtgttggncttgtgatgagtgtagcagctacctacatggtcaacggcaagct

SEQ ID NO: 8793 - DNA, 471 bp, Gossypium hirsutum
  Clone ID: uC-gsronu33B178h03b1
actaaacctgactagtcggcatcactgatgcactttggggtgcaagagttttcacaggtattcacgaaacaagctgtgtaaaacatacggacataccggaatcaatcgaaaattggtttgtgcttcttcttcggtggccaagaagctttatggcggtcatagtctcttcgattaccatgttggagaaaatgctaaatgctacactgctctaaacatgaacataacagccatgaaatggaacttcaattcaggttcttgctatatttgaactttgtccttcacggttggtctaaaagaaaagcaccattgcttaatattaaagagtagaaaaggtttcttgggagggattgtgtacataatttgtaccatatcagtttaaaaacagcaaaaggaaaatatatgttgaaagggagtatattcttttgtaacatctgcctattgttaatacaaggatgatatatatatttccac

SEQ ID NO: 8794 - DNA, 533 bp, Gossypium hirsutum
  Clone ID: uC-gsronu33B178h06b1
gtttcttttcaagtaccctttgggtgatccattggagatatctcaacgtcgatgcctgttaataatggccatgggtgttaaacctgaagttgggcatacctgtctcagacacatttctgtaccagacactaacactcaaatggaagtaagacacatttctgtatcagacactaacactcaaatcgaagtaatgtagggaacttccacaagcattgactttgaatgtgctgtcatatacattctgccacccttttttttttaatgcgatactattatatttgataatggagatgctttgagttctttatcattttattgttttagtttctctttagttataatttatgttggtacacttgttcgtcttattttaatgcatatgatattttttttctgtaaaatgcacgcaaagatgtttcttattagtattatttgaaatataagacatgtttatgccaaatattttgttatgtgatatatatggtcatggatctttcaatgggtgattactttagagctttacttatgttttc

SEQ ID NO: 8795 - DNA, 510 bp, Gossypium hirsutum
  Clone ID: uC-gsronu33B179a02b1
tgttttttactgagcagatcagcccacaaaaaaggggggccaagcaactgagagcgtggggagaagaaacagatcatctcctcgaaaatggtggctcttatcaccattatggtaacatcaagcagtttgcagatgtgaattatccctttactgattcatcatgtcaactcttttccccactggaccttcaacagcacaagcaaaacacgggccctgattctgtaagctatgggcaggccagtgttccctatatgcatctcaataacagcggtccttcaaaccaaatttcaagatttccaactagtgccaaatctgaaaataacgggcatccttcgacaaacgagtcatcttgtgcatcgaatcaggcacagtccatagagagctctcggggtctttcatttgaggttcctgacattataacgaatgagaagatgggaaagccatttcatcaacaagatacaaaagccccagtcaacaggaatatcaaccaggcaagagtggaaagtcaga

SEQ ID NO: 8796 - DNA, 541 bp, Gossypium hirsutum
  unsure (1)..(541): unsure at all n locations
  Clone ID: uC-gsronu33B179a03b1
atttgcttcttttttagatggattgaaggttggggctggactagcactagatattggagggtgtaccatgtcaagcatgttggccaatgttaacactggaaatcaaggcctacagggtgaactgtaaatctagctttgccaagtttcaagatttatgtccgaagacatggttagacataagaggcaagggatcaaagctttggagggctcctagtcgggatgatcatctcaaattcacatgcagtagcgggtctattcctggaagattattcattagttgctaatttgaagcaagagttaattgtttgaatcccctcttggtttacgtggtgcagagctcaacttagtgttgaagaactactgttagttgttgaagttggtcatacgaggtacatgtctaccgtgtaacaagttcctttacatagtgaaaattttcagcggactacggtcccgtggtttttccccttaaatatcaaggggtttccaccgtaattctgttgtcttggttacattcatattgcanataatggtgctcattgca

SEQ ID NO: 8797 - DNA, 312 bp, Gossypium hirsutum
  Clone ID: uC-gsronu33B179a05b1
gcttatggacagctctttctcgattctatgggtgggggggcatttcagttcttaggtggtggagccatctgactggttaattccgttaacgaacgagacctcaccatgctaactagctacacggaggtgatcctccgtggctagcttcttagagggactatggccttttaggccaaggaagtttgaggcaataacaggtctgaggtccccttagacgttctgggacgtactcacgctacactgatgtattcaacgagtctatagccttgttcaccaggccccgttaatatttgaaacttcatcgcgatgggg

SEQ ID NO: 8798 - DNA, 384 bp, Gossypium hirsutum
  Clone ID: uC-gsronu33B179a10b1
ctcacgcgtccggataccattgtcggtgatggaattcatgttctacgatgtggatagagtgttgagaggtggtgggtatttgtgggtggatcgattctttagcaaagcaatggatcttgagaaaatttatgggccattgattggtaagcttggatacaagaaagtgaaatgggcagtggctaacaagacagatcctagtggtttgaaacatggtgaagtttatttgtctgctttgttacaaaagcctgtttcaaaatcattatggggaaaaattgaagactcattcaacatttaggataaatgatatcggatcacgcggaaaacatgcccgccgactgtcgttttgctcttgacaaaaactggtatgaattttattcatcggat

SEQ ID NO: 8799 - DNA, 478 bp, Gossypium hirsutum
  Clone ID: uC-gsronu33B179c06b1
ataataaatcaacccaaaaaaaaaaaaaaaaaaaaaagaaattttttataaaaaatttttttgttatatacacacacataaaaacataaaaaactaccatattccatacctctaacctcccttcttttcccttcccttttcaatccaaaatcttggtttccccttttttttcttcctccttttctttcttcccctcttcccctttttcttctcttttttttctcctcttaactcaattaccctttccccttttatcaccctttctctcctaaactcctctctgcctctcccccttatccctctcaatcctttcctctttttttccattttctttcattttaaaatgtccgctttccacctcccttctctttattcccttccctctatttccttttttcccccctctttcctttcctttttcttccactcctttgctttttctcctccctttttctctctccctcttttctcctctttt

SEQ ID NO: 8800 - DNA, 404 bp, Gossypium hirsutum
  Clone ID: uC-gsronu33B179c07b1
tttttcgcgtccgcctggttccgactccccgaagggtgccccagaggttattgctgagtacactgtccgtgccttgcagcgtaccgtccctgctgcagtccctgctattgtgttcttgtctggtgggcaaagtgaggaggaggctacccttaaccttaatgccatgaacaagctccagaccaagaaaccatggtcactctcattctcatttggacgtgcccttcagcagagcactctcaaggcctgggctggaaaggaggaaaacgtgaagaaagcacaagatgctttccttgttaggtgcaaggctaactcggaggccaccttgggtacatacaagggtgacgcaaagattagtgagggtgctgcagagagccttcatgttaaggactacaaatactaagaat

SEQ ID NO: 8801 - DNA, 553 bp, Gossypium hirsutum
  unsure (1)..(553): unsure at all n locations
  Clone ID: uC-gsronu33B179c08b1
agtcccgcaacagagaagacaccagcgacgccgtctgcagtggcaccatcgccggagccaaagaaagcatcttggtgtgttccaaagaaagatgttacagattccgaattgcaggcaagtttggattatgcttgtgcacatggcatagattgtagtccaatccaaccgggagggtcttgtttcgagccaaatacactatcagcacatgcagcatatgcgatgaatctctattatcaaagttctggccgggatccatcgagctgtgatttctcacaagcagccatgctttcttctagcaacccaagctataatggttgcactttccctggtgggagtacatgaaaaaggagagtagtaagtcgggcagatgaatgaagggcagtggggggcaacttttgttgttctttattttcatcaactttcagtaatggtattgagtgattggcacttcttcaagtgcgaaaaagatgaaagaaatgcttaccttttttaatttagaaataggagctcatgtcttngtgcaatatatatatatggatgtatgtatgcatgt

SEQ ID NO: 8802 - DNA, 565 bp, Gossypium hirsutum
  Clone ID: uC-gsronu33B179d03b1
atttttattccgctattttctctctccccaaacaccggtttaagccaaaaagaagacagtggccgatcagctcaccgatgatcagatctctgagttcaaggaggcctttagcctattcgacaaggacggcgatggctgcattactaccaaggagctcgggactgtgatgcgatcacttgggcagaaccctactgaggcagaacttcaagatatgattaatgaagttgatgctgatggaaatgggaccatcgattttcctgaattccttaacctgatggcgaggaagatgaaggatactgattctgaggaggaacttaaagaggctttcagggtttttgacaaggatcagaatggtttcatatcagctgctgagctgcgccatgtcatgacaaatctcggtgagaagcttacagatgaggaggttgatgaaatgatccgtgaagccgatgttgatggtgacgggcagatcaactatgaggagtttgttaaagtcatgatggccaagtaactttctcactcaaccataagatgaaccaaacattgatttaaagggaacagggcagat

SEQ ID NO: 8803 - DNA, 537 bp, Gossypium hirsutum
  unsure (1)..(537): unsure at all n locations
  Clone ID: uC-gsronu33B179d04b1
ccccatctacagggtttacaaagggattgggacagctgtaaccaatggctccgaaggttgagaagaaggcagatgcaaaagcacaggccttgaaggctgcgaaagcagtgaaatctggagccacttttaagaagaaggccaagaagatccgaacaaaggttacgtttcacaggccaaggaccttgaagaaagataggaacccgaagtatccgcgcattagtgccccaccgaggaacaagcttgaccattaccagattctcaagtttcccctcacaactgagtcagccatgaagaagattgaggacaataacactttagtatttattgttgacatccgtgcagacaagaagaagatcaaagatgctgtgaagaagatgtatgatattcaggccaagaaagtgaacaccttgatcaggcccgatggcacaaagaaggcatatgttaggttgacgccggattacgatgccttggatgtngcaaacaaaatcggaattatctaagcaagtggcgactacccttgtttgatgcttttatttt

SEQ ID NO: 8804 - DNA, 538 bp, Gossypium hirsutum
  Clone ID: uC-gsronu33B179d08b1
ttttgcttcgcccctttacagccaaattccttggtggagcgtttcttttttaactgtccagttctcaacgaatccatagaatttcaccaagaagaagaagaagatgtcgtggcaaacatatgtagatgagcacttgatgtgcgaaatcgatggcaaccatctctcctccgccgccatcgtcggccacgatggcagcatttgggcccagagctccaatttccctcagttcaaacaagaagagattaatgccatcatgaatgactttgctgaacctgggtcacttgctccaactggattgtaccttggtggcacaaaatatatggtgatccaaggcgaacccggatatgttattcgagggaaaaagggatctggaggtattactattaaaaagaccaatatggctttgctcatcggaatctacgatgagccaatggctcccagccaatgcaacatggttgtggaaaggcttggtgattatctcattgatcagggtttttgatcttgctgttgtggccctatttgtttcaattcttctcta

SEQ ID NO: 8805 - DNA, 553 bp, Gossypium hirsutum
  Clone ID: uC-gsronu33B179e02b1
ccttcttgtccggttcgggctgccatggaagatgccctggttcgtattttaactcccaggcgctccattgacatactgagggatgtacatgctgccaaggaacagaggaagccatatgttgttgtctttgttggcgttaacggagttgggaaatcaactaatctcgccaaggttgcttactggcttctgcagcacaatgttagtgctatgatggctgcttgtgatacattccgttctggtgctgatgagcagttgagaacgcatgcacgtagactccagattcctatttttgagaaagggtacgagaaagatcctgcaattgtagcaaaggaagcaattcaggaggccactcgtaatggatctgatgttgttctcgacgatactgctggtcggatgcaggataatgaaccactaatgagagccctctaaaagcttatatacctcaacaatccagatctagtcttatttgtgggagaggcactagttgggaatgatgctgttgaccagttttaaaattcaatcagaaattggctgaccttttactgctcctact

SEQ ID NO: 8806 - DNA, 539 bp, Gossypium hirsutum
  Clone ID: uC-gsronu33B179e03b1
cgttcctatattcgctcttcaaaggtagagtgtgtgggggtcatgaatggaggatcaagggtttctgaaattacaccaaaatggaatggagtgacaataaatagtccaagcattggcagcaaaaataaaagatcagttgggatcatgggagattataagttctctccaaatgctgtccacgaagaggttgagagcttcctcttacacgccataaacatgagcttcttcgagcgacttcacttggcttggaaaatagttttcccatctccagcatctagaaggagctctaatgcaaatatagcgaagcagcggttgaagatgatcctgttctccgaccgctgagcagttagcgatgaggcgaaacagaaaattgtgaaaaatattgttcatgcactgtcagattttgttgagatagagtcgaaagacaaggttcagcttagcgtctccactgattctgatctgggagctatttactccgtcacagtgcctgttccgcgggtcagggcagaataccaagaggcagatgaatctgggacgat

SEQ ID NO: 8807 - DNA, 546 bp, Gossypium hirsutum
  Clone ID: uC-gsronu33B179e08b1
tcttttacattacctacaaaatctttgctttccctgttttttttttttttgccaatggcttcttcaccaaaattcatctcttacttcttccttttagccctcttctccgttgaaatacatggtagggatttttttagcaaaatcccaagtgttaacacaaatgagaaagaggtgaccaacaaagaagaacaaaccactttggggaagaaggagcaagagccaaggtttgtccccgagacccaaaatggctatgggctttacggtcacgagtctggtcagctccctcctagcaccgccagtaccaaagaaacctatgaaccctatgtcacacctgttaaataccaccctgatgaaccctacaatagcatcccagcgtccaaaaccaacaacaaagactcttacttttatagcaagacaaatgcgtacgggaacactgagcagcaaagtgaagccacggtcaatgagaaaggatggaccacccaggaaaccaacaactacaatggcaactattacaatggtaacaatgaggccttgttcactgagaaa

SEQ ID NO: 8808 - DNA, 483 bp, Gossypium hirsutum
  Clone ID: uC-gsronu33B179e11b1
gaaacatagctgaattatactaatatttcattccccatgaagatacataaatccaaagaaattaaacatcttcttttttatatggtgttacatttattcagaatcaatccaaaaggaaacaacactacaacatcgtagattaaacgaccagttaccgagaaaacattgatcacttcaaactggaccttaagaacatcaaaaccacgcagcactaagaagagaaagaatttagagaactgatttagcgacattggaagccagagggtactttctttgagcagacattaagaagcaaactgagggaaagtgggacattaaggttgatgcccaaaatatttgctttgattgccgtgcaaaggcaaacggcagcttcaagatcagcaagaccttggatgagagagcagcagggttgaacaggaggggtaccaatggtgaccgttagcaagccacggagcaaatcagcacatacaccgagtttaagag

SEQ ID NO: 8809 - DNA, 430 bp, Gossypium hirsutum
  Clone ID: uC-gsronu33B179f07b1
cctacgcgtccgaatctttcccttttgctttcaagttgttcttcttcttcttctccccctcctcctctctccctccattctatcgaattctcaagcttccaatggaaacgttagcttcttcttctcttcgtacgaccctcggcggcggcgctggtggcggattactcaatttttgtggcggtggctccgtctctgttcttggcttccctcttcaacatctcaagattcaatcccttcccgattcgaagaaaaagcagggttttggggtcataaaagcttctgttgctaagacaggaagttgcacttgtcagaataggcactagaggaagcccattagcacttcgcgcaagctcacgagacacgtgacaagctcatggcttcccatccggaactagctgaagaaggggctatcaaaattgttgtaatcaaa

SEQ ID NO: 8810 - DNA, 427 bp, Gossypium hirsutum
  Clone ID: uC-gsronu33B179f08b1
tttttcgcgtccgcaacaaacaagacaaccacaaaggtttcaacatcagttacaacaaaaggtaaagtgaaacgcaagcctataactgctttctttggcacctgcatgtgttgtgcaactgtgacaaattaatcaaataaacaccattgaagaccctttttttttccttttgtttttgcttgggttaagttgggttggttttattattattattattattattattattattattatttaattgaagctttgaaaaatggagttttgtgagagatgtgaattgtaactatggttgtattttttttctcccttttttgggtttcttattgaatttgtataaaagatgggggtttgatgatgtaaaagtaaaacttgggcaatatttatttttgctgcctttgattgtaatatttgcttaatttatatg

SEQ ID NO: 8811 - DNA, 534 bp, Gossypium hirsutum
  Clone ID: uC-gsronu33B179f09b1
ttctatcgcgtccgaacaaattttgagagagaggtagatccgatggggaggtcgagaaggaaatacaaacaatctcgtgccaaggtcaaagtgggtctccccaggaaaaaccctcacgtctttaagccatgcttcactcttcctcccaagctccgttcactcgccaacgtcgacgatgccctctccaagtgggacgacaaagccagcgtcatccaaaactacaagtcctttgggatcgtttctaaccctaactacctcggcgttcgttctcgtacttcccacatcgtggagagcgattcactccaagtccctcattctccgccttctgatgaaccggctgatgaattcgagcccattgattcgggcagcgatctcgaagaggatgacttaaaaacagcacttgggaagaagcgaagagatggaaaaagcagacatttacagccactgaccaccatgcaacgtctttacatcggccagctgattgagaaatatggcgatgactaccaggcaatgttcatggatgtaaaattaaat

SEQ ID NO: 8812 - DNA, 385 bp, Gossypium hirsutum
  unsure (1)..(385): unsure at all n locations
  Clone ID: uC-gsronu33B179f10b1
tctttgtctgtcggctcagaagccgacgaggtgcaggccgagcgccgccgtggccccgtcgctccggccaccgtacacggtggccagaaatcgcctcaggtacaagtgggcggtggcacagtggcggtgcttgcaggagatgtgactggggcggtgggatgggaccgatggcagaggcagcagcagtttggggggctagggtttattattttttgtgttaaggtttttttgggctgtaattgttttgggttgggctaggttatttgtttagtttgggtttggnggattttgggcccaaaattgggcttgtacacataccgaattgaataacttggtgacaggatgaaaattacattntatatatgaaataactaacttctntatt

SEQ ID NO: 8813 - DNA, 335 bp, Gossypium hirsutum
  Clone ID: uC-gsronu33B179h01b1
cggactcttgggaaaaaaaaaaaaaaaaaaaaggggggggatatgacaactggtgtgggggaaaaccttaccttggttatacggagaagacaaccatgtcttctgaccgtcatttacggaattgcgccagcgaagatgacctttgagggaccatagatgagcactactgaatcatgacatggttgcatgtgtggatcaaactgcttttgggattcatgcaactgttgaaaagctcgattaaagccatatattataaaaaaacgaaagcggaaaaaataacaggcctctgacctgatatattatcaaggatggatgcctggaaggtctataattat

SEQ ID NO: 8814 - DNA, 297 bp, Gossypium hirsutum
  Clone ID: uC-gsronu33B179h03b1
ataattaccaatatatacaaaatgtgggggcatttattaaaaccaggtgggataactataaaagtcaaccattataaaaatataacagctcatgctctttcggcatgattcatatttaaatcatatcctcaattaacaaccaggcatttaagaggcgggctaccggtccatattcacaaccatggcatttgcagcatgctaagtcctcattgctaccaggactcacgagcctatctaggatctccctaggtctttatatgttaaggtagcgaacactaacgacttattctcaaacca

SEQ ID NO: 8815 - DNA, 429 bp, Gossypium hirsutum
  Clone ID: uC-gsronu33B179h08b1
ttctactcgtccgggaagggcttatcccttggggtgacattgttatagtccagggcgagagctgaaaacaagatcacgttttaccaacatggttcaacgagtcaccctcggcttcttacatgagactccccaccggagattctgatcgcttccaaatatccgatgatcgaatctttgaatcagataattatgggaaggtttccacttcatcatcatcatcatcatcatcttccatggttgctccttctgctagtactaagattattttatcaaccggagttcaatctcctgctggctgtcgtttgactcctcgccgcgtcgttacatgaaaccatcgcatacttatggggtaatctagggtctgggaatttcatgtatgtagaaaaaatatatgtatttctggttacgtaaatcattatcgatggggac

SEQ ID NO: 8816 - DNA, 511 bp, Gossypium hirsutum
  Clone ID: uC-gsronu33B179h10b1
gcgtcaggcacggccaccggcggggggggagtctttgttagccaatgatgcttcctccgacgacgatgaaccccaacaaatcactcaccctcctcctcctcctcctcctaaagtttcctctctccctcaacccaaatcttcttcccttttcactaatcttccgcagcctaaacaatccctcaaatccttcacaaaacaccacgacgaagacggaaacggcggtggaggaggtgaagtagctgttcgtgttcccaaacctgctgttcctcatcccaaaaacccatccaatcttttctctcatcttccccaacccaaaccacaacagccacccaatcctcctgtcgccaaaagaatcgttcaattcaagcctcctataaaccccaatacccacgtggattccgacgatgacgacgaggaggagaacgaaaggccaaagcggggagaatccgaaaccctagctcaaggtccttccgtgaaatcctttctatcaagcatacctgctcccaggaac

SEQ ID NO: 8817 - DNA, 427 bp, Gossypium hirsutum
  Clone ID: uC-gsronu33b023a01b1
caaatcgtgtctatgttggtaacgggggatggtgtgttgatgatatggcactcaagaccttgttcagtgagcaaggcagggttgtggaagcaaaagtcgtttatgacagggaaagcggtagatcaaggggttttggctttgtaacttacagatctgccgatgaggtcaacagtgccattaaatccttgaatggttgtgatttggatggaagaccaattcgggtcactgtagcagagtctaggccaaggcgccaattttgagtgcggatatttcctactgatgctgctaaaattttttggggacgcctaaaatatgcagccggaagctggcaaatgcagtatttttctgtttgcgggattctgctcggctgcatttggacgttatgggtgaacctggtggtttttaactaggaaaagctgataatatc

SEQ ID NO: 8818 - DNA, 355 bp, Gossypium hirsutum
  Clone ID: uC-gsronu33b023a02b1
ttgttctccgtggcgctttcatgagcgatgaacctgtgggtcttatttaggggcgcagaagggcgggcctaaaatacccaaagcccagcttatgatggtactttttcagccactccagacccgacaattgggaacagtacctacgaaccaataagatgccggcgtttagattgtgaagcccttctaggtaaactatctttagaggatcgatttcctttttgatacctctatgtgatatttcttcggttatctcagcctgaatggaatggaccacccgcgtggtactcctttaaaagcattttgggccattgcactgagaagcttatacgaatacctgttaggttttccttcttgg

SEQ ID NO: 8819 - DNA, 231 bp, Gossypium hirsutum
  Clone ID: uC-gsronu33b023a03b1
tttttttggttgttgaggtagtagattcattgggtgatttgagaagtgaatgtgggacgcttaaaaaagatgattcttcgcgtttgcaacagcatagttctttttccttagcctcaccacaactggcatgagccatattgggagcctggatgctggctactggctatggctcctgtctcatcttaagtgtcttgaaaattctataatatataatgctgagtggattttctt

SEQ ID NO: 8820 - DNA, 380 bp, Gossypium hirsutum
  Clone ID: uC-gsronu33b023a05b1
ttttcgcgtccgcccacgcgtcctaccacggggggaattttggagagagacccgaaaacaatgtctaaggaagttagtgaagaaggacagggtccgaaggactatgtggaccctccaccggcacctctgattgacatggctgaactcaagtcatggtctttttacagagccctcatagctgagttcatagccactctcctcttcctctatgacactggtgctactgtaattggtcacaagaaacaacaagatgcattgtgatggtgctggtctcttgggtattgcatgggctttcggcggaatgaactttatccttggttactgcactgccgggatcttaaggggacacaattaaccctgcggggacttttggggtgttt

SEQ ID NO: 8821 - DNA, 347 bp, Gossypium hirsutum
  Clone ID: uC-gsronu33b023a06b1
attttaccatgcttccgtgtgaaggaaggggagcatgtcattattgggcaatgcaggccgttgtcgaagaccgtgaggttcaatgttttgaaagtgattccagcaggatcttccggtggtgggaagaaagctttcaccggaatgtaagcttttctatggtagtccatggttataggaaccaatagagaagataatcaaagaaattaagttcttaaactgcatttagctttgaggatattttactgttagaattgttttctttttttgggttattttcttgttttgatttttgtcgaattaccaaattcggaattttgaaagatatctttatttaattttggctttgg

SEQ ID NO: 8822 - DNA, 498 bp, Gossypium hirsutum
  Clone ID: uC-gsronu33b023a08b1
tctttagatgagttgtggggcagcaactgtacggcagggtaagaggaaaggggcctgctttaccatcgactgttctaagccggttgaagataagatcatggacatagcctctctagaaaagttcctccaggaaaggatcaaggtcggtggcaaagccggtgctctcggcgattccgtcactgtcacccgcgacaagagcaaaatcactgtctcctccgactccaacttctctaagcggtatcttaagtacttgactaagaagtacttgaagaagcacaatgttcgggattggcttccagggatttcttccaacaaggatcggaccgtttacgagctccgatacttcaacattgcggagaatgagggtgaggaggaagagtgaagaccgggtccagctttttctttattcaatacccctttggttgggtattctgtatgaggaccctagtttataaatctcaggggtcgaatctttggacttgatttgggttgtttttg

SEQ ID NO: 8823 - DNA, 437 bp, Gossypium hirsutum
  Clone ID: uC-gsronu33b023a09b1
tttgtatcgcaatctctgtgacggatcagggcaagctgaaaccagcactggcgaagaaacgctactcttcactacagccgtcaacaccatgcggtggccggcggtgaaaagtggggggctgggggtggttgcgatgacatacgtggcggtagactatttacgcatcctatccccaacgtggcacgagcgtcttcaacccgtactctggtctttactcgccccttgtcgccgtcacgcgcgtccccttttaccgttactggagcgccgtgtttccagctgccatctttttccttgcttcgatgactattatgctcttcagcttttttttttgaagcctgcacagttcgttccgatgccgttgctcttggactcacatggcccaatggtaggcctccttttcctgatactggtcaatggttgctcctggcactaaatgg

SEQ ID NO: 8824 - DNA, 154 bp, Gossypium hirsutum
  Clone ID: uC-gsronu33b023a10b1
tcttttgcctttgtcattttaactaaataagggcgattactttagtatgtatcagcaaatcttcatgaggatttggttcttacattatgtgtaatgtggcttttctgctatgtcagaatgtattatgatatttaagaaagtttgttttctattg

SEQ ID NO: 8825 - DNA, 213 bp, Gossypium hirsutum
  Clone ID: uC-gsronu33b023a11b1
cacgcgtccgtaaagcactgcttaaggggggcatgatggcttgagagcgctatagagccctgatgtaatgcttcgtgtttttacttatttcaccttttaatttcaaaaactatagacactgttggtttggtttttgctgaattgagctgtctctgtcaattggattgcgattgcttgtaatcaggaaccgttcattgttttttactaacaata

SEQ ID NO: 8826 - DNA, 484 bp, Gossypium hirsutum
  Clone ID: uC-gsronu33b023a12b1
tgtactagatcgcgggcggacgaccttagggggttattaaatagtaaaaaaattttataaaaaaataaaaaatgggaaaaaaataaataataaataaaaattaaaaaaaatataaactatactataataaaaaaaataaaaaatatacaaaataaaaaataaaaaattataaataaataaaaaataaaaaaactttaaatatataaaaattaattataaatatatataaaaaaaattaaataaataaattaaaaaaacaaaatattataaaataaaaacaattaaaaacaattaaaaatataatcaattttaacaaaattcataataattaaaaaaaaaaaaaaaaaaattaataaaatttaaataataaaaaaaatataaaaaaatataaaaataataataaataaattaaaaaaaatatttaataaaatgaaacaaatatattaaaaaaaacaaaataaaaaacttattatatataaattta

SEQ ID NO: 8827 - DNA, 412 bp, Gossypium hirsutum
  Clone ID: uC-gsronu33b023b01b1
ttcacgcgtccgatctggaggagaacgtgggggaagggcaactgtatgatctgtttggccaagttggaactgttctttccgttagagtttgtagggatcagaataagcgatcttctctaggttatgcttacgtcaattacagcaattaccaagacgctgcacatgccaaggaaatgtttaacttcactcccattaatggaaaacctatgagaattatgttttctcaacgcgatcctattattcgtaggactggatatgccaatgtctttatcaagaacctggacccagctattgataacaaggcattgtatgacattttcgctgccttcgggaatgtactttcttgcaaggttgctactgatagaaatgggcaagcaaaaggattcggcttatgttcagtttgaaaatgatg

SEQ ID NO: 8828 - DNA, 453 bp, Gossypium hirsutum
  Clone ID: uC-gsronu33b023b02b1
tttatcgcgtccggaggctatatcctgcctgggggaggcagagaacatgttctgtgatattggaaggctcagcatggctgccaagtattataaggaaattgctgaattatatgagtctgaacagaacactgagcaggccattgactattatgaaaaggcagctgatttcttccaaaatgaagatatatcaacctctgccaaccaatgcaagcagaaagttgcacaatttgctgctcagatagaacaatactagaaagctgttgagatctatgaagatatagcacggcagtcactttccaataacttgctgaagtatggagctaaaggacatcttttaaatgctggcatttgtcaactgtgcaaaggcgatgttgttgcaaccaccaatgccttaaagcggtatcaggaactggatccaactttttttgaaccccagaatataaattttagctg

SEQ ID NO: 8829 - DNA, 334 bp, Gossypium hirsutum
  Clone ID: uC-gsronu33b023b03b1
tttttgcgtccgagatttcattatcgttaaggggccccatttgataggaaagagggtaaaagagtagtaatctaatggttgaaattcatgcatacgatcatatcgatgtatgctatatgttcttggtcgagtcattagattagacgtgttcctttcaattttcctttactttccttcttaccaaacagagtgttagtgtttgtggcggcaagtggtggcttggcggcttggcggctttggtatttggttgaattcttcattgtacattcatttccatcattttatgtataatttttcattgcacctctttgaggcattgaagatggaaaagctc

SEQ ID NO: 8830 - DNA, 254 bp, Gossypium hirsutum
  Clone ID: uC-gsronu33b023b05b1
tttaatttcaattcaaacatgggtttgatgggggcttcatggtctgagaaatgtttaccatccgaaaagcgggaaaaacggagtctttgtctaaagaaatgcgttgagaaagggtggatgtatagaacctttcaacgagatagtgctttttcaactctctcaaaacggaatctattccaaacatatatgccatggttccttacttagacagggtacaaatatctaaattctgatatttgtagatactttttcag

SEQ ID NO: 8831 - DNA, 392 bp, Gossypium hirsutum
  Clone ID: uC-gsronu33b023b06b1
ttttatccagctaaattcctgaggaagctgggggaataagagatagcgtttggttcccagtcagccaccaattataccaaccttgcacaggtacatgctgctgagaatgcaaaaccctttgatgaaattgaatttgagaaagttcttcgcaagaagtttgcgaagagggatgaagagtatgactcaatgctgggcattgtccgtgaaactccaccagaactaattcttccagacaatgtcctaccagataaagagcaaaagtcctctgaaaaatgatcttttttttatttattaggcgcttttttatttgcttcaaaaggttttggggatttggcttcaagaaaaattggtggtttggttcaagtacatggcaagggattgatttttctttt

SEQ ID NO: 8832 - DNA, 221 bp, Gossypium hirsutum
  Clone ID: uC-gsronu33b023b08b1
tgtactcctgggtttcgattcaaatccggggtcttattaatggggttttgagtgtaacaactcattaacccaattccacacttttacccacaaaacctctcttatagccagttatttcctcttgggaacagcctccggttgtatcttcctcactctctccctactgtttactcccttctctatgtgtgtctcttctttatccttctctacgccatcaccat

SEQ ID NO: 8833 - DNA, 197 bp, Gossypium hirsutum
  Clone ID: uC-gsronu33b023b09b1
tcgtgctgaggagctacaaaatcaaatggagggggattatgacatcggatcagcagttcggtacatgattattccacatgctgtgtcatggtttacaggagaagctatccagggagatgagcttgatatagatgacgatgaagaagatgacgatgatgatgatgaggaagaggatgatgaggaagaggttgatgatt

SEQ ID NO: 8834 - DNA, 56 bp, Gossypium hirsutum
  Clone ID: uC-gsronu33b023b11b1
tctataaaaaataaaaaaaaaaaaaaaaaagggggctttttaaaattatacgtctt

SEQ ID NO: 8835 - DNA, 328 bp, Gossypium hirsutum
  Clone ID: uC-gsronu33b023b12b1
atactcctttcatttccttctctccactgggacaagattgaagaaaacccttaaacctctttgccttttttttttcgtttcattttcgacgaaataacaatgagggaaatccttcacgtgcaaggaggccaatgcgggaaccaaatcggatccaagttttgggaagtgatctgcgacgagcacggggttgatcctaccggaaagtacaatggagatggatcatccgatatccaactggagcggatcgatgtgtattacaacgaggcttccggtggaaggtacgtccctcgggcggttctcatggatcttgaccccggtaccatggata

SEQ ID NO: 8836 - DNA, 259 bp, Gossypium hirsutum
  Clone ID: uC-gsronu33b023c02b1
tatctttcttgcgatttcctcagcctctctcacgcttccttattataaccaattggttggtagcaccttccaaagtgaaaggcgaaagcatctcattcgtaggctgtcttcaacttcttgttttctgtactttcgaggcttgcgtagggatatttttggccatcaattatgaaaatgtgatcccaatacttcctctaggaggctttgttcatcatcatgaactttttgcccgcattcttctcaacttcttcttcttcat

SEQ ID NO: 8837 - DNA, 371 bp, Gossypium hirsutum
  Clone ID: uC-gsronu33b023c05b1
atcttggatgcctttttactgcacttgcaggtggagacatataacttaagcaacccattcaaccacagttgggggtggtaggttccttagcaaccattatctatttatgatcttcttgtattaactcttttgtttgtcgtttatattttatcctttttttgttttttttatttttttctttgtttaactttttttttttttttttggtaaattttttgcattttttattgattttttcttatcttcatatttctttattgtcatttttcttttactttttttgtttttaaattcttttttattatcttattcttttcaattcattaatttttttcttccttcctttttgtagtatttattattatttcttt

SEQ ID NO: 8838 - DNA, 321 bp, Gossypium hirsutum
  Clone ID: uC-gsronu33b023c08b1
ttctgccacgtctttaccaccagaatgtgagcgatcactacaacaatcctcggaacgtcggttccttcgacaagaacgaccccaacgttggtaccggcctggtcggcgctcctgcttgcggtgatgttatgaagttgcaaatcaaaatcgacgaggattcgggcaaaatcgttgatgcttgctttaaaaccttcggttgtggctcggccattgcctcttcttctggtgctactgaatgggtgaaagggaaaagcatgcgccaagtgcttattattataaacacggatatctgtgaacattttatcactttctctcgtttag

SEQ ID NO: 8839 - DNA, 326 bp, Gossypium hirsutum
  Clone ID: uC-gsronu33b023c09b1
tcttttcacgcgtccgcccacgcgtccgaggggatggaattcatctatgatgggaaaacatgtatagtttttttgtgtaattacttgtatggtatttattatctaatctgtgatttatcgagcttggatgttcatgccgtgaaacttatcagtggttagattctggtaatttgataaattagattaaattcatcgatgctttcctttggcacatagaaaaccggtttaccatcctcttcatttcttgttaggctgtttaagtctttctgaattatcttttaacgtgaaatcttactgctatgttgctcaaattttttcgatttttt

SEQ ID NO: 8840 - DNA, 467 bp, Gossypium hirsutum
  Clone ID: uC-gsronu33b023c11b1
ttcaagtaaagatatcatcttcaatcattgtgattttcccttctctcaattggctctgcccgaaaccctagaaattcaccctcccaatatcacaaaatcaaaagaacccccaattttctcaataaaaccctcccttttcccgagaaaatccttttcgatattaattaagaagggaattttaaagcccaatttcaggtttaaggaaattagaattttcttggggggcatatgtgggaaggttctattggaagcatcgaagccatcctcgtcgtcggcctcctccgttagcacgacaacgacttcgacgtccgtgacggagacagtgaatgggtctcaccagttcaagatcacggggtattccggtgtctaaaggtttgggggatcggaaaatacatagctttcaacacgttcatgtggggtgggtattttgtgggccgatctatttttatccccgagggaaagagccc

SEQ ID NO: 8841 - DNA, 423 bp, Gossypium hirsutum
  Clone ID: uC-gsronu33b023c12b1
tctttctcttctttcctcctagcccaaaaaggggaaaccctgtgtcctttctgtggctctttttcccgttcaatcatgtcttgcttcattagcaaatatgccgatgagttggctaaaaacgctgcttacattggaacccctggaaagggtatccttgctgctgatgaatccactggcaccatcggcaagcgtctttcaagcattaatgtagagaatgttgaagataacaggcgtgctctccgtgagctcctattcacaactccaggagctcttcagtacctcagtggggttattctctttgaggaaaccctttatcaaaaaaccgcttcgggcaagccctttgttgatgttttgaaggaagggtggggacctccctggcatcaagggccacaagggtacccgtttagcttaacggaaccaaat

SEQ ID NO: 8842 - DNA, 314 bp, Gossypium hirsutum
  Clone ID: uC-gsronu33b023d01b1
ttttacgcgttcgcccacgcgtcctcccacgcgtgcgttttttcggaattgaggggtggggatagcagtttgaagcatgaagtggaggaaaataagctgacctcgcccagcaccaccaccaagtaagtacatttccaagtacatgtatcagcttatttcgacagtacgagtttcactaatatgttttgcatattttttttgttagaaagataagattttagtttttactttgttcaaagaattgtatttatgatcgtagaggtctgaattaatgactgacatgaaaaatgtatttcaatttggattcttttctt

SEQ ID NO: 8843 - DNA, 184 bp, Gossypium hirsutum
  Clone ID: uC-gsronu33b023d02b1
tttttatcttcccggaagccattgctctcgggggtgcttgtggcatatcgacggcaagggatcggattctggcagcagccatgaatgttctggctgtagtgacaagcacaatcgccatttcttctaacatatatagccttataacaggaaatcagtcaagacgtgtatatagactctttttcgc

SEQ ID NO: 8844 - DNA, 455 bp, Gossypium hirsutum
  Clone ID: uC-gsronu33b023d05b1
ttttgcccgtgttactgatggtcttcctctgggggagggactagatgatggtcgtgatctggtagatgctgaaatgtacaaacagcaagttaaggctttatttaagaatctctccaaaggccataatgaggcttcaaggatgtctattgaaaccggcccatatgtattccactatatcattgaaggacgtgtttgttacttgacaatgtgcgatcgatcttatcctaagaaacttgcctttcaatatctggaagacctcaagaatgaatttgagcgtgttaatggagctcaaattgaaactgttgccaggccttacgcctttataaaatttgacacattcatacagaagacaaaaaagtttgtccaggacacccgtactcaacggaatattgcaaagttgaatgatgaactctattaatttaccaaataatgacttgcaatgtacaagaagttct

SEQ ID NO: 8845 - DNA, 169 bp, Gossypium hirsutum
  Clone ID: uC-gsronu33b023d06b1
tatatacttgttggctgaatatacatattggtgtgtttttagaaacatccacgggtttctacataaccgacgaatccacacaaccaactctcaccttagaatacacactttgtgaatacgccctccttaactaaggagcttgcaaatagcaacctcaccaacccttact

SEQ ID NO: 8846 - DNA, 384 bp, Gossypium hirsutum
  Clone ID: uC-gsronu33b023d08b1
tctttcacgcgtacggactcattaaacatgggggtatttttagaaaagctggcttgcattttgccaagcttatcttatttataatattataaaggtacgattatttttaccattttacaaaaaaagctccataaatgttcctctcttgagtacacccaccctttctctctcgcttgtcttttcccctacctttcatttgcttattcaaacgattgtgcaaacttattaacgttccttataacaagaagaagatgtagaagcatagctacagaacaagtggaagaagaaaagaaggaaaacatttttcagtgcttcatttagatgatactagcaggttgcacctagaaacagaataagctgggccttttattggcccttgaattg

SEQ ID NO: 8847 - DNA, 251 bp, Gossypium hirsutum
  Clone ID: uC-gsronu33b023d09b1
tttggccattatacaattggcaaagacaggggggatctttggtgggatcgtagccaaaaacttgctgataactgaactgggctccaaggcttcttggtttacaatgctgttggtggtggtactggttctggacatggatctctcatataggagcgtctctatgttgactatggaaagaagtctaaacattggattcactgtctatcccttaacctaaggttttctacatcagtgcgtagagccttacaaca

SEQ ID NO: 8848 - DNA, 340 bp, Gossypium hirsutum
  Clone ID: uC-gsronu33b023d10b1
tttttggaaggaatcccaccagaccagcagggggtgatttttgctgggaagcagcttgaaaatgggaggacccttgcagattacaacatccagaaggaatccactttgcacctggtccttcgcctccgcggtggcttttaagtgtggtgccgaacacctgtccagatattgttgatgtgttaagtttgtatgtgtgtgggtcgtatgctaatgtgagctggccactaggctggggaagcttacgagtaaaaataattgcttttatcaacgcttttagttgttctttaggtttcaaggttctatggcattgaataaatatggttttgcattttgcagtcat

SEQ ID NO: 8849 - DNA, 532 bp, Gossypium hirsutum
  Clone ID: uC-gsronu33b023d11b1
tcttataatcatgtttgtgttgttataggtcttggtaaattgtttgattaagtaagaccatgattatgttatatacttgcattacaattgtaaggcaactaatgaattaattattaatcgtatttaaattgtaattaattgacacaatacttaatcagttcatgtttaatcttctaaggtagctgagggttaaattagcgacggtattaaacggtatattagccttgtataacttgcaagattattgtgattaaactgtttcaatgtaggaatatattgttacttcacttaatcttttacttgcttatttaaattgattaattatttgaattggttttgtaatatattcaagagattagttaatttagtaagtttgtatgtgctatagttaacaaattactaagttgccattaatttattcgtaacaacatgaaccatggcttgataatattaagttacgaaatgtaattgatctaacacaattatgtcatattgaataaaaacaatttttgaaattatgctttggaatttt

SEQ ID NO: 8850 - DNA, 171 bp, Gossypium hirsutum
  Clone ID: uC-gsronu33b023d12b1
ttacaatgtgtttgatctgaagtgttttgagtgaaattgatgagatatgagagtgggagaaggatgaactctgtattttgttgtatggtgaagtagctaacttctgcaattagtttgtttattcatatgcttagcatatggtaatgtaatctgcagttgcttcttattcac

SEQ ID NO: 8851 - DNA, 444 bp, Gossypium hirsutum
  Clone ID: uC-gsronu33b023e01b1
tttttactctggatacagacaactatattagggcaatgcgggtctttggtggtgatccaatttggactccgtacaatcgttcgcacgatcatcttcctgcaaggaaggagtatatcaagaactttttgcgggaggaaggtggtggccaagccgttgatgctgccgcataaaatcaacattcatctggtggtggccaagtcgttgatgctgccgcataaaatcagcattcatctctggtatcgcgtcttataaaatatgaaaccccggatttgtggtaataaataagtctaggcttgtctgcttttgatgcgtggatattggatcgctatgggtggtgctttgctttaattgcctatttcctattcaaaattcccaaacctgctttggatttctacattttatgggcttactaccagatttggcttttattatcaaagttacatt

SEQ ID NO: 8852 - DNA, 413 bp, Gossypium hirsutum
  Clone ID: uC-gsronu33b023e02b1
tttttactgcttcagtggcacaacgtgccttgcgttatattgctgtgaagttgaagaggctattcgattctcttacacatagtaagttgtatgtttgtatggttactggtttggagcctgattctgttgatgacgctttcagatacgccagagaaatccttaagtgggattacaacgacaatagcttcatcagcaccgagttctccactactacccatattgaggcaagcacaacttcatgacccacgttttgtgtgtgcgtgtgtgctctaaatcacagaactcaattctaaagcagggcaagcacttctttctttggatttactagattttcaatatgtaagtatgtattgtatgtattgttgtaactcgaaaatcaattagaaaacactcaagcattactggatatgttt

SEQ ID NO: 8853 - DNA, 433 bp, Gossypium hirsutum
  unsure (1)..(433): unsure at all n locations
  Clone ID: uC-gsronu33b023e05b1
tttagaaaagaatggccatcatcacttacgagagactagaggactctgcttgtgagaggaacagacagttaccaccgtcttaaggaggccaaggattggggctggctatcggttcatagacatgattactgaacctcataggctaattcgtcggtgtgaagttacagctattctcattttgtatggtcttcctaggttactgacaggatctatcctggctcatgagatgatgcacgcttggcttaggcttaaaggttatccaaatctgagtccggaagttgaggaaggaatatgtcaggttttggcacatatgtggttggactctgagatctatgctgcagcgngaagtgatgcagcttcatcgtcatcctcgacatctgcatcttcttcttcatcatcatcaccataattattctttttcacataatcaaag

SEQ ID NO: 8854 - DNA, 192 bp, Gossypium hirsutum
  Clone ID: uC-gsronu33b023e06b1
ttttacccccttggttggcaaaatcaattgtgtgactttaaaaccttaccagctaatttaacataattcacttaacatgtctaccaccactgacacactacttaagccatttttactttaccctcctttcttaaaagcattgccattaacaagatcaccgaccactacttcatttgaagtatccccactcat

SEQ ID NO: 8855 - DNA, 410 bp, Gossypium hirsutum
  Clone ID: uC-gsronu33b023e07b1
ttctttctagatcgcgacggacgcccttttgggggttttttaactaggaacggggtaacctacacctaccttactacgacttacaccaagctaaatggtggcattggacgatttgtactattataggaaaaattcatagatacatttaaattatctattactaacgtctgctttcactattttttaaacttttaaatcacttaaaaaattaaattcttacattatttaagaataattattaaaaaaaagtggggcaattaaatctttcaacataggggttagaagcccgtattcttttactatataaaattaattaataaatttttaattaaatacaaccttatatatattttataaggagcattaccagatatatatagaaacagcaagtcgttgccctagtagcttta

SEQ ID NO: 8856 - DNA, 93 bp, Gossypium hirsutum
  Clone ID: uC-gsronu33b023e08b1
ttttccacacttggaaatcttcatgctggggtgtctgtcaaagggatctgcagaatcttttgcgcagtttccgtataaaaagtactgttcact

SEQ ID NO: 8857 - DNA, 295 bp, Gossypium hirsutum
  Clone ID: uC-gsronu33b023e09b1
ttcacgcctccggtatgggaaaacctagggggccttttaggagcacgagggcggactgagagtcttcaaggctaacctgcgtcctgccaagcgccatcatgttctggaccccagagccgtccatggcgtcacaaagttttccgatttaactccatcggagttccgccgtcagtatctaggcttgaaaccgcttaagctcccagcccatgctcaaaaggctcctatccttcccactgacaacttaccggatgactttgactttcgtgaccaccgtgccctaactggcgttaaagac

SEQ ID NO: 8858 - DNA, 435 bp, Gossypium hirsutum
  Clone ID: uC-gsronu33b023e10b1
tttattgccccagcttccaacgctgccattgggggcagtgttgagataaaggacctgaggccttgcgtgaactatcttacgaaggggagcggaaaaccaccgtccgcttgttgtgcgggagcctccgctctggcatccgccgcctcgtcgtctgccgacaagaaggctgcttgtgaatgcatcaaatcagcgtctaagaatattaaacccaataaccaattagctcaggctcttccttctaattgtggaatcactttgcccgtcgccatttcaccaaatgtcgattgttccaaggttggttgagagcttggaagctgaaactgggagtgcttggatgggcatgaagtaattaaaaaactccatgatagaagctcaattgttttgcttatcaattaactggaaatcttccgtcttgcaatttggattcctttggtg

SEQ ID NO: 8859 - DNA, 460 bp, Gossypium hirsutum
  Clone ID: uC-gsronu33b023e11b1
tttaaggagtccgtgacaaggtggagatagggggatgactgttgaagacccaaggaatgcattgtggtgaaaaactgtgtattttttttatttattttctagaaatagaaccatggaaaccttggctaataattttattttaattacccatctccttatatatctgttttataattaatatttatattatgttatattataagtttgatatatatatgtatgagaagatccatagttgatcgattaaaaaataagaagtgtggtaatgagaaaatacatatgttctattattcatttacttctttaggttattcgattactgtgagaagtgtcataatgagaaggtgcatatctagcattggctctgacaagaaaatacttgatttttaaatggtcaaaacttaccttcctttcttgggacttatctggtgcacattcacattcactttttgggttttcc

SEQ ID NO: 8860 - DNA, 353 bp, Gossypium hirsutum
  Clone ID: uC-gsronu33b023e12b1
tttggaggtggaggcggagaaagcagagcgggagcagtggcttggttggagaggcggatgcatcaccttaaagaagagacgacgatggttgaagctcggttagagaggatgtggcatgagcatgctgctttaaaagcacagttaaaagaattggggtatccgaagaagcataatagataaaattcttacatgtatagtctttttttacgaaggagtatttttcatagtaaatcatgaaaaatcagacatgcatttcatataattagtatatgtatgtagaagtctgtaattgaaatcatataaactgtttggttgataatgaatgaatgaaataggggttggaattcacaaat

SEQ ID NO: 8861 - DNA, 261 bp, Gossypium hirsutum
  Clone ID: uC-gsronu33b023f02b1
ttgtattcgatcggatgaccccattgaattgggggaagacaaccctttaacctgccgtgaaacaaaagctgaaagctaaagaactggctgaagatgatcttacctaagagagctcttcaacgagagaggcgcctatagagctcactatttcatttaaatggtgattgctatggtgaatgcgtctgtgtacaattatgctcccaattctcttccttataacaatcattatcacaaatgtttcacttgatgggccttaaattt

SEQ ID NO: 8862 - DNA, 254 bp, Gossypium hirsutum
  Clone ID: uC-gsronu33b023f03b1
tttacgcgttcgaaggttatccctcttagggtgccccgtctgttaccaatgacttgtagtagaagatcttacatttcagttcgtagaagttgctttcttcatttactcatcagtcagcaagtataaaagagaaggctcgaacaaagactgcaaaaatgtcttgccaattgcaacaacatgttgagtgttgaatttgaagatgataggaaagtttcttaccacaagaaggttgtttttctttttttttgccgggg

SEQ ID NO: 8863 - DNA, 510 bp, Gossypium hirsutum
  Clone ID: uC-gsronu33b023f05b1
tttactcgtccggggaaagaagaagaagggggggggtttatgaagagaagagggaagaaagaagaggacacctcagttccagtagagaagtgcgatgagccagtagtccagccagagacgccagagaagaaaggtttcctcgagaagatcaaggagaaacttcctggacaacacaagaaagctgaagaggccagtagcccggctccagccccagcagctgagccccatcacgaagaggtgtcaaaggaaaagaagggaattttggagaaaatcaaggagaagctttctggttaccactccaaatcagatgaagaaaaagaaaaggcttgagattcaagtttacataaaaatactgatgggattgtgttgtttcttaaattggtaaaaattatttgcttttgattttgaagatgtattttgtggatatttcatttttaaggttttttttttttccacatttttagttcaaatcattacggaaaaaaaagtttgttttcggttttaagaaat

SEQ ID NO: 8864 - DNA, 481 bp, Gossypium hirsutum
  Clone ID: uC-gsronu33b023f06b1
cctaactccttacgcgtcgccatgtcgcgattcatcagcagactgtgtgtaccaactccgccacgcctgatgaccacgatgatcgccgtcgtgctgacggtttcttctcagatctgcaggggcggcgccagggggccaaaaaagatgtgtttgatcctttgtctccaacaaggagcctgaacatgatggatcaagtcaaggggaatcgattttctctcacatcccgtgacatttcagggcttgggagcgaggccaaagaatcaaaccttcgcccgttatcttcctatcttcctaattataagccacaactttctgcgactctttcaattaccaacaggatctccggggttttcctaactactggacttttggtctcttatcttctttctctgaaaatggggttcaagtttgcttcacccttttgaattcctaccaacttttttttttttaacaaaacttgccccagttctcgtataattgt

SEQ ID NO: 8865 - DNA, 383 bp, Gossypium hirsutum
  Clone ID: uC-gsronu33b023f07b1
tctttcgtgtttgtctattgaattctttccgggggtttctcgagaaaaaaaaggtgtcttcaggttgcaattgcggatctagctgcagctgcggatctggctgcaattgcggtgagaactgctcaatgaaccttaaccttggatactcggagaagacaaccagcactcagaccatcatctccggagttgcgccagtgaagatgacctttgagggaccagagatgggcactactgaatcaggacatggatgcagctgtggatcaagctgcaaatgtaatccatgcacctgttgaaaagcttgatgaaagccatagattatgaaaaaagaaagcagcataattacaggccctctgtaatgatttattttcaaggatggatgcctg

SEQ ID NO: 8866 - DNA, 269 bp, Gossypium hirsutum
  Clone ID: uC-gsronu33b023f09b1
tatcattgaggaagctaggaagaggcttgggggccaaaatgctgcttgaacattaacacaagatatctagatatgtcttgctgctgtagtttattctggagttactagatttcttgcatttggttatgaagaaaattttgagaactattttcttcttgcaatcttaaattgttcggttgggtaatgttagtgaactttcaaggctatattttaaatgaatgcttggtataaaaagtcaccacatttaattctaaattataactcaccat

SEQ ID NO: 8867 - DNA, 423 bp, Gossypium hirsutum
  Clone ID: uC-gsronu33b023f11b1
tttgtctttcgctctcaaccctcgaccaagcgccaatcttcttcttcttcctttgcttggctactgagcagaattaggaggttttgatttgttggtctgagtttgggtttgggttaattactacaattgttttcaaattataatttgtgaataattatgagggaagaggattcgaattggttctctagatgggaggaagagctgccatctccggatgagcttatgcctctttcccaatccctaattactcctgatcttgctatggccttcgacattcgtaaccccaatcatcaccatgctcaacagcaacagtcctcagtacagcctgctccttctccacctttcgccggtgttcagccttctttttaacctaccttagctgaattcgccgctgattctggggacttgggatcccgggctgct

SEQ ID NO: 8868 - DNA, 417 bp, Gossypium hirsutum
  Clone ID: uC-gsronu33b023g01b1
gtccgcccacgcgtccgattcaggggtcatgtgtggctcctacagcatgtttttcacctcgtttcttttcatcaaaatccaaaaaggaccgaaaacccaagaatgaaatggggaaacaagtcagtccattgcctgagcttattgccgagccaaccaatgcgcggtccatgtcgtttgtgggaacccacgagtacttggcacctgaaattatcaaaggtgagggacatggcagtgcagttgattggtggacctttgggatcttcttgtacgaactattgtttggtaaaacttctttcaaagggtctgggaaccgggcaacactcttcaacgttgtagggcagcccctgagatttcctgaatcacccctcgtaagcttttcagccagagatttgaatagggtgcttgctagtcaaagag

SEQ ID NO: 8869 - DNA, 390 bp, Gossypium hirsutum
  Clone ID: uC-gsronu33b023g03b1
tttttcctctttctctctattcgaaatttgggggctctctcattttacgatatttcttagtgtgttttggatcgggaggttagaggtttatcatcaatggcggatactgagacgtttgcatttcaagctgagatcaatcagcttcttagtttgattatcaacactttctacagcaacaaggagatcttccttcgtgagcttatcagtaacgcctctgatgctttggataagatcaggttcgagagcttgacagacaagagcaagcttgatgcacagcctgagctctttattcatatttgttccagacaagaccaataacactctatcaatcattgatagtgggattggtatgaccaaggcttatttggtggacaatcttggtaccatcgc

SEQ ID NO: 8870 - DNA, 394 bp, Gossypium hirsutum
  Clone ID: uC-gsronu33b023g04b1
tttttacaaggacttttgaaagccggggaaggggagatcacagggagatgggggtggaaccagagtttcccggccgggaccgactcgtcttataagaccatcaaggtccagctttgctatgcacccatcagccaagtcgaccgtgcatggcggaaaaccgaggaccatcttaacaaagacaagacatgccagttcaagatcgtcaagaaaccctacaccaacttcaactaaacccttgaatggaccatcgaacgagacgtgccgacggcgacgttctttattcgagcctactctttggactccgacgaccacgaggtggcgtacggtcaaaacaccgactcctagaagaaaaccaatttgttttaaatccaaaccatcaccggccgccatgttt

SEQ ID NO: 8871 - DNA, 394 bp, Gossypium hirsutum
  Clone ID: uC-gsronu33b023g05b1
tgttattttgccttttcgctatcgtctttgggggtcaactccacggcgcagaggcgaggagtctctatttctcaatccaaacaaccgctctaaacactctcttcttttattgctcctactcttccagtcatggcaggtttggcaccagaaggatcccaatttgatgctcgtcaatatgaccagaaaatgactgagctgctccagaccgatggagatgactttttcacaagttatgatgaagtttatgacagttttgatgcaatgggacttcaagagaaccttctgaggggtatctatgcatatggttttgagaagccttctgctattcagcaaagaggaattgtaccattttgcaaggggcttgatgtgattcaacaggcacaatccggaactg

SEQ ID NO: 8872 - DNA, 384 bp, Gossypium hirsutum
  Clone ID: uC-gsronu33b023g06b1
actaactaaaaagagggggcctttctttgtttaacgctgaagattcctttaacaacaatggctccctcaatgtctactctaatggttgttctcgtcgctgtatgcgctctcatgggttccgccattgccgccgacgctccggctccgagccccacctctggtgccagctctatctcgccgccatttgtctctgtttccgtcgccgctgccgctatggctctgcttttcggatctagactttggatctgaatgatgctatctctggtgttcagatgatgctctgtttttcttttatatatgtattttttttcttcttgatttgattttgaatttggtttgcaattttagtagctgtggcagtggatctagggagtgattatatta

SEQ ID NO: 8873 - DNA, 344 bp, Gossypium hirsutum
  Clone ID: uC-gsronu33b023g08b1
tctttcttctcttctttcaactcaaagagggggtgcccaagtaatattagaatgcgatgggtgttgtcacttataactatgagtctacctctccagtcgcccctgccaggcttttcaaagctttttctcttgaagctgacaaggtttggcccaaggctgctcctcaggcagtcaagagcgttgaggttgaagctaatcctggccctggaagtattcgaaagatcaactttgctgaaggccttccattccaatatatgaagcaccagattggaggacatgacgacaagaatttgtcatacagttattagtttgatcgaaggtggacctttgggggacaagcttga

SEQ ID NO: 8874 - DNA, 469 bp, Gossypium hirsutum
  Clone ID: uC-gsronu33b023g09b1
tttttattccattctcttcgctctgcttgtggtgccactccagtcaatctgagagatcattgatctgtatgtgggtttcgcagtcttcactgctctgatccaggtggtttacatggctagtgtgggatcatttcctttcaactcttttctttctggagtgctttcttgtgttgggactgctgtccttgctgtttgtcttcgcattcaggtgaacaaggaaaacaaggaattcaaggatctaccacctgagagagcttttgcagattttgttctttgcaacttggtgctccatttggtgatcactgaatttccttggataaaatcataatttccaggttttgccggactgcgtgttttctcaggtttcgggcgggattcataattttagcatgaaactgaagtcttagatcatcattttgagcttgagcatacttccagaatctgggtaggaaattggatattttattct

SEQ ID NO: 8875 - DNA, 461 bp, Gossypium hirsutum
  Clone ID: uC-gsronu33b023g10b1
tagaaaaagcttaacctgccagtcctccgggggcacaaccatgggatccttgcctcaaactttggagctcaggagagttcgtcgtgaattcaaggctaacaagatctcagaggatgattatgttaaagccattaaagaggaaattaagaaagttgttgaccttcaagaagagcttgacattgatgtcctggttcatggagagcctgagagaaatgatatggttgagtactttggtgagcaattatctggttttgctttcactgttaacggatgggtgcaatcttatgggtctcgctgcgtcaagccaccaatcatctacggtgatgttagccgccccaaaccaatgactgttttctggtcatctactgcccaaagcatgactaaacgcccaatgaagggaatgcttacgggccctgtcaccattctcaactggtcctttggagaaaagatcaccgagatcg

SEQ ID NO: 8876 - DNA, 542 bp, Gossypium hirsutum
  Clone ID: uC-gsronu33b023g11b1
ttccacgcgtccgcccacgcgtccgcccacgggtccggtgggatctatattcccatctccaatgcactatgctggtccaactgaagtgcagtggcatgctaaggctcggattaatgccggagccaatttttacattgtcggtagagatccggctggaatgggtcatccggttgaaaagagagatttgtatgatgctgatcatgggaagaaggtcttgagcatggctcctggacttgagcggctgaacatccttcctttcagggttgctgcatatgataaaacccaaggtaaaatggcgttcttcgatccctcgagggctcaagacttcctcttcatattcaggcaccaagatgaggacattagcaaagaacaaagagaaccctcctccgggaattatgtgccctggcggctgggaagtgttggtcgaggattacgccagcttaacaccattggacaatgacagaataccgcaacccggtgctgcttagatgaattgaatttggagcaaacctcgaacactatttatcttcatcgcgtaatct

SEQ ID NO: 8877 - DNA, 373 bp, Gossypium hirsutum
  unsure (1)..(373): unsure at all n locations
  Clone ID: uC-gsronu33b023h01b1
agggtcctttcccgaactccgaattcnagggctggtcgatccctgcaacgatgaagaaaatgttcaatctatcgtccaacttcttgactcatagagatgcttgggccggcactttcgaacacgttgtcggagagctatcctctcctagaactgattgcccagagaagttaccggaagcagcactactgaggacaacagaagcaaacgaagacgctggtctctctgaatttcagagcgaggtggttcaactagccagggtgcttaatggtgaccactttttgagcagctttgccgaggagatgcgcacaaagatgagcgtaaaaggagcttatgagtacgtgaaaggcgccgtttcaaggtttataagagccag

SEQ ID NO: 8878 - DNA, 282 bp, Gossypium hirsutum
  Clone ID: uC-gsronu33b023h02b1
tgttttctattgccggattttaatctcacgcggtgcgcgtaaagctatggtagggggcccctcaactgcagccgccagatatgaacatctgcttaggagttagtgcttttgagcaccactgcattctggccctttccttgacccttttttacctacaacttaattctgacttttattacaaatttttactcttgctctcttataactgacttgaagtgattcgatctcaaagttaaataatgaaattttgaaaccacaagggtgtcccatccttcttttata

SEQ ID NO: 8879 - DNA, 320 bp, Gossypium hirsutum
  Clone ID: uC-gsronu33b023h03b1
tttttaagaagagatcgggtctagctaggcgagagcagaggatcgactgtgaggagtgccaccaccaaaagcatccgtagcagcagcagtggcagcggcagaagcctaccggagcatcagcactactcgccgcaggcataggagaagcggttgcttggcttttatcttccctaaaaaaaccaaagcattgcggtcaaaagaggccaatcctcagagttgagccatctttaaaaatggcgttcaacatgtaattatccttttcaaataatgttaaacgtttacggctcagtccatacacgagatttgttaaagcagagaaa

SEQ ID NO: 8880 - DNA, 321 bp, Gossypium hirsutum
  Clone ID: uC-gsronu33b023h05b1
tttttagtgttgaaaatctcgagaacaatgtgcagcggtgaactcgcctgtggttactcccagttgattctccacgacgatggaatctcaatcaccgccgagaagattgctacattggtgaaggcagcgaacttgagcgttgaatcttactggccaagccttttcgccaagctcctcgagaaagtcaacgtcgatgatctcatcaccagcgttggctccggtggtggtgctgcccctgttgccgttgctgctgcttctggtgcaactggcggcggtgctgctgcggcagcccctgctgttgtggagaaaaaggaagaatag

SEQ ID NO: 8881 - DNA, 321 bp, Gossypium hirsutum
  Clone ID: uC-gsronu33b023h07b1
ttatagcatccccaacttctgtatcagtcggaggtgtacatgcttcttcaaggagggaccgaaattcctcatttaaaatggtttgcagttgagggagaatacaatgttatggttatcgatcttcttggaccaagcctagaagatttgttcaactattgcaatcggaagtctttctttaaaaacagttttgatgcttgcagatcagttattaatcagagtttgtgtacatgccttctcgcgggtttattcatcgtgacataaagccccataactttttgatgggtctagggcgcaaagcaaattagggatacctaattgatt

SEQ ID NO: 8882 - DNA, 331 bp, Gossypium hirsutum
  Clone ID: uC-gsronu33b023h08b1
ttttaatctcaatctgtttcagtttacaactgtggggttcaaggttgtgttcggggtaaagcatgagcaagaagaaggagacttggaaaccaaaaacgaagagttttaaagcaagggtccatcggattaaactagatataggaaagataaaggaagatcaaagatgcataagagatgaacaaagggatatacgagaaaggtttgaagatgttaatcggcaatgcgatgcgctcagactggaaactgaagcgattgtgaagcaatcagctttgaatcggattcgacttggtattatgttgaatatcttaaaagctcgccaagtgggtgactt

SEQ ID NO: 8883 - DNA, 533 bp, Gossypium hirsutum
  Clone ID: uC-gsronu33b023h09b1
tttacctttagcttttctcagagatggcggggggaaggggcagtgcaagtcaggcgaccatgtccgcaattgcattgctattgtgcttaatggtttgcctggaaaccattgatgcagctacttacactgtcggtggctctaatggttggacttttaacacggctacttggccaaaagggaagcggttcagggccggcgacgtgctagtgttcaactacgatgcgactatccacaatgtagtagcagtgaacagacgagggtacactaattgtaccacacctgcaggtgcaaaagtgtacaactcagggaaagataagataaaactggtcaagggacttaacttttttatgtgcagcactgctggtcactgtgagtctggaatgaagattgcaataatgcagtgtgacacaaattattgccttctcttctaaataattggttgaatgggctactactttgtcgtctttgggtttaagttttaataaggggaatgggattccaactttttattttatttaaaattattgttaaca

SEQ ID NO: 8884 - DNA, 245 bp, Gossypium hirsutum
  Clone ID: uC-gsronu33b023h10b1
ttttgacgcgtgggcttttgagagcgtatgggggtgacacctatgaaataaccggcaaacaaattcaaatgtaagtacttacttttcatttcacttaaaattctcatatctaacacatacttgggcattatcatatgggatataattttttaaagatcaatttctgtaaatatgattatctaattgtcatttaaaaaaaaaaaaactactcttaaaccaatattctttaatacaaaatgataaat

SEQ ID NO: 8885 - DNA, 361 bp, Gossypium hirsutum
  Clone ID: uC-gsronu33b023h11b1
tttttgtctattgaattctttccttcactgggtgtataaaaagaaaatgtgggggaggttgcaattgcggatctaactgcagctgcggtgacaactgctcatgcagcaggaaccttaaccttggatactcggagaagacaaccagcactcagaccatcatcttcggagttgcgccagtaaagatgacctttgagggaccagagatgagcactactgaatcaggacatggatgcggttgtggatcaaactgcaaatgtaatccatgcaactgctgaaaagcttgatgaaagccatagattatgaaaaaagaaagcaggcaaataacaggcccttgtaatgatttatttttaaggatggatgc

SEQ ID NO: 8886 - DNA, 537 bp, Gossypium hirsutum
  Clone ID: uC-gsronu33b023h12b1
acagaagaacaatgatgggttctggaatcaaaatctcggctctgggtgttattatgcttctgctgttgattgccccagcttccaacgctgccatttcgtgcagtgttgtgataaaggacctgaggccttgcgtgaactatcttacgaaggggagcggaaaaccaccgtccgcttgttgtgcgggagcctccgctctggcatccgccgcctcgtcgtctgccgacaagaaggctgcttgtgaatgcatcaaatcagcgtctaagaatattaaacccaataaccaattagctcaggctcttccttttaattggggaatcactttgcccgtcgcccatttaccaaatgtcgattgttccaaggttggttgagagcttggaagctgaaactgggagtgcttggatggcctgaaagaattaaaaaactccctgatagaagcttaattggtttgcttataataaaccggaatcctccggtcttggaatttggattcctgggtgaataaaggttaatgctccctctccttgttttccttttttc

SEQ ID NO: 8887 - DNA, 321 bp, Gossypium hirsutum
  Clone ID: uC-gsronu33b025a02b1
tctactcgtacgggtatagttattttaagggggcgaatttaaattgccctatgtggaccacataacaactatataattccatgttaattgtattacacgctctaccaggtggtgttttcctttataagagcacttaaatgactaattgcaatgcagacgctatacttgaagttcaaaacattacaatatactcaccctagagaactccaaaatctgtaaactttgcagataaatgtgttatggcatactcaggaattcaagctgtcgtgagggcttaacaggggcggctgctttataggcactaggtttatcagccttagc

SEQ ID NO: 8888 - DNA, 525 bp, Gossypium hirsutum
  Clone ID: uC-gsronu33b025a03b1
ttttcgcgtccgagcccaccaaaataatgggcgcgtcgttggtgctatctctggtgattcagctttgtagtacttgcctcagctgccaactttaaccaagacatcgatgttacttggggtgatggcaggggcaagattctcgaaaacggaaaccttctcactctcaccctcgacaaattctccggctctggttttcaatccaagaaccaatatctgtttgggaagatcgatatgaacattaaactggtcccaggcaactctgctggcactgttaccacttactatcttcgttcggaagggtcgacatgggatgaaatcgacttcgaggtcttggggaacctaagcggagacccatacatagcccacaccaatgtatatacaccaggcaaaggtgacaaagagcaacaggtctacctttgggtcgaacccaccaaagactttcacaccttacttccttctttggaaccctcaaccaattattttttctggtgatgggacttcccttagagaggtcaagaacttgga

SEQ ID NO: 8889 - DNA, 500 bp, Gossypium hirsutum
  Clone ID: uC-gsronu33b025a04b1
tttatcttctatcagcttgctggtgttgttggggttgagatcaccggtgggcctgaaattccatttcatcctggaagagtggacaagcctcacccaccacctgagggtcgtcttcccaatgctactgagggagctgatcacttgaggcaggtgtttagtcatcaaatgggtcttagcgaccaggacattgttgctctttctggtggccacaccctgggaaggtgccacaaggagaggtctggatttgagggaccatggactaccaaccctcttatctttgacaactcttacttcaaggagctcttgactggagagaaggatggcctgttacagttgccaactgacaaagttctccttttcgaccctgttttccgtccattggccgacaaatatgcggctgatgaggatgcttttttgctgattacactgaagctcacctgaagctgtctgagctaggatttgctgatgcctaagctgatgattgccaaaataggaagaag

SEQ ID NO: 8890 - DNA, 311 bp, Gossypium hirsutum
  Clone ID: uC-gsronu33b025a05b1
ttttaagatttcgcaaattgcagcattgttgggaaagtttagcttcaagagacaaactacttccctttgtcaaaggtctcattgccaaatatcagcaagataatgctaaggcctaagccctcccaatgaacgcctgtcacaatgattgtcgcatgcaattcgccttttttgtatttgctgcttttgtgtgtaatgagctacttgctcttattttcgagtgaaaaaataaattaactcattgtacccttaaaaaaaaaacaactaactattaaaaaatcctatggagtaaattctattattttaataagaac

SEQ ID NO: 8891 - DNA, 89 bp, Gossypium hirsutum
  Clone ID: uC-gsronu33b025a06b1
tacccgtccccaattccccggtctttcccacccctcctttatatcccagaaccaggtgggttacatatggtgagtttttaaaggtacaa

SEQ ID NO: 8892 - DNA, 493 bp, Gossypium hirsutum
  Clone ID: uC-gsronu33b025a07b1
ttattcccaacccaccatgtcacctgcaggggccgccctctgcttcctcctgctcctcttctccacctcaaatgcacacaacatcacacgcatactcgccaaacaccctgagttctccaccttcaaccactacctcacactcactcacttggcttccgagatcaaccgacgcgaaaccattactgttctggccctcaacaatgctgccatgtcatccctcttgtctaaacaactctccctctacaccctcaagaatgtcctctctctccatgtcctcgtcgactactttggttccaagaagcttcaccagattaccaatggaactgctttgacttccaccatgttccaggctagtggcgccgctcctggttcctctggctacatcaacatcactgatcttaaaggcggaaaagtcggcttcggggctgaaaacaacgatggaaatatcgatgctgtctacgttaagtccgttgcagagatttcttacaacatc

SEQ ID NO: 8893 - DNA, 493 bp, Gossypium hirsutum
  Clone ID: uC-gsronu33b025a08b1
tttcacgcgtacgttttgaccttttgttgggtcattagctttgattagtgggaaaagttccttgtatgtgcagtgagaacaaaggctaaagaaaatggaagtgggtcagatgcagagaagattggtggactacacaaaatccttgtttatggagggtttcttggatgctcagtttttgcagcttcaacagcttcaagatgagagcaacccagattttgttgttgaagttgtgtctcttttctttgatgattcagagaaacttcttaatgatctcaccatggctttagatcagccaaatgtagatttaaaaaaagttgatgctcatgttcatcaattgaagggtagcagttccagcattggtgcacagagagttaaaaatgcttgcattgctttttcgagcttttgcgaggagcagaacatcgatgcgacactgagatggtttaacaagtgaaacaagaagattaccttgtgaaagacaagcttgaaactatgc

SEQ ID NO: 8894 - DNA, 393 bp, Gossypium hirsutum
  Clone ID: uC-gsronu33b025a09b1
ttcacgcgtccggctgatttagtttaagagggcatttccttagagcataaaagaaaatttacgaacatgccgggtgtcaatcctgaaattgagttcccagccattgagttccgttcatcggatttgaagcgaggaaccgaagggtggaaccgtttgtgcaagagggttcaacgggcttgtgagactttcggttgtttcgaggtggtatacgaaaaggtatccacgaaacttcgagaggatgcgtttgggttgatgaaagaaatggttgagctcccagtggagacgaagcagaagaataatagtcccatgccttaccatggttgggttggaccttgcaagcaggtttctgtgttgtatgaaggctttggagttggagatgccttcaactatgac

SEQ ID NO: 8895 - DNA, 120 bp, Gossypium hirsutum
  Clone ID: uC-gsronu33b025a11b1
taattttcttttgatttaaagcttaaaaaggaaatttttaaggttttacgtgtccaatcaacaatggcttcctcaatgaattttttgatgcttcttttcctagatgtttttgctcttaat

SEQ ID NO: 8896 - DNA, 596 bp, Gossypium hirsutum
  Clone ID: uC-gsronu33b025b02b1
ttttacggaccctgcgccagaactttagtggggtcgtctaaagattggaacttagccaaaaagtatccattttcaatatccatgagatggaatggcttggcagtgttccaaagactgctaatacgattgttaagagcctcatagccaatgtttcttcctagtaatttcaatattaccgtgagttccatctctttgactaaaatattttgaatccgttcagagaagtcaatggaaggaataccattaacaacagatctgtgaatgtctccttctaaaaactcaagatcttcatcaacatctagactagaagacccatcttaccaacgtctattcctccagaattggttcctaaaagtttatccttccaggatatctttaggctcgatccagagtctttaccatctcagtgtctttttctccgattccacctttgaaccgtactttcttaagtcgaccatcagaattcgatcgagatccatcgccaccgcttactgcctaaggggggaaaacgttatcgggatcagagagaggttttccattttttattgaaaaaaaattgtttgaggatttatttttttaaaatggttaaattaatc

SEQ ID NO: 8897 - DNA, 383 bp, Gossypium hirsutum
  Clone ID: uC-gsronu33b025b03b1
tatatttgttgttgatggaaatgaaaatgagagtgatgttagggaattaaggttgaaatttaacagtatggatgatttcatcgatcattctatttgagttgctatagaattgaaaaccatgtgcagttcagatttagggaagtcattgatatcatagaacacaagtttatgatttgttgaactcggaatctgctatccacaatatcacttgcttttctccattttgttccagtaaaattttgggacttaattcaattactttcatttcttcatcttcttttctattttgcattaagtgtaatcttatatttatgaaaaatcttgactacccttatgaattgtttaccatatcttttcggcgaaagttagatatatcgagtttg

SEQ ID NO: 8898 - DNA, 540 bp, Gossypium hirsutum
  Clone ID: uC-gsronu33b025b04b1
tgtttacgcgtccgcttcttcttcttcaaacaagcgaaaaaacaagaggaaaaaaatgggtggagaaagaaaggtctacactttggctgaggtttctcaacacaaccatgctaaagactgttggcttgtcattgagggcaaggtatttgatgtgactaaattcttggaggaccaccctggtggtgatgatgtcttgctgtcttccacagggaaggatgcaactgatgattttgaagatgttggtcatagtagctagtgctcgagcaatgatggatgagttttatgtgggtgacatcgatacatcgaccatcccctctaagaggaagtacactcctccaaagcagcctcactacgaacaagacaagacctcagaatttgtcataaagcttctccaattccttgttcccctgctaatcttgggattggcctttggtgttcgctccataccaaaacaccagcttcatcttaagcattgagactccccaagagataatttgaacaattttacaataagatatgctagtttaaatttgttggaat

SEQ ID NO: 8899 - DNA, 333 bp, Gossypium hirsutum
  Clone ID: uC-gsronu33b025b05b1
tttatttgcgtttccagagccatgccgttcttggtcttcaggaagctgcagaagcataccttgtgggtctctttgaagacaccaacctgtgtgcgatccacgccaagcgtgttactataatgcccaaggacattcagttggctcgtaggatcaggggcgagcgtgcttaatttccaagtgtgttaatcacacacttagaatggagaaactattgtttgttgttaggcaaatgtgttgtactatttttttatgtttatttttaatcctcttttaggacaagattaaatgataggtttatcttagtgcgtaggttccaatgttatgatgaaatgg

SEQ ID NO: 8900 - DNA, 492 bp, Gossypium hirsutum
  Clone ID: uC-gsronu33b025b08b1
ttctgatgatataaacatcgaacacaggaggcacacttgtgagttcctccaatgtccttatagtgaactccaattgggttttcttgaccggactgccagggacaatcatcaactaacttgtccacatagaaactcgtctgcagagttcggtggttcgaattttaacataaatgatgtgaaaccggtcattttccctccaccatttgcgcaaccgaagccggcagcaccgtctattacttctgtttcaacaccattcgatctatcagggctcggagttccggaagatggacagaaaatgatcagtgacctcatgtcgatatacgacaacaatgttcaagccaacaagaatgcgagtcccattaaaaatccagtcacggaaggtcaaaatcttcttcagctgaaaacccaacagcaacaggacgagttctttccgtggtcaaggccttttcttctttaatgagtccaacatacccggcttataaccagatttta

SEQ ID NO: 8901 - DNA, 388 bp, Gossypium hirsutum
  Clone ID: uC-gsronu33b025b11b1
acgcgtccgatgagaacaatatcttgggatggagtgtaacaattattggacctcctgatacttcttatgaagggggatttttcaatggttatatgagttttccaccaaattatccaaacagcccttcaaacagtcaaatttacatcaaagatttggcatcctaaatgttatcctgatggggcggtttgcatatcaattcttcatccctcgggtgatgatccaaatggctatgagcttgcaagtgagcgctggatgccagtccatacagttgaaagtattggtttgagtatcatatcaatgctttccagccctaacgatgaatcccctgcgaatgttgaagctgcaaaagaatggagagagacaggagaagaattcaagaggaagggta

SEQ ID NO: 8902 - DNA, 462 bp, Gossypium hirsutum
  Clone ID: uC-gsronu33b025b12b1
ttgttgtctcatcctgatgcagaactgcggggggttgaaggtatctatcacaggatctacaagattttcccacctagtgagaagattgagaatataaatgaccagtactggacattacgggcagaagagattccagaagaagagaaaaatcttggtccaaatgatcgcctaattcatgtttaccacttcactaaagaaactgctcagaaccagatgcaaattctgaattttggagagccctttttcttggtgattcatgaaggtgagactttggctgaaataaaagtccgaatacaaaagaagctgcaagttcctgatgaggactttgctaagtggaagtttgcattcctctcacttggccggccggagtaccttcaagattctgatattgtatctagtcggtttcagagaccagatgtttatggtgcttgggagcactatcttgggcttgagcactctgac

SEQ ID NO: 8903 - DNA, 449 bp, Gossypium hirsutum
  Clone ID: uC-gsronu33b025c01b1
ttaccaaccaccaggctttatcagagacgtgagcagctgctgcaaccaagggcattacttcaaacccaagcttttgttctgccttagctgctgctctcacttcctttgttggaaataatggaagtggtggtggtactgcaagtgaactaggctttgcatcaagctgctacctgcagggaaaaaaacccttatccatggttaatcctcaccagcaacaaaagcagggttgcatgagaagaaagaagaaggctgtccacaagacaaccaccaccgacgacaaacgattgctgagcacccttaaaagaataggagtgaatgctattcctgcaattgaagaagtcaacatattcaaggatgaaggttggtatccagcttattaatccccaagttcaagcttttatttgctgctaacacctgggttgttagtggctcttctcagacaaagaatt

SEQ ID NO: 8904 - DNA, 440 bp, Gossypium hirsutum
  Clone ID: uC-gsronu33b025c03b1
tttttgaggtattgaaccatgggattccctgggattttatggacagagtggaaagcttgacgaaggagcattacaagaaatgcatggagcaaaggtttaaggaactggtggcaagcaaggcccttgagggtctccaggctgaggttactgatatggactgggaaagtactttctatttgcgccatctccctgaatcaaacatggctgaaatcccagatctaaccgatgaatacaggaaggtgatgaaagaatttgcattgaaattggagaaactagcagaggagctgctggacttgttctgtgagaaccttggtctagaaaaaggatatctgaaaaaggctttctacggggcaaaaggtcccacctttggcaccaaagttagcaactacccaccatgtcccaccccagacaaaatcaagggactcagagcccacacggac

SEQ ID NO: 8905 - DNA, 233 bp, Gossypium hirsutum
  Clone ID: uC-gsronu33b025c05b1
gttttgtgatatatataaaggaaggtgtgggcgagggaatcggtgagggtgccgctggagaagaaaaatgtggtctttttgggggatggaatgggtaaaaccatcattgcggttgctttaaatgcaaggatgcctggactcaccacttatgacactgctactggcggggttattcgggatggatattttacccccccctcttacaatcaggttccctgtattacatccccccc

SEQ ID NO: 8906 - DNA, 449 bp, Gossypium hirsutum
  Clone ID: uC-gsronu33b025c07b1
tgtccacgcgtacgcctaactttgtggatactgggttcacctacaactttccaaggccaacagcaccacctggtgcgcaaaggacatccttgaattagccgcgaatgaggtggttcatccctaaaggttcgtgctttgtattctacagctaccatatttgtggatgcagctgtcacaggtatttgaatgtcatatcatatttgttcaggcatacttgtctctgagtgatctgatcattatgtgttattgtgtttaatatatttaattatttatgacagattagatctatatgtatagagcgaaagaaagatggttgtagaatataggtgatttccatttcacagctaggcttagattgcctttctttttttgctctttcctaaacaatttgcatttgtgtgttgtggtttcacagggtacattattcacacccctttttgacatacctt

SEQ ID NO: 8907 - DNA, 439 bp, Gossypium hirsutum
  Clone ID: uC-gsronu33b025c08b1
tttcgaggtatatggaagcccgtttttatgggtggaacagattggcctagtcccttggcaaatttatccgtcgttctgcaacaaatcaaaaaatttattgctgccactggtgttgatgtcccaagccttgaaacagggggaagctctccggctatgcttcctttgcccttggctgctctcgttagcctcacgataacctataaacttgataaatcctctgagcgctcccttgtattacttggcccagcaatgagttccctaggtgggaagttgtccttggccatgtatgcccatcatatctgcactatgggctcagaaggttaagcggtggaatgatttccttgtattctcttctgcccgtactgtcttccaccacaacagcgatgctgtagttcaacttttaagagttgcttacggctactctcggattaagcccttc

SEQ ID NO: 8908 - DNA, 535 bp, Gossypium hirsutum
  unsure (1)..(535): unsure at all n locations
  Clone ID: uC-gsronu33b025c09b1
tgttttctagaagaatcagaaaaataaacagagagagggaaaaaaacaataaagagaaaaaatggatgaagaggagcatgaggtgtacggaggggaaatccccgacgaaggagagatggagggcgaattggaccctcagaacgccgacgtcgacatgtccgccgacgatgaagacgctgtcaaggaattggacgagatgaagaaacggttgaaggaaatggaagatgaagcggcggcactccgggaaatgcaggccaaagtcgagaaggaaatgggtgctgttcaagatcccgctggtgcaacagctaatcaggcgagcaaagaggaagcagattcacgatcagtttttgttggcaatgttgattatgcatgcacacctgaagaagtgcagcagcattttcattcttggggcactgtaaacagagtaaccattctgacagacnagtatgggcaacccgaaggatttgcttatgtagaggttcttgaagcagaatcttttcaagaagctcttgtgctgaatgaatttgaatacatg

SEQ ID NO: 8909 - DNA, 496 bp, Gossypium hirsutum
  unsure (1)..(496): unsure at all n locations
  Clone ID: uC-gsronu33b025c10b1
ttgtttactggttattactgtcctgtggtttatggcggttgccctgtgattcgagcactgacgtttaagagtaaccgaaggacgtttggtccgtatggagttgaagaaggaacacccttcgctttctccgtagagggagcgcgagtcgccgggttcaacgggagaagtggatggtatgttgattcaatcggatttcgattgtgtcgtgttcaatctcccaaactctttcagaaggtgcagaaaggatttcaaaggcttactagtagtgtctcaaaagcctctgtctagcctagagaggattgtcactcaaaaggccccttccattaatacctggaggtgctaaagttcatcatcaaaattatagcagcaaccaccttagagtttaaaatcaaacaatcttgaatgtatacagatatatatatatatatatagaccacgtcgggttntgttggctttcggattttatttgaggttataaagattggattaggggttt

SEQ ID NO: 8910 - DNA, 475 bp, Gossypium hirsutum
  Clone ID: uC-gsronu33b025c11b1
tcttccacgcgtccggccaaagatcttggggcggctgtataagcagagaacacgaaagatggcaatgaaaatcatcagcatggcagcacttgttgttgttgttttggcttcatccgtgttgcagagcacatatgctgcaaattacactgtgggtgacgccaccggttggacagtccctaaccctaataatactgaattctatgatgactggacagacaataagaacttcgtggtcggggatgttcttgagtttagttttacaaccggacgacatgatgttgccgaggtgactgaagctgcttacgacaactgcaacactacaaatcccatcgttcgatatactacaggaccggcgagtattacccttaacaggaccggtgaataccacttcatttgcactttcgacgggcactgtggcttaagccaaaagcttagcattgatgtcagaactggccccagcactgctcccacacct

SEQ ID NO: 8911 - DNA, 462 bp, Gossypium hirsutum
  Clone ID: uC-gsronu33b025c12b1
tctcccacgcgtccgcccacgcgtccgataagtgccaacaatcttaattttacggacccagattccggccactggtccatcggaatctgatccttcaatttttatttttatttattgttttacctttttaccctttaccaattttcccgcttattattttacccaaacaagtataaccccgttttctttaaaaaaagactagtggaaaatacggggcccctgttttatgtatttatttatatatttgtagtagattatttggtggtgacgtggcatgctccaaataaggcgcaacaatgaacaccaaaacgatgcgtctccctccccgtcgggtgcccgattccatgcccaacaacaaacgaaaagagagagacggttttgaccttaaaccccctaaccttttttctccgttctcgaaaccacccaatgccggcgcttcttccccgctttttttcaaccacc

SEQ ID NO: 8912 - DNA, 411 bp, Gossypium hirsutum
  Clone ID: uC-gsronu33b025d02b1
tttaaccttgactggcaagacaatcactctgggggtctagagctccgacacgatcgacaacgttaaagcgaagatccaagacaaggaaggcattcccccagaccagcaacgtctcatctttgccggaaaacaactcgaagacggccgtaccttggccgactacaacatccagaaggagtcaactctccaccttgtccttcgtttgcgcggcgggatgcaaatcttcgttaagacgcttaccggaaagacgatcactctcgaggtcgagagctctgacacgatcgacaacgtgaaagccaaaatccaagacaaggaaggcatcccgccagaccagcaacgtttcatcttcgccggaaagcaactcgaggacgggcggactttagccgattacaatatccagaaggaatcgac

SEQ ID NO: 8913 - DNA, 640 bp, Gossypium hirsutum
  unsure (1)..(640): unsure at all n locations
  Clone ID: uC-gsronu33b025d03b1
tctacgcgtccgcccacgcgtccgcggacgggggggttcggggactaccaaggacagtgaagtcgtgagggttcagtatgaccctaatgagtgtagctatgacactttgcttcatgtcttttgggctcgccatgatcctactaccctcaaccgccagggtaatgatgtggggacacagtacagatctgggatttacttttacagcccagagcaggagaaggcagcagtggaatccatggaaaaacagcagaaactcctcaacagaaagattgttactgaaattctgccggccaggaaattctatagagcagaggaatatcaccagcagtaccttgcaaagggaggtcgttttggttgtaaacaatctgctgagaaaggatgcaatgatcctatccgatgctatggctaagttgccactttttttgtatgaacttctgcttttgtctatggaattttaatgccttgnggtatctatggtggtactgaaggcggtggacttggaattattcataatttcaaggcagaccgatattatggtatgttttctacgggataggatggacatggatgttgactttaaatttgggatcatgtttaatttggaaaatacctactttttgggggaggtgtctcttttttc

SEQ ID NO: 8914 - DNA, 262 bp, Gossypium hirsutum
  Clone ID: uC-gsronu33b025d04b1
tttcccaaaaaaataccaaaagaaaattgggggtgatgtcaatagggtaatgtgttttttctctttttatacctaccttcactcctatatgatctggaattacagtggttaaactatttgtatgtatgtcttttaccctcctttatgaacccttttagcaaacatggtactaattgctggactaatttgtatttggcaataaactcgagtttatacattttgaataagaggaaacaaacaacaagatccataaaaaagtcag

SEQ ID NO: 8915 - DNA, 260 bp, Gossypium hirsutum
  Clone ID: uC-gsronu33b025d05b1
gtgtatacgaaaatttgaagaaaaaaatccatgacggatctaaggtccccaagggctattcaaatcgccggcgaaactttgatctggaaatctaaaaatgtcgtccacattcagcggcgatgaaactgctcctttttttggcttcctcggtgccgctgctgcccttgttttctcctgtatgggagctgtgtatgggaccgataacagcggtgttggcgtggtgtccatgggagtgattaggccggagctggtgatgaaat

SEQ ID NO: 8916 - DNA, 205 bp, Gossypium hirsutum
  Clone ID: uC-gsronu33b025d06b1
atgttaccgaatggaaactctcctttggagtgcggagttgagtcttccaaagcacaagatataagcgagttggctccacccgacccaaatggctacattgacttggacattaatttcctatcttgagtttctggcgagtctctctaattaagggaaccactcattcccctattactctcttgactgcactaaaaaatgttcattc

SEQ ID NO: 8917 - DNA, 407 bp, Gossypium hirsutum
  Clone ID: uC-gsronu33b025d07b1
tagaaaacaagcagaccaaaggtctccggggtcccccaaaagtctcattcggtccgccgctcaaccattgtttcaccaccttatcaatgggtgaaggcgcacaaaggcgccttaatgctctccggttggagcctagcctcaaaggccgttgattttagccccaaaatcccatcttcgactttgatgtcaacgaaggagatgaggatccctacggctcgtatgccaaggtactggtgcgtgtacggggatcgtgctggcgcttggcgtgaggagcaccgaggctggggcttctgaaacgttggggcgtacggaggcacgaagctgctgtccgattgttgttgcggcgcatgaaggaggagtgacctaaggttactgaagctgcttaacctttgagctgtttttggcct

SEQ ID NO: 8918 - DNA, 370 bp, Gossypium hirsutum
  Clone ID: uC-gsronu33b025d08b1
tctttcaatcttatgtaaagtactatgctcggggaacggtatagagtgcacggtggagacagttttagagtgcccatattttgcttgagggggatgtttcggcctttccgtatgttgaccctaccaggatcaagatatacatactaaggccaaatgatttaaaagaattggatggggctcttggcctactaaatctggatgcttctacaaaacaaatggatgctgctgatgcacaaactggaccaacagcctttaaaagtacaaagaggaaacgtccaatatctcttccactagcttttgttaagaagaaaaacaagaggtctgtcctacgaagactgtattgtaacgtttggcattcagcatagcattc

SEQ ID NO: 8919 - DNA, 457 bp, Gossypium hirsutum
  Clone ID: uC-gsronu33b025d09b1
tttttcacgcgtacgcttgatgggaagccgagtgaaatcgaaattgtgggaacagacattgccactcctactgcaccttcagcagctaatggcacctttggaagttcaaatggagcccctagaggtggccaaggcaggggtggaggattcggtaggcaacgtggtggtgctggaggtcgtggctttggaagaggccgtggacagggaaagggccgtggagaaaaggtttctgctgaagatcttgacgctgatctagagaagtatcattctgaagcaatgcagacaaactgaagcattttccatgttctattggttggttttaagtattttctactatggacatattgtgcttggtcctcgactattttgagtatctctaccaaaatcttactatttagaacaactagtcttggagagaactattagagtcttgattattggagttgggcttttactg

SEQ ID NO: 8920 - DNA, 409 bp, Gossypium hirsutum
  Clone ID: uC-gsronu33b025d11b1
tttttcacgcgtccgcccacgcgtccgccgacgggttcggaaatctgttaaggtgaggcctaacttggttgtttacaatactttgatagaggcaatggggagggcagggaaaccggggtttgcaaggaaccttttcgaggacttgattgagtctggtttaactccgaacgagaagactttaactgccattgcaaagatatacggcaaggcgaggtgggagaaagatgcactgaaattatgggaggaaatgaagtcgaaaaactggcctgttgattttattctgtataatactttgttaactatgtttgcagatatcggtttagttgaggaggcagagcagctctttattgacattgaagcgatcagagaattttaagccggatagttggatcttttcagtaaagaaaat

SEQ ID NO: 8921 - DNA, 448 bp, Gossypium hirsutum
  Clone ID: uC-gsronu33b025d12b1
tgttttttttttcgaattttggagcgaaagggggtggtaaatgcaagaaatgcacttgatcgaaggtggccgtttgtttaacggcggcggcggcgacggagggggaggagacagaaagttacgagcacaccaccaagcacttaagtgtccccgctgcgactcttccaacacgaagttttgttactacaataactacaacctctctcagccacgttatttctgcaagaactgccgtcgttactggacaaaaggaggcgtcctccgtaacgtccccgttggcggtggttgccgcaaagccaaacgctccaaaaccaaacctttttccgaaaccaccgttttcgccaccgccgtatttggactgtcacattcggagcaacaacaacgggaacaccaaaacagcgatcaacggaaagcagattcttattttatgtctgagagcttgagcctt

SEQ ID NO: 8922 - DNA, 418 bp, Gossypium hirsutum
  Clone ID: uC-gsronu33b025e01b1
attggagaattcataaccactgtccaacagggtggtgctgcaatcatcaaagcgtaggaaactctcaagtgcactatctgctgctagtgctgcttgtgatcacattcgtgattgggtccttggaactcccgagggcacatgggtttccatgggggtttactctgatggttcatacaatgcaccagctggggtcatctattccttccctgtaacttgtaagaatggagaatggacaattgtccaagggctggcaattgatgaattctcgaggaagaagttggacttgaccggagtggagctgatcgaggagaaggaattggcatactcgtgcctttcatgaatgcattcatcatttccataatctgtttggaagaggagtgggttgccttaataggattagctgtagttttgaataaaa

SEQ ID NO: 8923 - DNA, 629 bp, Gossypium hirsutum
  Clone ID: uC-gsronu33b025e04b1
tgtttttcatttgcgtccctctagcaagcattggggtgttcaaatggagagaaacggcatgcgtaggcagcttgcaatcatgaggcaatccctgtttgatcagggacatgttgatgaacaattcgtgcagttggaggaactccaagatgatgccaaccccaatttcgtagaagaagttgtcaccttatactaccgtgattcagccagaataatccttaatatagaacaggcactggagaggaagccttttgattttagaaaattggatgcctatatgcatcagttcaaaggaagcagttcaagcattggagccaagaaggtgaaagctgagagcacactgtttagggaatattgcaaggctggaaatggagaatgatgcatgaggagtttccaacacctgaaaaagaatatgcaacattgagaaagaaggttggagcttattttcaggtggcaagacaagctgggccggtggagaccgcaagtcgcccaataagaaaagctggagatatttatccatccaaatttagtaacttgcatttatttggtagaaattataccacctgatgatttgtatgatggtattgggtggcgatttgactctttttatccacttacattttctcctttct

SEQ ID NO: 8924 - DNA, 393 bp, Gossypium hirsutum
  unsure (1)..(393): unsure at all n locations
  Clone ID: uC-gsronu33b025e05b1
tctacgcgtccgctcaccgtattcttcgtcgggagcattctcttgacagttccgatttacgacaggctcatcgttccaatcgctagaaaattacttaaaaacccacaagggttaacccctttacaaaggatcgctgttggtttagttttatccattatagcaatggtagcagcagcattgaccgaaataaaacgattgagagcagcaactacgaatggtcttgcgaataacccaaccgctcaaatcccattaagtgtcttttggnttggtccctcaatttttgcttgtaggcgctggtgaagcctttacatacataggacaacttgattttttcttaagggagtgcccaaaagggatgaaaacaatgagtacgggtttatttttaagtacact

SEQ ID NO: 8925 - DNA, 303 bp, Gossypium hirsutum
  Clone ID: uC-gsronu33b025e06b1
ctcatctcgtccgcccacgcgttcttccacgcggacggttacgcgtccgggagggtgtatccagcgagaggaaagagatcacgatgaacgaggaggtgcccgacgagatgatgactttggaggatttcttggcgaaggccggtgcagtggaggaagcggcggccgttgcgtcagcggaggttaagttgcatccggatagattgagtggtggagtctacacgtttgatccggtgggagggggtgcgtttcaaattctggataagatggaggggtcaattgttgggctggggaactgagttgaag

SEQ ID NO: 8926 - DNA, 377 bp, Gossypium hirsutum
  Clone ID: uC-gsronu33b025e08b1
ttccacgcgtccgcagtgattcagtccctgggtgaggaagagattaacggggggttcttggttcagcttgataaattgattcgtttgcttgaaaccccgatctttgcttatctaagattgcagcttcttgaacccggaagatatgtatggttgctgaaagcattgtatggtcttttgatgctacttcctcagcaaagtgccgcattcaagatactgcaaactcgtttaaaaaccgtgccatcatactccttcaatggtgatcaactcaagcatgcattatcaggcaacccatactttcatcacggtgcaccccaaatttttgaggatggtaacaaaaaccttaataatgggaatgtacagaacgactttaattttac

SEQ ID NO: 8927 - DNA, 289 bp, Gossypium hirsutum
  Clone ID: uC-gsronu33b025e09b1
tcgttcatgttaagccttgtaggtgaagaagggggtggtcatttgtgtggcggctgtgattcttttattagtataaatagcgactggtaatggagtggctgtggcagtgtctttattgatttttttcttttctgcaactttataccgttgctcgttttgtcttttctttgaactggttgcttttagttgtagaagcttcaatcatccttgttcatggacaggtctggactcacgaaatgttgttgtttcaaaatagttggtaataatcattgtacgtgatatcgaacgt

SEQ ID NO: 8928 - DNA, 454 bp, Gossypium hirsutum
  Clone ID: uC-gsronu33b025e10b1
tcgttcttacaagaggtgcgaagaggagtgggcgagagcagatatatatagcagtgccctctcaccaaatttccaatggttggctgtttcgagtgataagggcactgttcatatatttcaccttcgagttagagtttttgggggccattcatcttctcaatcatcttctgtccaaggtccagcattattgcatcagaattcttcaacctcacttgatgcacttatccctccaagcactggtgccaaccctagttcatccttgtcttttatgagaggggttttaccaaagtattttagttcagaatggtcatttgctcggtttcacttacctgaagatacccaattcattgcagcatttggatctcaaaacactgttgttgtggttggcatgaacgggagtttctacaggtgcagttttgatccccgttatgggggaagaaatgttgcagcagga

SEQ ID NO: 8929 - DNA, 534 bp, Gossypium hirsutum
  Clone ID: uC-gsronu33b025e11b1
tcgtacggcattgcttcagtcacttggtgggcggaaagggattaaccggtttggtgatttttcagctcctctcgatgaagcattgatacatgtttcactggatttatctggccgaccgcatttaagttatgatttaaacattcccactgcaagagttggaacatatgacactcagttagtggagcattttttccagtcattagtcaatacctctggcatgacactacacataaggcagcttgctggaaaaaattcgcatcatataatcgaggcaacctttaaggcttttgctagggctcttaggcaggcaacagagtatgatccacgtcgccttgggactataccgagctaaaaggagttctatcaagatcttgatgttctccttggatgtttattttagtttgaagctttgggtatttgagaaattaagatgtgaggctcaaacgtgttgctttgggtatttgggtttccttttatattccatgaacatgaatttggattagaaatacatgatgatgaactatgctttacttt

SEQ ID NO: 8930 - DNA, 503 bp, Gossypium hirsutum
  unsure (1)..(503): unsure at all n locations
  Clone ID: uC-gsronu33b025e12b1
tccaactttgtacgtacaagtgaagtgagggcaatcttgatacggtaatgggttaggtagttttcagcatacttgttttgagtttagtggttgtagataaagaaaaaatggctgaggagcataccaaggttggtggtgaggaagcagtggagagcaaggagcgagggatgtttgatttcttggggaagaaagaagatgagaagcctcaacctcaagaggaggtggtcgccacccagtttgagaaagtcaagatagaatattnncataaggaagatgagaagaaacacagtcttctggacaagcttcacctatccaatagcagctccagctcttctagtgacgaggaagaatgtgaaggcggagagaaaaagaagaagaagaaaaaggagaagggaaagaaagaacaggacagtgcagtcccagtggagaagtgcgattaggtagcaaccagttaccactcaaagactccggaaaagaagggttttatggtttagatcaaagac

SEQ ID NO: 8931 - DNA, 122 bp, Gossypium hirsutum
  Clone ID: uC-gsronu33b025f01b1
tttactaccacctctgcctttgtatcaaaaggaaatttatagtatttagatgcgaaaaaaaaaaaaaaaaaaaaaaaaaaaaaaaaaaaaaaaacaaacaaacaaaacaaaaaacaacaacg

SEQ ID NO: 8932 - DNA, 171 bp, Gossypium hirsutum
  Clone ID: uC-gsronu33b025f03b1
gcgggaccggtccgttttcccgggactttccacgcgtcctgtctatcctcctttgtattttctaccctagtggggcattccatatccaacggggcttaaagatcccatccgctgctttggttgaagccttctattctgagactgatcacgatcctactactgaggaattca

SEQ ID NO: 8933 - DNA, 592 bp, Gossypium hirsutum
  Clone ID: uC-gsronu33b025f05b1
ttttaagtttgaagagttgggggctcaaggggggtctttgaccagatcaggggcctggagaaagatgctttcttcgaaggatgcaaattttgtaggttatacgtacaagaatgttgagattgtcaaggaacatcatcttccaggcattgctgaggtgaagaagaaaagcaatgcacctaagagaccttctgtgaaatcattgttcgacactcctggacctcctgatcccccaacaaaggggagctttctcaaccttttgccaacttaattagaggaacctgtaagcccggtgtctgaacattaatttattagagtgacacaatattcttggaaacctttgcacagatagtttaatgatgcaatatgtaggtaaattcgtcttatgcaaattggtagcgaatatttcccaatgtggaaatcggcatgagtcataattgctttgaaagatacttctctactttaaaagaattctttttgtttaagctgtttaaatacacatttgcctttatggtccacctttttttaggagtttactttttttagaatttttaaggttgctttcgaatgatcctacccgttttttttcctttta

SEQ ID NO: 8934 - DNA, 508 bp, Gossypium hirsutum
  Clone ID: uC-gsronu33b025f06b1
ttttacgcgtccggtgctgggcaaattgtcagtggggtcagggaccctatgcgtggaaacaccatcaaggctccttgtggtctcaaaactcgccccttcgattccataagggctgaagtgagagctttctttgacgtgcacgagcaagagggaagtcatcctggaggagttcatctagagatgactggacagaatgtgacagaatgcatcgggggatcccggactgttacattcgatgacttgggttcacgctaccatacccactgtgaccctcgtttgaatgcctcccaatctcttgagctcgccttcattatcgccgagcgcctcagaaagaggaggatcaactcacagcaactgcaaccactaatcacagggctgtaaaggggggggtcaaggatcctgcccctagccttttaccaaaaatattgttgtcccccgtttttttcccctcgcttaagtggttattggcattattaatatctttttaagttgggattttgagttatgt

SEQ ID NO: 8935 - DNA, 510 bp, Gossypium hirsutum
  Clone ID: uC-gsronu33b025f07b1
tttcacgcgtccgatttttattttcattagcggaacaataaaaaaatgccgggttctcgcattgcagtaggatctgcagctgaggctggccaagctgatgccctcaaagcagctttagctgagtttatttcaatgctcatttttgtttttgctggtgaaggctcgggcatggcttttaacaagctcactgacaatggctctacaacaccggctggccttgtagctgcatcggtggcccatgctttcgctctttttgtggccgtttctgtcggtgctaacatctcgggtgggcacgtaaaccctgccgtcactttcggtgcctttgtcggtggccacattaccttggtccgaagtattttgtattggattgctcagttgctcggatccgttgtcgcttgcttgctcctcaagctttcaactggtggattgacaacatctgcatttgccttgtcatctggcgtgggagcatggaacccagtggttttcgagatcgtgatgaccttcggtttg

SEQ ID NO: 8936 - DNA, 534 bp, Gossypium hirsutum
  Clone ID: uC-gsronu33b025f08b1
ttccacgcgtccggcctggtatttccaacatggccaccatcgacgaggctgagcgcatattgacttcagaatctaaagttgctttgggttacttgaactctttggtgggtcctgagagtgaggagattgctgccgcatcacgactccaagatgatgtcagcttctatcaaactgtgaatcccgatgttgcgaagcttttccacctagatcctcaagttaaacgccctgcattggtcttagttaaaaaggaggctgaaaaaataagctactttgatggccagtttgttaagactgtgatatccgagtttgtattttccaacaagctttctttgattacaatttttactagggaaagtgctccttcaatttttgaaagcgatattaagaaacagattttgatgtttgctgcatcaaacatttctgagaagtatttaccatcattccaagaagcaacgaaatctttcagggaaagcttatctttgtttttgtgcaagtcgataatgaaaattttggtagacctgttgcagaatattt

SEQ ID NO: 8937 - DNA, 385 bp, Gossypium hirsutum
  Clone ID: uC-gsronu33b025f09b1
ttatgttgtaaaacctggaccaattatctgattatatttctaaatctttgtatctgtactgtagagtttattaaaaaaaaaaaaaaaaaaaaaaaaaaaaaaaaaaaagggagaaaaaaaaaaaaggaccagggaaacaaaaagaaaaaaaagaaaaaaaaaaactataggggagggccacctaaaggaaacaaacttaccaccgttagacaacgacgggacaggtaaaacatgggggaaccaaaaaaaaatgaacgggccgaagattaacaatgtggcaaagggaaaaacccgggaagaacccaaaaaaataggttggtaccaaaacctgcttattcaaaatggcgaaagagaaaagaggtctaaagggacattaattgcaaac

SEQ ID NO: 8938 - DNA, 160 bp, Gossypium hirsutum
  Clone ID: uC-gsronu33b025f10b1
tttcacgcgtccggtttcttctcatggaagtggggttgtgaaatcagactcagataagcttggggggccttagttctcgctgagtgttcatggttttttgtttgcttcagtttaaaacaatattctcagcatatacaactgagtgtgctttgcacttttt

SEQ ID NO: 8939 - DNA, 378 bp, Gossypium hirsutum
  Clone ID: uC-gsronu33b025f11b1
tttataagcttgaagagttgggggctcaagtggaggtctttgaggagatcagggtgcttgtaaaaagacgctttctttgaaggatgcaaattttgtaggttatacttacaagaatgttgagatcgtcaaggaacatcatctttcaagcattgctgaggtgatgaataaaagcattgcacctaatagaccttctgtgaaatcattgttcgacacttctggacctcctgatcccccaacaaaggggagctttctaaacctcttgccaactcaatttgaggcacctgaaaccccggtgttttaacatcaatttatttgagtgacacaatattcttggaaaccctttgaccgatagtacaatgatgcatttttgtaggtaaa

SEQ ID NO: 8940 - DNA, 539 bp, Gossypium hirsutum
  Clone ID: uC-gsronu33b025f12b1
tctataagtctaacctgaagaaagaagagagtgtgtgataatgagccaaatgggtgcttttcagtggcacaagattgctgctgtttctggaatagcagcccttggattgggcacttatggcttccatatctttaaacctgaaaatcccgtttacaaggaggtatggcaaatcgcttctacttaccacttgtttcacacagctgctcttctttctgctcctattaccaaacgcccccacatttttggaggccttttgactgctggcattctttctttctctgggtcgtgttacacggcagcatatctggaggacagaaaatattcggcccttgctccatttggcggccttgcttttgttgccggttgggcaagtttgttatttctaagggtgggttttccttaaaagaacttatgctttactttgaacaagttagagaacacctgtcctctttgttatgcccatattatgaacaaacctttgtatagttgctggttataagataccctaaacatttttattgcaacaagacatattatga

SEQ ID NO: 8941 - DNA, 55 bp, Gossypium hirsutum
  Clone ID: uC-gsronu33b025g02b1
ttttccacgcgtcctataatacaccaaaaaaaaaaaaaaaacaaggggagatttt

SEQ ID NO: 8942 - DNA, 378 bp, Gossypium hirsutum
  Clone ID: uC-gsronu33b025g03b1
gtttgtgcgtggagttacgccaaatacgcggtgtcatttgattgtggaatatgggttctccaatttttccccttttctttttccaacgatttcgcattatttttcattttcatttttgatttttctttcttccatttcaaattttaattccgatcgagcaccaaaatccttatttccttttcattcttttgaaaattttaattgattgattaactgttgcaaagttgagtttttgatcggcaatggtgaaagaaactgatttctacgacattttaggggtcagcccttctgcgacagagtctgaaatcaagaaagcttattatatgaaggcacggcaggtccatccagataaaaatcctaatgatccccaagcagctc

SEQ ID NO: 8943 - DNA, 89 bp, Gossypium hirsutum
  Clone ID: uC-gsronu33b025g04b1
ttttaaacaaaaaaaaaaaaaaaaaaaaaagagaaaataaaaaaaaaaaaaagggaaaaaaaaaaaaaaaaaaaaaaaaaaatacaacg

SEQ ID NO: 8944 - DNA, 551 bp, Gossypium hirsutum
  unsure (1)..(551): unsure at all n locations
  Clone ID: uC-gsronu33b025g06b1
tttacgcgtncgaaaaggggaaaaatatcagtgtgaaggaaaaactcanagtgtggcgacgatctgcacattgaaattcgcttgttctcggattgacgtcgctatggtttatataacatcgtgggacgaatttgtcgagagaactgtacagttgttccgtgccgatcctgaatctacgcggtattgcatgaagtaccgacattgtgatggcaaattggttttgaaggttactgataacaaagagtgcctcaagttcaagacagatcaagcacaggacgcaaggaagatggagaaactgaacaatatattcttcactttgatggctcggggaccagatgtggacatgtcagaaattacagggaacgaacaggaagcacagccggtgaagaaaggaaggggaagaaaacaatagcttggattgctggtagacatataaatggttttgagccaacgtgattggacctcaatgaatttagaggaattttgtggcttacgatttgaaaatgctgggattgccaaaatttttcctgaagaaattaaagaacacttct

SEQ ID NO: 8945 - DNA, 416 bp, Gossypium hirsutum
  Clone ID: uC-gsronu33b025g07b1
ttttcacgcgtccgcccacgcgtccgcccacgggtccggagggcttaaaggccattgcacaacgtgttcatggtcttgctggggtatttgctttgggactgaagaaacttggcaccgtggaagtccagggccttcccttctttgatactgtgaaggttacatgtgctgatgcccattcaattgctgatgctgctcgcaggagtgagataaaccttcgggttcttgatgccaaaacaattactgtttcgtttgatgaaacaactactttggaagatgtggacaagcttttcaaagtattttctggtggcaaaccagtctcattcactgctgcatctcttgcatcccaggttgagactgcaatttcttctggactagaacgacagagcccatatcttacacactcgatatttaacatg

SEQ ID NO: 8946 - DNA, 510 bp, Gossypium hirsutum
  Clone ID: uC-gsronu33b025g08b1
ttttccagcgcttttgtggatgctgacagggggttgcattaaaacgggaaggcgacaaattgcaagacgcgcaatagaccttgctgagacacgcttgttgaaagatgggtggccagaatattatgacggcaaacttgggagatatgtcggtaaacaggctaggaagtatcagacatggtcaatagcaggatatttagtggcaaaaatgatgatggaggatccgtcgcacttggggatgatttctttggaggaggacaaacagatgaaaccattgataaaaagatcatcttcttggacttgctaaaaaaaggaaagaaaaaaaaccagaattgggaaatggaaagagaccaacttcagaattttcattgtaccggtaccagtctttctttttcttttacgatatgtttccaagtcaagaaaatagtgacatataaaaggaaatgaaagaagattttgcagccatggctgatggctcatgcattggttattttcattacaagtatacattaa

SEQ ID NO: 8947 - DNA, 446 bp, Gossypium hirsutum
  unsure (1)..(446): unsure at all n locations
  Clone ID: uC-gsronu33b025g09b1
tttcagctgcggatccattgcttccctgtgggctgtaagcaaaaaagagagagaatgaaggttgttgctgcttatttgttggctgtacttggaggcaatgcctctccttcagctgatgatcttaagaacattcttgccagcgttggagctgacgctgaagaggaaaggctccagcttcttttatctgaagtgaagggaaaagatataaccgagcttattgcatctgggagggaaaagcttgcctctgttcccagcggtggtggtgttgctgtggcggcatctgcacccggagccgncgncgncgccgctcctgctgcagctgagactaagaaggaagagaaagttgaggagaaagaggaatccgatgatgatatgggcttcagtcttttcgactaaaactaccacgcaccgncagcaacctattaatgaaatacggatggtttttt

SEQ ID NO: 8948 - DNA, 424 bp, Gossypium hirsutum
  Clone ID: uC-gsronu33b025g11b1
ttgtaaaaaaaaaaaaaaaaaaaaaaaaaaagaggaatttttaaaaaactaaaagttgtaaaaaaaacccaaaaaaaaactataaataataaaaataacgcaccctcactaaaaaataataaataaaactaaataaaaaaaaaggggccctctttttaaaaaaccaaattttatttcccctcattttcaatttaatatttttttttttgggcccctaaatttaaatttattgccctttttataaaaacttcagacttgaaaaaccctggggtttccccaatttaatccttttaaaaaaattcccttttttccatttttgcaaaaaaaaaaaaagcccccccccatttttttttcacaaaattttccaatcttaatttgaaattgaacccccccttttagggtatttttaaacccctgtttttgg

SEQ ID NO: 8949 - DNA, 363 bp, Gossypium hirsutum
  Clone ID: uC-gsronu33b025g12b1
atctcatgaaatgcaagattttgtggtctttttgagaaatatttaggtgttcccttcatttgagtcttctttcttaaatttcgtctaaaaatcctctcccaatttcatttccaaagcttttcaattctcttgattgttcatataatataaatttcttctttttcagccatgggtgttgcagttctaaaaccagacgattgtttaaagctaccaaatcccatgacacaaccaaatagtctttgccttaacccgaaccgatcgaattggtcacaacccaaaccgtaaaactcggtctcctaccacctcccctccttcccagaccgccggccccaaggtaccgcctaaagatcccgtgatgggtca

SEQ ID NO: 8950 - DNA, 208 bp, Gossypium hirsutum
  Clone ID: uC-gsronu33b025h01b1
attctggcgtccagccggcatgacttatataacctacttcaacataatgcccaacctcgttaggaactgcttaaaggaaccttacaagactgaatcccttactcgtgagaaagtctatttcttcatctccaagtggacccgatggaaagcctgaaaagcctaccctccgctcacactcaccttaagaatgacacccatgttttggcca

SEQ ID NO: 8951 - DNA, 190 bp, Gossypium hirsutum
  Clone ID: uC-gsronu33b025h03b1
cctataaagcgtctattaacacgctctcactgatctccttattacaacgttctgaatgataaaaccctatccttatccaacttaatctccttgcagaacatccccctatttacatgtggcttattaccaaatatgcccgctactatcaccctttctatcatttaccccaccaaaatggtcattggcaacc

SEQ ID NO: 8952 - DNA, 280 bp, Gossypium hirsutum
  Clone ID: uC-gsronu33b025h04b1
tgtgtcctgtcagtcttctccaatgcaagcatggggtgatgttaagaatgacctggtgtaaggaacttgatcatctgaagaatgcatttgaggctgagctataaaaacattcaagggacttttaatgcctgtttgaggtgctgatacctttccggcgcctttttggtctgattttaaaaagaaaagaaccgttatctttgcgacatttttcttgtttatactgatgtgatgcggcaaaagttgcatatgcctgctattgatgcttttgtaaggatatact

SEQ ID NO: 8953 - DNA, 505 bp, Gossypium hirsutum
  Clone ID: uC-gsronu33b025h05b1
gtattctgttaccaatgatgcaggcggagggtgtcacttgactatgggagcgggtctttcaagggttcttaggggtggtcctagctgtagtgccaatctacctattccatcccaaatcaactatccagttccaggagggtttactatatccggactaaatttaaatcttggaggaggctccacgcagcctgtgatgcgaccaatgcaaccttcccaacctccaccaatgctgcagcaccaagacgttacgccctctttgatgaacaccgctacttttggcgcggagggtggctatggtgcatagatcaccactcagaatgcaaatgggccgaccaacagatacttgagcatggaccattgcatggacttggataactattggcccacgtactaatggacaatgcaaaatccaatgtccccaacatgctttttgtttttagtattaggcagtgggtaagtttggtagtatatgtttttaaattggattagttgggggaattaaatg

SEQ ID NO: 8954 - DNA, 615 bp, Gossypium hirsutum
  Clone ID: uC-gsronu33b025h06b1
tttaaaacagtcaattgttttctcaattcagtgaggacttgtcagtacctggagtgacactggtcaaagccattaatgagatatgtgggcaagctaaattttcagatcttacaaagaactttttagttatactagctgagaatggaaggctaagacatatagaaagcattgcaaagagatttgtggagttgaccatggctcataagggagaagtgaaagctattgtcacaagtgttattccccttccttctcaggaggagaaggaactaaaggagacgttgcaggaaataattggacaggggaagcaggttaagctggaacagaagatcgatcctagtattcttggtgggcttgtcgtaaagtttgagcaaaaggtatttgacatgtccattaagactagggcacgacagatggagagggttttgcgtgagcctataactttggttccctttgaggatattataaccggccagtggacattaagtttcttggcaccattgggtatttcggaactgcaaagaaattatggcttttggtttgccctgtttctttactttgcattttggaggaagctcctttcaataaaaaatttttggttttttttactaatttaaa

SEQ ID NO: 8955 - DNA, 441 bp, Gossypium hirsutum
  Clone ID: uC-gsronu33b025h08b1
tctttaaaaagaaaaagtttgaaacccggaaggggcggacgaggaacaccattttgaatccaaggccgacgccggtgcctccaaaacctacccacaacaggccggaaccattcgtaagaatggttacatcgtcataaaaaaccgtccctgcaaggttgttgaagtttcgacctccaagactgggaagcatggtcatgctaagtgtcactttgttggaattgacatcttcaccgccaagaagctggaagatattgttccctcttcccacaactgtgatgttccacatgttaatcgtactgactaccagttgatcgacatttctgaggatggatttgtgagtttgctgaccgaaagtggagacactaaagatgatctgaggctcccaactgatgagaaccttgtgaaacagatcaaggatggttttgctgaggggaaagacct

SEQ ID NO: 8956 - DNA, 380 bp, Gossypium hirsutum
  Clone ID: uC-gsronu33b025h09b1
tataatggaagctaagagatccctattagggggcttcctacggctttccttggtgtccatatcaaccgcaacatcaactcgaaaaacccgaacccgaaatccatgcaagagcatggtgttttatttccacgacataatctacaacggccataacgcaaagaacgcaacatcagccattgtaggttcaccacaatgggggaacaagaccattttaacaggaaaaaaccatttcggagacctggtcgtgttcgacgaccccattaccttagacaacaacttgcattcgaaaccagtgggtcgagcccaagggttttatatctacgacaagaaagacatattcacagcttggatgggtttcttcttcggtttcaattctaccc

SEQ ID NO: 8957 - DNA, 413 bp, Gossypium hirsutum
  Clone ID: uC-gsronu33b025h10b1
ttcaagatccttttgggcatgcagaagggcggatacattggagagtgggagcgcatttaacaacacagaacgggtgaaagaagcatggaactgaacctaaagttaggcatgtgcggggtgatcatctcatactaatgcgcaggagtgaaggctagcactagcaaaggactgcctacctggttgcattatgacagcgttgggcacatattgctgacaacatcagactacaataatggaccatgaagaatacactatactgaaagtagccatggaaagtacttggctttttatattgaggggattagatcaagattaaaactgctatgaattatgtttatgcctttaaagctaataatggcagtgcctatttatgtaatatggggactcaaatataaagagtgagcttatgatga

SEQ ID NO: 8958 - DNA, 333 bp, Gossypium hirsutum
  Clone ID: uC-gsronu33b025h11b1
tctctcacgcgtccggggcgcataagttacgggccttgtggacgatcccctaggcgtcgcaatccctctcctcgtgggcgtagctacagcaggtctccaccataccgtggtcgtgaggaattgccatatgctaatggaaatggtgcaagggaacgccgacggagcaggagttaagtgctgcaaggatgtaactcttatgtgaagggactgattaagtttgtttagtttgttgacttcagtgctactgttttaattgggcaacgcccgcagcatcttggatttggttaagttactttctggttttccttatttatatgaaggttttatttgctt

SEQ ID NO: 8959 - DNA, 438 bp, Gossypium hirsutum
  Clone ID: uC-gsronu33b025h12b1
tattggactccggaaaggaaccggattggtgcggcgtttaaggatggacgggggattgagtggaacgctctaactagccagaaaactcacgccataaagctgccttgtgcgtgggtaatgacgtgtgctttttctcccacgggtcaatcagctgcctgtggtggtctcgatagtatgtgttccattttcaacttgaattctccgactgacagggatggaaacctacctgtatcaaaaacacttagtggacataagggttacgtctcgtgttgtcagtatgttccagatgaagacattcacattattacccgttccggtgatcagacctgtgttctatgggatattactactggccttagaacatcggttttcgtggggagaattttattctggccatactgatgtcgtgctaagtgcctcaattaacggatccaactt

SEQ ID NO: 8960 - DNA, 522 bp, Gossypium hirsutum
  Clone ID: uC-gsronu33b112a01b1
ttaatttgaaagttttcgtgatgatgaaaaacagaaaatgacttctgctttgggtgaactggagtctcaaagggatcaagcacgacttgctcatcaacaagctcaacgggagtgtcatcaaaaggtggaggaactcccttgttctattcgcttaatagtatgagcaatggtaaaaataccaagaaggctcttgaactagttgttggattgttgtttgccttatttattaaaaagaatgggtaaattagtccctatgcattagattaaagagcaaactagtcttttttgttaaaaatttcattctttaatgttaaaaactgatgtggctgacgaaataaccaaatagatacatgtctgaggtaagagatttgtttgtttttaatagtaaaaatgaatggaatttttaacagatggacaagtgtgctctttaatcttacatataaggattaattttaaaaggggcaaaatgcaattcgcttttcagtagcagggcctctatgatatttgtacctatgatcaacc

SEQ ID NO: 8961 - DNA, 485 bp, Gossypium hirsutum
  unsure (1)..(485): unsure at all n locations
  Clone ID: uC-gsronu33b112a02b1
tcctcacgcgtccgcccactcgtccgcccacgcgtccggacaatattcctgcgcctgctggaaattcacaccgttctatccaacgagaagcagctctaaccaagtttcgattgaagcgtaaggatagatgctatgagaaaaaggtccgatacgagagcagaaagaaacttgcggagcagcgacccagagtaaaaggccaatttgttcgtcaagtacaggttgatcatcctacgcagacaattcactcgatggctagttacaacatagagaagtgcatggattgaagtttacaatggatctttagaattggtcgcacttgcaatttcagccaaacactaaagattcttttgttcatatctatactcaaaattacattagtaggttataacacagttaggttactatgtacttgtaaaaatcacattttgagcttagagttcaccctaacagagtntgcttccctgagctttgtcagggttctctgg

SEQ ID NO: 8962 - DNA, 322 bp, Gossypium hirsutum
  Clone ID: uC-gsronu33b112a03b1
taccacactgacaaaggcccgactcaaggatactaccatggcggaactcgctggggaagccagtccaccatattggctatcaacctccagaacgtatacgcactgacactcacccacgctcaacggacttatcatatgctccggccgacctattgtatgtgggaatcctacactatattcaacccagacttatggaaccccctacagaaacgccacattgaaaccttacctaaatggtcatggcaatggctgcagaacaacacataaacaaccggatgtgctccactcaagcatatagatccaaccatcacaacctccctgg

SEQ ID NO: 8963 - DNA, 495 bp, Gossypium hirsutum
  unsure (1)..(495): unsure at all n locations
  Clone ID: uC-gsronu33b112a04b1
gtcaaggctggaattattcggcaaatggaggcatttcgagctggatttaatcaggtttttgatgttgcatcattacaaatatttacaccccaagagttggactatttgctatgtggtcgcagagagttgtgggaggctgagacacttgctgatcatataaaattcgatcatggatatactgcaaagagccctgcaattgttaatttacttgaaattatgggnagaatttacaccagagcaacagcgggccttctgccaatttgtttctggtgcgcctagacttccactgggtggtctggcaatgctgaatcccaagcttccaatcgttagaaagcattcgtcgtgtgtaattggtggtacttcaaggggaagggacccctcagatcagcagatgatgactgcccagtgtatgacttgtgctattacttgagcttnctcatattcttcaggaattatgtatagaattgctattgcaatcacgagggaggatctttg

SEQ ID NO: 8964 - DNA, 522 bp, Gossypium hirsutum
  unsure (1)..(522): unsure at all n locations
  Clone ID: uC-gsronu33b112a05b1
taaaatttgaagaaaaaaatccatcaccgatctaagttccccaaattctattcaaatcgccggcgaaattttgatctggaaatctaaaaatgtcgtccacattcagcggcgatgaaactgctcctttttttggcttcctcggtgccgctgctgccctcgttttctcctgtatgggagctgcgtatgggacggctaagagcggtgttggtgtggcgtcgatgggagtgatgaggccggagctggtgatgaaatcgatcgttcccgttgttatggctggtgttttgcgtatttatggttttgttttttgcggttattatcagtactgggattaacccaaaggctaaatcttattaccttttcgatggctatgctcatctttcctctggccttgcttgtggtcctgctggtctctccgccggcatggctttggngatcgtcggcgatgcttgcgttagagccaatgcccaacagccaaagttttttgtggaatgattcttatcctcattttgctgaagctttgct

SEQ ID NO: 8965 - DNA, 378 bp, Gossypium hirsutum
  Clone ID: uC-gsronu33b112a06b1
tttcattatatgtaattttactcactaaaacatatggtttcgtgataacagtacggataccgaggtcactccgacgtagggacgcactttccaagctctgcattcgaccggggtgatgcactctatagtgctggttccctacgatctgggttggatcgctgaggacgctggtggcgaaagcagcgaaacggcgtatgttattgcgaaatcgggtttgaaaactatccacgccggattcaatcaacggatgccgataccctgggaagaacgacataaattagatgccaagatgcgtctgcgtgctctaagaattattagagagaagacattgatggaactgttatgtttgccgatgatagcaattgcatagtatggaac

SEQ ID NO: 8966 - DNA, 399 bp, Gossypium hirsutum
  Clone ID: uC-gsronu33b112a07b1
tatgtaattgagaagattgctttgaagcagaaatgggagctggaagggcttaatttttcaaaactggaattgagtaaggttaggttcgggactggcaaaagatgcgagttccggatccgatttggaaaaactcatctgctcttcaaattccccgacgaagtttcttccttgaaaaagtttaccaaacgaagtagcaacgattttcttgattttgtcaatgaaattaattcctcggccgtactcgagccttttacaaggaaggtcccttcgagttacgcctctctcccggtcaccaagcttccctcctctttccgctgaacacttcacatactgatctgaaacgagtccttgttggtcatggcatcactttacaagtaaatggagctaagagatctctct

SEQ ID NO: 8967 - DNA, 386 bp, Gossypium hirsutum
  Clone ID: uC-gsronu33b112a10b1
tgtcaaaagcttcagaattgcaaatggagattctttctcaacgaccatcttctttctcaactttgaatcccaacgctccattgtttgttccgttagcgtatcggacggtggaggatttctctgatgagtggtgggctctcgtccaatcctccccgtgcttgcgcgactacggactgtaagaacgtttgcaccatccccaaaacgacgacgcctatcttctttttcccgacgatcttgatgccgtctttgacgattacgacgactttttcgttgaccctacctgtgaagggatggaggaagatcctcaaagggatttggtccccctgggagcattcaaatggcggaagggtcgagtcctgagcgagtcactaggtatcttgagaaag

SEQ ID NO: 8968 - DNA, 190 bp, Gossypium hirsutum
  Clone ID: uC-gsronu33b112a11b1
tttcattatatgtaattttactcctaaaacatttgttttcgtgataatattatttaaacatagattacaatctcttgacaggggacaagagcattatcttgtaagtataagtataagaagcttggattcgatttcaagaaataaaagttattcgtggggcgctggaggcgtcagcagcgaaacggtgtag

SEQ ID NO: 8969 - DNA, 575 bp, Gossypium hirsutum
  Clone ID: uC-gsronu33b112a12b1
tcccacgcgtacggagaaaacatagaagaaattgcttatgtataccaggacggttatcgtggtcactccgacgtatggtcccactttccaagctctgaattttaccggggtgatgcactttataatgctggttacctacgatgtgtgttggatcgcggaggacgctggtggcaacagcagcggaacggagtttgtatttgcgaaatcgggtttgaaatacttccacgctggattcaagtaaaggttgccgaattcctgggaggaacgacatatattagattccaggtttttatttcgagcttttagaatttttttagagaaaaatattttttttcttattttctttttctttttagcttttttcttttttcttttctttattttttacttttttttaccttttttccattatctttttttttatttttttattttttcttcttatatatttattttttttttattttcttataatattgttttaaattttttaatttatttattttattccattttctttctcttattatattattttatttctatattttttttatttttctctttttattttc

SEQ ID NO: 8970 - DNA, 453 bp, Gossypium hirsutum
  Clone ID: uC-gsronu33b112b01b1
tctaagtttgctttctccttgtaattctcaacatctatatgtgtttaaaaaagagattgtaaaataatactcttgtatcatcactctcccaccccgaccgcttgattttgatcagacggtaatcatgccgatcagaaacatagccgttggccggcctgaagaagctactcatccagatgctcttaaagcagctttagctgagttcatatcaacgttaatcttcgtttttgctggatctggttcaggcatggcttttaataagctgaccgacggcggtgcaacaactccggctggtctcgttgccgcctctctagctcacggatttgcgcttttcgtcgctgtctcagtcggtgctaacatctccggtggccatgtgaatcccgccgttcatttcggtgcttttcgtggcgggaacattactttttacgtggtatccttattggattgctcaac

SEQ ID NO: 8971 - DNA, 452 bp, Gossypium hirsutum
  unsure (1)..(452): unsure at all n locations
  Clone ID: uC-gsronu33b112b02b1
tcccacgcgtccgtgacttatctcatttccaatcatctgccatggcaaaacttcgaagccggtccttttggtctcatctctccgatgcctttcttttctttgctgctgcctttttagctcttgtgttagtatggtccttttggtcgtatttcactccaacccctaacttcctacccacctttacccatccatcctccaactccaaaaccaatctggtcgaaagtgggttcggagttaacttaaagtccgacccgaaagaccccactttttatgacgatccggagatgagttactccatagaaaagccggtgaaggattgggatggaaaacgacagagtggttaaagcatcaccnctacgttcgccgccggggcacgtgaaagaatcgttcttgtacccggggtcccacctaagccatgtaagaatcagtcggtgatcatttgcttttacgtc

SEQ ID NO: 8972 - DNA, 436 bp, Gossypium hirsutum
  unsure (1)..(436): unsure at all n locations
  Clone ID: uC-gsronu33b112b03b1
tattgccagtggcaaagatggcattgaacatgctgctaagagtctgcctaaggagcccgatactaaagctgaatccactgaagaagaaagcgccatcaccaaaacctcccaccgcgctatggtgggtgggacacaagaatgcgttgttctgcagtaggaactggcattccacaaacagaaccatgtttcttctatgttatagtttctactaagcccgtttggcatgtatgattgtgtatggcagtggtagcctaaataaagcaaacatagtttgcggtggtgtaaggtttttcattaaaccttggacttgttgatttgatgatgtactatgattggataatgtaaaataccaattaatggtttgtgtaaaaaaaaaaanntnacaaaaaaaaaaaaaaaaaaaaaaaaaaaaaaaaaaaaaaaaaaaaaagggcgg

SEQ ID NO: 8973 - DNA, 407 bp, Gossypium hirsutum
  unsure (1)..(407): unsure at all n locations
  Clone ID: uC-gsronu33b112b04b1
tcccacgcgtccggtcaactattacgtggagagcctttcctttggggagcgagtctcaggtagactgttctttaagctaacagcttctctgcagagtcttataatgcatgaggagaaaggtcacatcaaccttgttgcaattgaccatgtggactctgtcaagtggaccactactggtcatttgatctacaggctaggctgtatggacaagcgtgtaatagataggatggggaaggccgctgttgaaacgaagcagaaaggatcaagagttagcttggagcttgacaagctacaggctgagcgtgaacgtggantcaccatagatgccccctatggacgatcgagccaccgaatactattgcaccgtctttgatgcaccgggacaccgtgactgtatcaagaacatg

SEQ ID NO: 8974 - DNA, 491 bp, Gossypium hirsutum
  Clone ID: uC-gsronu33b112b06b1
taggttctccaaaactacaagaacttgcaagatattattgctattttggggatggacgagcttagtgaagatgataaattaactgttgcacgtgctcgtaagatcaaaggttcttgagccagcctttccatgtggcagaagtgttcactggtgctcctggcaagtacgtggagttgaaggagagcatcaccagcttccagggcgtgttggatggaaagtatgatgacctgcccgagcagtcgttttacatggttggaggaatcgaggaagtgattgccaaggcagataagattgccaaggaatctgcagcctaatcaaatccacataccttaatttctgctgagtaatttcgaaaataatctaggtggtgttggtaatgccagcaacagaactgttcatttatttgggggttttgtgttttatgtttaatgatgttattcaagagtgtataagagcacttcgccccgcttttttttgcttaatagggaata

SEQ ID NO: 8975 - DNA, 394 bp, Gossypium hirsutum
  unsure (1)..(394): unsure at all n locations
  Clone ID: uC-gsronu33b112b07b1
gttgtcatcattccagctggggtgcctagaaagcccggtatgactcgtgatgatcttttcaacattaatgccggaatcgtcaagggtctatgttctgcaattgctaagtattgccccaatgcacttgtcaatatgatcagcaaccctgtcaattcaactgttcctatcgcagctgaggtttttaagaaggcaaggacatatgatgagagaaagttgtttggcgtaaccacccttgatgtggttcgggctaagactttctatgctgggaaggctaaagtaaatgttgcagatgttaatgtccctgttgtcgngtggtcatgctggaattaccattctcccgctattttctcaagccacaccaaaagccaatttacccgaaagaggatatcagggc

SEQ ID NO: 8976 - DNA, 95 bp, Gossypium hirsutum
  Clone ID: uC-gsronu33b112b08b1
gtttgcttgttagtgtctggtttctatcgatttttttcttgtattatcaggagttttaaaacatgaaagtggaatgaagtaaatgctttcttttc

SEQ ID NO: 8977 - DNA, 333 bp, Gossypium hirsutum
  Clone ID: uC-gsronu33b112b10b1
ttataaaaaaaaaaaaaaaaaaaaaaaaaaaaaaaaaaaataaaaaaaaaacaaaaaaatataaaagtaaaaaaaaaaaaactaggggggccgctctttgggttccccgtttctccccccgcgcgcgcgccgccttttctttttttcctggccggccaacccgtctgctctgccccgcctgtttattgcgcctgaccgggggccccctctgttgccccccctttgcatcctcggggtccatccccctttggccgctggtgctgctcccgcggggggccgcccccttggcccctttcacaaatttcgcttccctttggcgaatggggccccccc

SEQ ID NO: 8978 - DNA, 447 bp, Gossypium hirsutum
  Clone ID: uC-gsronu33b112b11b1
tctgacgcgtgggtgttgctgcggaagagccctggtatggaattgagcaagagtacaccctgttgcagaaagatgttaagtggccaattggatggcctcttggtggctaccctggacctcagggtccttactattgcggtgttggtgtggacaaagcctatgggcgtgacattggagattctcattacaaagcatgtttatatgctgggattaatatcagtggcatcaatggagaagtgatgcccggacagtgggaatttcaagttggtccggcggttggcatttctgccggagaatgagttgtgggttgcacgttacattttggagaggattacagagactgctggaaatggtgctctcttttgatcctaagccaattcatggcagactggaaatggtgccggcgctcacacatattacagaccgaagtccatgagaagtgatgga

SEQ ID NO: 8979 - DNA, 407 bp, Gossypium hirsutum
  Clone ID: uC-gsronu33b112b12b1
tgttcggaccttgtccgattacaacatacaaggagagtcatctatccagctttaatctccgtctgcgcggtgggatgcaaaccttattgacaacctagactggcaagacaatcactctcgaggccaagagcgtccgacacagatctgacaacacttagatgatcatatacaatatcgggatggcattaccgcagagaggcaacgtattatctatgtactaaacaactggaaacggtcgtaccttggccgactacaacatccagaaggagtcaactctccaccttgtccttcgtttgcgcggcgggatgcaaatcttcgttaagacgcttaccggaaagacagatcactctcgaggtcgagagctctgacacgatcgacaacgtgaccgccaaaatccaagacaagga

SEQ ID NO: 8980 - DNA, 612 bp, Gossypium hirsutum
  unsure (1)..(612): unsure at all n locations
  Clone ID: uC-gsronu33b112c01b1
ttccacgcgtccggccttaagagttatttgggaaatgtgtgggcatcggaacggatacagaggtgtgggaaaagctttgcagagttcaacaggaaagagggcttttggcatggaatatgaatcagattggactaagaatagagtttcatcggcatttacagctcaagtcatccgttctgctacatcacttatgccttggagttgtaaaatccctataggtgatggatttcatgagtttctttaattagttgactagcatttatattgacgcattcttttgggaaaatatatttgtaccgcatacgagaaccatctagaaaaaaatgcctggttttgtgagagaaaagaagagaatcacagaacccaatatgtgtctcagctccccgcttatgcaagatcattcaaaaggcaatcaccgttcaccctctcaggctactgatgaaatagaaagcctgttgcttcagggctaccggatgatgtggccaagtattgccttgcttctgtccgcgctctagcttnccttcatggtgtggttgaagaagtgggaatcattcattcaagcaagaattcttatggacgaagatagctgatgctgagagggcttatgtctac

SEQ ID NO: 8981 - DNA, 435 bp, Gossypium hirsutum
  Clone ID: uC-gsronu33b112c03b1
aacaattggtttgagaagcaaactgatgggacacttgatatagtatgttcatcatggatggattggttccatggtggtttacagttccagattgagcaccatttgtttccaaggttgccaaggtgccatctcaggaaagtttccccattcgttcaggagctgtgcaagaaacacaacttacagtacgataccgcttcgttttggaaggctaatgtaatgacgatcgagacccttcgatcagccgccttgcaggcaaggattctcagcaacccagttccaaagaacttagtgttggaagcagtaaaaactcatggttgagatggaactttatgtgaatgaatcagcttatgttggtatgacctgtaggtcttaaaaagttgtgtactgattccagtagactgatataaaattttcctccattagtgctcacaggtg

SEQ ID NO: 8982 - DNA, 534 bp, Gossypium hirsutum
  unsure (1)..(534): unsure at all n locations
  Clone ID: uC-gsronu33b112c04b1
taaacaaacagcgtaaccaccttgtaaacactcaaaacgctattgccagcaaacaccgcggaatcccacgcgccaccttttccaccgatctcactcgcgacccatggcgtcccccgcgaccattccgatgacgacgtctcaatctacggccggtggtggtacccaatcacagcccccgatagccacgcccgcgtttagggcgttcctctcgcgcttcacgtcctcgatccgtcaaggactctcccaacgccgtccatggtatgaactattgatcggtccgccatggctcgtcccgataatctaactgatgcctattcccggatccgcaaaaacctctcttacttcaaagtcaattatataactctactagggggtgtgctcgccttttctatcctatcgcatccnctctctcttctcgtncctctcggcctcctgccgtttgagtctttctttacctctccgacgtncgatcaccctcgtgatctcggcgtacgtctcgatcgtagacgctgcgcgtggtggtggtgaccgctc

SEQ ID NO: 8983 - DNA, 386 bp, Gossypium hirsutum
  Clone ID: uC-gsronu33b112c06b1
tgagaaacttaaacaacccaaaaacaaacagaaaaaaaaaaatggtgctgctgaagggacagcctttggtcgcaagactggctgctttttccaaatacgtagtccttcctggatccatggttgctgctattatttactcccctcccaattatgattctcccaagaagggcaaatcccctaattaatttttctctcctggtatctttttccattaatggggttttctgcaagatgtcacctgcatactgtttctaggtttgtagagagttgaacgtattttatttgcctttagaagaacttttctgttatgaatcttcccttcttctcagactttgtcaaaagaataagatattatgtaatgaatacaagaatgccccattcgtaac

SEQ ID NO: 8984 - DNA, 454 bp, Gossypium hirsutum
  Clone ID: uC-gsronu33b112c07b1
taaaatatctgctttttcttagttttcctttttgtcccttgtttatttgatatttccccctcatggccgccgctgatgtcgagttccggtgcttcgtcggagggctcgcatgggccaccgacgaccgggccctcgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacatcaccgtcaacgaagcccaatcgcccagaagtggatgccggtggcgaggatttggaggaggaaaccggtggttacagccgcggtggaggcggcggcggattgggtggtcgccaaggaggatatggtggcggacgccgtgaaggtggatcggaaatgg

SEQ ID NO: 8985 - DNA, 394 bp, Gossypium hirsutum
  Clone ID: uC-gsronu33b112c08b1
ttttcttaaatagatatgagaagagaaaaaaaaagagaatacacaagagaaaaatatatataaaatcaaaagagccacgaacaccttttagtttccaaactcttttgatttgcttgtatgcgctttgatacctaacatatgtgttacatacatactttttgtgagaaaaaaatcttttttacaatccgcgcctcccgtttcgttttgactccttcttgggtctatagtggattacactagtagaaaaatattgtgtttctttgtgtctaccactgtgcgtgtgttgtgtcgggtttctgctccttgtgtgtgttttcttttgcaggtgtggtcaagacgctgagggcacaaagtatggacgatggtatgggacacccgtgtcgggtgttgtgca

SEQ ID NO: 8986 - DNA, 320 bp, Gossypium hirsutum
  Clone ID: uC-gsronu33b112c09b1
tcttactcattcactcctacacagtagaaaaaccctttaattttaagaaggatattttggttttatactgagaaatccaacttcttttgtatctttatctttttggtacttcaattatcaaaagagagaaaagcaagaacaaaaaaaaaaaaacatacaactaagtgaaaaaccagacaagagagaaaacaagaaaaatgggtgttctggatcatgtttcagatctgtttgactgttctcacagttccaagcacaagaaacgtaagcagttgcagacggtggaaatcaaggtgaaaatggactgcgaaggatgcgaacgg

SEQ ID NO: 8987 - DNA, 581 bp, Gossypium hirsutum
  unsure (1)..(581): unsure at all n locations
  Clone ID: uC-gsronu33b112c10b1
ggcaaccctaacctcttctccatctccctccattctctcttcctccaccgccaatcctaaaaccccttatctgaagccgccgctcctcttcttccccaagcctcttaccaccgctctaaccaccgctttagccaccaccaccttactcctaacctcccctccctcctccattgcctctgatgcatacaacgtctactacggaaccgccgccagtgccgccaactacggaggctacggtggaaactccgacaagaaagcctccgctgagtacgtctacgatgtccccgacggatggaaagagcgtttagtttccaaagttgaaaagggcaccaacgggacggacagcgaattctacaaccccaagaaaagacaagagaaagagtacttaacattcttggctgggttcaggcaattagccccaatagacgtgattttgaacaacttggcattatcagacgtcgagttgcaggatttgattgccggggccgacagcttggtctccgaggagaagaaagacgagaatggacagctctatnatgtgtacgagattgacggaatcggtagcatagtttgattgcagt

SEQ ID NO: 8988 - DNA, 494 bp, Gossypium hirsutum
  Clone ID: uC-gsronu33b112c11b1
gggaagttgatgaagtcaaagagttaattatcatcgccaaggagtatgttcttggtctgcagatggagcttaagcgtagagaattgaaagacaatccggtacgccagcaggagcttgctgcctacttcacccattgcaaccttcaaatacctcatctcagacttgctctgcgaaatgcattgaccatctgtttcaaggcgaaaaacctggctacagccgctaactttgccaggcgtcttctagaaacaaaccctaacgagaaccattcaaaggcagcgaggcaagtactccaggcttcagagaggaatatgacagatgcatctcagttaaactacgatttcaggaacccttttgtgacatgcggggcaacttacgtcccaatttaccgaggacagaaagatgtatcttgcccttactgtactactcgctttgtgcctacccaggaggtcatttgtgtacaatctgtgatctcgctgtcattggagcagaccatc

SEQ ID NO: 8989 - DNA, 458 bp, Gossypium hirsutum
  Clone ID: uC-gsronu33b112c12b1
taaaaacttttgcctctgaaactatggctccgttctctttacgtagccgtcttcaggcttctgcgctaagcaagaggcgtctcaaatccaaagccaagcatgggaggaaagggatgaagaacatggcggaaagcttcaaaagattgaaatctgaaatggaagaaataagcgaggaacaaaagaatatcagggaagggcaaaggcaagttaaagaaaaattcggaatcatcgaatccgagtgcgaggaattgaagagggaaactaggctcataatccagcaaagtgcgagaactcaggttaaacttgctcttattttccgcatactgaaagcaagggaagccgtcgagttgaataccgctgccactctcactgaaatgctccgtgaaatagttggaagagagagggagggaagcaaagctgacatctgaatgactatgataagctcctcggtgcagctg

SEQ ID NO: 8990 - DNA, 484 bp, Gossypium hirsutum
  unsure (1)..(484): unsure at all n locations
  Clone ID: uC-gsronu33b112d02b1
gaagaacacaagaagaaagtggaagcaaagaacgcattggagaattacgcttacaacatgagaaacacagtgaaagatgaaaagattggttcaaagctctcaccagatgataagaaaaggattgaagatgctattgaagaagctattcaatggttggatagtaaccagttggctgaagctgatgaatttgaagataaaatgaaggaattggagagtggtttgtaaccctatcattgctaaaatgtacccaagggctgngtggtgatatggtggagggnatnnnngngngnatgctccctccgtctggtggaaggcggtgctggccccaagattggggaagtagactaagtaattggtgtgggctctattttaaattagattcgcttaaatacagtttattgcttgacttgggtaatttattttgtatttgggttttagactttgtttttaatgagatgacttttaatccttttacatatgagac

SEQ ID NO: 8991 - DNA, 435 bp, Gossypium hirsutum
  unsure (1)..(435): unsure at all n locations
  Clone ID: uC-gsronu33b112d03b1
cccacgcgtccgaaaaaattgtgtttagatcagaaatggggtcccaaactcctctaaagctcccagtcattgatttcagtaagccagacctaaaagcaggcagcaatgagtgggatttggtgaaagggcaagtccagcaagcacttcaagagtacggttgcttcgaggctttgttcgacaagatccctctccaccttcgagaggcaatattcggatccttgcaagagcttttcgatctccctttacaagccaaaattcgnaatgtttccaataagccttatcatggtntacgtcggccaataccctcaagtcccattatatgaaagctngggcgttgatgatgcaaacattactgaaaaagttgaagccctgactactaccttatggcctcagggatntcaagtttcagcaacactatacaatctntctagaaca

SEQ ID NO: 8992 - DNA, 454 bp, Gossypium hirsutum
  unsure (1)..(454): unsure at all n locations
  Clone ID: uC-gsronu33b112d04b1
taaaaaggtcatctagagcctgagagaaagattggtggaggggtcaaagctttccaaatccgtaatcatccccagtggaagagtaaatgtttctttgtgattagggatgatgaaactatggatgattttagcttccgcaagtgtattgatcatatccttcccttgcctgaagatttgaagggaaagagcaattcaaacagggcatcgggtggcggtggcagttggagaggacgtggtgggaaaggaggcggacgaggccgtggaaaaggtggtaagtcaagaaactaaggtggtagtagtagttaaggcagtctgaattttggattaaactctttggtaggaccagaactgctnttgtttgattatatatctgaccctaaagttccaaattgaattgcactttggaagttatggtactnggatgttttcagtgcttctttttttatggcattta

SEQ ID NO: 8993 - DNA, 385 bp, Gossypium hirsutum
  Clone ID: uC-gsronu33b112d05b1
tttcttacctcttggctaatcccgaagcctgcaactaggatctaggttgctttgaaatcttatgcttgcttttaaagaagagtctgcttttaatgttgtgcttttgatagctactgtttcggcttaagacatatattgctgttgttcatgaggagaaacctgaagaagtggtcaaggttggagaaattgcaacagaagaggtaccggctgttgctcctgcagcagaacctgttgctgaagaaccaaaggaagcagtgcctgaagcagcatccggagaaccccaagctccagatactgaagccacagttgaaactgaatcaaggaggtggtttaagagcccaaggctgtgactgaggagccagaagttgagaaaaaggaagaagag

SEQ ID NO: 8994 - DNA, 395 bp, Gossypium hirsutum
  Clone ID: uC-gsronu33b112d06b1
tcccacgcgtccgcccacgcgtccgcagagatgagcactactgaatcaggacatggatgcggctgtggatcaaactgcaaatgtaatccatgcaactgctgaaaagcttgatgaaagccatagattatgaaaaaagaaagcagcaaaataacaggcctctgtaatgatttattttcaaggatggatgcgcgcaaggtctataattatgtctctgtctgtcttgtgtaatagaagctttgtttgtggtaaaaataatgtataagccatttggttgggagcaaattttccttttgtccaaaggatttttgctgctcattcatggtgacttggtttatggtttcatctgttggtgttgaaatcttataaaaatatatatcggtgctgcttatggtttg

SEQ ID NO: 8995 - DNA, 534 bp, Gossypium hirsutum
  Clone ID: uC-gsronu33b112d08b1
tagaagataacaaagcgtttgtcttagatctcagaagatggcccgtaccaagcaaactgcgcgtaagtcgactggtgggaaggctccaaggaagcaacttgctaccaaggctgcccgtaaatctgccccaaccaccggtggtgtgaagaagcctcatcgctaccgtcctggaactgttgctcttcgtgaaattcgaaagtaccagaagagtactgagcttcttatcaggaaattgcctttccagaggcttgttcgtgaaattgcccaggacttcaagactgatttgcgtttccagagccatgccgttcttgctcttcaggaagctgcagaagcataccttgtgggtctctttgaagacaccaacctgtgtgcgatccacccaagcgtgttactataatgcccaaggacatccagttggctcgtaggatcaggggcctagcgtgcttaatttccaagtgtggttgatcacttaacttagaatggagaaactgtttgtttgttggtaggcagatgtattgtaccatttttttttta

SEQ ID NO: 8996 - DNA, 526 bp, Gossypium hirsutum
  Clone ID: uC-gsronu33b112d09b1
taaattttctttcatcctctccgatcacattcgcaatggattacgatttcaggaacagaacgggtccaccgtacgaggcgcagatcccgatttaccggcaacaacccacttcatcgtcatctacccatccgatgtacggatcttcaatgtacccgaggatcggtggtcaacccgccgctcacagtgttgcccctcccaccactcgcgcctcttctttccaccagaattcttcgccttcctcttcctcgggattgggcattagggttgctttgaaaccagaatatcgtattacacctccgcctcagttgtctccccaagttggggatattcctcgaagcaattttcagttggatttcgagtttgagaggaaaattttggctgaagcagaaaaagaaaacatgaattggagtaagcttggcttggaaaacctttcttccaagcctatcgaaacttcttcttctacgggtgcaactcagatcctgtggtgagcaaatacattgcctctggactcagccgagaagcagtg

SEQ ID NO: 8997 - DNA, 542 bp, Gossypium hirsutum
  Clone ID: uC-gsronu33b112d11b1
tcccacgcgtccggttttctctgtttgccatttgccttaatcatcttcctctttctttaaaacctcttcctatttaatttccgactaaacttgcgctgaattccatggctactgcagaggttgtatcagctcagactgcaatccatgaggagaaacctgaagaagtggtcaaggttggagaaattgcaacagaagaggtaccggctgttgctcctgcagcagaacctgttgctgaagaaccaaaggaagcagtgcctgaagcagcatccggagaaccccaggctccagaaactgaagccacagttgaaactgaatcaaaggaggtggttaaagagcccaaggctgtgactgaggagccagaagttgagaaaaaagaagaagagactcctaaggaaacggtagcagagccagttgccgaggagtccaaggagtccaaggagacttctgagccaacagctgacgaatcccaagaaagcacagagtctacagaagcagcagcagcagcagcagcagcagcagcagcagtaaaagcagaacccgag

SEQ ID NO: 8998 - DNA, 418 bp, Gossypium hirsutum
  Clone ID: uC-gsronu33b112d12b1
tgtgtttgtctattgaattctttccttcactttctcgagaaaaaaaaaatgtcttcaggttgcaattgcggatctagctgcagctgcggatctggctgcaattgcggtgagaactgctcaatgaaccttaaccttggatactcggagaagacaaccagcactcagaccatcatctccggagttgcgccagtgaagatgacctttgagggaccagagatgggcactactgaatcaggacatggatgcagctgtggatcaagctgcaaatgtaatccatgcacctgttgaaaagcttgatgaaagccatagattatgaaaaaagaaagcagcaaaataacaggcctctgtaatgatttattttcaaggatggatgcctgcaaggtctataattatgtctctctctgtcttgtgtaataga

SEQ ID NO: 8999 - DNA, 424 bp, Gossypium hirsutum
  unsure (1)..(424): unsure at all n locations
  Clone ID: uC-gsronu33b112e01b1
ttaaaaaggttccttctatccatgggtatacaatgggtttgaaactagagcagttcgtctttgatgcatttccatatgctacttcaactgctttgtttgaggtattacgagaggaagagtttgcaccagtgaaaaatgccaacggttcaaattatgacactccagacagtgcaaggttgcttgttctgcggctacacacacgttgggtagtagctgctggtggcttcttaacacattcagtgccattatatgcaactggtgtggaggtatcaccactttgttcgtacactggagaaaacttggagtccatatgccgtggaagaacatttcatgcaccctgtgaaatcgcattttagttcaactttgtaacgtagccacacattctagatgatttgtgcagtgatnttgggttgatgatgtaaga

SEQ ID NO: 9000 - DNA, 569 bp, Gossypium hirsutum
  Clone ID: uC-gsronu33b112e02b1
tcccacgcgtccgcccacgcgtccgcccacgcgtccgcccacgcgtccgaggcaatggccggtgtgaagccatgtgcatcgatggtactaagcgcctttgccacatccgtgggaagatgcataagaaggtttggattgctgccggtgatataatccttgttgggcttcgcgactatcaggatgataaggctgatgtgatcctcaagtacatgccagatgaagcaaggctcttaaaagcctatggtgagctcccagagaatacacgtctcaatgaaggcattgtcgatgaggaggatgaaggaggtgcagatgattatgttgagttcgaagatgaagatatagacaagatctagggttttggatttggttatgtttgatacatgtgtttaaatgttagaaagggattgcttgatgttgattggatgctgctaagaagcctgcaaatcctgggatttatcccagatgcataagtttgcatttgtaagagtgaatgttcattctagagtaatgttaattttgctaaactgtgttctatatctcaatttactatgaaagttagcttattctgg

SEQ ID NO: 9001 - DNA, 508 bp, Gossypium hirsutum
  unsure (1)..(508): unsure at all n locations
  Clone ID: uC-gsronu33b112e03b1
taaaaatgatgacccttttaactccactctcccataactctttatcctctccacaattatcaacgaaacgccatggttgtcctcttcatcaaccccatgtacctctcagaatcacctgttcttcttctgctagcaaacgtgttcccaaatccgaggaatctccctttaaggaactgaggactgtagcttgtggccttcttgctgtatgtaccgttgccactgcctcgcctgtaattgctgccaatcagaggcttcctccgttgtcaacggagccaaaccgatgcgagcgtgcattcgttggtaacaccataggtcaggcaatgggtgtgtacgataagccgcttcgatctacgcttctgcgattacactaacgagaaatcgaacctgaaggggaatatctcttgcggctgcacttatgtcggatgctaagttngatggtgcagacatgtctgagctgntgatgtaaaggcttatgctgctggagctagctcaaaggtacagacttctc

SEQ ID NO: 9002 - DNA, 535 bp, Gossypium hirsutum
  unsure (1)..(535): unsure at all n locations
  Clone ID: uC-gsronu33b112e04b1
tcccacgcgtcctcccacgcgtccggctatgacaagattcaaggatgcgatttacatgaaggtgaatgggggaaagtcggtaccattgtccattggagttatgtgcatgatggaaaggctaaaaaggcaaaggaagtagtggaagcagtagaccctgataagaatttggtcactttcagagtgatcgaaggagatctaatggaagagtataagagctttgtaatcacgattcaagtttcgcccaagagcgagggtagtggcagcgtagtgcactggactttggaatacgagaagctgcacggtgnggattgagcatcctgagactctgctgcaattcgttcaagatgtctctaaagacattgacggccacctcacccagcaagtatagcagtatcacatgatgctattgttgccgctacttgaagcactattcatctatttaatgattaaagtgacaacttccttctcatgttttttgatctgataggtacgtttagatcaatatgcagtccggggaggagctttgattttctgc

SEQ ID NO: 9003 - DNA, 456 bp, Gossypium hirsutum
  Clone ID: uC-gsronu33b112e06b1
tcccacgcgtccgctctcctatactcaacttcttccacttaaaagcaagttagctagctagggttttgtgagccagagagatgggttcaaaaagaacggcatcactagccctcttctttgcactcaacatcctctttttccctggtgagtgcttgtggttgctgcccttcccccaaccccaaacctaaacctaaaccaaagccaaaccccactccctccccatcttcttctggcaagtgccctagagatgctcttaaactcggtgtatgtgctgatttgctcggtggcttgctcaacgtcaccattggtacgcctcctggtcaaccctgctgctctctcatccaaggtctggctgatcttgaagctgccgtttgcctttgcacgggaatcaaagctaatattttgggcatcaaccttaatgtcccactgtaccccaacttgcttcttaatgtctgc

SEQ ID NO: 9004 - DNA, 463 bp, Gossypium hirsutum
  Clone ID: uC-gsronu33b112e08b1
gcgttttggggaagaaagaagatggtcaataattttccattctttacacaatccccatttttcactttccgttccgttttatatttatgagatacatttattgacaatattcagaaattgtctagatgaatggaattatagcttcctgttatttggttgtttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaggggtcccaagtttacgtccccgggcttgcaacgtaatagcttttttttggggccccctaaattaatttcacgggccggggttttacaccggggggccgggaaaaaccctgggtttccccactttaatcccttgggagcaaacccccttttcgccagtgggggtaatagcaaaagggcc

SEQ ID NO: 9005 - DNA, 157 bp, Gossypium hirsutum
  Clone ID: uC-gsronu33b112e09b1
tcttccacgcgtccgaaaaaaaaaaaaaaaaaaaaaaaaaaaaaaaaaaaaaaaaaaaaaaaaaaaaaaaaaaaaaaaaaaaaaaaataaaaaaaaaagaaaaaaaatataaaaaaaaaaaaaaagcaataaattttatataatataaaataatttt

SEQ ID NO: 9006 - DNA, 594 bp, Gossypium hirsutum
  unsure (1)..(594): unsure at all n locations
  Clone ID: uC-gsronu33b112e10b1
tcccacgcgtccgatagtctccaatttgatctccattgacattctaagggattgtcaaagagaaacctcaaaaagaaagggtgttcaaagagaagagaagagaaatggtgggtccagttaggccacagttcgtcctctttggttcatccattgttcaacttagtttcagcaatggtggatggggtgctattcttgctgacgtctatgcccgcaaagccgacatacttttacgaggatatttcggatggaattcacgacgtgccatacaggttctcgatcatgttttcccaaaggatgcttctagacagcctgaattgataataacttattttggcggtaatgactcgatgggggctcatccatctggccttggcccccatgttccacttcctgaatatatcgagaacatgaagcaaatagtgaattatctgaagggcctttcagattcgacgcgtgtcatatttcttactagtcctccggtcaatgaagaaagagtaaataaataccgcagtgaacattntagccaccttgtttcgacatacgagttatgccagacatatgctgatgcttgtgtaaagctctgccaggaactgg

SEQ ID NO: 9007 - DNA, 524 bp, Gossypium hirsutum
  Clone ID: uC-gsronu33b112e12b1
tatagttcaaaaggagcagaggtcacaattcggcatcaagaatcccaggacggttatcgtggtcactccgacgtatgtacgcactttccaagcgctgcatttgaccggtgtgatgcactctctaatgctggttccctacgatctggtttggatcgtggtggaagctggtggcgtcagcaacgaaacggcgtcgcttattgcgaaatcgggtttgaaaactatccacgtcggattcaatcaacggatgccgaattcctgggaagaacgacataaattagagtccaagatgcgtcttcgtgctctaagaattattagagagaagaaattggatggaattgttatgtttgccgatgatagcaatatgcatagtatggaactttttgatgagatccaaaatgtgaaatggtttggggctgtttcagttggaatacttactcattcggttaatactgatgagatggcggatcggaaaaggatgaagaggagaatcctagaatgcctgttcagggcctgcttgtacgcct

SEQ ID NO: 9008 - DNA, 256 bp, Gossypium hirsutum
  Clone ID: uC-gsronu33b112f01b1
tgttgtgggcggacaattggtgcttaattccttccttacaatccatctttgaaccatgttgctgcttaaaaggatgtttggagctggagagtggattgtggtgcttttttattttattttattttattatttaatattcaagggttttgagaacattaatgttaatagctattattgtacgagatttttttttgaaaaattagtgtcagtttgcggtcaaacttctatggaacttatatttaatacctggttttgg

SEQ ID NO: 9009 - DNA, 73 bp, Gossypium hirsutum
  Clone ID: uC-gsronu33b112f02b1
cccacgcgtccgggattctacccgccgctcggtgggaattacgctccagggaggcgcccgcgacttgtccgcc

SEQ ID NO: 9010 - DNA, 417 bp, Gossypium hirsutum
  Clone ID: uC-gsronu33b112f03b1
tcccacgcgtccgcccacgcgtccgcccacgcgtccggcaagtaggggatgcctcgggagacgagtgcgctagagtcacatgggcagcaacggcgcataggaaaggagggaaccctaggattccctggtgttgtttagtttttgggctctattgggccgtttagggttttagattactttgggccatgttgggccattaaggatttgggtaagtagtttgttattttattttgttttgtaattggactcttattgggctagtcaaaaattggggcgtgtacatcaatattttaacatttttatttatatattaaaattcaaatatgtataagtttgacggataaaactcaaaattgtacatcaactttatccaatgtgcaatttgatatttttttaaaaaaaaaaaaaaaaggggcg

SEQ ID NO: 9011 - DNA, 411 bp, Gossypium hirsutum
  Clone ID: uC-gsronu33b112f05b1
tttgttcacaatgggcgcatttcaccgactcaacttgctccatttcacgctctctttagttgtcattgccgtcaatggccacaatataacggccattctcgaaggttttccagattactctgtttacaatagtttcctcacccaaacaaagctggccgatgagattaacacccgagagaccatcacttgccttgtcctcaacaatggggctatgtctgccctcacatccaaacaccccctttccgtcgtcaaaaacatcctcagccttcacgttctctggactactatgacccccaaaagctccacaaaatctctgatggcactaccctcaccaccacgcttttaccaaactactggttatgcccctggaaaccttggtttcgtcaacattaccgacctccaaggtggcaa

SEQ ID NO: 9012 - DNA, 417 bp, Gossypium hirsutum
  Clone ID: uC-gsronu33b112f06b1
tttaaatgaagggtctgcaggcacttatattggcaatggtaatggttatggcgatcgctacaactgatgctcaaagcatttgcaacatgccagcttcaggtttgatggcatgcaaaccagcagtgaccccccccaaccctccgtcgtccacgtcaacttgctgctccgccctctcccacgctgacatgcgttgcctttgctcatataagaactccaagctcttgccttcccttggtattgacccaaaccttgccatgaaattgcctagcttgtgcaagcttcctcatcctgcaaattgttagttcctggttctccatatttgatctcaaatgtgagggaaaatcatgcttattataagcctctacttcacataattgtactgactttcgggtttttctttttcctttatttctttta

SEQ ID NO: 9013 - DNA, 502 bp, Gossypium hirsutum
  Clone ID: uC-gsronu33b112f07b1
tcagaactttatgtctttgcatcttctgattgtagtatgtattataagtgcatgggatgttatatttgaaattcaaatctatgttgcttggattcgagtgtgagtgttgaagatagggtatgtgaccgatactattatttagagtgtccttggtggatcttatctctatacccatgtttgcatatatgttggatacaagtaccaggacatggatacttaaaggaaaaatctgttcttgactcagtgaactggttagggttctcttatacaatctgtttcttgcttttttgtcactatcattcattattttgaagctgatttaagatatcatcaccttgtggatcaccacaggttttcatttttgtagctgctgagtatgaaacaagaaagaattccttgaatcaggattcgctttgggatgctataatacctgccaaagagcgtgcaaagttttggatccgcagcttaaacatatttcgatttgttgatcacggaaagaacc

SEQ ID NO: 9014 - DNA, 441 bp, Gossypium hirsutum
  Clone ID: uC-gsronu33b112f08b1
gctgagtttaagcatatcaataagcggaggaaaagaaacttaccaggattcccctagtaacggcgagcgaaccgggaaaagcccagcttgagaatcggtcgccatcggcgtccgaattgtagtctggagaagcgtcctcagcgacggaccgggcccaagtcccctggaaaggggcgccggagagggtgagagccccgtcgtgcccggaccctgtcgcaccaagaggcgctgtctacgagtcggcttgattgggactgcagccctaatcgggcggtaaattccgtccaaggctaaatacgggcgagagaccgatagcgaacaagtaccgcgagggaaagagaaggttgtgtatattcacgggaattggtgtgtagtagaatggaaacctgttatacgtaatctctaatgattattcaaaattttattggcatacacgtttga

SEQ ID NO: 9015 - DNA, 536 bp, Gossypium hirsutum
  Clone ID: uC-gsronu33b112f09b1
ttcccacgcgtccggaacttttctctctatacttgggcaaaatgatgcaatactcttctggagtctttaggacaggagaagaacatttggacgttgcacagcgaagaaaaatcagttctctaattgagaaaacaaggatagagaaatggcatgaagttctcgacattgggtgcggttggggaagcttagctattgaaactgtgaaaagaacaggatgcaaatatactggcatcactctatcagaacagcaactgaaatatgctcaagaaaaagtgaaggaagccggactcgaggataacatcaaaatacttctctgtgactatcgccagttacctaaggaacaccaatttgacagaatcatatctgtagagatggtagaacatgttggtgaagaatatattgaggaattttacagatgctgtgatcaattactgaaagaagatggacttttcgttctacagttcatatttatcccagaggagcttttcaaagaaatccagcaacagctggttttcttaggaatatatattccctgg

SEQ ID NO: 9016 - DNA, 540 bp, Gossypium hirsutum
  Clone ID: uC-gsronu33b112f10b1
aaattaacaaggtattgttgcccagggagttgtacaagccagtggaagcaccggctgagtcacccaagccatccaaatccaaatccaaatccaaacacaagatagccgatgcaccggaatccgatgcaccagcggagagtgatccagctgatgatcagacggcagacaatgacaatggggttgcaggactggacggtaggagattggtgatgtggatgctgagcctgtgcattggggtattgctgatttgaatacactgatatagaaatatttatcagattgatacaaatggtatgggagacaatactttttaggccattggataacgagaaatggggtccttatttcatgtgagagatttgaaattttctttttcttttaatttctttggtggtttgtgagcaaaagagcaataagtgatgagtcccacttgcatggggccattttgtttattcttttttatttatctccgtttgtaattattagcttgtaatgtatagaataggttacattgcgtaaatctaattttttaaaggtttt

SEQ ID NO: 9017 - DNA, 432 bp, Gossypium hirsutum
  Clone ID: uC-gsronu33b112f11b1
tcgcaggatcctcggtcctaaggcttcttgcatttccttcaaggactctgcttgtcgttgctttggttacatggtatccaagaagaagtatatcttcaccattgacgacgactgctttgttgctaaggacccatctggcaaagcgatcaatgcacttgagcagcacatcaagaatctgctatcaccatccactcccttcttcttcaacaccttgtatgaccctttccgagagggtgcagattttgtccgtggatacccatttagtcttcgcgagggcgttccaactgctgcttctcatggactttggctaaacatcccggattatgatgctccaacccaactggtgaagcctcttgagaagaacactaggtatgtggatgcggttcttacaatttccaagggcacctttgttcccatgtgtggtatgaattt

SEQ ID NO: 9018 - DNA, 340 bp, Gossypium hirsutum
  Clone ID: uC-gsronu33b112f12b1
tcaaaaagtagcggcatcagttttgtttcggtttaggttaagatggtttagagggtcgggtcggagtttgagacatggcattcatgttatctttttaaacctctatttactgacgattccgagtgtaaaagaagtagtggaagcagaaaaaccagataagaatttgggcactttcagagtgaaccaaagagaacttatggaagaaatataaaaactttgtaattaccatataaatttttatcccaaaaaaaaagtttggggcggcgctcttaaataaaccaggggacccccccaaggcttcccgcgggaatgggccttccgggggccccctaaaattttt

SEQ ID NO: 9019 - DNA, 153 bp, Gossypium hirsutum
  unsure (1)..(153): unsure at all n locations
  Clone ID: uC-gsronu33b112g02b1
gctcttaggtactagagcgcgacctttccatgccctagcatcgacgaaagagacaaaacatggggtagagcgcccgccaaaaccagctaaacatggcgacatgagtgcatcaaaaaaaaaaaatcnctccttttctctcatccctgcaattca

SEQ ID NO: 9020 - DNA, 378 bp, Gossypium hirsutum
  Clone ID: uC-gsronu33b112g03b1
cttaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgaaggttgttgacattgttgacactttcaggcttcaggagcaaccccctttcgacaagaagcagtttgtcgtgttcatcaagaagatcatcaagaacttgacaccaaaactggatgcggaaaagccagagtccttcaagaaaaacattg

SEQ ID NO: 9021 - DNA, 499 bp, Gossypium hirsutum
  Clone ID: uC-gsronu33b112g04b1
ttttaaaaaaaaaaaaaaaaaaaaaaaaaaaaaaaaaaaaaaaaaaaaaaaaaaaaaaaaaaaaaaaaaaaaaaaaaagaaaaaaaataaaaaaggaaacagattaaaaaaaaaataaatggggggtcagtttattagaatccagttatctaacggcagtttaatccgcccttaaatttttcttttttggggaccggtaaaaccttttattggcccgccttttcccccctgggggacttggaaaccccggcggttccccatttatatggtaggtggtaaaatccctttttttccagtggttgcaaaccctaaagggcccttgggattagcctttccaaaaattttgacagcgctcttgggaaaggggtccccccctttatgggttttttaatggccggggttttgggtttccccccctgggtttctttcgttttttccctgtacctttcgccggtttttccggttatgttctttccttggggacccttttgggggtttt

SEQ ID NO: 9022 - DNA, 390 bp, Gossypium hirsutum
  Clone ID: uC-gsronu33b112g05b1
tgactagttctagatcgcgagcggccgctcgggatctagaactcgagttctttgtttaagaataaggatcttttaagatacgcctgatcacattaaataagccgatccccgtctcagtctttcgatcatatgaggctgattgaccttgtttgagcctagtgagttggctggacccggatccctaccgagctggaatcgatgagttcgttgcttccactttcactttgcagactaagtgttccactgtgatgggagtccttagtgtaagatcgcacggtgctgatgccccgaatgaagggactggtggggcttttggtggtatgatctttgctccggctggctgcaatggtggtttgcatgtggtcatataatcggcggtgacattgggct

SEQ ID NO: 9023 - DNA, 601 bp, Gossypium hirsutum
  Clone ID: uC-gsronu33b112g06b1
tctttcgcgtccgtccacgcgtccgatccagttgagttggatggattaaggaatgcacatatccgggatggtgcagctgttgtgcagtatcttgtctggttggataaacagatgcaagagatttatggggcttctggctacttcttggaggggaagggagcaagcaaaaaaagattcagagagactatgaaactgactgaggtgactgctagtgataagttggagggatttcgtgcaacaaaagagcactttagaggcctaagtttccctactatttcttcggttggtccaaatgcggccgtcattcattactcacctcagcctgaaacatgtgctgaacttgatccagatagcatttatctatttgattcaggagcgcagtatctagatggaacaactgatataactcggacagttcattttggaaagcctttagaacatgagaaggcttgctatacctcagttcttaagggccatattgctctgggaaatgctcgctttcctaatggaacatatggtcatgcacttgatattctagctcgaattcctttgtggaggtatggtcttgattatcgacatggtactgttcatgcattggatc

SEQ ID NO: 9024 - DNA, 288 bp, Gossypium hirsutum
  Clone ID: uC-gsronu33b112g07b1
tcggacgcgtgggcgtactctcaattggagaagctcttttgtattagatcgcgacttttccttgctcttttttagccgacattgccagaacatggggtagagcgcccgcgaataccagctaaatatggcgacatgagtgcttcaagttatgctcttactccattcaatcatcctgcaatcaccactccagaggaacaaagcttactcatttgcaatagggcactgcggtctagatggatccaagggttacatcacgctctcatacaggaatcaaagctactctatagg

SEQ ID NO: 9025 - DNA, 487 bp, Gossypium hirsutum
  Clone ID: uC-gsronu33b112g08b1
ttttctctcaatactgtttcactaaaaaatgccaatcaaaaaagatccttcgattccaccgccgatgatcagcaagatcggcccttacaccgtcttcgttaccccttcgtcaaccccttctccaactgaccctcctgtttttcactctcccaagaaggcggcgccgccttctccttctccttatccttctgctccgccgcctgtccagccacctccccaacagttcgacaagtctttccttacttcccaatccctttccgatggttcatttttgggtttcttcaaaaacgctgccttcaaactccaaaacgctcattcaagcttggatgaccattagctcgttggttaggcttaaatcagtccaagtatcaatgggcattggacgattattatgagagcaagggattggaaaggaaaggggtaaaagtgaaagaaatatctagcaaaatcaaagtgtgtagcatacttctggtcccgaacttgactg

SEQ ID NO: 9026 - DNA, 548 bp, Gossypium hirsutum
  unsure (1)..(548): unsure at all n locations
  Clone ID: uC-gsronu33b112g09b1
tggatgccaagatggacaagagcagtgtccatgatgtcgtcctcgttggtggttccactagaattcccaaagttcaacaactattgcaggatttcttcaatggtaaagagctttgcaaaagcatcaaccctgacgaagctgtcgcgtacggtgccgcagtccaagccgcaatcttaagcggcgaaggcaatgaaaaggtacaagacctcctgcttttagatgtcaccccgttatccctcggattagaaaccgccggcggtgtgatgactgttttgatcccaagaaacactaccatccccaccaagaaagaacaggttcttttcaacatactccgataaccaacccggtgtattaatccaagtttacgaaggtgaacgaacaagaacaagagataacaacttattaggcaaattcgaactctccggcatcccaccggctcacgaggtgtaccgcaattactgtgtgcttcgatttgacgccacggcattnanacgtttcagcgagacatacaaccgtcatagacatatcacatacgaacgataagagac

SEQ ID NO: 9027 - DNA, 508 bp, Gossypium hirsutum
  unsure (1)..(508): unsure at all n locations
  Clone ID: uC-gsronu33b112g11b1
tagcaagaaaaagaagggaaaatggaagggaaagaagaagatgttagattgggagctaacaagttctcagaaaggcaacctattgggacagcagctcagtcccaagatgataaggattacactgagccacccccagcacccttgtttgagcctagtgagttgacttcatggtcgttttaccgagctggaatcgctgagttcgttgctactttcctattcttgtacatctcggtgttgactgtgatgggagtccttaaggacaaaaccaagtgtacaactgttgggattcaagggattgcttgggcttttggtggtatgatctttgctcttgtttactgcactgctggtatctcaggtggtcatataaatccggcggtgacatttgggctgttcttgggaaggaaattgtctttgacagggcaatattctacatggtgatgcagtgcttgtgagctatatgtnggctgtgttggtcaaagcgttcatgtggaagacaggtatggtgctt

SEQ ID NO: 9028 - DNA, 493 bp, Gossypium hirsutum
  unsure (1)..(493): unsure at all n locations
  Clone ID: uC-gsronu33b112h01b1
tcccacgcgtccgcccacgcgtccggcccttccacatgccatcctccgtcttgaccttgcaggtcgtgatctaaccgatgccttgatgaagattcttaccgagagaggttacatgttcaccaccactgctgaacgggaaattgtccgtgacatgaaggagaagcttgcttatgttgccctggactatgagcaggaactggagactgccaagagcagctcatctgttgagaagaactatgagttgcctgacggacaagtcattactattggagctgagagattccgttgcccggaagtcctcttccagccatctttcatcgggatggaagctgctggaatccatgaaactacctacaactctatatngaagtgcgatgtgnatatcagaaaggatctctacggtaacattgtgcttcaggggggttcaaccatgttccctggtattgcagaccgcatgagcaggagatcactgctcttgctccagcagatgaaa

SEQ ID NO: 9029 - DNA, 293 bp, Gossypium hirsutum
  Clone ID: uC-gsronu33b112h02b1
ttgacgcgtgggggacagttcttgctttgtcagctaatatcttcacaagtttagagttgtatcattagttccttctttgctcatagtaaagatttgttggtttcatgatgtgggtcttcattattttgagctctggttgagtgactcctttaaggtatacctgcaacttcccatctttgcatggttttaaataaccattagctccttttcatttgttctccacctttgtttttatggtacttggcttctaaacctggaacactttatagacatatattttcagattattgcta

SEQ ID NO: 9030 - DNA, 529 bp, Gossypium hirsutum
  Clone ID: uC-gsronu33b112h04b1
tgaaggtcgatgtgcaaaacatcatcgagacacttggtgctggacacggtggtagagtatctcttacccgcagttacgttcaggcccttgaagcgtcaatttcccgaaacttcccggacaatggatgcatagcatgcatgtgccataacactgatggaatctacagcaccaagcagaccgctgttgttagagcttctgatgacttttatcctcgtgaccctgcttcacatactatccacatttcctcagtggcttacaacactcttttcctcggagaatttatgcaacctgatcgggatatgttgcatagcttacacccagctgcagattaccatgctgctgatcgtgctggtgagtggatgtgctatctatgttcagtgataagcctggacaccacaattcacagctcctgaggagctggtccttcctgaggaatcagatctccgcacccaattgcctggcaggcctaccgctgactgttctttcgctgatccggtagagacgggattagcttactcaagattggaat

SEQ ID NO: 9031 - DNA, 561 bp, Gossypium hirsutum
  unsure (1)..(561): unsure at all n locations
  Clone ID: uC-gsronu33b112h05b1
tgtttgctaatggttttgtttcgtcgagagttctcgttttgtgattcattgtatttatgggagatgatgtgggctctcgaatatgatccggacttgttctctctgtatgaagaacctggatcaaatattacgaaggctgttggttctaacaaagggaaaccaaaatcgagacgtccttgtgggaagtatgagagagaaaatatgaaaattaaaagctccgatgcctccctccccatttctgttttccttgttgcaagtgtcttaaaagataagagctcgaaactactgcatgaagctcggggcctcgatgatgtagttaagattctaaatgacatgactggtaatttggatgccaagaaagcctgcattggggcaatgaaacttcataagaaatatttaaaaaaggcaaagaggacgtaatatttggtaaaccagatgaaattttccagaactcaagtcaagagataattattattattacttttggtttcttttccatgttgcacgcatcagattcccgatgaaccctcgctcggngactgccgatttctgtatacgaat

SEQ ID NO: 9032 - DNA, 442 bp, Gossypium hirsutum
  Clone ID: uC-gsronu33b112h06b1
tcttacgcgtccggccgatgttgatggtgacggccagatcaactacgatgaattcgtcaaagtcatgatggccaagtaaggatctctccaaccaaaaaaaaaaaaaaacagagtagataagtttgcagagatttcaatctcgtaattggttcgtgggtcgttcgtttatcgtttgcattaattcgtcgaccggcttgtttgctctgctttttcttttagtagtctgggtttttatttttcttatatttggttttggtttttgtttttgttttttttgctttctattcttggtgcctttgaaacctttagaacaatttgcaagattccaatgtttttttttgcttatgggtgactaatttttactatattttaaaattttaaaagtgctttattttcaatggcttgtctgatttgccttttcgaataaaaaaaaatatcttaa

SEQ ID NO: 9033 - DNA, 420 bp, Gossypium hirsutum
  Clone ID: uC-gsronu33b112h09b1
tgacaccccattagttacagcagatgatgaagtaaaatcagtagtaaaatcaggtctttcccaagtttgttcattgtttgaaaacgagttgtcttcctttcttctcgttcccgacatcacagccgagaccgccgagactagaattttacagtgcctttcggatgtcgagtggatgtgcaacatactccccaaaatggatttaatgaaagactttgtttgtagttggggtggagatgtctagaaagattttggagatagttgaagacaagaaacttgataatgcaatgtgggtttttgaaagtgaagctatagaagtgaccggaaagttctggaagctgtcgggcttggaaacgtgattcttctgcaccgggtcgagtccaattgcttgagacatgctaccctattaaggaagataaagcc

SEQ ID NO: 9034 - DNA, 367 bp, Gossypium hirsutum
  Clone ID: uC-gsronu33b112h10b1
cttcctgccgtttttgctccttccttcatctctacatccctaaacaaaaagcaaataatggcagaaagaggcggcggcgaacgcggtgctttcaggcgtggcttcggcggcgggagatccgatcgtgggccaagaggtcggcgccgtggccgcaaggatgaggaggagaaatgggttcctgttacaaaacttggccgtttggtcaaatcgggaaaaatcacatccctcgaacaaatctacctccactccctccccataaggagtaccaaatcatcgaccaaactcgttggcccttcactaaagacgaggtgatgaagatcactcccgtccagaaacaaacacgcgtccggtcagcgcactcgtttaa

SEQ ID NO: 9035 - DNA, 640 bp, Gossypium hirsutum
  Clone ID: uC-gsronu33b112h12b1
tgtgcttcttcctgaactttgtggtgcattcttaacccagtacttcttggaactggttaagactctctgttaatgccaccacctgaaggtgtgcaacctttttcaagcggttcaaagaagttattcttggttcatccctcatgcattggaaattttctccagctatatactatcaagagcactcaagcttgatatggcgtcatcataaaccatgctggtatataaactgtttgaagcaggtagatttgaaagaaaggaatcgttctttggttcatcccttggtgcagtggaatttttcttgggctatatcctatcaagggtactcgggcttgatatggtgtcatcacgaaccatgcaggtatgagaactgtctcaaacagttaatttcgaagtttttctttagttcatcggttataatgaaaccttactactgaaccatgttggtattagtttgtattacgtggcctccggatggatgagtattgaatatgagcatagcatgttttactgttcaacttttcttatatagtcggaggatcatattcttatatctatatttgaatatgtaatcggatactagtctgtatttacgttgcacatctgagtttcatccaaatcggcctatttggaaaaacattgc

SEQ ID NO: 9036 - DNA, 73 bp, Gossypium hirsutum
  Clone ID: uC-gsronu33B153h04b2
atttatttaaccatctgattcataagcctaggtggttgggttatttcaattataaaatcattttcagttggtt

SEQ ID NO: 9037 - DNA, 338 bp, Gossypium hirsutum
  Clone ID: uC-gsronu33B154a10b2
ccctctcgttcggccacgcgttcggtgcctttggggggggatttgggttacacaaagagatatgtacgatgtcttcagatatccgaagtcgttaatagtatgaaggacttgattgattacagtagagagacgaagactggacctatggagagtttggccaagttccctcgaagaacaagtacttcatttggtattcaagcacaacagcctgaggaacaactactacagcagcagctgacaccacaacagcgaacaggggcccagaacaccagttgtcaaagttctacccaggtttctgggatggcatctggtggtaaccatggtggagctaacataaa

SEQ ID NO: 9038 - DNA, 540 bp, Gossypium hirsutum
  Clone ID: uC-gsronu33B154b07b2
caaatggctgtagtttaatctagctgatccttaaaaataccatcactaccagcatcgccatctcccaccctatccctttgatcaagttcatccatctgccgttgattcttcatccaatggacggcaacaagcaagcccagtcctcctcttaccctcctcagcctcccactacttctattacgccttctcctccttcctcctccgccgccatcgccgccactccgcctgctcctttccaccacctcctccagcagcagcagcaacagctccaaatgttctggtcttaccagcgccaagaaatcgagctagtcaacgacttcaagaaccatcagcttcctcttgctcgcatcaagaagatcatgaaagccgacgaagatgtccgtatgatctccgctgaagcccctattctcttcgccaaagcctgcgagcttttcattctggagcttaccatccgttcctggcttcacgccgaggagaacatgcgacggacgcttcagaaaaacgacatcgcggcggctattactaggaccgacattttcg

SEQ ID NO: 9039 - DNA, 317 bp, Gossypium hirsutum
  unsure (1)..(317): unsure at all n locations
  Clone ID: uC-gsronu33B154c04b2
aaggtatcagttcgaaggtggtggaaaaattatattcgaggaaagcttttaccgcaaagggggggattcttatagataagtttcaatgcccaacaacaagtctaaacccagaccaagccgaatgtctgtttacctttacattcccaatattattgggtatataagaattctgttgaattgctatgcttttgctatatggttttccagcaaaagactttntgctgctctgtattttctaagctttgtttgtgatgctgtggatggttggtgtgctcgcaatttcaaccaagcttcaacattttgagctgtcctgaaca

SEQ ID NO: 9040 - DNA, 489 bp, Gossypium hirsutum
  Clone ID: uC-gsronu33B154g10b2
tgtcctacaagctagaaggcaaggtagccataatcaccggcggagcaagtggcatcggagaagccaccgtccatcgtttcgccctcaatggtgcccgtatgatcgtgatcgctgatatccaagatgaattaggccaaaaagtagtcgaatccatcggttcaaataagtgttcatacatgcactgtgatgttaccgatgaagaacaagtaaaaaatttagtccagtcgacggtccaaaactacggcagcctcgacatcatgttcagtaacgctgggacagttagcaactcaattcaaaccgtccttgaactagactttgcagcgtttgaccgccttttcaccgtcaatgtccgcggcatggctgcttgtgtgaaacacgccgcacgagccatggtggaactgaacgtgagaggaagcatcatttgtacggcgagcacgaatgctagctgcggtggtgaaagggacactgattaatacatgtcgaagcatg

SEQ ID NO: 9041 - DNA, 71 bp, Gossypium hirsutum
  Clone ID: uC-gsronu33B155a12b2
cccgagccccgccctcttcccaaacaccgtcttttttagaaaaaatttgcccattacacccccccccttcc

SEQ ID NO: 9042 - DNA, 432 bp, Gossypium hirsutum
  unsure (1)..(432): unsure at all n locations
  Clone ID: uC-gsronu33B156b08b1
ggttgtctcagtttcaggcgccgtttgctccatcaataatctctctagcgatgaccaccatcgttgcaacgatctcaacctcaactctgcttcttttcttcttcagaatgtgttgggaaaatcaagctcaaccctttatgccattgcacttcttgcctcagggcaaagctctaccattacaggcacttatgcaggacaatttatcatgcangggttttttgaatcttaaaatgaagaaatgggtgaggaatttgatgactaggtgtattgccattacacctagtcttattgtgtccatcatcggtggatctcaaggggccggtcgactaatcatcatttgcatccatgatcctttcatttgagctaccaattgctttaattccactacttaaattcatgtgcagcttaaccaagatgggaccatataagaac

SEQ ID NO: 9043 - DNA, 270 bp, Gossypium hirsutum
  Clone ID: uC-gsronu33B156e07b1
gacgctatatcttttctatagatgtaccttaaatttaatttatttttttttttttcttttaatttctttcttcttatattcttattttttatctttatctcttttttatctatttaaatatctttttttttttgttttaattttttttatcttaatctttttatttaatatttctattcttagtggtaacataatttatgccttttaaaagatactttttatttttattattatctaataatatattttttctaaatttttatactgttt

SEQ ID NO: 9044 - DNA, 83 bp, Gossypium hirsutum
  Clone ID: uC-gsronu33B156f04b1
attaataataatggatccttcagtggaaactcttcttacactccttgtgatttttctctccttcaacattctattttacatct

SEQ ID NO: 9045 - DNA, 1064 bp, Gossypium hirsutum
  unsure (1)..(1064): unsure at all n locations
  Clone ID: uC-gsronu33B156h07b1
cccatgcgtccggaacccttttgggaattacctcatgcagaagttattggaagtgtgtaatgaagaacagagaatgcagattctgttaatggttactgaagaaccaggtgcaacttgttagaatatctctcaacactcatggcactcgtgtagttcaaaagctgatcgagactctcaaaaccaggcagcaaatttcactggttatatcagcacttgagcctggatttctatctctcatcaaggacctgaatggaaatcatgtcgtgcagcgttgcttgcaatgtcttagcagtgaagataacaagtttatctttgtagctgctgcaaagtattgcgttgatattgcaactcatcagcatggctgttgcgttttgcaacgatgcattagccattcaactggtgagtatcgagataagttggttgaagaatattcaccaattgggctctactagaacaggatgcatatggtaattttgttggttaggttatcttgtagttaataattctttcggccattttaactttgtttctctaatttaagtggactattgttcacttctcatttttaaatgttacttattttgtgtataaatgttctttttatttatttttaagtgctggtctatattttctttttctcttttatctcttttatattctctctatatttaatgtattgtttctttttactatataatgcgaaattacattccttatttatacacttttttatgtattttattattcattttatttttatctatattatcgttccatctcttttttcatattagtctatttattttcttaatttttatctattatatattcttattcgtttacttttctctattttatattattattattttttttttttttattatcttatattttttatttattttatttatctatttttatattttttaaataatttatctttatttttgtcttatctttatttttttatatttctacttctttatatatattttttttcttcatatttttttttttctattttactttctaattntctctattatttaatattttatttt

SEQ ID NO: 9046 - DNA, 205 bp, Gossypium hirsutum
  unsure (1)..(205): unsure at all n locations
  Clone ID: uC-gsronu33B157a04b1
cctgagtcnctttcaacaggatgcaaaactagtcctgtccctttgaaagatgagattgtggaagaactttcttcccagttttcagcagatcatgttgaaaatggtcatggttgcaataaaaaagagtctacaattgaacagtacaatttgtttgcagcgagtaacggtttatggatttcgtactttctgtcattcattctatgta

SEQ ID NO: 9047 - DNA, 460 bp, Gossypium hirsutum
  unsure (1)..(460): unsure at all n locations
  Clone ID: uC-gsronu33B157c07b1
gcagctatagcgcaagtggaagcagggttggctttgatggaagaagcatacgacaagtgcagcaaagggaagggttactttggtggggatgaagttggnntccttgattttgcttttgtttgcttttttgttttgtcttatattaactttaataagttttattctctattattttttctactttatgtttttatcattttcttattttttaatacttttttatattttccttattttttattatatctaatttataaccttcttattatttttatttcttatttctatttttatttttagtttttttctttttactattatttatttatattttatcatttttatatatttctttatctatttcttcttatctattctttttttactctacttcttttttatattatcttcattttcttttttttcttattattttttttttctattcttttcatttttt

SEQ ID NO: 9048 - DNA, 144 bp, Gossypium hirsutum
  Clone ID: uC-gsronu33B157g04b1
tatagggaaagacggtgacgcccgtgggggcaccggcgcaaaattcccggcgagacacacgcgcgcggatactcacaaagactgacgacaaggcatactgaagaccgaatggtcctcaatgaagagagtaataattaatcagca

SEQ ID NO: 9049 - DNA, 488 bp, Gossypium hirsutum
  Clone ID: uC-gsronu33B158f04b2
ctggtgtccgaaagacttgcaaatgaaatacaagattgtgtgatgaagattgttaagaaaagagaagatagagttgtgaatgcagaagctgatagctttggcaatgattttctaggattacttgtaaatgcctatcatgatctggacgacaaaaataggctttcaatggaagacttggtagctgagtgcaaaacattctacgttgccggacaagaaactgttaatgccttgcttgcatggatggtcttacttttagcaatccataaagattggcaagagaaagcaagaagagaggtgattgaggtttttggtaaccaaaatccagattctgatggcatttctaaactaaaaattatcaccatgatcatttatgaaaacttaagattgcatggtccaacaaatggcctgccaagaagagttgcaagaaaagttcaggtgggaaagctagttttcccagctaatataaattcttcttattgcaaaggctg

SEQ ID NO: 9050 - DNA, 304 bp, Gossypium hirsutum
  Clone ID: uC-gsronu33B158g01b2
cttttgttccctctgtaccggcgagaaaggcgtcgggcggagcggtaagcccctccactgcaaaggctcctctttccatcgtgtgatccctaactttatgtgccaaggaggtgacttcacggccggaaacggtaccggaggtgaatccatctacggatccaagttcgctgacgagaacttcatcaagaagcacactggtcccggtattctctcaatggctaacgctggtcccggaactaacggatctcagttcttcatttgcacggctaagactgagtggctcgacggacagcacgttgtgttt

SEQ ID NO: 9051 - DNA, 469 bp, Gossypium hirsutum
  Clone ID: uC-gsronu33B158g10b2
gtgttcccaccgcagattaccttatgtgcttatttaaacgtcattgatcttcatgacaatttactcactggccagattcctcaacaattaggctttctatcacggttgtcagcttttgatgtttcttacaacaagctttcggggccaataccagcctctttagggaacagaagtgggaatcggccgagtttcaatgtcacttcttttgaaggcaataaggatctttatggataccctttaccacccatgaaaagcaaagggttgtcagttttggccattgttgggatcgggttaggaagtgggcttgctagtttggtgcttagttttacaggagtttgtatctggttgaagattagagatgaaaagatggctgccgaagaagggaagaagagtcaccctatgcctgatattaaaagcttgaatctaagattaattactgatctaaaatggggaaaagaaaagaccggaa

SEQ ID NO: 9052 - DNA, 435 bp, Gossypium hirsutum
  Clone ID: uC-gsronu33B158h07b2
ttaattgggagctcctcctttgtggctgagttgtgggaggcactattgcaaattcttgaaactcagaccaccaccaaagccatgaggtatcgatctcttctccatcaccttaagaaaaataatatttctatgtcaatgtatctagcagagattaagcatctatgtgattccttaggtgggtgtggccattatgtatctttagaagaacaaaaatcagaacttctcaatggtcttcttctagaatttgatcacgttgtgtcaattattgcgaaaagtcgtgttccatttgatttgtacgatattactacaacttttcttgatgctgaagctagatagtaagcccatctgtcatatggcttattctcagccaatctagctgaagcccaatagggttcttcaccagctttcctatcatattctgaacaaccgtcacct

SEQ ID NO: 9053 - DNA, 239 bp, Gossypium hirsutum
  Clone ID: uC-gsronu33B159d05b1
tttttcacgagaatgaaaacttggcggtacgccgtgtacaataaatggcggttgccttcaatgagaggcaaatatatacacatcccaaattgcatacaccctctgcatttgatacctataggcagttgatcacgttactcgttatcatgtattcatggcgctaaaccatgtagtttgcaccatatatttctgttcaaaaaagacccacccaatcagcattttaagcagttgcgcatcac

SEQ ID NO: 9054 - DNA, 183 bp, Gossypium hirsutum
  Clone ID: uC-gsronu33B159f08b1
cctacgcgtccgttgtgttgttattgttgttgaggtgtgtgttcgtttgtgaaccctgttcatcgacttttaattattccccctcatttagtgcaacattagtcaagcattccttgttcgcttggtttttgcttgagtgttattattattattatgaatttgatattagtagtagtgtatttg

SEQ ID NO: 9055 - DNA, 532 bp, Gossypium hirsutum
  Clone ID: uC-gsronu33B159h11b1
gtcatcccgagattttctattttccgattcttggggggtcttttacccaattttttggtatttctaaaacagaaacaaataggtgtctcaatggcagaagagagcggggccccctgtaagttgtgctgatttgcccgctaaaaggcccagagaagacgaagaaaacggggtctcttctgctgctgctgttgatgccatggaaatggaagctgataccaataacacttccaaggaagttgatgggatttcctctgttattcctggatggttctctgagattagcccaatgtggcctggagaggcgcattccttaaaggttgaaaaggccttgtttcaagggaagtctgattaccagaatgttatggtctttcagccatccacatatgggaaggttcttgttctggatggcgtgattcagctcacagagagagatgaatgcgcatatcaagagatgatcactcatcttccactttgctccattccatatcctaagaaggttttggcattggtggtgggatgggggagtctccgg

SEQ ID NO: 9056 - DNA, 492 bp, Gossypium hirsutum
  unsure (1)..(492): unsure at all n locations
  Clone ID: uC-gsronu33B160a08b1
gctgntgtccagaagagaagggcagcgctcaccggcttcgttaggttcaagtttgggttagctaacatcaagaaggctggagtcgtcaggcaagagcttgcaaagcttaaaaaggagaatgcatcttgaagtaattctgaattatgggattttttgctagttttttcatcaatgttccgcgagttctttttgggattgatttcgtttttctattaaacaaagggttaaggtcttttgaggacaccttatttgctgtatgacagattttgtagtgagtttattgctatatattgcttgctcaaaaaaaaaaaaaaaaaaaccacaaaaaaaaaaaaaaaaaaaaaaaaaaaaaaaaaaaaaaaaaaaaaaaaaaaaaaaaaaaaaaataaaaaaaacaaaaaaaaacaaaaaataaattcacacacgggggggccgttttaagggacccaagtttacatccccgtgcttgcaacaaaaacttttttaaggggc

SEQ ID NO: 9057 - DNA, 472 bp, Gossypium hirsutum
  unsure (1)..(472): unsure at all n locations
  Clone ID: uC-gsronu33B160b05b1
ccactcgtccgcccacgcgtccgcccacgcgtccggggtaacttgccaataggaatcttccctcgtgatgccacaaattatgaattcaatgaagagactgggaagctcactgtttttattccagcaatatgtgaagtgggatacaaggactcatctgttctgcgcttcttcaccactgtgactgggtatctggagaaaggaaagctggctgatatagagggtatgaagacaaaggtgatgatatgggtaaaagtaaccagtatcacttgtgaaggatcgaagatctatgtcacagccggaatgaagaaaagcaggaatagagaggcgtacgaggtttccagggatggagtaagtgtagataagttttaaagtggttaggatgccttggagatcctatttcttttaactattaactctgaaccttcatacttttgtgtccataataagttttaggattcaangtgcaagactg

SEQ ID NO: 9058 - DNA, 496 bp, Gossypium hirsutum
  unsure (1)..(496): unsure at all n locations
  Clone ID: uC-gsronu33B160d04b1
ccttcttgtccgcccacgcgtccggaaacagagaagagaaagaatggcttggatatggttggaagcagcacttcccctcggaatcatagctggaatgctctgcgttatgggcaatgctcagtatttcatccacaaagcttatcacggccggcccaagcacatcgggaacgatatgtgggacgtcgccatggaaagaagggataagaagctcttcgagaacctctcgtcctccgattgatccctttttagttttcttctggaaacttggtcgatggagtgagagaagaaataaaaaatgctctatgatattctgtaatgctgaagaagactaaagagcagatgaactcgagtattttctttttcattgtaatgttaagcatgaacttctgaaatgttgcacttttggcaacacttgctaatgtttacgctggtggtgtattggagatttgttgcttccaaannaaaaaanntntaaaaaaaaaaataaaaattaaat

SEQ ID NO: 9059 - DNA, 465 bp, Gossypium hirsutum
  unsure (1)..(465): unsure at all n locations
  Clone ID: uC-gsronu33B160f07b1
ctctcaagaatatggactctgttttttatcctatcctctgtttttctgttaacaggatttgagacagtgacctacatgttacagggggcagttaagcatgaagactttgatgggcatagagggaccattggagctggtgatctacaatggatgactgctgggagaggcattgtgcactcagagatgcctgcagcacaaggaacccaaaagggtctacagttatggatcaatctctcgtccaaatataagatgattgagccaaggtatcaagaaatatcaagtaaggacattgcagaagctacaaaagatgggatcaaagttagagttatagctggtgaggctttaggaactaagtcagcagtttataccagaaccccaacaatgtacttggacttcactctcgaaccgggagctcacctttcacagccgataccggaatcgtggaacgccttntgttatgtcttg

SEQ ID NO: 9060 - DNA, 265 bp, Gossypium hirsutum
  Clone ID: uC-gsronu33B162c04b2
cctacgtgtccgacaattggaagatggaaggactttggctgattacaatattcagaaggaatccactctccaccttgtcttgcgtcttctgggtggtttctaagctctcctatgaaaatgaggattctggattttatgtgagtgaatgtgatgtctggccctgtttaggtctcattaataaacctaaactatcttatctgagatgtatcctatgctatggagatgtatgaatagacattacatggttacctttggtaatacattg

SEQ ID NO: 9061 - DNA, 470 bp, Gossypium hirsutum
  Clone ID: uC-gsronu33B162d01b2
cccacgcgtccgatctactgtcaaagccaacatgggacgctgcgagccgtattcatgatgcattggttcggatggatgatgaatatctaaggtcagcccttgattacctggaacttcagccagatttgtctgcacttgtacgtggtgctcatactttcaggtgtccgaaccttgggattactagctgggttaggctaccaatccatgatgcagatttcgggtggggcaggcccatatttatgggccctggtggaattccttatgaagggttatctttcgtaataccaagtccaaacaatgatgggagcttatcagttgccatctccttgcaaaccgaacacatgaaagtgtttgagaagctcttttatgacatttaaaggaagaagaaacctcgtatacagtccatgtagtccttaaacgttcctttgtgccaatttttggaataccttgttatgttataaagtctcaca

SEQ ID NO: 9062 - DNA, 501 bp, Gossypium hirsutum
  unsure (1)..(501): unsure at all n locations
  Clone ID: uC-gsronu33B162f04b2
accttattctcctcaactcccacacgtttacgagttaatttggtagcagcatggctggttcaagtgccatgcttgtgcagctcactctgatgcttgctttactctcatgttcaatggctcaaagtacatcggcatcacccacaatgtcaccaagttcaagcaccaccccctctcccgttgccactccaccaccaaccaccatgacccctcccccagccatgactccaatgtcagcacccgcaccgtcaatccccatggctcctaccccttcaactactccaatggccccaaccccatcctctgtcccagaggcaccaaccccatcaatgaacagttcaccaccggcacctgcacctgtgacgcctccatctatgacgcctaattcagaacctagggntacagctccacctccagccatgacccctgtggagggcccaccaggttccgctgcttctacacgtgaatacaccatgtccttgttagcattgcttggaggagttg

SEQ ID NO: 9063 - DNA, 345 bp, Gossypium hirsutum
  unsure (1)..(345): unsure at all n locations
  Clone ID: uC-gsronu33B162g01b2
gactgttagaacggagataaggtgaccgcggtggctggttgtcacaaggatactacgcaatggaaccgtaaccacgtgtcgtttcgtgtgttggggattgagccaggaacgcccggtgtctgccatttcttcccggcggataacttcgttctggttccagacccttgaatttgtagtaattgtctttcctaggatacgagacttgggttgtcataaataataatactcgattcctaatacttgatgtctggttatatctatggatgttgttctcatggtaacgaaatcaatgttttttgaaaaaaaaaaaanaaaaaataaaaaaaaagaaaaaaaagaacatac

SEQ ID NO: 9064 - DNA, 516 bp, Gossypium hirsutum
  Clone ID: uC-gsronu33B163b04b2
ctcgaaaaaaaaaatgtcttcagggtgcaattgaggatctaactggagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggtgaaaataatgtataagccatttggttgggagcaaattgtccttttctccaaaggatttttgctgctcattcatggtgacttggtttatggttttatctggtgtggtaaaatctataaaaatatata

SEQ ID NO: 9065 - DNA, 455 bp, Gossypium hirsutum
  Clone ID: uC-gsronu33B164a10b2
ttattataaaaacaaaaaaaaaaaaaaaaaaaaagaaaaaattaaaaaaaaaatttgcgcgtcaaaaaaccccccacatcaaatattccctgcttacttccccctccaacccatgacctagctcttctatacttcaccctatcttccatcccctgtccttatatttacaacgtcttgccttgaaaacccccgcccatacccccctttctctctaaacacaaaaccccccctcccccctccaagaccgttcaacaaaacttcctttctccctccccttactacatttcattcctccacgatgcctcctcgtatcccccctcttcttatccttatactcttgagagttttttgtttcctcccactcttcccttaaatttacacctcccctctctccttctcctttctttatcttctctctcattccctctaatatcacttcttccccttcttccccc

SEQ ID NO: 9066 - DNA, 506 bp, Gossypium hirsutum
  unsure (1)..(506): unsure at all n locations
  Clone ID: uC-gsronu33B164h03b2
ggccccccattgtctactgctgtgtctagggtcttagcttgtctcattgagaaagatgttcaattccagcttattcccgttaacatgtccaagggagagcacaaaagttctgatttcctcaagatccagccctttggtcaagtaccggcatttcaagacgaaagcacctccctgtttgagtcacgggcgatttgtaggtatgtatgtgaaaagtatgcagagaaggggaacaagggattgtatgggagcaacccgttggcgaaagcttcaatagatcaatggttggaggcagaagggcagagctttaaccccccaagctcagttctggtattccaacttgcatttgcaccccgaatgaagattaagcaagaccaatccttgatcaaccaaaaccacgataagctggctaaagtgctggaggtgtacgagaaaaggctaggagaaagtcngntcttggcccgggatgagttttcattggcagatctttcccacttgcctaacacaca

SEQ ID NO: 9067 - DNA, 542 bp, Gossypium hirsutum
  Clone ID: uC-gsronu33B166a09b2
gtttattattgcaattttagctgaggagaaacacctgcccatgtatcaagaaatggcatcctagcccaatgtagagtatattgctggaggtgctactcaaaattcaatcaaagttgcacagtggatgcttcaaattcctggtgcaactggttacattggctgcattgggaaggacaagtttggggaggaaatgaagaagaactcaaaagctgctggtgttaatgttcaatatctcgaggatgaaactgcaccaacaggaacttgtgctgtttgtgttgttggcggtgaaaggtcactcattgcaaatctatcagctgctaactgctataagtctgagcatttgaagaagcctgagaattgggcgttggttgagaaggccaagtacttctatattgctggatttttccttactgtatctccggactccatacagcttgttgctgaacacgctgctgcaaagaacaaggtgttctcaatgaatctttctgctccatttatttgcgagttcttttaagatgcacaagagaaagcactaccgtata

SEQ ID NO: 9068 - DNA, 361 bp, Gossypium hirsutum
  Clone ID: uC-gsronu33B167b09b1
ttcttttatttgagagaaattgatgatgctgataagttggtagaagcaatcaaagcaaagaagaatggaaaggctgttatcgttggtggaggttatattggtcttgagcttggtgcagccttgaaaattaacaatcttgatgtcagcatggtgtacccggaaccatggtgcatgccccggcttttcacctctggcatagctgctttttatgagggttattatgctaataaagggatcaaaattataaaggggacagttgcggttggattcacctctaactccaatggagaggtgaaggaagttcaacttaaggatggcagagttctggaagctgacattgttgtggttggtgtttggtgga

SEQ ID NO: 9069 - DNA, 479 bp, Gossypium hirsutum
  Clone ID: uC-gsronu33B167c06b1
atttttattatcaaacaacaaaaaaaaaaaaaaaaacgacctataatttaaaaatactcaatcacatacactcaaaaaaaaaaacaccaacatagccccttcccttcctccaaatctggggccgcccgttttatgggttcctagcttccttcccctgccttgcaccttcatttcccttttatggccccccctaattctattttcctgcccttcctttcccccccccggtcctgggaaaccctttgtgtcccccactttatcccccttgcacctcctcctcctttcccccccttgccttttacctaagagccccccccctactccctttcccaccagttgcccctcctgtttgtccaacggccccccccctttatctcccctttccccccgccggttttggtggttcccccccattgggcccgttcccttttccagtgccttccccccgttcttttgtttttcccctctcttttccccct

SEQ ID NO: 9070 - DNA, 95 bp, Gossypium hirsutum
  Clone ID: uC-gsronu33B167d03b1
gtttttttttttttttttttttctttcacttttttttttttttttaaaaacccaagcggcgacagactcaaaacacataaagaagacgcaagtag

SEQ ID NO: 9071 - DNA, 155 bp, Gossypium hirsutum
  Clone ID: uC-gsronu33B167d12b1
ttttgtctcatacccggagaaatgaaagacaggagagagtttattatcgagagcgtgcgagccccgtccggacggaaaagtactaggacgacaacgcttagcaacgaaaggctaggatgacgaaccatcccgacggttctgatgacaatccagat

SEQ ID NO: 9072 - DNA, 394 bp, Gossypium hirsutum
  Clone ID: uC-gsronu33B167g03b1
gaacttacatattataggaactaaattgaaatagggatttatcttttggtggaatactaatctgaaataggtgaagatttgtttagatgtaaaaacaaacccagttgttgcgcccattttgcctttagattttatgttgcttttttctttcaaaaaaaaaaaataaaaaaaataaaaaaaaccaaaaaaaaataaaaaaaaaataaaaaaaaaataaaaaaaaaaaaaataaaaaaaaaatatataaaataataaaaaaataaattaataactcaacaaatataataaattataaaattcaattattatatttttttattaaaatattaagggggcggcgttttttaataacaaatttaattcccctttattattagtgttttatttttttttt

SEQ ID NO: 9073 - DNA, 445 bp, Gossypium hirsutum
  Clone ID: uC-gsronu33B168b03b1
cccattcttccgcccacgcgtccgcgtttccatcaggcgtttttcttagaaacaaacgctcttttcttattatcttgtatcacttcctcatttttgaataaaccccaacacagtctctttttagccttctctatcttttttttaatcaaatttcgatctccgtttctctcttttatttttcgaaatattcagttttcttatatttttcgattcgacggtttttttttttttttttttgaattcggttgggagggaacagtgagaaatggcgggaggaagtagccgtagacaggagggttctttagtgatcaataatacgaacgttttcgcggctcttgaaactctcaggaggaagaagaaatctgataaggaccgaggttcttcgaagaaatcttctttcaagtctcagcagcagccggaaaaagaagccgagccgcaagtcttt

SEQ ID NO: 9074 - DNA, 399 bp, Gossypium hirsutum
  Clone ID: uC-gsronu33B168c05b1
gcgtttttcaccattgccgttgaatagaagaaactaaggcccatatctcccccatgccttcagattctttctttggatttctgagggatttatgatcaattgtctgggatttttcagtaaagggtattcttacttgctgcaattctgtactgtcagcttccaattttcacggtttggtagattattgtgaattttttctccagatgttgttcgaaaagcataaattgaattaggcgttgcggctgtgagaagggctgggttttgtattgtgtagtgaaagatgaaacgcggttcggcggtctttttggtacttttagtccttggattcttttttgcaacatataatttggtgactttgatcattcacctttagacatttacttcaaagcaatgggattt

SEQ ID NO: 9075 - DNA, 533 bp, Gossypium hirsutum
  Clone ID: uC-gsronu33B169e11b1
gtacctttttgcgaagcgtaacacgccggtagcacatgcggttgggttctgggattaccattccttcattactgctgctgctcagtatcagcctcatggatttggtaccaccggggaaaagctccagaatatgaaggaagtcgctgcttttcttggacatgtcggcagcaaaacttcatgtggctatggagtcgctaccgggggaccattggcttggggtctttgctacaacaaagaaatgagccctagcaaaatatattgcgatgattactataaatacacctatccttgcacaccaggagtctcatatcatggccgtggtgccttgcctatctactggaactacaactatggggaaactggagaggctttgaaggtggacttgttgaaccacccagaatacttagaagacaacgcaaccttggctttccagacagcaatgtggaggtggatgacgccgatgaagaaacaccaaccctcagcccatgacgttttcgttggcaactgaaaaccaaccaagaacgacaccttgg

SEQ ID NO: 9076 - DNA, 526 bp, Gossypium hirsutum
  Clone ID: uC-gsronu33B169h11b1
actacgcgtccgcccacgcgtccgcccacgcgtgcgatcgatgtgatgattttgaggaactagtttatctccgatggataaatgcttgtttgcggtatgagctgaggaattatcaatccccggccggtgaaacagttgctagagatttaagtagaagcttaagtccgaaatcggaggcaaaagctaaaaaactgatactcgaatatgcacataccgaaggaatgggtagcattgattttgattgcgatcaatggtcttcttcccaagcttccgaaactcaagaacttgatgatcctttgatcgagaattcatctgctacaaaaccgaccaattcgggtaaaaataagttcttcaagaatttacggagactaatacggagaaaagacggtcatcacgcggaccatgcttcatcaatgggcagacctgatcatgttgacgatcctccaacttggagttcaagcacaaagagcgattctgtaaccatggtaagtagcccgagtgatagggttacaacttcatctaagag

SEQ ID NO: 9077 - DNA, 488 bp, Gossypium hirsutum
  Clone ID: uC-gsronu33B170a08b1
cttctttgctgaacgggaaattgtccgtgacatgaaagagaagcttgcttatgttgccctggactatgagcaggaactggagactgccaagagcagctcatctgttgagaagaactatgagttgcctgacggacaagtcattactattggagctgagagattccgttgcccggaagtcctcttccagccatctttcattgggatggaagctgctggaatccatgaaactacctacaactctatcatgaagtgcgatgtggatatcaggaaggatctctatggtaacattgtgctcagtgggggttcaactatgttccctggtattccggaccgcatgagcaaggagatcactgctcttgctccaagcagcatgaagattaagggtcgtgcgccaccagagagaaagtacagtgtctggattggaggatctatcttggcatcactcagcaccttccagcagatgtggatttccaagggtgagtatgatg

SEQ ID NO: 9078 - DNA, 531 bp, Gossypium hirsutum
  Clone ID: uC-gsronu33B170d08b1
cggaccggtccgttttcccggttttctacgcgtccggtagtttacagcggatggagtgagtctgctagtgctagtgttaggtgtccgccggccctggtatccaatttctctcagttggatgaaaagctgaaggctggttacaaggccacaacagctggaaaatttactgaggcactccggctcttcctcagcattcttcatactattccgttgattgttgtggagtcaaggagagaagttgatgaggtcaaggagctaattattattgccaaggagtatgttcttggtctgcagatggagcttaagcgaagagaaatgaaagacaatccagtacgccagcaggagcttgctgcctacttcacccactgcaacctttaattaccacacctaagacttgccctgctgaatgcaatgactgtctgctacaaggcaaagaacctggctacggcaggtaactttgcccggcgactgctagaaacataccccacaaatgagaatcaagcgaagacagccaggcaagtactttaagct

SEQ ID NO: 9079 - DNA, 96 bp, Gossypium hirsutum
  Clone ID: uC-gsronu33B170f02b1
cccattcgttcgcaaccaacaaaacaaaaacaaaaaagaggaggatttatataaaaaaaaagggggcggacacatcataaaggggccgacgttatg

SEQ ID NO: 9080 - DNA, 260 bp, Gossypium hirsutum
  Clone ID: uC-gsronu33B170g04b1
cggacttcgtgggccacccacgcgaacgagaacgcaagggggtggagatttaaagcgggcgggccggatgacccaccttaacccacgagtgaatgcgacggcatagctcaggctatagggaaaccaaaatacaagcaacgggccgacgcaaaacaacgtggggactgggaaaacactggcgtaacccaaggtaataaccgggcagaacatcccccatggggcagaaggcgtaacagcgaagaggcgccacaccgaacgcc

SEQ ID NO: 9081 - DNA, 495 bp, Gossypium hirsutum
  Clone ID: uC-gsronu33B171a07b1
cggatgcgtggggttgatctttgccggtaagcaacttgtagatggccgcactctcgctgattacaacatccaaaacgaatccaccctccacttggtgcttcgtcttcgtggtggtatgcagatttttgtgaagactcttaccgggaaaaccatcaccttggaagttgagagctccgacactattgacaatgtcaaggccaaaatccaggacaaggaaggtatccctccagaccaacagaggttgattttcgcgggtaagcagcttgaggatggcaggacacttgcagactacaacattcaaaaggagtcgaccctccatttggttcttcgtcttcgtggtgggatgcaaatttttgtgaagacattgacaggaaagaccatcactttggaagttgaaagctcggacactattgataatgtcaaggccaagatccaagaccaggaaggaatccccccagaccagcagaggttgatcttcgcagggaagcaactttg

SEQ ID NO: 9082 - DNA, 553 bp, Gossypium hirsutum
  Clone ID: uC-gsronu33B171b04b1
ctcattatcatccccatttccaatctccagctcccatggtaaatatgccgatcagaaacatagcggtcggccggcccgaagaggctactcaccccgatgctctcaaggctgcttttggctgagttcatctcaaccttgatcttcgttttcgctggatcgggctcaggaatggcctttaacaagttgactgacaacggagcaaccaccccggctggtctcgtagccgccgctctagctcatggcttcggtcttttcgtcgctgtctccgttggcgccaacatctcaggtggccacgtcaaccctgccgtcaccttcggtgcttttgttggcgggaacatcactctcttgcgcggcattctttactggatcgcccaactcctaggctcaaccgtcgcttgcctgttgcttaagttcgctaccggcgacctggctgtacccgcttttgggtttgcatcaggtgtgggcgtgtctaacgcaatggttttcgaaatcgtgatgaccttcggattgttgtacacagtggacggcacaatcgttgatcccaaaaagggaa

SEQ ID NO: 9083 - DNA, 83 bp, Gossypium hirsutum
  unsure (1)..(83): unsure at all n locations
  Clone ID: uC-gsronu33B171d07b1
ttaacctgtgacagtgatgggattattgtttagnncatcggagccgaaacaacattgcccacacatgggttggaaggtaatgg

SEQ ID NO: 9084 - DNA, 479 bp, Gossypium hirsutum
  unsure (1)..(479): unsure at all n locations
  Clone ID: uC-gsronu33B171g07b1
aaccgaaaggtaggaaccccnagcgaagccncagcccagagggggttcattttgaggcccttcaccggtcattcccgggcccggcgagaagccaatgatagttgttcagcacaagggggaggagaaacaggttgcagccccagagatcttctccatggttctcattaaaatgcttgagaacgcttgaagtttaccttgtcagcaccatcaagaatgctgttgtcacggtacctgcctacttcaactactcacagaggcaggctacgaaggatgctggggtgattgctggtctcaatgtgctgcgtatcattcaatgagccaaccgttgttgctattgcctatggtcttgacaagaaggcaaccagtgttggtgagaagaacgtacttatctttgaccttggaggtggtaccattgattccttcctcctaactattgaggaaggattcattgaggtaaaggcaacattggcgacatccat

SEQ ID NO: 9085 - DNA, 215 bp, Gossypium hirsutum
  unsure (1)..(215): unsure at all n locations
  Clone ID: uC-gsronu33B171h04b1
ccggaccggaatttcagggttgacttacgaaaaccggcgatanaaaccaaaacaaaaaaaaaaacaaacagtttttaaattaaaaggcaaaaagccgatagggcccttttggcaatggaatgtctagatacattctttagatctgaatgaataaaaatctggggggaaaacaatgaaaaaaaggttgaaagagaaacaagtctatctaatctaat

SEQ ID NO: 9086 - DNA, 214 bp, Gossypium hirsutum
  Clone ID: uC-gsronu33B172a10b1
gctaaatttctaaaaaaaaaaaaaaaaaaaaaaaggggaaggtaaaaaaaaaagggagggggaaggaccagaaaaaaaaaaaaaaaaaaaaagaaagaggggaaaaaggtctaaaatagcgaaagctaaatccaagtgacgggcgggggtttgacaacgtagggagtgggaaaagccaagggatagggaactcaatcgacagggaggaaaaaga

SEQ ID NO: 9087 - DNA, 550 bp, Gossypium hirsutum
  Clone ID: uC-gsronu33B178g01b1
gtgtttttcaagaaccgaaaggacctttaatcttttggaccaaacacaccccctaatgagaaccctaactttttttttcttctaatctttgattgtagaaaccaaaagcaaacgcgtaaagaaatcatgggttctgaacagaatgaaggaactagcttccctccatcggcgccaaaactttgtgccaacggctgtgggtttttcggcacggcggcgaatatgaacctctgttccaagtgttaccgtgacctccgtgccggggaggagcaagctgccaaggcgaaagctgccatggagaaatccctcagcgttaatacgaagcaggaagatgtcgttgacgagactgtgaagcctgttcttgagcttcctcatgtgggttcctcatcgacggtggtcgagatacaaccggctgctattgtctccgatgataaaccggcggaatccaaggcggcgaacaggtgctttatctgcagaaagaaggttggattgaccgggttcaagtgcaagtgcgtaagtacattctgcggcgagcatcgttacccgaaaaaca

SEQ ID NO: 9088 - DNA, 530 bp, Gossypium hirsutum
  unsure (1)..(530): unsure at all n locations
  Clone ID: uC-gsronu33B178g10b1
tataatttcttgctgagggaactgcaattcaagatctttttaatcctgatcgtgttcttatcggaggccgggaaaccccagaaggcaataaggctgtccaagcattgaaggaggtttatgctcattgggttcctgaggagagaattcttaccaccaatctttggtctgcagagctttccaagcttgctgccaatgctttcttggctcagaggatctcatccgtgaatgccatgtctgctctttgtgaggcaaccggggctgatgttacgcaggtctcttatgctgttggtaaggacacaaggattggacccaaatttttgaatgctagtgtcggttttggtggatcctgcttccagaaggatattctaaatcttgtttacatctgcgagtgcaatggccttcctgaggtggcagagtattggaagcaagtcattaagatcaatgactatcagaaaaaccgatttgttaaccgtgttgtttnctcgatgtttaacaccgtttcaaacaaaaagattgctatcttagggttc

SEQ ID NO: 9089 - DNA, 450 bp, Gossypium hirsutum
  Clone ID: uC-gsronu33B179e07b1
tccttcgcgtccgaattcaccatgaccctcacttttggggagatgatgtgcatcattttaaacccgagagattcgctgaagggattgcgaaagctaccaattataccgcggctgcatttcttcccttcgggttgggacctcgatcttgtgttggtatgacatttgcaacaatagaaaccaagattgttctctccatgattctacaacgttacaccattaccctctcccctgcctatatccactctccgatatccattctcagcattagaccacaacatgaaattcaggtgatacttgaaccactgcatcataatgcttgaagtacatagctgttaagaactaagggtttaacgtggttcatgtattttaggtttaagagatgacatttaatatgtttaaggtttcagcatttgcaatcccttccctatcctaagctatacccacctttat

SEQ ID NO: 9090 - DNA, 287 bp, Gossypium hirsutum
  Clone ID: uC-gsronu33b023b04b1
tttgtttccacttcctctcttccagatcttggtggcaaaagggaattttcaggtgaaaaagatgggtcgcggagttagcagtggcggtgggcagagctcattaggttatttgtttggtagcggagaagctcctaaaccagggacaaacacctcccaagctgctccagctgaagcaccagctgtctccaaacctggccctgcttctgaaccagtagatttttccaagcaaattcctgctggtattaacaggtttttccgcaaacaattacatgcttgcccatggtcag

SEQ ID NO: 9091 - DNA, 93 bp, Gossypium hirsutum
  Clone ID: uC-gsronu33b023c01b1
tctcacgcgtccgcccacgcgtcctgtggatgagggttttgggtcatgtggcgttggatttggggaaatgatggggaatgagttctttcattt

SEQ ID NO: 9092 - DNA, 339 bp, Gossypium hirsutum
  Clone ID: uC-gsronu33b023c10b1
tttttccttattgggaccatgttttggggtactggaaagcaagtttggaacgtccagacaagttaatgttcttgaaatacgaagatttggttgaagatactgttttgtattttaagaaaacagcagattttatgggttatcctttcttcgtagaggaacaacaacaaggggtgcctgataacattgtgttgatgtgtagttatctactacttttagtggtttggtagtaattttaactcttatactatcttttcctgaatttcatttttcttatctgatcttaatctttttttttttccctatcgttgattatttctttctttttctcattttttcttt

SEQ ID NO: 9093 - DNA, 416 bp, Gossypium hirsutum
  Clone ID: uC-gsronu33b023d07b1
tctttgacgcgtgggcggacgcgtgggattgggggaaacatagatccccgatctgctgcttagagttagtttctcatatttatggggctacttgaccagttgtgggacgacaccgttgcgggtcctcgacccgataatggtctcggcaagctccgaaagcactccactttcactttccgctctaactcctccaaggaaaccgatggcgggagtgtgagatcgtacaatgatgagacgccggaggaaacaacgaaagtgacacgtacgattatgatcgtaaaatcgccgcgttaccagagcggatcgcctccggtttcgccggccgaatcgactcctcccggatttcctttttctggaggaagcatagagtcgtattcggtttcgagaaaggcaacatcagatgcatacgagaaggg

SEQ ID NO: 9094 - DNA, 435 bp, Gossypium hirsutum
  unsure (1)..(435): unsure at all n locations
  Clone ID: uC-gsronu33b023e04b1
tttacgcgtccgnccacgcgtccgcggtggggggtatgagattctgaatcaggccgataaggcttgtagcatggctaaacaggcatttgaggaagccattgctgagcttgacacgctgggagaagagtcttacaaggacagcactctcattatgcaactcctaagggataaccttactctctggacttcggatgttcaggaccagttagacgagccatagaaggtggtgtaacccgtgttggtcctagtcttcttccggaggaggtgggctttgaatgtcatttgtttatgttgattaaagtgtgtaatttaaaatgggaagtaatccatggcatgatgctatacttctacccccgactagatttatgaatttggaagcgacttggataggggggactggaataactcggccttggaatttggaattcttggatg

SEQ ID NO: 9095 - DNA, 400 bp, Gossypium hirsutum
  Clone ID: uC-gsronu33b023f01b1
tttacgcgtccgcccacgcgtccggtgaacggggcaacgcctgctatcgtggagccaccttcaccgggaacaccgtgttctccaccaccaccttcggcacaacaaacatgccccatagacactctcaagctaggtgcatgtgtggacgtgttgggtggcttagtacacatcggcataggtagcagcgccaaagacacttgctgccctgtactacaaggtgctgtggatttagacgctgccatttgtctctgtactacgatcaaagccaaccttttgaatatcaatattataatccccatagctcctcagggccctaacgactgtggcaaaacttcacctccagggttccaatgtccagcacaatggttaaaaaccataaaacccccatgttttttttctt

SEQ ID NO: 9096 - DNA, 401 bp, Gossypium hirsutum
  Clone ID: uC-gsronu33b023f10b1
ttccacgcgtccggccacgcgtccgcatgcgggtactgttctagtactggtgggggtcaaggtctttctctaggagtgctaaacttgtctatagttatcccacagatgttcgtatcaacaattagtggaccgttggatgatgcattccggggtggcaacttgcctgcttttgagctggggtccatagtggctgctgacagtgcgttgatggctatattggcattgccgaacccacctaaacaagtgtccctttcgccaggaatgggtggtggccattaataaataatcaattccactgcttctgatcagcctctttgcatgccaacaatgtgtttcaaggtttatgatttgcttgggggtagttcatataaaaatttcctttgatgcaatgcagccatggc

SEQ ID NO: 9097 - DNA, 411 bp, Gossypium hirsutum
  Clone ID: uC-gsronu33b023g07b1
ttagaaatccctatttctgcaaaccctagggggagatccccagtaagtgagactccatttacctttatccaatcgccatggattctgcaactcgaagaagaagtcaaggaggcctcttcgaaggtctctacagagtcatcatgcgacgtaactctgtatacgtcacctttgtcatcgccggcgcttttctcggagaacgcgctgtggattatggagttcataggctctgggaatacaacaatgttgggaaacgatatgaagacattccagtgctaggacagcggcaatcagaggaatgaaatcattatgcccttttctggatgttttgaagaagtcattgaggcttgggccagagcatatatctaattaggtagctatgctcattggtgcaataaactggtaattgttttt

SEQ ID NO: 9098 - DNA, 417 bp, Gossypium hirsutum
  Clone ID: uC-gsronu33b023h04b1
tttaaaagaagcaaaaggccaacaatgtgggggggaaagaagagataaaggtgctgcatcaaccaaaagccagcagggtttcgccattctcagtaatatcaaggagcagcagttttgacagtctcataagtgggtcatctagcagcggtgaagggagcaaaggaaccaatgatgcctatgtttttgatattcctagctattggtccgactttgcagctgatactaacctagaatttcctgacgctgaggcgttttcagatgccacacccgtaggagatagtaatttgcttgaccacatttttgaagaataccagaaactttttgaccgcgatgaccctggcggaagagaatccatatttgatgttctctcttgattttgagtattttctgctaccagattcttcccctgtataattc

SEQ ID NO: 9099 - DNA, 295 bp, Gossypium hirsutum
  Clone ID: uC-gsronu33b025a01b1
accatggggggccagattataaaccaaaggggactttaaagacgacgaaagatccgattactacattggctactagaggtgccgggaagttcgatttgacggtcaccgccgtcggtgatttcctcacgcttcatactggaatcagtccatatagagtcgctgaagcagtttttgactccccaccggtcgtgatattcaccgtccacaatattttggtaccctttgagttgtttcggaaagccaccgtcgccagaaacttgttctgaacccagttttttcacctttaccgacacct

SEQ ID NO: 9100 - DNA, 483 bp, Gossypium hirsutum
  Clone ID: uC-gsronu33b025b07b1
ttttctatcgaattctttccttcactttggggagaaaaaaaaatgtcttcaggttgcaattgcggatctagctgcagctgcggcgacagctgctcatgcagcaggaaccttaaccttggatactcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagcacaataacaggcctctgtaatgatttattttcaaggatgaatgcctgcaaggtctatgactataattatgtctctgtctgtgtcttgtgtaaaagagctttgtttgcggtgaaaataatgtataagccagctggttgggagcaaattttccttttgccaaaggattttttg

SEQ ID NO: 9101 - DNA, 427 bp, Gossypium hirsutum
  Clone ID: uC-gsronu33b025c04b1
ttgttgggcgctggcgctggagggtacggagacgggggcgatgtagctgctgaggcgttggcaccatgcaggatctagaggctgcagagggttgcggcgcaaacgagggagggatgacctagggttgctgaaaccttttgggccatttgggctcactttcagtattgggccatcagatttgggctagagggactgttttgggtatttgggtttgtaataggacattattggccatgtaatttttttggggtttttaattatatttatttatttacttggtttgtttgtaacgggcctaggcatatttggcccactatacccccttctaacatttttcccttatcggtaaactttctttcgtcttcctttgagtcagtctgggaatcctttattcaaacatcgctactgtggattcttggttctttaa

SEQ ID NO: 9102 - DNA, 336 bp, Gossypium hirsutum
  unsure (1)..(336): unsure at all n locations
  Clone ID: uC-gsronu33b025d01b1
ctcacgcgtccgnccacgcgtacggttggggggcacctgctagacgttccttgttttaaaaaaaaaaaaaaccaaccctttaatcttcccttcatataattcccattatatatgcatacatatttacacatacacatacatatatatgtatgcatgtgagtaccttcatcttttcaattgtagggtacccttttaacgtaagagggcatgcaagcaagagttgcaccaaatcaaaactatattatgtatgcatgcatgtatgtatgtgtgggttcatgtttgagtgttttgaagtgtgatgggataatatttgaggattttgttaatggtgatatt

SEQ ID NO: 9103 - DNA, 543 bp, Gossypium hirsutum
  Clone ID: uC-gsronu33b025d10b1
ttccgtcgttctgcaacaaatcaaaaaagggattgctgccactggtgttgatgtcccaagccttgaaacagggggaagctctccggctatgcttcctttgcccttggctgctctcgttagcctcacgataacctataaacttgataaatcctctgagcgctcccttgtattacttggcccagcaatgagttccctaggtgggagttgtccttggccatgtatgcccatcatatctgcactatgggctcagaaggttaagcggcggaatgatttccttgtattctcttctgcccgtactgtcttccaccacaacagcgatgctgtagttcagcttcttaggagttgcttcacggctactctcggattaagcccttctatcatgtgcagcaaccgtggagtgggtgcactcctgggtcatggatttggctctcatttctcagggggaatggcttccgtttccccaggaatatgtacttacgatacattgaacaatcagagatttatgttatgacaaagaaatcggtctctttaatgtttctgtaa

SEQ ID NO: 9104 - DNA, 753 bp, Gossypium hirsutum
  Clone ID: uC-gsronu33b025g01b1
tttccacgccttccgttgattatgccgaatattttcaatgagatggaattttttaatgaggtgatgggtaagataattacatgtgaaaaataatgaaataaataaattatacattaaattaaaaaaataactcctaatttaaagataataaatgtaattatctaaaaaagtttcaatatgaagaatgcatgcatttgtttactaagaggtttaaaaaaaataattaattaatcaaacaaaaaaaatcttgaatgtgtgcattcatttcattttgaaaatttttttagataattaaatttattttttttaaactaagagttattattttaatttcatgaaatatttatttattttattattctttatatgtaattatttattgggttatcaaagtaataaaaattacatctcattaaaattttttacgtttgaaattttacattattccctttaaaaagtattacattttttttaaaaaacaatttaaaaaaaaaaaaagttttttttaaaaaaacgtttaaatacaattaaaatttttttgtccaaatttttaacacttaataactaatttaattaccttttgaaattaatccttttcacattaaaaagatattcatatttaattttttccccctggagggtatgcctcaactccaatttaaccaaaattttatcctcactctcaaaattaactcaaaaatatatccaaaattttttgtttaactcttttctcattaatttaccctttttttt

SEQ ID NO: 9105 - DNA, 577 bp, Gossypium hirsutum
  unsure (1)..(577): unsure at all n locations
  Clone ID: uC-gsronu33b025g10b1
tttttcttatttgtttctctccgtttaagcggagaaacaaaacctctagtagtagtattagaatcatgggtgttgtgagttatgagtttgaggtaacctccccaattgctccagccaggcttttcaaggcttttgttcttgaagctgccaaggtttggcccacggctgcccctcatgcagtcaagagtgttgagctcgaaggtgatgctagtcctggaagtattgtaaagatcacctttgttgaaggccttccataccaatatatgaagcaccagattgggggacacgacgaaaacaatttttcatacagttacagtatgattgaaggtgggcctttaggggacaagcttgagaaaatcagctatgagaaccagtttgtggcagctgcagatggaggaagcatttgcaagagctcaataaaatattacaccattggcgactatgtaatcaccgaagatgaaatcaagactctcattanagggagtgaggtagtttacaaggctattgaagcttatcttttggcaaaccccgatgcctgccactaaagatataagcttctttgaattctcatgcatgc

SEQ ID NO: 9106 - DNA, 373 bp, Gossypium hirsutum
  Clone ID: uC-gsronu33b025h07b1
tcttatacacctgcgggctctttgctctctggtgcgtatttatgggaaaactgtggagtgctaaaacctttgcttgctttgtcctattagctatcatagctagatgcgcacttggtcaggctcctagctcggccccaaccaattcaccgccgtcttctaaccctactccggatcccaaggtttctccaaccatgtcttcaaccgctacaccaaccgcatttccgccttcaacatacactcccccgtctttaggccctgaatcttcaccaacttgctctcccactacttctcccccagctccctctcgctggtatttccgttggctctccccctacccgctgattctcccaccaacttcatcatctagacacca

SEQ ID NO: 9107 - DNA, 419 bp, Gossypium hirsutum
  unsure (1)..(419): unsure at all n locations
  Clone ID: uC-gsronu33b112a08b1
tgagaattatagggttcctggaatggtgaaccaggcctcagattggccactgctgtcaccaccagtcatgcccctaacaagcacaaaccaagatctttatcttagagaccaagattccatcaggaatatacttgtcaaactaggaggaagattctcggatgatcatccacaatcaagcaccatatccaccaccaccaatccaatgaattttcgatacccttttgatgtttatttttctcaagatcatcagctatacgaggattccatgaacatactttcatctgcatcttccattagtcccttaaacagtacttgttctcaaacaaacagtactaccatttncagtgtaacaggttgggtggtcctaatgatatgattcaagggcttgatgcttccaagctggctaaggaagctgatct

SEQ ID NO: 9108 - DNA, 343 bp, Gossypium hirsutum
  Clone ID: uC-gsronu33b112b05b1
aagcccctcacttgcttcaggacatgtattcagagtttgtggccaaactggtgtttatcaacgttccatgatggaacttggctctcaacatgatgattagtccttggctaacgcagcgaaccaataacatgtttgtgtgtgcaaggccaggcaactcatctgatatcctttgagatatattgcgcctgaacaagtaccacgtcagttggtggattgagcaaggtcggtgtacaagactttacggttgctgatgctgcaacagatgtgacaatcaaaccagctaccaaacacagcgctgaattgcctgtgactgaaaagagtacagtgatgagccaagtactag

SEQ ID NO: 9109 - DNA, 547 bp, Gossypium hirsutum
  Clone ID: uC-gsronu33b112d10b1
tgtcttgtcgaaagcgcccgaaccgaattcgagaacgggagtccggctatcgcgaacaagatcgaagaatgcaggtcctacccattgtacaagtttgtgagggaagttcttgggactcatttgttaacaggtgagaaagtgatttcaccaggagaagaatgtgacaaggttttcacagcaatgtgtgcagggaagttgattgatccgttgctggattgcttgaaagactggaatggtgctcctttgcccatatgctaaaaagggtgtttcttttctcaaagtttgagagcgacaacaaagccacactgttctataagttctttaacctgtgctcatatataaagacatatatatagcttgtttaagtttttcattcgaaaaatttgtgaaaaaccagaactgctgctgtttttagtgacttgttcttttctttttcttttctttttggggaatttaattacttgcataaatgtttctttgtataagacgttgatacagcaaatgaatgaattatagaactgttctactaaaaaaaaaaagggcggcg

SEQ ID NO: 9110 - DNA, 580 bp, Gossypium hirsutum
  Clone ID: uC-gsronu33b112e07b1
ttcccacgcgtccgaagatgctcagcaaactatgacagccttgaaatctgccaacaaggagctgaaaggaatgatgaagactgtgaagattcaagatatagataatttgcaagatgagatgatggacatgatggatatgagtaatgaaattcaagagaccttaggcagaagctataatgtgcctgatgatattgatgaggatgaactcatgggcgaacttgatgctctggaagcagacatgggaactgaagctgatggtgttccctcttatcttcaacctgataaggaggaaccagatttggatgcagagctcaatttgcctacagctccatcaggaaatgcaacagcagcagctggcagggccaattcccaggttgaggatgaacttggtttccctgctgttcctcgagcatctgtccgcagttaaaacatttgctaatatatatactgtaagatgaagttggatgaagcacgttctttgtaacatattgtgcagaataactttaataactagtgcatttaattgatttttatttttcggttgggagctatatataagcatactgattgacttgaaaaa

SEQ ID NO: 9111 - DNA, 496 bp, Gossypium hirsutum
  unsure (1)..(496): unsure at all n locations
  Clone ID: uC-gsronu33b112f04b1
ccgaccccaagagaagtgctcgtgactcccacgtccctgtattggctccccttccaatagggttcgcagtgttcatggttcacttggctaccatccccatcaccggtactggtattaaccctgcaaggagtttcggtgctgctgtaatctacaacaacgacaaagcctgggatgaccactggattttctgggttggtccatttgttggagcacttgcagcagctatatatcatcagtacatccttagagcagcagctatcaaagctttgggatccttccgcagcaaccccaccaactaaaaaaaaatcaacccaaatagctttgtctccacttcactctttttctattttctccatttgttcgtttgtgtgtatgagaagattattattatgaatgatgatgatgaccctctccatgtatcananaaaaaaaaaaaaaaaaaanttnataccaaaataattcccacttttaatcttttactcttcttcttcctcct

SEQ ID NO: 9112 - DNA, 404 bp, Gossypium hirsutum
  Clone ID: uC-gsronu33b112g01b1
ttcacgcgtccgggaaacccaaggttttgggggatgcctcatgtcgttcgcaagtgtaaaaggttgcgttgaggcaatccacgaggttgtttcgcacgagaagttcgatgcactccaacctaaatgctgcaaagcaatcatcaagctgggcgacaattgttggccaattgtttttcccaatcaaccttgccttcctgtcttactcaagaccgtttgtaaggttttagggatggttgtgaaagttgagaatgttgcagcagcaccttgatagtttgcgctgttgagattttaacttccttggattaagagataacacagctctattcgttcttttagtctttcaaatcttaaagaacaagtattctttttactagtttgccacatcggcatttttctattattcc

SEQ ID NO: 9113 - DNA, 440 bp, Gossypium hirsutum
  unsure (1)..(440): unsure at all n locations
  Clone ID: uC-gsronu33B007b06b1
ccctcgtttccgtaaaaaaaaaaaaacaaacagggagggtagatttaaaagaaaggggggagtaccaaaagagtactgagcttcttatcaggaaattgcctttccagaggcttgctcgtcaaaaatgcccaggatttcaagactgacttgcgtttccagagccatgccgttcttgctcttcaggaagctgcagaagcataccttgtgggtctctttgaagacaccaacctgtgtgcgatccacgccaagcgtgttactataatgcccaaggacattcagttggctcgtaggatcaggggcgagcgtgcttaatttccaagtgtgttaatcacacacttagaatggagaaactattgtttgttggtaggcaaatgtgttgcactatttgtttatgtttattattaatcctcttttangacaagattaaatgataggtttat

SEQ ID NO: 9114 - DNA, 278 bp, Gossypium hirsutum
  unsure (1)..(278): unsure at all n locations
  Clone ID: uC-gsronu33B007c10b1
gaatangctaaggaaaaagcaaagggatcaaattcttgatgatgcttataataaatatatgtttgatgatgacggtttaccgaaatggttcttagaggaggaaaagaggcatcgtcaaccaattaagcccgttacaaaagaagagattgctgcattgcatgcacaattcaaagagatcaatgctcgaccagctaagaaagttgcagaggcaaaagcttgaaagaagcggattgcaatgaacaatgctcgaaatggtacggctgttagcaaattgtttt

SEQ ID NO: 9115 - DNA, 588 bp, Gossypium hirsutum
  unsure (1)..(588): unsure at all n locations
  Clone ID: uC-gsronu33B008e03b1
cccacgcgttcgcccacgcgtccgctttctgacgtctgtttgtgttttcattaccgctattgctttatactacctaacaatgcaggaaaagtacctttacatgcctctttccggcttccatggggtgctggcaggcttcttggttggcatcaagcaaatagtacctgaccaagagctatatctcctaaaaatcaaagtaaagtggttgccatcacttatgctattgctttcaattgccataagtttcttcaccccagagtccgcaacatatcttccaactttgatatttgggacatatattggctggatttacctcaggtacctgcagagaaaaccagaatcaaagcttaggggagatccaagtgaagattttgcattctccacattcttccctgaatttctcaggccaatcattgatcccattgcatcaatatttcaccggatgctntgtgggaaatctgaagtttcatcaaatcctcagggttatacattgggaggtgcaccattacttggttctgaccccattgaggcatctaggagacgagaaagaggggctaagagcgctgaggagagattggcagctgagaa

SEQ ID NO: 9116 - DNA, 575 bp, Gossypium hirsutum
  unsure (1)..(575): unsure at all n locations
  Clone ID: uC-gsronu33B008e11b1
ccctctcgtccgggaagcaacattagctaactcgctcatggaactagaaaactcagattcaagcccccaaattcgaatacgagttcctcttgctggattggatggtgaatgttgcagttcaaatggcttcaaggatgggcagagcaacatccttgtggaagggacatcaaccaagcagattgaagtttgcatgggtggcaagtgcaagaagatgggagctgcggcgttgttagaagagtttgaaaggaagttgggggaagagggcactgttgtggcgtgcaaatgcatggggaagtgcaagacctctccaaatgtaagggtcttgaactctcaaacggaaactacaacaagaatcaatgaagactctgttagacttgggattaatcctacatgcacgggtgtcgggttgcaagactttaacctcatcgttgcaaatcttttgggcaagaacatagatgatgaatgtctggtgctctcttcttgagacttcattttgtttcattcttcgattacgatcatgaaattgtaatagtgtgaataggggacatatagtggatgagctatnggcatggatg

SEQ ID NO: 9117 - DNA, 202 bp, Gossypium hirsutum
  Clone ID: uC-gsronu33B014a04b1
atgctaaatgaggacgagctgagggatgctgtgcttcttgtggttgcaaacaagcaagatctgccgaatgctatgaatgctgttgagattactgataagcttggcctacactgccttcgtcagcgccactggcctatccagagtacttgtgccaacctttggccaagggctgtatgagggactggactggcttttcaacaac

SEQ ID NO: 9118 - DNA, 556 bp, Gossypium hirsutum
  Clone ID: uC-gsronu33B015h04b1
ggcgtgtttaggtcaggaagaaattaaacggaaagcggtccaaatagagaatatgtctgtgaagttagaagagatggaaaggtttgctctcggtacgaatagtattcttaacgaaatgagacagagggttgaggacttggtcgaagaaacttcgagacagaggcaacgagctgctgaaaacgaacaggagcttactcgtgtgaaacaggatttcgagtccttgaaatcttatgttagtagtctcattagtgtaagagaaactcttctttcatcggagaagcagtttcaaaccatcgagcggctctttgaacgactagttgcaaagacaacgcagctcgagggcgagaaaaagcagaaagagactgaagttcagaagcttatggaagagaatgtgaggttgaccgcacttctcgacaagaaagaagctcaacttttggccatgaatgaacaatgcaaagtaatggccttaagtgcttcaaaatatgatcaactttctcgccctaccgcctattggaccgtaccaccctgctgactcaacaatcagccagagaactgt

SEQ ID NO: 9119 - DNA, 562 bp, Gossypium hirsutum
  Clone ID: uC-gsronu33B016d09b1
cccacgcgtccgcttgagtttctgctacctactctaatattatagatcatctccctgtagggaaaacaacctgcaattaaactagggtttgagctttttcttattgacagtaaagttttaagacttgtaaaggtaatcctacaatatacagagagagagagagagagagggagtagtggtggtactggataagaatgaaggagagtggaggaaggaagcagggagcagcgtcgccatgtgcagcatgcaaacttctaaggagaaggtgtgcccatgactgtgtttttgctccttatttcccagccgatgagccccacaagtttgctaatgtccacaaggtcttcggtgctagcaatgtcaacaagatgctccaggaactgccggtgcaccaacggggagacgcggtgagtagcatggtgtatgaggccaacgcccgggtacgtgaccccgtatacggttgcgtgggagccatatcatcactgcagcagcagatagacacccttcaaacccaattggcactggcccaggcagaggtggtgcaccttcgggtgaagcagactgc

SEQ ID NO: 9120 - DNA, 545 bp, Gossypium hirsutum
  Clone ID: uC-gsronu33B016f10b1
atcgtcaacgtgaaagccaaaatccaagacaaggaaggcatcccgccagaccagcaacgtctcatcttcgccggaaagcaactcgaggacgggcggactttagccgattacaatatccagaaggaatcgactcttcatctggttctacgtcttcgaggtgggatgcagatcttcgtcaagactttgaccggtaagaccattactttagaagtggagagctcggatacgattgataacgtgaaagcgaagattcaggacaaagaaggaattccaccagatcagcaaaggttgatttttgctgggaaacagctggaagatggaaggactttggctgattacaatattcaaaaggagtccactcttcaccttgttcttcgtcttcgtggtgggttctaagccttaaggtcttccttaagtgggttttctggttttacgtgaaggattgtgccctttgatggccttttaaataatttctagtcttttgttaccgggtgcatctatgtatgggtttctctttgaatggaatttgcatatttacctaaaaa

SEQ ID NO: 9121 - DNA, 175 bp, Gossypium hirsutum
  Clone ID: uC-gsronu33B018g10b1
gcgtttttacactaataagagaggatcaagaaaaaagagaaaaaaaatagaggacaacgacagacaatggatcaagaaagaccaggggcaggctccttcttgaggagccaagcgtagcgtgcagcatcgctttcaaggcatgtaggttttgtatggtggaacttaattaaaatca

SEQ ID NO: 9122 - DNA, 273 bp, Gossypium hirsutum
  Clone ID: uC-gsronu33B027f02b1
ttccacgcgtccgtttccttcagtttggatccgaaggtgagggtgttgaaacatacgagagtggaatcgctgtcggtgtgaccgaagaagtggtcgcgttcgctagggatctcgcgatgcatccagagacttggcttgattttccggtgcccgatgatgatggttttgatgattttgacatgtctgatgagcaacaagaacatgctttagctgttgaacgtcttgcaccaagattggctgctcttaggattgaactttgcccaggatatatga

SEQ ID NO: 9123 - DNA, 335 bp, Gossypium hirsutum
  Clone ID: uC-gsronu33B027g06b1
tccattcgtctcggaagatgaaaggattcaacttcttttatctgaggtcaagggcaaagatataacagagcttattgcatccgggagggaaaagcttgcctccgttccatctggtggtggctttttccgtttctttatttctttgttttatcctcttttctcttgtatctctctttttttcattttcttttctacctttcctctttttttttctttttctctttctttttcattttttattcactctcttatatccactttttctgtctttatttttttattctccattttcctctttttattttcattcattcctctttttattcctttttttt

SEQ ID NO: 9124 - DNA, 661 bp, Gossypium hirsutum
  Clone ID: uC-gsronu33B032c11b1
cccactgtcgtccgcggacgcgtggggaaagaattcaacttattgtgtacaaccagcttgcattgagccctcctgcatccagccatcatgtgtggtacctacaacatgtttttcacctcgcttcttttcatcaaaatccaaaaaagaccgcaagccgaagaataaaatgggaaaccaagtcagtccattgcctgagcttattgctgagccaaccaatgctcgctccatgtcatttgtgggaacccatgagtacttggctcccgaaattatcaaaggtcagggacatggaagtgctgttgattggtggacttttgggatcttcttgtatgagctattgtttggtaaaacgcctttaaaggatctgggaaccgagcgacactcttcaatgtcgtagggcaacccttgagatttccagaatcaccagtagtaagttttgccgcaagagatttgataggggtttgttggtaaagaaccacacataggttagcctatagcgaggtgaactgagattagcacaccctttcttgaaggtgtaaatggcttaatcgttggcagcccccgagatccaaacagtgaatgagcgattcggtcccatataagtgcgaaaccgtgtctggacagacaaaacatcgattgattttatattagacatttccgtgtc

SEQ ID NO: 9125 - DNA, 462 bp, Gossypium hirsutum
  Clone ID: uC-gsronu33B032d07b1
cccacgcgtccgcccacgcgtccggctttggaatgctattatatttgggtatattatgaaataagactagagaatctttatgtacttgctttttagattaaagttctattaaattgtgctaatgtctttacttgatggatttgcagactaatgctaatgtctattaaattctggtgttttggtttgaagcatcaatttttctatgttcgtttagttgatttgttcgattttctctttagaaggttgccatgctcaatatatgttgatgtaatctatttaaaatttctgagcgggtttaaaatttattttgattattatgtgtggctaggtaacaaggggaataatatcgatgattattactttgattatttatggtgcgaagattataagtatatcaagggtgatcttttctgattgtcgtgaaacttctgcatctcagccgagggtagtcttaattgatct

SEQ ID NO: 9126 - DNA, 420 bp, Gossypium hirsutum
  Clone ID: uC-gsronu33B036h04b1
cccatgcgtccgtagatcgcgagcggccgcacattgacttctgtacacgaggcaatgctagaagatattgtcttgcccgccgagattgttgggaagcgcactagatatgcaattgatggatctaagttaatgaaggtgtttttggaccccaaagaacgaaacaacactgagtataagcttgagaccttttctgcagtttaccggaagcttgctgggaaggatgttgtgttcgagttccctgttacagaggcatagataagtccttttacaagtgttgagacatctttctggtcttatttcatttcttgttttcccttagaaaaactgcatttttgctatttaaaattcgacattattgagttgcccgaacaagcagagatatataagtattatgatggattctaatttattttcattgat

SEQ ID NO: 9127 - DNA, 158 bp, Gossypium hirsutum
  Clone ID: uC-gsronu33B037b09b1
ggtttctgagtcggagtcactggcggcgatgatggagaaagaagagacgggagcaccagcagagcctactgcggcgggtactactactactactacaactagtgctcaagaagaggtggctgctgctgttgaaggagaaaaggtttcttaaaatctgg

SEQ ID NO: 9128 - DNA, 513 bp, Gossypium hirsutum
  unsure (1)..(513): unsure at all n locations
  Clone ID: uC-gsronu33B037c05b1
cgcgagagaggtttttgagattttctgtctttttatttcaaaaatacaaaaaatatatattttttaaatgaactaaaactcccgcacaagtttcaaatcctcccaactcagttcaagcctagttcaataaagctacagtagggaagaagaggctttgaagtttctctaatggaaaagagagtgtgtgaagtttggaaaggaagtaataagtttatccttggtgggaggctgatattcgggccagatgctaagtctctgctcgttaccttattgctgatcactgttcctgttattatcttttgtgtatttgttgcaaggcatcttcggcatgcattttctccatataatgcgggatatgcaattctggctgtagcaattgtctttacatctatgtgttgattcttcttttcctcacatcagcccgggaccangaattataccacgcaattcacatccgagaaggaagttcgctatgatcttttgtttagctgaggtgggggtaggcaaacaccc

SEQ ID NO: 9129 - DNA, 226 bp, Gossypium hirsutum
  Clone ID: uC-gsronu33B037d01b1
gtattacgcaccatcagaacaatcatggaggggaccaaattaaccaagaatggagatcatacatacaacgcaggcaatcgcggcaaccgaaaagtatgccaaaacctgagcaaataataaattccaaacacgtccatagaaccaaaccatgcgtgacacgggcaaatgaagaggcaagaacaaagacgaggagcataagttgaaccaacaatataaggtctcaccc

SEQ ID NO: 9130 - DNA, 240 bp, Gossypium hirsutum
  Clone ID: uC-gsronu33B037e06b1
ccatttgtttgccggtgaagctgagtgtagcaatgtgggtggtaatggtattcaggggtttcttgatgaaacccttgttgctggtctgggaaatgaacgcaagcaggctatgggtaagcgtggtatgccaaagggtccaaagacaaacaacagcaacacgataaaaactattgatgctgaacatactatcgaagggataagggaaaacatggttgcaatgcaagatccccttaagcctaa

SEQ ID NO: 9131 - DNA, 565 bp, Gossypium hirsutum
  Clone ID: uC-gsronu33B038c04b1
ccagtttccacttcgatttcgtcatttttgggaccaattctttatgtgcttttgctcttaatctagctgtgttcttgcttgttggaaagacttctgctttgaccatgaatgtagctggggttgtcaaggactggttgttgattgcattctcatggtctgttattaaggataccgtaacacccatcaacttgtttgggtatggtctggcattcttgggtgttgcctattataatcattccaagttacaggctttaaaggcgaaagaagcacaaaagaaggctgcacaagctgatgaggaaggtgggaggttgctggaggaaagggaaagtgagggaactgacaaaaagagcgaatctcagaattagatcttgtcggtggttaattttaggatatgagatatggaaggaggtagcagataagggctaaagggagagtggttgggatgatgatcgtgaaggtttgcatttaagggcaaaaggaaatgaggggatcggatttcttttgccccattggctgcatttggttttgtatgttgtgttttaggccttcgttccatagactggta

SEQ ID NO: 9132 - DNA, 166 bp, Gossypium hirsutum
  Clone ID: uC-gsronu33B046e12b1
tcgctggttgattacaacatccaaaaggagtccaccctccatttggtgctccgccttcgtggaggaatgcaaatctttgttaagaccttgaccggaaagacaattactttggaggttgagagtttagataccattgacaatgtctaggttatgatccaggacaagg

SEQ ID NO: 9133 - DNA, 155 bp, Gossypium hirsutum
  Clone ID: uC-gsronu33B046f08b1
tcgcaaatgttctctccatcccaccatcccccaaaatcaccatggccgctacttcaccacgtgaggaaaatgtctacaaggcgaaactcgccgagcaagccgagcgctacgaggagatggttaggcacatggttaccatattatccttctttttt

SEQ ID NO: 9134 - DNA, 385 bp, Gossypium hirsutum
  Clone ID: uC-gsronu33B047d08b1
acccattctaccccccttggacaacaaacagggaaaaaattccgtttcacagaataagccttgagaaaacatgacagaatgaacaagcagagcgcttactcgctgggccagggtagataggggaggagacaatcaaacatatgataagaaaccccagagcacacgactttatagcccttaggggaaaaacgaaaggaaggattcgtactacctctttaacaattaattaacaaaaacatgcatgttttattgaacagcccatcttaatttgctttactggaaagggcaaagcaagccctaaacagggtaaacccattcttaataaaacccggtcctagacctcccccaattaaagacaactgtaattctctggtaatgccggaaa

SEQ ID NO: 9135 - DNA, 89 bp, Gossypium hirsutum
  Clone ID: uC-gsronu33B047e04b1
gactcgctatggataaggagcatgatgatttacgcgagagtctattacagactcaagcgcgaacttttcgttatttacaaagaattttt

SEQ ID NO: 9136 - DNA, 238 bp, Gossypium hirsutum
  Clone ID: uC-gsronu33B048b04b1
agtcgtcaatggctgttctctgagtagcagagagggtttttgaaagatgatgatgatcactgtcacagctgtgtatgatggcttatggggggcctgaaattctccatatgcttttttatatgttagtcttatgggttgttctaaagagccccgcataccaagtacaagaaggcgtgttaggaagaagaagaagtttcaggctcacgacccaaataaccaattcaaagttggcgattat

SEQ ID NO: 9137 - DNA, 308 bp, Gossypium hirsutum
  Clone ID: uC-gsronu33B048e02b1
cccacgcgtccgctttccacctcgaccctaccaaatggggtgtcaatgtccagccttactccggttccccggccaacttcgctgcttacacggccgttctccagcctcatgataggatcatgggactcgatttgccttcaggcggacatttgactcatgggtattatacctccggtgggaagaagatttctgctacgtctatttacttcgagagtttgccttacaaggtgaactccactacggggtacattgactacgataagctggaagagaaggcgttggatttcaggcctaagcttatcatttgc

SEQ ID NO: 9138 - DNA, 81 bp, Gossypium hirsutum
  Clone ID: uC-gsronu33B049c12b1
cccatgcgtccgtttttgttttcattttccttatgtcctatatctctttcctaggttttcggtttttcttactcaaatttt

SEQ ID NO: 9139 - DNA, 457 bp, Gossypium hirsutum
  Clone ID: uC-gsronu33B062d06b1
cttcttttccttctcagaaatcttagtatcatgagggtggccttaaatcccaaggggttttttgacatgactgatcggttggtcatgcccgctggtccggatctgtgtatggagcctttctccaagatagcactcctcgcactgcggagaacttccgtgccctctgtactggcgagaaaggtgtcggccgcagcggtaagcccctccactacaaaagctcttctttccatcgtgtgatccctaactttatgtgccaaggaggtgacttcaccgccggaaacggtacccggaggtgaatccatctacggatcaaagttcgctgacgagaacttcatcaagaagcacactggtcccggtattctctcaatggctaaccgctggaccggaaactaacggatctcaattttttatttgcacgggtaagactgagtggctcgaccgataagcacgtgtgttt

SEQ ID NO: 9140 - DNA, 569 bp, Gossypium hirsutum
  unsure (1)..(569): unsure at all n locations
  Clone ID: uC-gsronu33B080c03b1
tcgctggctctcattttgcctgaaaaccatgtcggggagaattggttagggagcctatggaggagaatactacccttgggccggctgtacgagacggcgaacatgttttcggggtggctcacatttttgcttcatttaatgacacatttattcatgtaacagatttgtctggaagggaaacaatggttcgcattacgggtggtatgaaggtgaaagctgatagggatgagtcttccccttatgccgccatgcttgcagcacaagatgtttctcaacgctgcaaggagttgggtattacagcccttcatataaagcttcgagctactggagggaacaaaaccaagacacctggtcctggtgcccagtcagcacttagagccctcgctcgttctggcatgaaaattggacgcatagaggatgtcacccccattcccaccgatagtactcgtagaaagggtggcagacgcggaagaaggctgngattctatgcttcatatctgctactcagccgctgctgctggcggttgacataggaattctttttgttttgaaacaatttttgattagat

SEQ ID NO: 9141 - DNA, 339 bp, Gossypium hirsutum
  Clone ID: uC-gsronu33B082a11b1
aataataaaagctcaagttcaagttatcagggagaaagcagaccggccttttcgttgccttgattgtcagtatagaagagaacttgttagggtatatttggcaaatgtagagcaaatttgtcgtcgttttttggatgatagacgaagcaatctagggaagttcatagaagacaaagctaagtggtcaagtttttggactttctggtcggggattgaccaaaattccaggcgcccaatgtccagggagaaaaaagatatgactttgacagcagctgtgttgcacttttctattgagaaagaagttccatcttcttttggatatggattcactttattagt

SEQ ID NO: 9142 - DNA, 537 bp, Gossypium hirsutum
  Clone ID: uC-gsronu33B089c02b1
gtttgtagaagacagaagaagaagaagaagaaggggaagaaaaaaagggaacaaagggtggcaattcagattcctagagtgaaacttggaactcaaggatttgaggtttcaaagctgggatttgggtgtatgggtctttcaggtcacaataattcagtgtcagatgaagctggcatagccatcattaagcacgcattcgaaagaggaatcactcatttcgatacagccgacatgtacggacccaaaactaacgaaattctagttggaaaggcattgaagcatttgccacgagagaaggtacagttggctacaaaattcggtgttgaaagcatgggtccaggtggtccggttatcaatggcactcctgaatttgttcgttcttcacttgaggctagccttcaacggcttgatgtggattatattgatctttactatataatcagagttgaccacaagactcctatagaagataccatggaagaactgaagaagtggtggaagagggaaaaataagtacattggtatatcttgagctag

SEQ ID NO: 9143 - DNA, 382 bp, Gossypium hirsutum
  Clone ID: uC-gsronu33B090h12b1
cgcgtccgcggacgcgtgggcaataggtcaacatttcactggaccagggcaccgtgaggttgccaattgttgtaccttgctatggttctgtatcatgcaggagatatggctggggccataatgcagcagcacaaagaactaattataaatgaacgttgcttgggtttggaccaccctgatactgctcatagatatggcaatatggcccttttctaccatggcctgaaccagactgagctagcactacgacacatgtccagggcactgcttttgctaagcctatcttctggcccagatcatcctgatgttgctgcaactttcataaatgttgctatgatgtatcaagatattgggaagatgaatacagcacttcgttatctgc

SEQ ID NO: 9144 - DNA, 452 bp, Gossypium hirsutum
  Clone ID: uC-gsronu33B098g11b1
ctcactcaacattcccatttccaatctccagctccgaggggaaatatgccgatcagagacatagcggatggccggcccgaagaggctactcaccccgatgctctcaagggtggtttggctgggttcatctcaaccttgatcttcggtttcgctggatcgggctcaggaatggcctttaacaaggtgactgacaacggagcaaccaccccggctgggctcgtagccgccgctctagctcatgggttcggtcttttcgtcgctgtctccggtggcgccaacatctcagggggccacgtcaaccctgccgtcaccttcggggcttctgttggcgggaacatcactctcttgcgcgggattctttactggatcggccaactcctagggtcaaccgtcgcttggctagtgcttaaggttcgtaccggggacctggctggacccgcttttggggttgt

SEQ ID NO: 9145 - DNA, 511 bp, Gossypium hirsutum
  Clone ID: uC-gsronu33B099f03b1
cccactcgtcttcccacgcgtccggaatgtcgtggttagctagatcgattgctaactcgctcaagcttgacgacgacgacgacgacgatcggaccaatgcggcgctggatccgaaacccgaatccgatccgaatcctaaccaagcctctccttctcattcccattcatcatcggatcccaacactccacgtggcgtcaaagaagacctatccgagcttaccaaaaccctatcttgtcaattctggggggttgcttccttcttcgctcctcctcctccgaaatcatcggagcagcagcccgatcacgcggctgagaaggaggaaaactctctccggccaccgccgtcttctgatgatacggatgagtcgtcggatgaggcattgatagcgggaatccgtagcgatttatctgagatcggtgggagattcaagactggaatctcgaagctgtctaaatatatgaatgtctcggagttcactaagatcgcttcgaattttctttcagtttggat

SEQ ID NO: 9146 - DNA, 76 bp, Gossypium hirsutum
  Clone ID: uC-gsronu33B100c07b1
gaacgcccgcaggaaccggcccggaaaaaccgagccgacccacgctcttcgaacatgttacaacagcacccataac

SEQ ID NO: 9147 - DNA, 134 bp, Gossypium hirsutum
  Clone ID: uC-gsronu33B100c11b1
tcgggattattgaatgatttttagcattagctcaggttgttatatttctatttcatttcaaatgttcaaccgccattgattgtcaaaaaaaaaaaaaaaaaaaaaaaaaaaataaaaaaaaaacattaaacttt

SEQ ID NO: 9148 - DNA, 211 bp, Gossypium hirsutum
  Clone ID: uC-gsronu33B101h05b1
cccacgcgtccgacctctgcaacatcactgttaacaagaatgctgtttttggtgacagcagtgcattggctccgggaggtgtacgaattggtacacctgccatgacttcaaggggtttggttgagaaggactttcaacttatcgtccatgtcttccatctagtcttgtcattactcttatctttctaattgtaatatggtttgttttttaa

SEQ ID NO: 9149 - DNA, 106 bp, Gossypium hirsutum
  Clone ID: uC-gsronu33B107c06b1
aaattaattttaaaaaaaaaaaaaaaaaaaaaaaaagagggatatgtttgaaatttgttttgggtccaggctcccgttctcagggatccaacctgacagccctgtg

SEQ ID NO: 9150 - DNA, 541 bp, Gossypium hirsutum
  Clone ID: uC-gsronu33B108f03b1
cccacttttccgcccacgcgtccgtgagttggtgcgaagatgagtcgtggggcagcagcgggaccccaggggaagaagaaaggggcctcctttaccatcgactgttctaagccggttgaagataagatcatggacatagcctctctagaaaagttcctccaggaaaggatcaaggtcggtggcaaagccggtgctctcggcgattccgtcactgtcacccgcgacaagagcaaaatcactgtctcctccgactccaacttctctaagcggtatcttaagtacttgactaagaagtacttgaagaagcacaatgttcgggattggcttcgagtgatttcttccaacaaggatcggaccgtttacgagctccgatacttcaacattgcggagaatgagggtgaggaggaagagtgaagaccggttcagctttttctctattcatcacccctttgtttggtttatttgttatgaggaacctagtttatcaatttcaggtgtcgaatctttggacttgatttggttgttttttgaaccctagtct

SEQ ID NO: 9151 - DNA, 401 bp, Gossypium hirsutum
  unsure (1)..(401): unsure at all n locations
  Clone ID: uC-gsronu33B110a10b1
ttctttttccaatcttttttgagaaatcggtagcgaaaaatgtcgtcgtcggggaggaagatcacccttaagagctcagacggcgaatcattcgaggttgatgaagcggtggcgttggagtcgcagacgattaagcatatgatcgaggacgattgcgctgataacgggataccgttgcctaatgttacgagcaagatcttagcgaaggtgatcgagtactgcaagaaacacgtcgaggctcctaagacagacgatcgatccgtcgatgacgagctcaagagttgggacgctgactctgtcaaggtcgatcaagctactctctttgatctcattctggcagcgaactatttgaacatcaagggcttgctggatctcacttngccaactgttgctgacatgat

SEQ ID NO: 9152 - DNA, 429 bp, Gossypium hirsutum
  Clone ID: uC-gsronu33B114d08b1
acgcggcctataataagcgaacagggagacaactggtccaggggatgtctcaaaggttttctcttttaggacacaactaatgcagggaggctcgctgtgaccaatctggcgactgcaagccaaagcatgacccatataacccaccgatgacacgctttcacacacaagtggacaaagaggcacatgaagctgatgatcaatgagactggaataacactctatagctgtgaacaaaaaaatcagtgcttatgttaagcacaaaaagaaacagaatcagatttgctggatctgggaaaaggtcagcccagataatgatggcggattccagcggctcttggatactgttcagtacaaagctaatagcatacttcgttatgagcgcacctttggtgaaagaattgcgagcacaggaggaatagaaacaacgaa

SEQ ID NO: 9153 - DNA, 454 bp, Gossypium hirsutum
  Clone ID: uC-gsronu33B114e04b1
gagtgatctaaaaaaggagttaaaaatggcttgggctgcatctcactaagtggtaaaaggtgagcttaagaatggttctgatgactgccttgcgagcttgatgtattcgaattaccaaggtgctccggtaacgattaaaaaagattcattacccactccatttgcgcagaatatgatggtcgacggtctgtacggaggcctggtgtatgatgttgttagggttaagtggattattctttggaccactgattgtaaggtggctactaagatcattccgaccgaaaaccatattgtttgggaggatatagtgagcatccttcagccctacaatagctctgacatcttgcccttatcatgtgggggtgcattttccttcgaagctcatatccatgcaaatgcagatgggatctctaaacctgacagcacaaatcatgtggagcggttgcaattaacc

SEQ ID NO: 9154 - DNA, 373 bp, Gossypium hirsutum
  unsure (1)..(373): unsure at all n locations
  Clone ID: uC-gsronu33B116b06b1
ttttacttttcttttagttttagttcacacaagtgaccctngacaccttttatatatatatgtatagacacccgtgaaagtttattcaaaaaaaaaaaaaaaaaaaaaaannataaaaaaaaaaaaaaaaaaaactaataagggntcccccattcacatacaccggccacccccccccaccccccctgcatgcgccccccccctctcaagcccccaagcccccccccccggccccccaactcacccccccccgcccggggaccccccccggtcgaacccccgcaccaatctccccccccccccagctcccagggccacccccctggggtcccccccccaaaaaaccctcgcccccacaccccccccccccccc

SEQ ID NO: 9155 - DNA, 455 bp, Gossypium hirsutum
  unsure (1)..(455): unsure at all n locations
  Clone ID: uC-gsronu33B127h04b1
cgggccggaaaancctggnngaaccacgcgttccgttacgcgtccgcagtcttccaatgtctccccaggtaccttttgggtgcaaaatgtgaccaacaataacaccaccaaccactcatcgttatcttattatactcccaggattaatcctgtaatagccaaggcactgcgtactgaagcatctgccacagtacagcccataaaaatggggaaagctatcagggttcatcaatttggtggatctcaggtccttaaatgggaggatgtggaacttggggaacccaaagagggtgagatacgtattaaaaatatagctattggagtgaatttcatcgatatctattttcggaaaggagtttataaggctactaccatgcccttcactccaggtatggaagctgttggagaggtgactgccgtgggacctggactgactggcaggaaagttggagata

SEQ ID NO: 9156 - DNA, 450 bp, Gossypium hirsutum
  Clone ID: uC-gsronu33B132e02b1
tgaacaggagaggaacatcgatagatagaaggagatggcggtgagaggtagagcagtagaaacgctgccaaagctgatgaggagcccgaggaaggactcggcttcttcaacagtgactcgaactccagccttgccctcccttagacgcgctttctctctctacgatcagattaatctcatcgacaatgttcccgatgaccagcttcgtttccaacgatatacggaaacaggattcactgtgaacggtgtcaactatgaaggcagcttgctttgtgtgggaaatttggttacttcttggggcccccgtaaattttctgaaattactccccaaagcttatccatctttcaaattatacgacctattccagaaattttgattcttggctgtggaaggtacattgaacctgtagatccggaactcagacgcttcatccgatctactggcatgaa

SEQ ID NO: 9157 - DNA, 454 bp, Gossypium hirsutum
  unsure (1)..(454): unsure at all n locations
  Clone ID: uC-gsronu33B132e10b1
ttttcacgcgtccgtttgcattttccatctgtgtgtttacattctaagacctattcttgcgtgacaaaacctggtgctcatctgctgttttaacgattaccgaatttgctaatgagaatcgatccgcgcgggtttagattaactgttttgtacaggggatgcacgatagttcatgaagggtgccatcgatagtcatcgatactcgggcctgaccagacacttcattcacacgagccgcgctcacactgtcaagtcacaaccactccatggggccaccttcggttgaaatcaaccgtcattgttggagcctatagagatggacatgatcaaacatcatgaggcatgccctggacgtgacgactgagactatggtgatgctggtatagcgganagggnggtgaatattgtcacaaagatttactgcggtgatgccagggataaaatatgtgaatct

SEQ ID NO: 9158 - DNA, 318 bp, Gossypium hirsutum
  Clone ID: uC-gsronu33B132f05b1
ctcccgcgtccgaaaaaaaaaaaaaaaaaaaaaaaaaaaaaaaaaaaaaaaaaaaaaaaaaggaaggacgatataaaggaagggggcttccgtatgccggctcccggcttccttaccttgggatggcgtgccttagcttttctgtactgtcaccttgattccatggcctggcctgggattacccggtcgtggctggctaagccctgtcgtaacccatttcatttgtcttgcgttgcattttcttttagtcggctggtttagttggggcttggcccgaaccgtttgccctcctggcgattgccctgcttgcttggggga

SEQ ID NO: 9159 - DNA, 566 bp, Gossypium hirsutum
  unsure (1)..(566): unsure at all n locations
  Clone ID: uC-gsronu33B136c09b1
ttgattgtctcccagctccctttttgtctctgcatttttcctagtgtaaaaaaagaaagttagatatgggtaaggatatagagagtagtgtagagcaagggtcaggcaaggactaccatgatccgccaccagcaccattgattgatgctgaagagctgactaaatggtcgttttacagagcagtcattgctgagttcattgctacccttctcttcttgtatgtcacagtattgactgtgattggttacaaggtccaaaccgatcctctcaagaacacagttgaccctgactgtggtggtgttggtatcctgggtattgcttgggcctttggtggcatgatctttattcttgtttactgcactgctggtatctctggaggacatatcaacccggctgtgacctttggactgttcttaggacgaaaggtatcactgatccgagccatcatgtacatggtggctcagtgcttgngtgccatatgcgggtgtggattggtcaaagctttccaaaagacttactanncacactatggaggtggtgctaatgagctccaaagtgggttcaac

SEQ ID NO: 9160 - DNA, 458 bp, Gossypium hirsutum
  Clone ID: uC-gsronu33B137h07b1
tcgattctttctcttttgaagaacttgaaaaaggatcagtcgaaaaaatgcggaacatgtgtagtttcgagaatttaagcaatttggaagtgaataaaagcggaaaacaccgtgagggaactccagtggtgattgaaaacaagatgtatttccgaaaaggtaaggttggggattgggagaattatttgacacctgaaatggctgttcggttggactcgataacgttgcagaagctaaatggttcaggcttaactctatgattgaataataaagcagccatggggtacattttgccttctctgcaatttcacatattatgtttctaaaaataaattgggtatgctttttgcaagtagcaacacttctcgtgttgttcatgttaagatcaattaaaagtatagttggttcaattgaaatcgattcaatcaataaaatttgatataagttgatttgaataa

SEQ ID NO: 9161 - DNA, 263 bp, Gossypium hirsutum
  Clone ID: uC-gsronu33B139b06b1
ctttcactctgatcttggaagacctgctgcagattatggtggtgtcagcggagacggttccaaactacttgtatgcgctggaaatgacgatgctcggaagggggtctgcgatcgtggattgacgttggataaaattaaggcttgtgggggtgatgaatcagccaacaggcttaaacctttctacaagggggaaccaattactgtgaccataccatagtcatgggaaagtagtggttggcaattactttgatttaaacgtgcca

SEQ ID NO: 9162 - DNA, 500 bp, Gossypium hirsutum
  Clone ID: uC-gsronu33B139c02b1
gtatatactcatgcagaggagtgcactaggtggagatagcttgtgggaactgacatggctgcatgtgaataacattgcgccatctttgcagtcggaggttttccctgatcagggtccagagctcaagcatggcgaaaccggttgtgcagtttctggtgaaacagtttctgttccttcaaatgaaacaaccacccttgaaggggctggtgcgggaagttaaatgttgtgtacagttgatgcttgaaaagggtttgtaattgccagcatatagagtcgcacacaatacattgctatttctcgaggatatccgcattgagacattaggacacattaggttatgctgccgctgatattccgcaaatcctagtatcgtttggaggtattgggtgcatattggttaaaaaagtgagccttccttagaaatgtgtgtaagatttttcagttataattaccagttattctagatctggcttggccttccatcttattgctgcctccat

SEQ ID NO: 9163 - DNA, 558 bp, Gossypium hirsutum
  unsure (1)..(558): unsure at all n locations
  Clone ID: uC-gsronu33B139c10b1
cccactcgtccgcccacgcgtccggtggctactgggggtggagatgatcaggggttcctttggaagataggtcatgctgattgggcttctgagctccaaggccataccgattcagtctctactttagcctttagcagtgatggacaactacttgcatctggaggttttgacggacttgttaaagtttgggataccttcggaaatttcaaacgcacacttgagggtcctggaggtggcattgagtggattaggtggcacccaaaaggtcatctgatcttagccggatctgaggattgcactgcttggatgtggaatgctgataatgggaactgtcttaatgtattctcaggccatgatgccattgtgacctgtggtgattntacccctgatggcaaaacaatatgtactggttctgaagatgctacattgaggatctggaatccaagaagtggtgaaagcattcatgttgtaagaggtcatccatatcatacagaaagactgacgtgcttgtctataagtctgattcactttagctatactggttctaagatggctctg

SEQ ID NO: 9164 - DNA, 439 bp, Gossypium hirsutum
  unsure (1)..(439): unsure at all n locations
  Clone ID: uC-gsronu33B145a11b1
ttctatcgcgtccgccatgcttccgctcatgcttggaaccccatcaagggggcactcatttaataaaggttgcacacagaactcaaattagtgtgattgtggactacgtgcgtgcgtgcgtgcatgcatatccatgtacaatatatcaacatatgtagttgtaggatgttccattctatctcatctcatctcttttgtcatcgccttttgtgttttgtcggcttagacagtgtgagtaaggtagatatataacccctttccactagtcttttagtttcaaaataaagacgtgattgtatgtatctttttaatttttttggcataaaaaaactcataattttccctttaaaaaaaaaaaaaaaaaaaaaaananannnnaanatttataaaaaaaccaacattaaaaanancntaancccttaaaaaaaccacaaaaaga

SEQ ID NO: 9165 - DNA, 487 bp, Gossypium hirsutum
  Clone ID: uC-gsronu33B146e06b1
gcattatttatgtgaatagagcttgtggcagtgatgggggtactgcccttcattgcgctgtggctggtggtgcagattcttcggttgagattgtcaagctgttgcttgatgcatctgccgatgtgaattgtgtagatgctaatgggaacaaacctgttgatctgattgtgccgggtttaaaatcttcgagcaattacagaagaaaggtgattgaattgttactgaatggcgatgatgttctttacggggaagaagaatctgataagacaacgatgcctcagttgccaaaagaggggtctgagaagagagaatatcctatggatgtatcactgcctgatatcaacaacaggatatatggaaccgatgacttccggatgtatacgtttaaggtgaagccttgctcgagggcatactcccatgattggactgagtgcccttctgttcattctggtgagaatgcgaggagaaaggacccaagaagtaccct

SEQ ID NO: 9166 - DNA, 79 bp, Gossypium hirsutum
  Clone ID: uC-gsronu33B147g08b1
ccgccggcagggaccgggaacggaccgggcggaccgacgcgcccggaccgtaattccacaccaacgcacggcaacaaaa

SEQ ID NO: 9167 - DNA, 343 bp, Gossypium hirsutum
  Clone ID: uC-gsronu33B147h11b1
ccctcgcgtccgatcaccgttggctctttaatcctgcgcgatacacccaatttcatgatcgaacgtggccaaaccgaggaagccaaggccaagctcaagaggatccgtggtgttgacgatgtccacgaagaatccagggaccttgtagcccacagcgatgccaccgatctagactaacacccgccggggagctcgaagctacgatatgatacacctcgttcattgacagatatgctctttgctttataccatgcgaccgctgtagcacaagggcctgtggcttttcaggaatactatattcggctcaatgaatggctgccctattagttccaaaacccagcaa

SEQ ID NO: 9168 - DNA, 479 bp, Gossypium hirsutum
  Clone ID: uC-gsronu33B149c06b1
tgtatattgaaattttctttctcgattttctctttagccaaaaaagatgcagatcttcgtcaagactctaaccggcaagacgatcactctcgaggtcgagagctccgacacgatcgacaacgtgaagaccaaaatccaagataaggaaggcatccctccagaccagcagcgtctgatcttcgccggaaaacagcttgaggacggccggaccttggccgattacaacatccaaaaggagtcaactctccacctcgtcctccgtttgcgcggtgggatgcaaatcttcgtgaaaaccttgaccggcaagacaatcactctcgaggtcgagagctccgacacgatcgacaacgttaaggcgaagatccaagacaaggaaggcatccccccagaccagcaacgtctcatcttcgccggaaaacaacttgaagacggccgtaccttggccgactacaacatccagaaggagtcaacgctccatc

SEQ ID NO: 9169 - DNA, 453 bp, Gossypium hirsutum
  Clone ID: uC-gsronu33B150a02b1
ccctcttgtccgcccacgcgtccgttttattttaaggacagaaaacgttccttctccatctctccctcattttcttctcctcttagcctcccccatggccggacatgggttcatcggaaggtgactccacgttcgctccgcgaacggcgaccggtatcacacgaggtgggcttcccttgtttcttctccgaacggaggtcgaagacagagcctttgcggcccaccacaacggaagagaagaggaaaggccccggtcggttcgtcggagcaccccaaacagtgaatcggagtttcatcttgcaggtgtcagacgcgtggaaggccggtggttggtgccccaggcggtgatggtggtgcgcgtgatggccaagggcagaggggagtggcggctgaaatcttgggggtaggttttttgctgctgaaaaatgtttagcttggtggctaggtgggctt

SEQ ID NO: 9170 - DNA, 541 bp, Gossypium hirsutum
  Clone ID: uC-gsronu33B150f08b1
ggctgggatgattgttcaaactattcaggttcctcaggttacttggcctgggactttgttgctggagatgtcggtattgattacgatgatgagatatcagatgtggattgggaagacgaccaaagtatagaagatgtggaaatgaggttctacgacggttttgacttggaaaatgctgcgttcgattggcccctctccccttgaagggattgttatccattcgagctctacacagactgcggtgagcacttttttgattcccctttgctatgcacaaacattgttcttataaggtagtagtatataaaacaagctttcctatgagtatttgtaataataaaaaaatagaacttgtaatatgtagcaaaagaatgtgtttccctagtaattgagatggacatgtcatagcattttcatgccccatgtcacatgctttatgtactgtacctacaataattatacaattagtgggaattgtaagatggttcaaaggtgtgatgatgacatgatggaatataaagaaattaatgtcagatgtgac

SEQ ID NO: 9171 - DNA, 283 bp, Gossypium hirsutum
  Clone ID: uC-gsronu33B154g05b2
cagtaaggaattggaatgtaataatattgattcatataggaggaaaaggttctctattgattcaaatgctgtacctatgggatagggatagagaaagaggaaaatccttagatttgacataatggtcgtgatggatcgatcaatgtgatttattgcgtacccctgactcaatgagaaaaggggtgatattgtataacagcaaaccgagggcacttggagaatgatggaagggaataaaataaaaagaaaaaaggtttcgggagataggaagaatggagacaag

SEQ ID NO: 9172 - DNA, 524 bp, Gossypium hirsutum
  Clone ID: uC-gsronu33B156f02b1
cccatttttccgtccacgcgtccgggaagaaatagaggtaccaaaaccaatattgatgccaatttcaggaaaggagcaaaagtgtgttgggaatatatttaggtgaagttttaatgcatgagagaagaaactgatatgtgtgaccagtggcaactcttacttgggttctttcattgacaaagagctattggctcatggttaccttgttcgagtaaccattcaacacccagctgaatttgaagatgtgaaagacctgctaggggtggaagatttaaacctattggaaagtgttagttgaacgaagatggaaaaattacaaagcctttgtgatgcttttagaggttgccatgctgttattcatacatcttcctttattgattcacatggtatctatggttattcagaacaaaaggtgttattggagactgaagtggcaaggactgtcatggaagcttgtgcttaggtagcctatataatgagatgcgtgtttactacatttctattggcatacatttgaggaatga

SEQ ID NO: 9173 - DNA, 353 bp, Gossypium hirsutum
  Clone ID: uC-gsronu33B156g08b1
aaagtactgaagccatggcagcagggaagtttgttgttctgatggtaatggtcgcattaatggttgagggctcaagggcaatgaccttgtgtgacatgaatgatgaggggacttgaggcgtgcaagccatcggtgagacagctgaacccggtcgacccatcgcccgagtgttgcaaggctctgaaaggggctgacttgccctgcttgtgttcttataagaattcagtgtggctaggctgtttgtggattgataaaaacattgtgttggtcttgcctctaaagggctagtctcgaatctacataatttgtcttttttagcaaatgatgccctttgtactttaactcttgttcct

SEQ ID NO: 9174 - DNA, 518 bp, Gossypium hirsutum
  Clone ID: uC-gsronu33B157b08b1
cccatgcgtccgcccacgcgtccggttctcaacgaatcgatctcccgagagtgaagaagatacagagtacaaactagatcgaggtcttctgataaaagcttcaaattgatattgtctgggtagattgcttcttggtaaccaagatggttgtacttgtggcttcaattgtaagcaagtttggaaatgtgcttctctacaggcagtatgtggacctgactcgtataagaattgatggtttttttgttgctttttctaataaggtctgatctagtaatgtttttatacttttttttttgtctgttatttgattttatttttattatttttattatattcatcttattattttctacttgtatctattcctctttgttttattctttttattctatttctttattttttttcttttttttttatttcttctctattttttatatcttctttcacattttttttcttcactttcttatatctctcctttcatatctttattcattattttctttttttattta

SEQ ID NO: 9175 - DNA, 496 bp, Gossypium hirsutum
  Clone ID: uC-gsronu33B157c12b1
cggatttctaccgacgattaaagaaccctctcccgatctaattacactgcatttaaatcggatagagagaaagagaaaacaacatgaagagaaaagatacagtcaaactcatcagcgctgaggagatggaatttattattgacaaggacgctgccatggtttctcagaccatcggaggttttgcggagatggagcttggagaagtgacttttccggagataagcgctgtgattcttgagaagatctgtcagtatttttattgggctcttcaatattcaagttattaaagctgcatggtgaggctggaatgactttgcgtgaaggacaagtaggggcatattcttgtttttgaatcttttgcagtgactattgttcgaggacatcagcagcatcccggataacatctgaagatgttattttcttgtattattggctatgaactgcaagaaacgttctggtgtttgaaatttagaaacaggcagatacttgaattgaa

SEQ ID NO: 9176 - DNA, 459 bp, Gossypium hirsutum
  Clone ID: uC-gsronu33B158b08b2
gtcttcttcgcggctgtttccggcggagccggagttcggaggtaaggtgtcggaagaaagggcggtggagggaagcagcgaggttgggctggagttgacgctggggtttaaaccggtggtgtcacgtgcttgtcaggtggtggtgcccgtaaagaaaaggagagtggaggcatacggcacgttcgaagatggtcaaacgtgtaaggttgagctgggtcttgactatccggcggcttaaatggcttttataaaaggaaaaagaaaaggatagtttgttcccagttttggcggctcgtttccggcttttggttattttacatagaaaagttgtgggtcgttttttttctttttggtaattttcctttttttctcattttggaaaacaatttgattttgcttttcttgttgttaaaatggttaaatttcttttgggggatgctctatgcttttttttctttt

SEQ ID NO: 9177 - DNA, 490 bp, Gossypium hirsutum
  Clone ID: uC-gsronu33B163f04b2
ccttgttgtatttcactctgggattgaagtatatggagcggagtatggctttggagcacacgagtaccctacaactggggtgttcgaagtagaaccaagaagttgtcctggtttcatattcagacgatcggtattgttgggcagcaccgacatgtctcgttcagaatttcggttatttatggaagaactttcgcaaaaataccgtggggacacgtatcatttggttgctaggaattgcaaccatttcaccgatgacgtgtgcatgcagctcactggaaaacatattcctgggtgggtaaataggttggctcgattaggttcgttttgcaattgtttacttccagaaagcattcagattccagcagtttggcatgttcctgatcgtccagcattttccgacgatgagagatcgaattcggctggaacttttttaacgggggagagcgaggaagaggaagcagatcatcatctactgacacacccgatatga

SEQ ID NO: 9178 - DNA, 511 bp, Gossypium hirsutum
  unsure (1)..(511): unsure at all n locations
  Clone ID: uC-gsronu33B164a01b2
gctgttcattactggagtagctctcagcaggcttaaactcaatcctgcaacaaagggtcatccagtctggtatgatggaagacgagaggttcatatacacccttcttctatcaacagtagcttgaaatcctttcaacatctctttcttgtcttccttgaaaaggttgaaaccaacaaagtatttctgcgagatactaccatcatatctcccttctctattttgctgtttggtggcttaataaacattcaacaccagtctggattggttgttatagatggatggctgaagctgacagcgcctgctcaaactgcagtattgtgcaaggaacttagatctgctcttcattcaattttgaaggagctaattagaaagccagagaatgctacgatcgtagataatgaggtagtcaagtctatgatacatttgttgctagaagaagacanaccctcaaatagttcagcactgtagtgactcagctcccagtttgtatcatttggaagtgatcagtgg

SEQ ID NO: 9179 - DNA, 365 bp, Gossypium hirsutum
  unsure (1)..(365): unsure at all n locations
  Clone ID: uC-gsronu33B164f04b2
gttatgttgcagtaagatcaaagagcaaaagccttgcctttgccaatatctgaagaaccctaatctcaagaaattcattaataccccaaatgcaaggaaagttgctagcacttgtggtactcccttccctaaatgctaaaagaaaaaactcaagttgtgttgtggtataatatctttgttttggtgtttgtagtgaaaaaaaaactgtggtttagtcatatgttggggggttaaagtgatatttcaccaatgtgttcactgtttttttatgtgtgtgtgaaatctatatcatgtactactagttgttgaagaagtaatttatttaatggaaatcagtgttggattattagattaccnactaaaaa

SEQ ID NO: 9180 - DNA, 512 bp, Gossypium hirsutum
  unsure (1)..(512): unsure at all n locations
  Clone ID: uC-gsronu33B166a02b2
cccacgtttctttccacgcgtccgcacgggttgtggcgtagtttaagcagagagggtgcgcaggataaagctattcaccattgtttcaacatgaaggtttgtaataaaaatttgtttctatcagcattgctttgcattgctgttgcaggagttttgggtcaagctcctagtaatcctcctacgtctacgccggcgccacccacaccaccggcttctactcctcctccgacgactcaagcaccgcctacaccaaccgccactccgccactggtttctactcctcctcccacttaatcaccgcccccagtgacagcttctccacccccagtttcaactcctccacccagttctcctcctcctgcaactccaccacctgcttctcctcctcctgcaactccacctccagtttttccacctcctgccactcctccaccagcttttccacctcccgccactccaccacctgcaaccncaccggcagcaactccttctcctgctancccaccaccagc

SEQ ID NO: 9181 - DNA, 178 bp, Gossypium hirsutum
  Clone ID: uC-gsronu33B167d08b1
tttttattagggaactgtgtccttcattcaaacacaatgccaaaatatatgaacttattcatggcattaattttcgtttgtgtgttaaattgtcactttttttttcttataatttgttacaatttcatatacacagatgtagattaatgttaaaaataaattcaatggttcttgtttg

SEQ ID NO: 9182 - DNA, 586 bp, Gossypium hirsutum
  Clone ID: uC-gsronu33B167e04b1
ccaaaaaaaaaaaatggaataccgcaatgtttttcccatttttgttattttttcctttttcatcgttggcgtgatttgtacggagactttctcggcggagggatttgaagttgatccgttgatcgaacaagtaacggacggtcacgaaggagccgagccgcagctgctgacggcggagcatcacttctcgctgttcaagaagcggttcaagaagtcgtacggatcacaaaaggagcacgattataggttcaagatttttcaggttaacctgagacgagcggcgcgtcatcagaatcttgacccgtctgcgactcacggggtgactcagttctccgatttgactccaggcgagttcagaaaggcatatttgggattaaggagattgagattgcctaaagatgcaactgaggctccgattttgcctaccgataatttgcctcaagattttgactggagagaaaaaggagctgtgacacccgtcaaaaatcagggtcatgcggatcatgctggtcttttagtacaacaggagccttggaagagctactttttggcacctgtgaacttgtgagcctcagcgagcaacagc

SEQ ID NO: 9183 - DNA, 417 bp, Gossypium hirsutum
  Clone ID: uC-gsronu33B167e12b1
tgtcttatctggttggtaaaaaatcacaagatgctgctgttggcattcttgttcaaatgcttagaacagcaccgcctctccgacaagactcgagttgctattcgacacattcattaaggactgaatatgagggaggtgtcagtatcgcttctggattttttatgccgcgtaaaacggcagatgcgctcgaagagctcaacagctacagagaaatgaaggatctactactatcgaagagtggaactcgggttgttcgtcatgaggaaatgaagtagctctggtttgaagatgatcatatgactgtcaacttgtgttaaatacagcagcagctaattgattttagctttaaaatataaacacatcttcttttcaataaaagtataggctcacaggttttgtcataattatattatttac

SEQ ID NO: 9184 - DNA, 483 bp, Gossypium hirsutum
  Clone ID: uC-gsronu33B168h10b1
tttgttgtctccttgacaaccttcttctacctggggggtttatgtttcggatatgcggccttcgggaacaacacgccaggaaacctcttgacaggattcggattttacgagccatattggctggttgatttagccaatgcttgcattgttcttcaccttgtgggaggatatcagatttttggtcaaccagtgtttgcatttgcggagagatggtttatcaacaggttcccaaacagttggtttgtgaataactattatacgaacaaacaccgatggtttccttcgtttcagattaatcccctcaagatatgctttcggacagcctatgtcgcaacaacaacagccattgcaatgatgttcccatactttaaccaggttttgggagtgctgggggctttgaacttttggcctttggctatttatttttcagtggaaatgtgcattgtgcagaagaagattcaatcctggactagaaaatgggtt

SEQ ID NO: 9185 - DNA, 409 bp, Gossypium hirsutum
  Clone ID: uC-gsronu33B169a06b1
ctattatttttggaggacccccatgaaatacgtcgaatatgtattatgggaagaaactgtactttgaaaaggggaactgatgacgtggaatgttctctacccttagaaaagttgattgctgaagaagaggaggaagagatcgagatgcttttggagaactatcttcaaagatgtgaatcttgccatggtcaggctgaaaggcttcttgattctgcaaaagaaatggaagattctatttctgtcaacttgagctctcgaaggcttgaggtaagcaaagtggaactacttcttcaggttgggacattttgcgtggcagttggggctctagtagcaagtatattcggcatgaacttgaagtcctacctggaatatcatatgttcgccttttgggtaaccacagcggggatta

SEQ ID NO: 9186 - DNA, 524 bp, Gossypium hirsutum
  Clone ID: uC-gsronu33B170c08b1
tttattcgtccggaaaaaaacattgttattccagttgatgctcaagacatgttaaccgaaaccgaatcaatggctcaaaccggcattttagtatcgatagacggtgaagtaacgggagttctcgccatatccgatccagtgaaaccaggtgcacaagaagttatttccattctcaagtcaatgaatgtaagaagcatcatggtgactggtgataattggggaactgcaagttccattgctagtcaaattggcattgaaactgttgttgcagaagctaaacctgaacaaaaagcagagaaagtaaaagagctacaagcggaaggttatgctgtggcaatggtaggggatggcatcaatgattcgccggcacttgtagccgcccatgttggtatggcaatcggtgcaggaacagatattgcaatagaggcagctgatatagttctgatgaagagtaacttagaggatgtgatcacagccatacaccttttcaggaaaacattttcttcgtattcgccttaactata

SEQ ID NO: 9187 - DNA, 418 bp, Gossypium hirsutum
  Clone ID: uC-gsronu33B171g02b1
aaaggggaggaaaaaccaaaagaaaacaaagagaaataaaacaaaggaaacaacaagaagagagagaacgctgaaaacaaccaaggaagcacaaacaagaaagcaggaaaaaaagacacaaaaaaacaaaaacaacaaacaaaggcagaccaacaaagaagcaggggaaataacaaaaacaaaagagaaaacaataataaaagaacaaacaaaagaagaaaaagcaaaaggacacgaaaaaaaaagaacccagagcaacaaagaaagaaaaaacaaaaaactaaactaaaaagtggaaaacaaaaaaacacccaacaaaagaaaagaaaaaagaaaaaaagaaagaaaagacacaaaagaccaaaaaacaaataggggagaaggacaacaaaaaagaaaacaaaacactaggcaagac

SEQ ID NO: 9188 - DNA, 499 bp, Gossypium hirsutum
  unsure (1)..(499): unsure at all n locations
  Clone ID: uC-gsronu33B179c12b1
tttttcgcgtccgcccacgcgtccgcccacgcgtggggctcacttaaaggcaatggaagtggccaaagaatcaggtgctttgttgtcatatgatccaaaccttcggctgccactttggccttcagccgatgaggccaggaaacagatattatccatctgggataaggccgatattatcaaggtcagcgatgttgagctagagttcctcaccggtagcaacaaaatcgacgatgaaactgctatgaaactttggcgccccaacttgacactactcttgatcaccctcggtgaaaagggtagcatgtattataccaagtacttccatgngtcagtggatgcattccatgtgaatacagtggatacaactggcgccggggactcttttgttggtgctttactatgcaagatcgtggaagacccaaccatacttgagaatgaatcgaaattgagggaggtactgaaattcgcaaatgcatgtggagccataaccacaaccaag

SEQ ID NO: 9189 - DNA, 383 bp, Gossypium hirsutum
  Clone ID: uC-gsronu33b025b10b1
tctgttttttcatgtacccttggcataaaaatgcgagaaggaagggttagacactgcagaatccctagccataaggatagcttggaaagacccttttgccctgagtgatcttacaaatttcttgcctaccattttcccttcatcaattctttgttatattgttgattgatgctgtttcacgggggaattatcctatttttttgttcttttgttttgtttgatcaaagcaaaataggaaagcgtagcactattgcattggcaaattgctgtgcatgcatttctttgaactcaaatatagaactgcagaatttataataaagaatcagtttcgtattccaaaaaaaaaatggataactttagggttgcaatatagtgtttttaac

SEQ ID NO: 9190 - DNA, 409 bp, Gossypium hirsutum
  Clone ID: uC-gsronu33b025c06b1
tgctctctcgtccgcccacgcgtacggccattggtggtttaataggacttgtttgttcagggactgttttagcacaagaaaactcaattgggtgtttatgtaacttggtttctaatgattctaagttaaagcttttgattgttaaggaaaatgggattgattgtttgaagaatttcttggattcatctccaaatccaaaaagtcttgaagttgctattgaattcattaggcatttagcttcttttcctcctattgcagaagctttggttgctgatggtttcattgcccgtcttgtatctgctttgaactgtggggttttaaatgtaagaattgcagcagctaaagctgtttacgagctcgggtttttcgtgaaaacaaggaaagaaatgggtgaatgtggatgcattgc

SEQ ID NO: 9191 - DNA, 378 bp, Gossypium hirsutum
  Clone ID: uC-gsronu33b025e07b1
tctctcacgcgtccggccatatcaaaacatccgggactcagccacttttgccaccttcaacggaaaatgtttgacccctaaagaaaattcctaaactttcaaccattctgctttgctgcaaaaaatgaaagaaacaaatggggaaaaaaccaagcactaccctatatcagaaagtttgtgtgtgtatgatttttttttaatttcttttctttttctttttcctttttaatttagtcgtcaatggctgttctctgagtagcagagagggtttttgaaagatgatgatgatcactgtcacagctgtgtatgatggcttatggggggccctgaaatcttcatatgcttttttatatgttagtcttatggcttgttttaaag

SEQ ID NO: 9192 - DNA, 326 bp, Gossypium hirsutum
  Clone ID: uC-gsronu33b112c02b1
tcccacgcgtccgacaagttccctctattgttgggttgttgtccttgtttttctttttccatgtctgacaaacaagctcaccttaatggtgcctactacggcccttcaatcccaccacctacaagaacctaccaccgtcccggccgtggctccggctgtggctgtggctgctgtctcctcaaatgcctcttcaacatcatcatcaccgccatcgtcatcatcggcctagccgttttcatcttttggctcatcttccgtcccaacagggtcaagttccatgtaaccgacgtccaactcacccaatttaaccctcactttccacaaca

SEQ ID NO: 9193 - DNA, 603 bp, Gossypium hirsutum
  unsure (1)..(603): unsure at all n locations
  Clone ID: uC-gsronu33b112g12b1
tgtggttaggaaggtcttgaagacaagtgtggaatctctcgttgagcttaacatgctgaagaaccttactggatcagctatggctggagctctgggtggatttaacgctcacgccagtaacatcgttgctgcaatctacatagctaccggccaagatccggctcaaaacgtcgagagctcgcattgcatcacgatgatggaagctgttaatgatggcaaggacctccacgtctctgtcacaatgccttccatcgaggttgggactgttggtggtggaactcagcttgcatctcaatcagcctgtttgaacttacttggagtgaagggtgcaagcaaagagacaccaggagcaaactctaggacgctggcaaccattgtagcgtctgctgttcttgccggggagctgtcgcttatgtctgcaatttcagcaggacaactagttaggagccatatgaagtacaataggtcaagtaaggatgtctccaaggcaacgtaatgataacctgatatttgggataaaagtgggngatctcccatgttagaaacatactaaggagacatatccctntgtaatcaagtaaagcactaaagaattttctttat

SEQ ID NO: 9194 - DNA, 452 bp, Gossypium hirsutum
  unsure (1)..(452): unsure at all n locations
  Clone ID: uC-gsronu33b112h07b1
tgaaagatcaaatctcccccctccccttgtgtttcgtggtgatcaacagtttagggtttttgttctctttctgaacaacaaaaatggtggggactactgagggagtggattcatctgcctccaacaacaagaagaaccgtatccaagtctccaatacccagaaaccccttttcttctacgttaacctcgccaagaggtatatgcagcaatacaacgaggtggaactctctgctcttggaatggctattgctactgttgttaccattgctgagatattgaagaacaacgggctggctgtcgagaaaaaaatcatgacttctaccattgacatgagagaggaatcaggtggacgaccagtacaaaaagcaaaaattgaaatactgggggngaaggnnnagaagtttgatgagttgatggcagctgctgcagaggaagccttagatgatggaggt

SEQ ID NO: 9195 - DNA, 409 bp, Gossypium hirsutum
  Clone ID: uC-gsronu33b112h08b1
ggttaataacactgatgcagaaggtaggcttacactagcagatgctttggtttatgcttgcaaccaaggtgttgagaagataaagccgaaaactagacatcgtaaatttgtgattagagttgtaaacttggtagtttcaattgcttattttgtatagataatcagatttccatttttcaagtctggttgacttattttgcagatagttgacctggcaacactaaccggggcttgtgttgttgctcttggcccctcaatggcaggtatatacttaacatatgaatttttaaacatagttggcacttcaatataacaattttttttcttttcattgaaagtggtttccttattatgggttggttcgaaaggcaagcatccatcggtcattggggtggtactaaattattga

SEQ ID NO: 9196 - DNA, 69 bp, Gossypium hirsutum
  Clone ID: uC-gsflmaxxa002a03b1
ctttgattttcggaccacacaccttctcaacctaactacgggtactatatagaacgatgaaggccttaa

SEQ ID NO: 9197 - DNA, 113 bp, Gossypium hirsutum
  Clone ID: uC-gsflmaxxa002a05b1
cagtaaatgaaagagttttttttggggaccaaaacgaagaactttttacattaaaggaggcgtttaaaaaaaaaaaaatggaatctatccattcacataattatttttttttt

SEQ ID NO: 9198 - DNA, 178 bp, Gossypium hirsutum
  Clone ID: uC-gsflmaxxa002a08b1
tcgccctcgcgtccgcccaattcgtagaaaactcagtgagtcaatttacaaatcgctgagccaccgccattcttaactcttggtattcgtcctctcgatcacagctttaaattctcaattcaattttccctgattatatccctattacccttaaacttaatgatgcttcaattttttt

SEQ ID NO: 9199 - DNA, 97 bp, Gossypium hirsutum
  Clone ID: uC-gsflmaxxa002b02b1
tttgaactttcttcctattcaaagcgattctaaaaagaagcttggcgattctgaatccaagccatctgatccttatccgccgtcgtcctcaccgatt

SEQ ID NO: 9200 - DNA, 148 bp, Gossypium hirsutum
  Clone ID: uC-gsflmaxxa002b05b1
ccgtgaatcactttctcgagaaaaaaaccaatgcaaacagcggaggacatccgtaatctcccaatcgacatcacattttctcgtcttggagaatggttagtagattgcatgagaatacccgtctgattggagaaagagattgttggtt

SEQ ID NO: 9201 - DNA, 111 bp, Gossypium hirsutum
  Clone ID: uC-gsflmaxxa002b06b1
cccacgctaccgctttcagacaaacaagtccacgagccggttatttactctctctctttctagatataaaaatatttagctttctttttcctttacatctatagatccgtc

SEQ ID NO: 9202 - DNA, 210 bp, Gossypium hirsutum
  Clone ID: uC-gsflmaxxa002b07b1
gttgatccgaatctaaaagctcctcaagcactttgcatttgttctactagagaactggctattcagaatttggaagtgcttaggaagatggtgtagcatactgttttatcatcagtatgtgcttttctacttcttaagtttcaattttttttcatcctaattttactttcttcttatttttttttatgtttttactttttttctttttct

SEQ ID NO: 9203 - DNA, 430 bp, Gossypium hirsutum
  Clone ID: uC-gsflmaxxa002b11b1
gcaatgccgaggcaagagatcttcaaacttatcagatggtggccagtcttttaactttagcatctctggccataagttattatacgctctcccttctgtgtagcctttgaaaaattgttgagtattgatctccacctcacagccagctagacaatcaatagccttaacttcaggcatctccaacttttcacataaagcacgccacattaccatcggttcccagcttaaaccggatgaatttgcaagagtattcttaactataaccggttcacctttagcccatcgggtttgaaagtgacgaaagccttcgtcaagattatcatttgaagttgaagaatataagccattgtcaatatgtccttcttcagaagtattatccccatttaatgtcttttgaagccattgtttaattctgcagctgcttaatatt

SEQ ID NO: 9204 - DNA, 475 bp, Gossypium hirsutum
  Clone ID: uC-gsflmaxxa002d02b1
cccacgcttccggccgtattgtgttccaccgacttaacgggaagcacgattctaggctcgaaggccttatcaagatggcagatctcacgataaatcttgcggcgatctgtactccagcagactatgatactcgtccacttgacacgatttacagcaattttattgatgcacttccggtggtaaagtactgctcagagaacaacaagcgtcttattcacttctctacttgcgaagtgtatggcaaaacaattggaagctttcttcctaaagattctcctctccggaaggatcctgcctactatgtccttaaggaagatacctccccctgcatttttggttcaatcgaaaagcaaaggtggtcatatgcatgtgctaagcaattgattgagaggcttatttatgctgagggggcagagaatggccttgatttcaccattgtgagaccttttaactggattggacctaggatggattt

SEQ ID NO: 9205 - DNA, 101 bp, Gossypium hirsutum
  Clone ID: uC-gsflmaxxa002d03b1
aggacatgttatttgtccttcaaatcttatcattcatcagaagctttggttctggcaaaacatatgatgaatgataagatttgaaggacatgttatttgtc

SEQ ID NO: 9206 - DNA, 513 bp, Gossypium hirsutum
  Clone ID: uC-gsflmaxxa002d05b1
caccaattggttttgaaaatgaggaaactggcgagacagtgtcgaaattcggaagatgataagttctctctccccaccgtcgacgatgctcgtcccatggatatcaacgaacaagaggagttggttcgttctcttgaaaagatgcaagctcaccaaagtctacaatggaagagcgtgtttgcagcacttctcttttgttactcggcgtttcttctatactcaatctatcagcagaccttatttccatgggaactgcggtaccatgcttacttcatggaagatgttgattcatggataataataactgcagattggctagctgttttggcatgctcaatggccattatgggtctattcaataattcaaaggatcacataaagtggatatggtactcatgctcaattggccttgtgcttgcaattttctgggtatactatatgctgagaatgccaaaatttcgttgggatgttatctggcttcctcttgggcccttatgtggagctggggtatgt

SEQ ID NO: 9207 - DNA, 510 bp, Gossypium hirsutum
  Clone ID: uC-gsflmaxxa002d06b1
caaacagcaaacgggaaaaaaatggcgggctggttcggatcgcaatcatatacggttgccaccatgactgtcaccagtacaccgtctccagatctcgcttttactaatcttgcttactgctcaccgtccgatcttcagagcttcgccgtccctggctccagactcttccttgttaatgttggcgatgcctttgttctttccatctctcctcatgaaagcattcgcagtaaatatattgcccttaatgctattcatcgtcggcttgcgaaggtttctaatggtgacactgtatcagtgagcagatttgttccacctgaaaatttcaaccttgcactgcttagggttgagttggaatttgtgacagaagggtactaaaaatgaacaggttgatgctgttcatctggctaaccagcttaaaagaggtttgtgaatcaggttatgacagctgggcaaaagttacatttgagtatcatggtaataactatattttcacaatcaaccaagctcaac

SEQ ID NO: 9208 - DNA, 486 bp, Gossypium hirsutum
  unsure (1)..(486): unsure at all n locations
  Clone ID: uC-gsflmaxxa002d07b1
catcgactataaatccctctgttgctccaccctcaaaatcttcgtctctttattttctttcgccgcctttctctcccagtttgattctttgttcggggcaatttaaagacgagtcaagatggtgaagtttacagctgaggagctccgtgccattatggaccggaaacacaacatccgtaacatgtctgttattgcccatgtggatcacgggaaatcaactcttaccgattctcttgtggctgctgctggtatcattgcacaagaagttgctggtgatgttcgtatgacagatacccgtgcagatgaggctgagcgtggtattacaatcaagtctactggaatctctttgtactatgaaatgagtgaggattctttgaagagctacaagggcgagaggcatgggaatgagtacctcatcaatcttattgattcccctgggcacgttgactnttcatctgaggtcacagctgctcttcgaatactgat

SEQ ID NO: 9209 - DNA, 501 bp, Gossypium hirsutum
  Clone ID: uC-gsflmaxxa002d08b1
cccacgcgtccggtgggatatgtacaggttttggggccactgtgaatgttgctaaacccaaaaagggtcaaactgttgcagtttttggactgggtgccgttggtcttgccgccgctgaaggtgcaagggtttgtggggcttctcggatcatcgctgttgatgtgaaccccagaagatttgaagaagctaagaggtttgggattacagaatttgtgaatccaaaagactacgataagccagttcaagaggtgattgtggagatgaccggcggaggagtggatcgcagtgtggagtgtacagggagcgtccaagccatgatttccgcttttgaatgcgtccatgatggtgggggtgttttgtgtgctggtggggtgtgccaaagaaagacgatgcattcaaaactcatccaatgaatctactaagtgagaggacccttaagggtgctttttatggcaactataaaccacgcactgatattccatggttgtcgacaaatatttg

SEQ ID NO: 9210 - DNA, 498 bp, Gossypium hirsutum
  unsure (1)..(498): unsure at all n locations
  Clone ID: uC-gsflmaxxa002d10b1
gggaattcagctaacagctcgtaacaacaacactgttcggcaatttaatctcccaatggggttgggaaatgctgaggattccacagcagattcatctactagcagtagtaggagagaaagggatggcggagttgttccagtttggtctcctccagcttctagttattcagagcagttcataggtgatgaaaacgatattggtacgagctcatcttatttaccaaggcatccacagtcccaccaaatagtaaactggaggcgtttatctcaaactggataaacacttacgaacaccggaatcttgtagtcagagaatgccagaatggccaatcttgtgggctgatggggtataacatggcttcaatctaccacactcgttatccccaatctaacttgatcagcagttgccctcctatgtgtacgaaacttaagattgatccggctgctgatcttttgactatctttttcccatgctgtnaccatatacatagtcctgct

SEQ ID NO: 9211 - DNA, 508 bp, Gossypium hirsutum
  Clone ID: uC-gsflmaxxa002d11b1
gtttcaatggcttcaagcgcttcaagatttatcaaatgtgtaacagttggagatggagctgttggcaagacttgcatgcttatttgctatacaagtaacaagttcccgaccgattacataccaacagtttttgataacttcagtgccaacgttgtagttgaaggcacaactgtgaacttaggtctttgggacacggctggacaagaggattacaacagactaaggccattgagctacagaggtgcagatgtctttgtcttagctttctcattagttagtcgagcaagccatgagaacgtactaaaaaagtggattcctgaacttcagcattatgccccaggcgtccctgtggttctggttggcaccaaattggatcttcgtgaggataaacattatctggctgatcatcctggcttgctgccggttagcaccgcacagggcgaggagctccgcaacagataggtgctgcttatacattgagtgcagctcaaaaactcagcagaacgtg

SEQ ID NO: 9212 - DNA, 370 bp, Gossypium hirsutum
  Clone ID: uC-gsflmaxxa002e01b1
gtctatttttactttgatcaatccttaatttccgagggggtattgaaaccctaatactaaaaagataccccaactcaaggcttaccaagggccactgaggaacctactgacgtattgaaatctgtatatgaaaaggaaaaccgactataaaagagaggctacagtcaattctaaatgatgaatacataaatagagcttatgtgtctgaaggcaaccaggctgcagctactaggaagccaccagctgctcctggtcatgcatcttactaagagaacggcaaagatgccaacgatactgagaaggagaagactggatcaagacagtatgctatcactaaattcattggagagaaacagaagaatcttactgg

SEQ ID NO: 9213 - DNA, 508 bp, Gossypium hirsutum
  unsure (1)..(508): unsure at all n locations
  Clone ID: uC-gsflmaxxa002e02b1
cccacgcgtccgagatgaccggcggaggagtggatcgcagtgtggagtgtacagggagcgtccaagccatgatttccgcttttgaatgcgtccatgatggttggggtgtttgtgtgctggtgggtgtgccaaagaaagacgatgcattcaaaactcatccaatgaatctactaagtgagaggacccttaagggtgctttttatggcaactataaaccacgcactgatattcccatggttgtcgacaaatatttgaacaaggagctggggctggatatggacaagttcatcacacactctgtgccttttgccgatattaacaaggcattcgactacatgctccagggtataggtctgagatgcatgattcatttggatgcttaaggaaatgttgctgctgtatatttgcccatccaggatcaaaactttaatgttttgtcctactatgtgttatattatgtgcctacttaagctacctttnccggttatcaagagtgcctatatagaac

SEQ ID NO: 9214 - DNA, 407 bp, Gossypium hirsutum
  Clone ID: uC-gsflmaxxa002e03b1
tgcatacagaatctgatgccactcaccaaactaaaaggaaggtgaatgaaaatagtgatgaaattttgcacaattcttctcaatgtggcctcgaaagcggtcctgaaaaatcgactaacaatgacatggatgcgaggccctcaagaaaacctatcaactctgcagctagtaaaaagaagatccgaaattcagataatggtactcggtctatccatgcgaagcagagccttgtaggcaaagaacttcctacttttcctggagaagtgaaggtcgaaagacttgaaactgagtatgaacatacaacaatggatggcgatggcgatgtctttggcttgtggcacacaacgggtaaaaggttcgtgactcaattcgagaaaacgaatggcctcttaaaggcacaagaagca

SEQ ID NO: 9215 - DNA, 515 bp, Gossypium hirsutum
  Clone ID: uC-gsflmaxxa002e04b1
cccacgcttccgctcttacactcacacacatgacagaaagaaaaccctaacttttcaagtttcaaactcctaattgaaaatttcaaatctctcaaaaccttcaaaatcttcaaaatctcccaaaaccttcaaaagtatcatagctggaggctagagctacagctggccgctgcccgctggtgttgccgtcgaagcacgggagcagaatgtccaccgaaccaacatctattgagggtagtggtacacatcctacttcgatagattctgaacattcgggagttggagcttcaagccaagcaaaggtgactactaggaaaagaaaagccattccttaaaggtcagaaatttggtctcacttcactaagattattaatagtgagggtgcaagtaaggctaaatgtaattattgtcaaaaggaattttgttgtgatgtgaaaaaaaatggtacatggtcattgaaatatcatattggttcatgtaagaaaaatcctagcaatgttgtggacactagtaaa

SEQ ID NO: 9216 - DNA, 513 bp, Gossypium hirsutum
  unsure (1)..(513): unsure at all n locations
  Clone ID: uC-gsflmaxxa002e05b1
cttcctctcactctcttcttcgctttctcttaaataatacgaaagctaaaagaaaaagctctaaatttcaatggcgaccgaagaaattagtcgaactcaaggcctcaatccttctcaacaatcttcttcacttccagactaccctcagatgattctggaagccatagaggcattgaatgagagagagggctccagtatgtcatccatcgccaagcacatcgactccactcactccgatctcccagcgtctcacaccactctcctctcccaccacctcaaccagatgaaacaaatgggtcaaattgttatgttgaacaacaattactcgaaacccgaccccaatgccccacctaagcgtgngacgtgggacgtccacctaaacccaaggttcctcttccactggcgtcgtcgtctctcctccaacctcgtggtcgtccgcctaagccgaggacttattggctccccccaagcccaaacccgtcagcacctgaagggcgcgtgggcgccccacta

SEQ ID NO: 9217 - DNA, 508 bp, Gossypium hirsutum
  Clone ID: uC-gsflmaxxa002e07b1
ttcatgcctaaatggttcctggttggtggtctttggaggatgtggaagacaaggattgctcaatgacgtctttgtccttgacttggatgccaaacaacctacatggaaagaagtttctggtggtgctccccctctccctagatcttggcatagctcttgcacaatagacggttctaagttggttgtgtctggtgggtgcacggatgcgggggtgcttctcagtgacacgtatctgttggatcttactacagacaagccaacatggaaagagattccgacatcatgggcacccccatcaaggttgggccattcgctttcagtttatgggcgtactaaaattcttatgtttggggggcttgcaaagagcgggaacttgcgattgcgatcaggtgaagcctacaccattgatttggaggacgaagaaccacagtggcggcaactggactgtagtgccttcaccagtttggtagccaaaatgctgtggtaccttcttctagactggatcatg

SEQ ID NO: 9218 - DNA, 393 bp, Gossypium hirsutum
  Clone ID: uC-gsflmaxxa002e08b1
gtatcttttggcagccaggatggccgaaagagaattgtggatccgacggtgttgaccacttgctcacaggagtcgttatccatcgtagtatcaattactggcaaatgcatatgtcccgaaccatcatctcggccatcgcttgaggacgttctttggaacttacagtatgcagctcaagttcaggctgcagccgatgccgatcagaaatccgattctacatcgtagtcaattgtatatggttggtacacaccggatgttttgttttcggagaaacctgctgatactgctcggataaagctcttggaatgtgctttcctatataaaatgagttagagctagagatgtaaagctgaaaatgtcatattttagaccttataaatggaaaattttggt

SEQ ID NO: 9219 - DNA, 511 bp, Gossypium hirsutum
  Clone ID: uC-gsflmaxxa002e09b1
tcgaaaaaaaatgaagtctcagatctgtttagcctttggaactctggccttgttgttagcttcagctttggccgatgacgtcgtcgtactgaccgaagcgaacttcgataaggaagttggtcaagatagaggagctctcatcgagttctatgctccttggtgtggacactgtaagaagctagctcctgagtacgagaagctcggggcaagttttaagaaggctaaatccgtcttgattggaaaggtggattgtgatgaacataagagtttatgcagcaaatatggtgttcaaggctacccaactgttcaatggtttcctaaaggctctttggaacctaaaaagtatgaaggaccacgcacggctgaggcacttgctgaatttgttaacactgaagaagggactaatgtgaagatagccactttgccatccaatgttgcagtgctaaatgcggataattttgatgagattgtccttgatgaaaccacagatgtgttggttgagttttatgca

SEQ ID NO: 9220 - DNA, 476 bp, Gossypium hirsutum
  Clone ID: uC-gsflmaxxa002e10b1
gtcaaccctaggtctgcgtcttccttggagacgcgtcattcagattctggcaatagcatactagaagatacagaaatttccaaaaccccaactacttaaagcgatactactcttgagtcgggtgctgattagagatgagtggagcagaaaaggttgtgtgcgtaactggagcgtctggttacgtagcttcgtggctcgttaagctcttattacaacgcggctacactgttaaagccactgttcgtgacccaaatgatccaaaaaagacacagcacctgcttgcccttgatggggctaaggaaaggcttcatttgttgaaagcgcagttgttggaggaaggatgctttgactctatagtggatggatgccacggtgttttccatacagcctcccctgtcatcttttcagctgccgacccacaggcagagataattgatccagcaataagggtacgcttaatggtctttaatcatgtg

SEQ ID NO: 9221 - DNA, 467 bp, Gossypium hirsutum
  Clone ID: uC-gsflmaxxa002e11b1
aaagaaccttatcagtgccagaagcagcaatagtggacataggacatgagtctttcctatgaccaaacttaccacactaaaaacaaatcaattgtagcccatcatatttaacacgttgacaaaccttgccgagactaacagatgaacacgatagtttggttaaatccaaatcaatacaaacccttgcaaatcctcctgtatgaacatcttccgtattccaatcaatgcaaattaccctccccacacaagaaacaatcctccaaactgccataactgcgtaatattccagaggtaattttgaaaaatgaacccaagcaataagaaactcaaatcttatcacaacttggctgaaaattcagaaaccattaacaaacagtaaggtagtgtccactaatgatctaatgacctcattccaagacatgattataatatgatttctggtcaacttgataagaaatagtcattat

SEQ ID NO: 9222 - DNA, 515 bp, Gossypium hirsutum
  Clone ID: uC-gsflmaxxa002f01b1
cccacgcttccgtgggaaattaaaaaaaaaaagaaagcggggaaatgtttaatctatggaatcttctcttcctctcctttgttcatttctcatcattcagtgttactttgggtggggtgtcgggaaacccatttactccaaaatcctccttcattcgttattggaacaaagaggtccacagggaaatacccaacacccattttttactctctaaagtttcaccattaactgccgtcgactccgccagtttctcgaaactcgccgcccacaacaacctcgcttctcgtcttccttccttttgttcctccgctaaactcttttgcttccccgacttatcgcccagtctcgagaaacattccaaagacgttaacttcgccttctacctcgacaggaacttcactaattacggctccgatcgactcgctggactcgactcctttaagaactactctgaaaacgacaacgctgtccgtgattcttttcgtcgctacagccgggacttcgcgggtcacaag

SEQ ID NO: 9223 - DNA, 356 bp, Gossypium hirsutum
  Clone ID: uC-gsflmaxxa002f02b1
ctcgttgttaagcgtatctcgcttgatattttagagggcgaactggcgaaacataagtcttacgccgaatatctgcttcaacagctatttcgtgcgaagaatatacatttaagggagggggaaacttttaagggagtagtagaaaatcatttggtttttgaagagcccttaaaagagcaaattgatgggctctatcaaatctgttgtgatctcattctaaatggggccaacagtagctactttctaaaaattgtggaattttatggatccacgcttggtatgtagccaagcccaagaaaaaaggaacgaggggaagaatcgacaaggaatccataacaaaaaaaaaattgtgaatg

SEQ ID NO: 9224 - DNA, 513 bp, Gossypium hirsutum
  unsure (1)..(513): unsure at all n locations
  Clone ID: uC-gsflmaxxa002f04b1
gtttgtgtgggggattccctctgccattttctggagatggtgatatcataggggaggtgatgaattgatctctgcttagaaacgaaggatcaatagagatgggttcttgtgtgtctagacctgaaggctgtattggccaaaggtcgaggtcttctaagaagaaaagtcgtaaaagaaggaaaacctttaagaaaagggcgccttctcgtctttccgagggttcctctgataatgtcgatcgtcgctcttccttcaccaacccaacttttcaaggttcttgttttttttatatttggcatttgctatttggaacatgggagctaaaggagtgctctagaacatccctcctggacccaattttgatgggatcatgataggattatgaccctgttttttatatattgggacaataattatcactgttattattattttacttgttcaccatgtcatgtttaaatatgggcaacattactgaatngcagctgaaacagttttattcagttacaggct

SEQ ID NO: 9225 - DNA, 513 bp, Gossypium hirsutum
  Clone ID: uC-gsflmaxxa002f06b1
atcaaggattacccttttgccaatgatggactggttctgtgggatattctcaaagaatgggtctctgattatgtgaaccattactatccagaggcaagcctagtggagtcagacgaagagcttcaagcatggtggactgaaatccgtacggttgggcatggtgacaagaaagatgaaccctggtggcctgtcctcaaaacaccacaagacttgatccaaattgttacaaccatcgcttgggtaacctcaggtcatcatgcatctgtcaactttggacaatatacctatgctggttactttcccagcaggccaacgattgctagaaagaatatgccaaccgaagaggcaactgaaagagattgggagtttttcatgaataaacctgaagttttacttctactgtgcttcccttcacaaattcaagctaccacggtgatggctattttggatgtgttatcgaaccattctccggacgaggaatacttgggagaaaaatcggagttggcatgggcc

SEQ ID NO: 9226 - DNA, 512 bp, Gossypium hirsutum
  Clone ID: uC-gsflmaxxa002f07b1
cggacgcgtgggcggacgcgtgggaaatttcttgcgtagttttatctgatctgtgtcttcgaagcctcacgtgaaaaatggggctgtctttcacaaagctatttagccggcttttcgccaagaaggagatgcgtatactcatggttgggcttgatgctgcgggtaaaactaccattctttacaagcttaagttgggagagattgtcactaccattcccaccatcggtttcaatgttgagaccgttgaatacaagaacatcagctttactgtttgggatgttggtggccaggacaagatccgaccattgtggagacactacttccaaaacacccaaggacttatttttgtggttgatagcaacgatcgtgatcgtgtggttgaagctagagatgagttgcacaggatgttgaatgaggatgagctgagggatgctgtgctgctagtattcgcaaacaagcaagatctatcaatgctatgaatgctgctgagattactgaccagcttggccttc

SEQ ID NO: 9227 - DNA, 262 bp, Gossypium hirsutum
  Clone ID: uC-gsflmaxxa002f08b1
gtttaaaacataagaaaaaagattatacgcaatgagcactgctggacaggttattggatgcaaacctgcggtggcatgggaggcagcgaagccactatcgatagaagaagtggaagtggcaccaccccagaagcatgaagtgcgagttaagaatctgttcactgctccatggcacactgatgtatactactgggagtgcaaggggtacactactatgtttgctcgtatactgggtcatgaagcctcagggatcgtggagagt

SEQ ID NO: 9228 - DNA, 424 bp, Gossypium hirsutum
  Clone ID: uC-gsflmaxxa002f10b1
gcataagcaaatcctaaggaatagaagaaaaatgggaagatacgacagagcgattaccgtgttctcgccggacggccatttattccaggtggaatacgccctcgaagccgttcgtaaaggtaacgccgccgttggcgtacggggcaccgacatcgtcgttctaggcgtcgagaaaaaatccgccgccaaactccaggactcacgatcggttaagaagattgtgaatttggatgatcatattgcattggcatgtgctggactcaaagccgatgctcgtgtcctcatcaacagggcttcggatcgaatgtcaaagccataggctgactgttgaagatccggttaccgttgaggatattactcgttacattgcgggtcttcagcagaagtttacttaaagtggaggtggtagaccatctgggctctt

SEQ ID NO: 9229 - DNA, 492 bp, Gossypium hirsutum
  Clone ID: uC-gsflmaxxa002g01b1
acgtgtcttcaaacatgtatagactcattcgcggaatcgggtaacgtatcatcgcagaagaggcaatcaatcttgaagactagcatggagattactagcaatgctttagccatgcttaatgggttatccaccatcgtgaaggaacttaacattccaaacgtcggcaacatcgacaccacgggggtcaatcgtaagcttttgtcggctgaggatatgcctgagtggattagtcaagctgaccgaaaactccttcaagcaaaaccaatggatttgaaacctaacgttgtggttgctaaagatggtagcgggaaatatgatactattaacaaggcattggctgaagtccccgtgaaaagtcccgatcgatttgttattcacattaaagctggtacttacaaggagcaaatcaacgtgaccaagcagatgactaaatgtgtattcattggtgatggcccaaccaagaccattattacaaatgacattagtgtcgct

SEQ ID NO: 9230 - DNA, 500 bp, Gossypium hirsutum
  Clone ID: uC-gsflmaxxa002g02b1
cccacgcgtccgagcagaccgaaacagaacttaggtctgtttttcttgagggttgagacatgcttgtgttgttcgagactccggcaggctttgcccttttcaaagtcttagatgaagggaagctgaataaagttgaggacttgtcaaaggaattcttggctcctgactctgccagaaaggttgtgtcgttgaaagccttttccaagtttgaaaacactgcagaagctttggaagctgcaaccaaactacttgaaagtgcacccagtaaaggtctgcgcaagtttttgcgtgcgcattgtgatggtgaaacacttggagtggctgattcaaagcttggaaatgcaattaaggaaaaactgaaaattgatctgtgttcacaataatgcctgtatggagttgctgagaggtgtgagaactcagttgacagaactcatatctggtctaggtgctcaagatttagctccgatgagtttgggtctttcacatagcctttctagata

SEQ ID NO: 9231 - DNA, 481 bp, Gossypium hirsutum
  unsure (1)..(481): unsure at all n locations
  Clone ID: uC-gsflmaxxa002g04b1
cctccattcattatttacgttaagttcaaagaaatggctaatcctgtgatcactcgcgtccacagtctccgtgagcgtttagatgagacccttcttgcccacaggaacgagattttggccttgctctcaaggatcgagggcaaaggaaaaggaattctgcaacaccatcaaattattctagagtttgaagctatccctgaagagaacagaaagaagctcgctgatggtgcattttttgaagtattgaaggctagtcaggaagcgatcgtgttgcctccatgggttgcacttgctgttcgtccaaggcctggtgttggggagtacattagagntgaatgttcacgccctctgttgttgaggaacttactgttgctgagtatctccacttaaggaagagcttgttgtggaagttcaaatggaactttgttttggaattggattttgagcccttcaactcatcattcccccgcccaactctttc

SEQ ID NO: 9232 - DNA, 508 bp, Gossypium hirsutum
  Clone ID: uC-gsflmaxxa002g05b1
attttaaacaaaaatggaagttcatgacaatctttttttagttttttcacaaggatgcaacatgggaatggtgatgctagcttgcatgtttatttcatggatctttgtttacagatggaaccagaggaacaaaaaaggccccaaaacatggccaatcatcggagcagcgttcgaacaattaattaactatgatcgaatgcacgattggctcgtcgaatacctgtccgcatctaaaacggttgtagttccaatgccttgcacaacttatacttacattgctgatcctgctaatgttgaacatgtacttaagaccaattttgccaattaccccaagggtgaaacgtaccattcatatttggaagtgctgcttggagatgggattttcaacgtagatggtgagctatggaagaagcaaaggaaaacagctagttttgagtttgcatcaaagaatttgagggatttcagcactgtagtattcagggaatatagtctacaactccattctatt

SEQ ID NO: 9233 - DNA, 513 bp, Gossypium hirsutum
  Clone ID: uC-gsflmaxxa002g06b1
cacaaagatggcaggcgcagcaaattgggtttccataaccttactgttttcagtatgtttatcggcgtcctatggtaagaggaccggaatctccaccatggctgacggagccgatgggtttcaaccaagcaacggttttccgcatgaagctgatcctgattcttcaacctctatcgatcctgatcctaccggattcggtgctgggataggtataggttatgaaagaagcccttactgtatcgactgcgacgatgtggatatcatgggcggcagcttttgcggcgcctgcaattacggatgcccttaccgcaggttcaataatgggtgtggtggctggtattgcttatatggatgaactcaaacgaacgattaaggactttaccatgaaacttgatgccaatggtcttttagggaaaaagaaggccatgaatatacaagctatggcgccagaatcttcatagaaatcttcatagatttatatatagattatagaaactacggattctatacaaa

SEQ ID NO: 9234 - DNA, 446 bp, Gossypium hirsutum
  Clone ID: uC-gsflmaxxa002g07b1
ctcataaaacctccccactactgatttgtctatataatctaatgttctcccgttgttttagccgtctttaacacttttcaatggcttcctcttctgttattgcttggggctcaggtgaagatggtcaattgggtatcggaaacaatgaagaaagagaatgggtttgcgttgttcaagctcttgagcctcacaatgttcgctccgtcgtcgctggcagccgtaattctctcgctatttgtgatgatggcaagttgtttacttggggatggaaccagagaggaaccctagggcaccctcccgagaccaaaactgagaatattccaagtcaggttaaggctcttgctaatgttaaaattgttcaggcggctattgctgggtggcattgcttggctgttgatgatgaaagcagagcttatgcctggggtgggaaccaatatgggcagtgt

SEQ ID NO: 9235 - DNA, 490 bp, Gossypium hirsutum
  Clone ID: uC-gsflmaxxa002g08b1
ctcactgctcactctctttaactttcgttcatctgcattattgtttcagatcgtaaaatcaaaaccaaattttcgtttaatttatacatataaacacccaaaaacaaaaagggcataaaaaaaggagattcaatggggatcttctccttcaatgccatagctttggccttcttattagccattatctctggcgccgtcaatgcttgcccttcttccgaccgagaagcattgctagctttaagttcatcgttaaaggagccttatttaggcatcttcgattcatggaaaggcaccgattgttgttccaactggtacggtattagctgtgaccccaccactcatcgagtcaccgacgtttccctacgcggtgagtccgaagaccccattcttcaaaaaaccggccactcatcttccggttacatgaccggtaccattaacccttctatttgtcagctcgaccgggtcactactttaatcattgctgattgga

SEQ ID NO: 9236 - DNA, 512 bp, Gossypium hirsutum
  Clone ID: uC-gsflmaxxa002g10b1
cccacgcgtccgagagagagtccctcttttctctctcttttcccttctttttgatcccaagaaacactttccatacacaaggaaactggtgttttcttctttcagagagagagagagagaaaagagttgccaccatgtctcttggctatgcagagaagctctcattcatagaagatgtgggtcaagttggaatgactgagttctttgactctgctcatgttttacaagataaaattgaacaacttgcaaaattgatagaaaagagtagacatctagctggtgtttacaggtgcaggaatatcaacttcttgtggcatacctgattttcgaggccccaaaggaatatggacattgcagcgtgaaggtcagcccttgcctgaagcatccctaccttatcaccgtgcaatgccaagcatgacccatatggctctggttggattgcagaaggctgccactttgaagttttgtattagtcagaatggtgatggtctccatcttcgatctggaatacc

SEQ ID NO: 9237 - DNA, 511 bp, Gossypium hirsutum
  unsure (1)..(511): unsure at all n locations
  Clone ID: uC-gsflmaxxa002g11b1
ccataaagtaaaaagaacagagctttgatatcctaagctaatgtcggacgaggagcaccatttcgagtccaaggccgacgccggcgcctccaaaacctatcctcagcaggccggtactatccgtaaaaacggctacatcgtcatcaaaggccgtccttgcaaggttgtcgaagtttccacttccaagactgggaagcacggacatgctaagtgtcactttgttgggatcgacatcttcactgctaagaagctggaagatatcgttccttcttcccacaattgtgatgtgccacacgtcaaccgtactgattaccaattgatcgacatttccgaggatggatttgtgagcttgctgaccgacagcggagacactaaggatgatctaaggctcccaactgatgaaaacttgttgaaacagatcaaggagggtttcgctgacgggaaagacctcgtggtgtctgttatgtcggcaatggnggaggaacagatttgtgcactcacggacattggt

SEQ ID NO: 9238 - DNA, 274 bp, Gossypium hirsutum
  Clone ID: uC-gsflmaxxa002g12b1
aagacgccagaaatcatgcccagtatcaacagcttcttcactgacccaaagtgaggcttcactcttgctttatgctgaaactaaaataaaaaaatagaagaactaagtcttattcaatcaataccaagttttgccctttctttctgctgactgtgatgcaaatttgtgttggttttgcacttggatgaggtgtgttttttaagagaataaaaggtgttgtggatttttcgaagaagtgttgttttagcttaaatgaatgacccttatttgcaat

SEQ ID NO: 9239 - DNA, 515 bp, Gossypium hirsutum
  Clone ID: uC-gsflmaxxa002h02b1
cccacgcgtccgcccacgcgtccgctccaacgcctcactgcaaacaaagcaatcatggcaagcaaagaaccggatcaggagcacagagaagacgaggatgccgcccccgccgaggaagaagacaccggagctcaaatcgcccctatcatcaagctcgaggaagtcgccgtcagcaccggcgaggaaaacgaagatccgatactcgatctgaagtcgaagctctaccgatttgataaagaaggcaatcaatggaaagagagaggcgctggtactgtgaagctgttgaagcacaaagagactggaaaagttcgccttgttatgaggcaatctaagactctcaagatctgcgccaatcatttagtgttgccgactatgacggtgcaggagcacgcagggaacgacaaatcgtgcctgtggcacgcttctgactacgctgatggtgaattgaaagatgagtctgtctgcattcgtatgcatctgtgaaaaattgcaaaaccttcatgcaaaagttccag

SEQ ID NO: 9240 - DNA, 416 bp, Gossypium hirsutum
  Clone ID: uC-gsflmaxxa002h03b1
cgcccctatataaaatctcactcatataatttaaattcgaagaatctgttacaccaaagactagttactcgaattcgttaattttaagtcgaagaaaaatgggaggtggtagggaaggcgaatcaagtgacaaagggctgttttctcatcttgctggctatgccgccggacattatcctccgcctggatcctaccctccacaaggatatcctcctcaaggatatcccccacaaggatacccaccggctggatatcctccaccagcgggatatcctccacatggcggatacccacctgcagggtatcctcctcatggaggataccctcatccacctcatggtggatatccaccagctggttattctggacacggttcgcatggacctgggatgggaggattattagccggtgctggg

SEQ ID NO: 9241 - DNA, 515 bp, Gossypium hirsutum
  Clone ID: uC-gsflmaxxa002h04b1
cccacgctttcggttaaaaactggttttccactgcagtggcgtgtaccaaagagagagagaatgaagtgtcagtaggccatgttttccaccatatcttgccttaaatgacaaatattgatcatctcccactctattcaacagagacccaggagcacattgttgttctttaagattgttaatttggtgagatttcttcgattttgttgatgaaaaaaaaaaaagatgaagactgaagaaaaaacagtgacagatgaacatgatgctggtgctgctgcaagacgaggaacactttctgttgctattcaacaggtggaagattctttctgactaacctaggaaacagcggatgctcgaagttggaagcgaaccaacctctttctcgagatcccctcgagaagtttggatgattcttcttaagactctgtcacagttaagatgccccaaacacctagtttgactcccaggaaagtgaattttcacttgacaccgaatccttccgatggaaggattaatg

SEQ ID NO: 9242 - DNA, 513 bp, Gossypium hirsutum
  Clone ID: uC-gsflmaxxa002h05b1
ctttgtctctcttaagtcttcccataaaacagagcagagaaggtaaaacccaaagtttgaaaaccatcaaaaatggttcaaaggctcacttaccgtactcgccatagctacgctaccaaatccaaccaacaccgtgtcgttaagacccctggtgggaaattggtctatcagacaactaagaaaagagcaagtgggcctaagtgtcctgtcactggcaagagaattcagggtattcctcacttgagacctgctgaatacaaaaggtctagattgccaaggaaccgccggactgtgaatcgtgcttatggtggtgttttgtcctgcagtgctgttagagagaggataattcgagccttcttggtggaagagcagaaaattgtgaagaaggttctgaagatccagaagtccaaggaaaagcaagcttcaaagagctaagaaattagatgtcgaatcatcatttcaattctgatatgtgatccagcaggctctggaaagtgccaccaatgacttcag

SEQ ID NO: 9243 - DNA, 482 bp, Gossypium hirsutum
  Clone ID: uC-gsflmaxxa002h06b1
cccacgcgtccgctttatcaaaaaaccgcttcgggcaagcccttcgttgatgttttgaaggaaggtggtgtcctccctggcatcaaggtcgacaagggtaccgttgagcttaacggaaccaatggcgaaactttcacccagggtctagatggccttgcacagcgatgccagaagtactatgaagctggtgcccgctttgctaaatggcgtgctgtccttaagattagtgctaatgagccaaccgagcttgcaatccaagaaaatgccaacgggctagctatgtatgctgccatctgccagcaatgtggccttgtccccattgttgagcctgaaattcttgttgacggatcacatgacattaaaaagtgtgctgcggtgacagagcgtgttcttgctgcttgctacaaggctttgaatgatcaccatgtcatgctagaaggtactcttttgaagcctaacatggtgacccctggatccgactc

SEQ ID NO: 9244 - DNA, 439 bp, Gossypium hirsutum
  Clone ID: uC-gsflmaxxa002h07b1
cccacgcgtccgcattttccagctccgtcattatcttccaatctcctttgttgtgcaagtttaaatcgacggcgatagagtgtgctagctaaagagagtagtaaaaaaaaaagaaaagaatctcgtcgatgttcatttcatttaaggagaaataaatttactactattattatccaatcgatgtaaagaatgagagcaccgataatttattcgttgcggtagctgtttcttgtgtagatgatgatcgatcgacagtttgcgttttgttaaatggagatttcttcgaatcgatgaagtgtttccggttttgttatgaatctgagtgttagatcggcttcttgatgccttgagtttactttttttctttcttttggttttggaggggaatcgatataattttctttcttcctttttttggggaaaacaatgatcaacggcg

SEQ ID NO: 9245 - DNA, 468 bp, Gossypium hirsutum
  Clone ID: uC-gsflmaxxa002h08b1
agataatatctcaaatctcctcctcctcctcagaagtcttagtatcatcaccatggcctgaaatcccaaggtcttctttgacatgactatcggaggccagcccgctggtcggattgtgatggagcttttcgcagagtgcactcctcgcactgctgagaacttccgggccctctgtaccggagagaaaggcgtctgccgcagcggtgagcccctccactacaagggctcctctttgcatcgcgtgatccgtaactggatgtgccatggaggagacttcacggccggaaacggtaccggaggtgaatccatctacggatccaagttcgctgacgagaacttcatcaagaagcacactggtccctgtattctctgaatggctaacgctggttccggaactaacggatctcagttcttcatttgcacggctaagactgagaggctcgactgacagcacgttgtgtttggaca

SEQ ID NO: 9246 - DNA, 502 bp, Gossypium hirsutum
  unsure (1)..(502): unsure at all n locations
  Clone ID: uC-gsflmaxxa002h12b1
agatgagatataattgaaagaaaagaaaaatggttgtgctagagaaactttgggatgatgtagtggccggacctcaaccggaacgtggccttggccggctgaggaagatcacaaccaccccacccttgtccaccaaagatgaggcttcatcaatggcgatgccgacgagtccgacgacacctgggacaccgtcgacgccggtgtcggctcgtagggacaacgtgtggaggagcgtgttcaatccaggtagcaaccttgcaaccaaaggtattggcgctgaagttttcgacaagcctcaacctaactctcctactgtttatgactggctttacagcggggagacccggagcaagcatcaccgctgattgggcgatggctgacggcggcggagggtagcaaaaccactagcagaaggttgctgctactgaaggagcaggatttgcatgtaaatatatatatcgntctttttaaaagtttttcaatgggtcaataagtagtagta

SEQ ID NO: 9247 - DNA, 52 bp, Gossypium hirsutum
  Clone ID: uC-gsflmaxxa003b01b1
ccttctttctttccttagaatttttaggtcacagatcggtttttatggaaat

SEQ ID NO: 9248 - DNA, 165 bp, Gossypium hirsutum
  Clone ID: uC-gsflmaxxa003b02b1
tctactcgtccgatcaaactccacaaccaaaccataaaatgtcactcaatagtgaatacattactgcataggattccacgagagatcttcattattttcatttgccatatattatttttaataattattcaacccccaaaaaaattgcttctaaccctagctatg

SEQ ID NO: 9249 - DNA, 89 bp, Gossypium hirsutum
  Clone ID: uC-gsflmaxxa003b03b1
ccctagcattggatgtcatcgcaaccgtacgacggtcgttatatctaggccatcaagaaggttctcacatgacactgctgaccaccatc

SEQ ID NO: 9250 - DNA, 95 bp, Gossypium hirsutum
  Clone ID: uC-gsflmaxxa003b04b1
catcgcgtccagacttgcaacgatatattacatatgcaaaaactttaaaaccaattctaacctctgaagcaagaaaactcttggtggcgtcttat

SEQ ID NO: 9251 - DNA, 74 bp, Gossypium hirsutum
  Clone ID: uC-gsflmaxxa003b05b1
gataaaaagagagatggcgtctgtaataaaatgggcaatcttaattctgtcggtggttgtatctgcacccttca

SEQ ID NO: 9252 - DNA, 56 bp, Gossypium hirsutum
  Clone ID: uC-gsflmaxxa003c03b1
ccttctttgggcggcttcggccagatcaagggtcattggtgaaggatgtcgttatc

SEQ ID NO: 9253 - DNA, 449 bp, Gossypium hirsutum
  Clone ID: uC-gsflmaxxa003d01b1
ttttcctacttcatctcaactatcaaacccagaaagctcaaaggaaaaaaaagatggctttggagatctgtgtcaaggctgctgttggtgcccctaatgttcttggagactgtccattctcccagagagctcttcttactttggaggaaaagaagatttcctacaacatgcaccttatcaatatcagtgacaaacctcaatggtttttggagataagtccagaagggaaagtaccagtggtgaagtttgatgacaaatgggtggctgattctgatgtaattgttggaatccttgaagaaaaataccctcagccttgtctcaaaacccctcctcaatttgcctctgttggatcaaacataattggaacttttgtcacacttttgaagagcaaagacgcttatgatggatctgagcaggctttgcttaatgaactcaaggcattggatgaa

SEQ ID NO: 9254 - DNA, 496 bp, Gossypium hirsutum
  Clone ID: uC-gsflmaxxa003d04b1
ctgtctcgtgggttaaggctgacaagtcctggctgctgagggttttgggggtttctaagactgaagtgtgtttgctttcggcattttctgcttcgtatcttcatcatgtgggcactacgccgagttcctaagccgctcagagatacaagtatcagaactggagcttctttttctgcttctgctagattacaaacttcaaataccttcattgaaaaaaatgctattttttctggttcttctcaactggtttctgatacatgtccatctttattgagattttactgctcaacacatgcttcctctaatttctttgtttggagatgtggcctttcttcccaagctggtgctgaaagcagtggggaggaagatgacttggaagatggtttttctgaacttgaaacagctggtaattctgagaacaaagagatcatatttctaaggatgaaactgaagatggactggattctgatcaagaatttctgttgatgttgaagaa

SEQ ID NO: 9255 - DNA, 432 bp, Gossypium hirsutum
  Clone ID: uC-gsflmaxxa003d06b1
ttttcgcgtgggtcttcttccagtttttgtaagtgatcattactgaactaagttcattaataagtactaataatccttaaatctacagccatggctgccatggcatcttctaccttcttcttcttcctactttgtctcacagtcaccgccaaaaagacctacattgttcacatgaaacatcaagacaagccactttcttttgaaacccacaatgattggtaccgttccagcttacagtcactcaccgtcaccccagctgagtctcttctttattcatataatgctgcatttaacggcttcgctgcttcacttgatccagaacaagctgaagctcttggcaaatcagattcgggtctggggtgttatgaagatactggttataatcttcacactactcgtaccccaccagttttatgcctggatgctgagtct

SEQ ID NO: 9256 - DNA, 543 bp, Gossypium hirsutum
  Clone ID: uC-gsflmaxxa003d07b1
tctttctggcagggccaacactgtttggacatgtgatcaacatagcttccgtagttgcctgtgactctctttccactggtgctaaaaaatactttgttttgttgataatcacggatggggttataactgacctccaagaaaccaaagatgccctcgtaaaagcatctggtctcccattgtcgatcctcattgttggagttggaggagctgacttcaaagaaatggagattttagatgcagacaaaggagaaagacttgaaagcacaactggatgtatagcttcacgtgacatcgttcagtttgttccatttcgggatgtacagagtggagaaatttctatggttggagcacttctagcagaattaccaacacaatttttaacctacatgcgacgcagagatattaaaccaagcacttaattttttgtgtatatatatattttctaacttcctttcacgccttgagtttgcctcttatcaatgcaaccatggccttttttaaataaagaaaaagataaagagacatgtcgatacggtgcattaa

SEQ ID NO: 9257 - DNA, 560 bp, Gossypium hirsutum
  Clone ID: uC-gsflmaxxa003d08b1
ttttatataaatccctcgaaaaatcctccccatccaatcaccacccgaaaccatggccactccttccccacgcgaagaaaatgtctacatggccaaactcgccgagcaagccgagcgctacgaggagatggtcaagttcatggagaacgtcgtctccgccgtccccgctcccgacgaactctccgtcgaggaacgtaacctcctctctgtcgcctacaagaacgtcatcggcgcccgccgtgcttcctggaggatcgtctcctccatcgagcagaaggaggaaggccgtggcaacgccgaccacgtcgccgtcatccgtgactacagggccaagatcgaggccgagttgtccgagatttgcgctggaattttgaagctccttgacgagaagcttgttccggctgctggaaatggggattccaaggtgttttatctgaaaatgaagggagattaccataggtacttggctgagttcaagactggcgatgacaggaaatctgctgccgagaataccctcactgcctataaatctgctcaggacattgcagtagctgagctag

SEQ ID NO: 9258 - DNA, 498 bp, Gossypium hirsutum
  Clone ID: uC-gsflmaxxa003d09b1
tttttacgcgtccgctgagaactcggtttttgcggggcctgtaacagctttgggactcttcccagatgtaggagcgtcatatttcttgtcaagactcccaggatttttcggagaatatgtcggtcttactggtgcaagattggatggtgcagaaatgcttgcatgtggccttgcaactcactttgtcccttcagctaaattacctatggtagaagcagcattatgtgatgcagattccagcgatccagtaatcatatcatcaattattgatcagtactgtgagaaaccctcattgaaagagcagactgtgtacaatcgattagatgtcattgatagatgtttctctcaaagaacggttgaagaaattttgtctgctcttgagagggagggttgttgaccaaagggacggttggatctttgctaccattcaacactgaaaaaagcttcttcgactagtcttaaaatttctcttagatcaattagagtaggaagagttca

SEQ ID NO: 9259 - DNA, 449 bp, Gossypium hirsutum
  Clone ID: uC-gsflmaxxa003d12b1
tccacgcgtccgcccacgcgtccgagagaggtgggtctatggcgacgacggtggtgaagagcgcgttgcaggcgatccgtgagaggggtctccgcagtttcttaagggagctcaaggatgatggcttcacgaaatgcttcttcgatggaaaccttctgcaaaccaaaatccacaatataggggcaacagttgtgggtgttgataaattcggcaataagtattatgagaaactcggagacacacaagctggaagacacaggtgggttgaatatgcaaaaaaggatcgttatgatgcttctcatgtaccaccagaatggcatggttggctttacttcataactgaccataccggtgatgagcctttgatgcttaaaccccataagtactgggtggagctcaaggagaacttttttggtaggggaatgagtttatctaccattttaaagaca

SEQ ID NO: 9260 - DNA, 424 bp, Gossypium hirsutum
  Clone ID: uC-gsflmaxxa003e01b1
ttttcgcgtccggagcatctccttatcctggtcaaaattctttacaacgggtcgtcattttcggagacatgggaaaggctgaagctgatggttccaatgagtacaatgatttccagcatggctctctaaacactacaaagcagcttattagagacttgaataacattgatatagccttcctaattggagacatatgttatgcaaatgggtacctttcacaatgggaccaatttactgcacaagttgagccgattgcttcaaccgttcctttcatgattgcaagtggtaaccatgagcgtgactggccgggaagtggatccttctacgggaacaaggattccgggggagaatgtggcgtgttggcggagactatgttttatgtccctactgaaaacagagcaaagttcttgtactccacagacta

SEQ ID NO: 9261 - DNA, 508 bp, Gossypium hirsutum
  Clone ID: uC-gsflmaxxa003e04b1
tctttttgttgatcgatcaatcacaaaagacaaatgtacggttcaaatatgtgatcaaatgtctagcaagctcaattatgatgatgaatggcagggaattcaacgcagcacgtttctggtagatggagatgctctaactaactcctctgatcaaaatgcaactgctggggcatctagccgcacctcatcagatacacgaagacgaaggtttgacccctcatcattccagcagcgtgctgaggcattggaaggattgcttgaatttagtgcaagattgctgcagcaagagaggtatgatgagcttggtgtgctactcaagccatttggacccggaaaggtgtcccctagggaaactgctatctggctgactaagagttttaaagagaatactgcaaagcaagaggattaacgctgatgaacctttaccgtttgtatcatatccatagctgtaatctttaccaattttttagagttcagcttatcccgatttaggccacgattccggtca

SEQ ID NO: 9262 - DNA, 542 bp, Gossypium hirsutum
  Clone ID: uC-gsflmaxxa003e05b1
ttctattaaaaaaaaaaaagctaacaagaagaagccttcatcttctttcaaccgattgaaacggattctatattttagttgttttatcaacgaaatcaagaagaacccaaattacaattcccaataaccttgatttttttttccggaaaagtttgaatttttccgttaatttgcaattttttttatctgggtcgatggcagaaatggaagacagcaaggcgaaatcatcatctgggtcgttgttcttcaatcgttcgttcacgatgaactctacggcggcagctgagtcgaattcccccaaattccatctccttctcaacagcccttcgtctctcaatcgagcagcttccatttcgaggttttacaattccttcgattccgtcaaaggtaaagttaaaaagctttgcaatttgttcgaatccgctaagtcttcgtcttcaccatcgaacttagccagtcctaaagaaacttctcccaaaagtgttttgagaccctcgaaatcgattgcgtattcgtcctcgttttctttgagctttaataac

SEQ ID NO: 9263 - DNA, 265 bp, Gossypium hirsutum
  Clone ID: uC-gsflmaxxa003e07b1
tgtcgcctttgtctttaagaaataatatgttggggtgtttatgagtttttagaataaagtagccatggcttgtcgtaggttttgcctgttgccgccacggttacttggtgcttgccaatagatagagtgaagtactaatatttacttgtttttctgtccagtgtgagcatctctgctatctcaggatatattgtgactattacataattaatgtaaggaagtgagtcagattcctaatgaatgagaagaagctcctatttcgttt

SEQ ID NO: 9264 - DNA, 523 bp, Gossypium hirsutum
  Clone ID: uC-gsflmaxxa003e08b1
tgttcaggcgcaataaaaccatcataccccagcacatttaataccaataattcgtatggaaggggacccccaccaggaagtggatatcaggatccaagatacggttttgatgggtttcgatcccctatcccatggcttgatggctctatgttttcagatgggcagcacaggcctgtctcaagccctgcaatgaactctttggtttcaaaagcaaatggttttccatcttcaaggaatcaaaacttcagatcgaattctaattacatgggactgcaccaccctgggccaatgtccggcatgggcacaactcatggttatgtcaatagaatgtacccaaacaaaccatatggtcagtatgggaccacattcagatctgggatgggctttggatctaatggttatgatttgcgaacaaatgaaaggggttggttggcagacaacacgtatagaccaaggtgacggggcaatggttattttggttcaggcaatgatatcatggacggttttaatgaattgaacaggg

SEQ ID NO: 9265 - DNA, 454 bp, Gossypium hirsutum
  Clone ID: uC-gsflmaxxa003e11b1
tgtggacgcgtgggtttctcgaagtcatttgtgaggtccccaagagcttgaatttccagcttcaatcaggaaatttccgtaccgtttgaacttgtatctgtttggttggatatggttactcagatgcagacattctttgatggggagtgtctgagctgagcaaaagagatgctggatattggcttttagttggaatgaagaacttgcagagcacagaagatattaaaccttttactgaagatttacatgaacccaaaacggaacagcagtacattaaaactgcaaatggcttcttagcagacactgggtctttatctgcttttagcaacaatggcgggaaagttttatgccaagatattgaactggtccagattttattgaacgatgtttacaactctacctgaatagagatgaggtttgtaaaaccctcttgaattgagcaaggatagaccct

SEQ ID NO: 9266 - DNA, 376 bp, Gossypium hirsutum
  Clone ID: uC-gsflmaxxa003e12b1
ttttctcggtgggcagcttttctctgccatggtagtgcggaaaccagctcatcgcttcctcgacgaactcgccattgaatatgatgaacaagacgactatgttgtgatcaagcatgcagcccttttcacatccactatcatgagcaagcttctagcccgccccaacgtgaagctgttcaacgctgtggcggcggaggacttaatagtgaaggaagggagagttggtggtgttgtgacaaactgggccctggtgtcaatgaaccatgacacacagtcctgcatggaccctaatgtgatggaggccaaggtggtggtgagctcttgtggtcatgatgggccatttggagccaccggggtgaagagggtgaaaagcatt

SEQ ID NO: 9267 - DNA, 326 bp, Gossypium hirsutum
  Clone ID: uC-gsflmaxxa003f01b1
ctttcgcgtccgagctgcttctaatgctgtgccagcatgaggttgatcggcttgaagtttgggcacaacctctttcaaaggaaggcacatcttcgcggcccaaaattagcccagacaaatggatcgaatatgccaggactgctttctctgtggatcctcgaattgccttttcgttagcctcaagatttccaacaaacactcatctgaaggctgaaatagctcagctagtccagtcacacatactggatatccgctgtatacctgaggcattgccatattttgtcacaccaaaggcagttgatgaaaattcagtacttttacaacaa

SEQ ID NO: 9268 - DNA, 366 bp, Gossypium hirsutum
  Clone ID: uC-gsflmaxxa003f02b1
ttctgttgcagctgtggaaaaagctgggcttgctgacaagatgagccacatctctactggtggtggtgccagcttggagcttcttgagggcaaacaacttcctggagtccttgctcttaatgacgcttaaacttttaattttgcacctctatgctgtttttgagcattgttcactgctgtaatggtggctagtatttttagccaagagtgaattttagtagagctgaggttgtagaggctgatagggtggacttgttataaataatttggtttctcctcattatccatcagagatgcatttgaattggatgtcttttatgatatcttgattgttaatgataaaattgcagtagtgcttgttctatt

SEQ ID NO: 9269 - DNA, 461 bp, Gossypium hirsutum
  Clone ID: uC-gsflmaxxa003f03b1
ttttctcgtgggcggacgcgtgggtgacgatcaacgaatccttcactgcctttgtcgatgggatccctttttcttttatttgcagataaggggtgagatttagattaagagagaaacaaaagaatatataaatgatgttgcagaaagttgcgagcaatgcgtattcatggtggtgggctagccacatcagaactaagcaatcaaaatggctggaacagaatcttcatgatgtggaggagaaagtctctaacatgcttgaaatcattgatgatgatggagattcctttgcacaaagagcaaatatgtattatagaaagagaccagagcttttagccattgttgaagacacttatcgagcttatcgagcattagctgagagatttgattacttatcaagggatctacaaagtgccaaccgcaccattgccactgtgtttcctgatcaagttcatattcccttc

SEQ ID NO: 9270 - DNA, 462 bp, Gossypium hirsutum
  Clone ID: uC-gsflmaxxa003f05b1
attgtgttcatttatgaaccagggaagaagcaccctctcatttacgatgcgtccaatgcctgctcgcttgcagatctgctgtgctgccaaacaagagaccgtggataaggtatgtgaagtagtaaagagacaattagctttagacaatgacaaaccaatcaccggtgaatcaacatttcttgatcttggagctgattctcttgatacggttgagattgtgatgggacttgaggaagaattcggaatcacggtggaagaggacaatgcacaatccatcacaactgttcaagatgctgcagaacttattgagaagctgtgcagtgagaaaagtgcctagaaaacaaggatcgcagttggttggtttatttgccgatatttgatattcacatactaaaccgcaaacttgggggaaatcatgtgtgaaactttattatgttgaatatgtaggaaatttcgtaataa

SEQ ID NO: 9271 - DNA, 518 bp, Gossypium hirsutum
  Clone ID: uC-gsflmaxxa003f07b1
tgtttgttcttgcatggctgtcggcagccaaggctttggattcgcaattcacagaattgcgtagggaagaagaactcgagaaggagatggaaagagcagctgttaagatccctgtcatgtctgaaagcggaaatggctctcttgcaagtggttcagcagaaacatcagaaacatcaactccaagcaatatctaagaaaaaaaaaaaacattcttccatttgttgccaacaggaagaataagaagctgataagaaaccagtgctaggcgactgttggctctagaattttgcttttgttcatacaaaggatattagttaaaaacgtaaatgctcgactttattataagtcctccatttctttagatgttgagcttagtgtttgtttagttattgtgctctttagaattgcattaggatccataccaattgaaacccttttttgatcaaattctttttatatatacattagatgacgcgggaattaagcccaaaaaaaaaaaaagaataaagaaaaagttt

SEQ ID NO: 9272 - DNA, 522 bp, Gossypium hirsutum
  Clone ID: uC-gsflmaxxa003f08b1
ttttctttggagaactccttgctcatccaattataaagagtcttctggggaccaaggtggagtggctttattatatcctccaatcctttaactctgggaatttggttcgctatgaagaattgcgtcgcgtgcacaatgctgcactgagtgctcaaccagccttggttgagaatgagaagaagctcttggaaaaaattaatattctgtgcttaatggagattatcttcagccgcccatctgatgatcgaactattcctttaaaagttattgctgagagaacaaaattgtcaattgaggatgttgagtatcttcttatgaagagcctgtctgttcgtctgattgagggtataatcgatcaagttgagggaacaattcatgtctcttgggtgcagccaagagttctggggatttcacagatcaaatccttgcgtgaccggttggataattggatgggcaaagtacataacgcttggttatcacttgaggctgaaacacttgatcctcgtgcatcatgactctttt

SEQ ID NO: 9273 - DNA, 554 bp, Gossypium hirsutum
  unsure (1)..(554): unsure at all n locations
  Clone ID: uC-gsflmaxxa003f09b1
ttttacgcgtgggcaaagcttcaagatgcaaattttcgtcaagaccctcaccggcaagaccatcacccttgaggtggaaagctccgacaccatcgataatgtcaaggccaagatccaagataaagaaggaatcccaccagatcaacagaggcttatctttgctggtaagcagctagaggatggtcgtacacttgctgactacaacattcagaaggagtccaccctccacttggtccttcgtttgaggggtggtatgcaaatctttgttaagaccctcaccggcaagactatcaccctcgaggtggaaagctcggacaccattgataatgtcaaggccaagatccaagacaaagaagggatccctccagaccagcagagacttatctttgccggtaagcaactagaagatggccgtaccctggctgattacaacatccaaaaggagtccaccctccatttggtgctccgccttcgtggaggaatgcanatctttgttaagaccctgaccggaaagccattactttgagggtgagagtcagatccattgacatgtc

SEQ ID NO: 9274 - DNA, 432 bp, Gossypium hirsutum
  Clone ID: uC-gsflmaxxa003f10b1
ttataaagttaaagtctttctctttctgagtcagctcaggtccttaggttgggaacttgatagtcatggatggttggctgaagggatctaatagttttgtggatagggtaggactaaatgacagtacggtcttagctttatctggtcgggatttcgataaccggtttaagaatgagaattgtgtcgatattccttcttcggaacctgttatgattccaggaaattcagggaacatggtgtcttcctttggaacttgttctgatagagttggactaaatgatggtacggtgttggccttatctggtcgggatttcgatagccggtttaagaatgagaattatgttgatgttcttcctttggaacatgttatggttccgggaaatttagtgccttcctttggaacctgttttgatacagtaggactaaatgttg

SEQ ID NO: 9275 - DNA, 495 bp, Gossypium hirsutum
  Clone ID: uC-gsflmaxxa003f11b1
ttttacgcgtccgctaatttaaacacctccgccgcttttgctactttccaattttcccaggttctaggcatggtggtgtggcttaaagtggctgttataaacgaagaaggaactcaagctatttttatcagactatgaatgtcatctgaaagatatctccataaatgtagatggtggagcttcttggctttatcaaggatatgctatcgttgcctattcagacaactatgccaatccaactcttcatttttattgaagcatccacgtccaacatatgttcacacataagaatggggatatgatccttcaaggaccctccaaatacatagaatcaatcattattctgtcattaaaccatagggttttttataacttgttaatagtattctacaaaactaaattatgcttcagttaaaaatcacatacatgaatcttttagggttaaacatatgttcttaggttctgcttgagaatactatctttcctggtatggga

SEQ ID NO: 9276 - DNA, 278 bp, Gossypium hirsutum
  Clone ID: uC-gsflmaxxa003f12b1
ttttggtctgcccttgcccatgtgtcacctgggggattgcttggtaaaccctgcgcctgctgccgctccattacaagccgagcctagtctataagaccttccttcctatccgcatcaaaacgctcagaacttgaatcccatggcaattgctcaacctatagatgctcaactggcgatccaaaggcagggaattgatggccttcttcagttacggaatgagaggctgagatatgtattacaagagcaaatgaagcgaccacacaccattctggtaaaga

SEQ ID NO: 9277 - DNA, 469 bp, Gossypium hirsutum
  Clone ID: uC-gsflmaxxa003g02b1
ctctcttctttttgcatccactgattttgcgttctttgttttgtggaatcaaagcttcgccgttgaccatgattctccggtcagtattggtcttggttctgttggtgggggttttattccgtgcatcgcaatctttgcgtttcgatctgcaatcgggacaaactaaatgcatcgccgaagacatcaagagcaattcaatgactgtcggaaagtaccacgttgttaaacctaacgaagatcattctttgcccgattctcacaagctcacccgtcagggtaccgtcttcgtatggggaataattttcactcggcagaaaagggggagaatgggcagtttgcattcacggcgacggagcaaggtgattacatggcttgcttttgggcgccggagcattcgccgccgatcaccgtcaccgttgatttcgattggaggactggagtccacaccaaggacttggcttacgttgcc

SEQ ID NO: 9278 - DNA, 573 bp, Gossypium hirsutum
  Clone ID: uC-gsflmaxxa003g03b1
ctttcgcgtgggtttttcttttctttgcattcattgggttcatttttttccccagcaaatggaagacttggttcccttgtggaactatcaagaggattttgatgaactgaaactcaagcttcaatacactagtattgagctagagtcggtgaaaatggaagcatatgaacaaataaggaaatacagggatgaagtgaaccatttggtgaatcttgtaaaacttgcttgccaagaaagagatgaagcaagagatcagttccaaaagctagttaacaagttaatggcttcttcttcttcttcttcttcttctacaatcctccctcaaccccagcctgaaaatctgcttgtgattgcagcagcaaaagcaaactcaagcataactgaatcaaacagtttatctgagacgtataatcatcacccctcacatgggtcttccccagtagattccttgtttgatgcagtcacttcaccagattttttaagcattaataataacatggttgacaacagtttgattcataaccttggaaaggggaaactttgcctgaaaaaggaagcttttgcagctgtatg

SEQ ID NO: 9279 - DNA, 389 bp, Gossypium hirsutum
  Clone ID: uC-gsflmaxxa003g04b1
cgtgggttgagattggatttcaataggctgtttgggggagcagcatgtattgagatccaaaacctgacaagagatctcatcaagagggttattgacggagcagccgaaattttctgggagatctttgttcaggtggaattacagaggcagagccctcctcctcaggatgggagcattccgaaattggtgagttctataactgattactgcaataaacttcttggtgatgattataggccgatcctgacccaagttcttgtcattcaccaaagttggaagcataaaaaattccaggagatgatccttgtaaatgaggtttcgaaaataataaaggctgtcgatttgaatttggatacatggatgaaggcgtatggtgatactaccctttc

SEQ ID NO: 9280 - DNA, 308 bp, Gossypium hirsutum
  Clone ID: uC-gsflmaxxa003g05b1
gtgtctctgtgacaaatggagggtccttagctcgctctctctatgcaaaaaaaacaaaaggaaaaaaaagtctcccttctttgctttctttcaagtaaaaatcaaacgaaacacaacttaaatacatattaacagacattgattctgatcatcaaattctctgtttctgatccaccaatccaaccagagtgttcaactattgaagctgtccgagttctctttgctttttgaaatctgatgtctccgccgcttcttggcgtgaaggaagggggtcctaacaatgtcactctactggcttcttctggctc

SEQ ID NO: 9281 - DNA, 321 bp, Gossypium hirsutum
  Clone ID: uC-gsflmaxxa003g06b1
ttcatcgcgtccgtttaaaaagaaaaaaaaagatggcgtctgtaataaaatctgcaatcttaattctgtcggtgtttttatctgtaagcttcagttcgggtgttaggttgctccaggaacagcccaatgatgacctcaaaaacatggaagctattcctcccattgatgcactcaaccctaccgagttcaatggacccggtgttggcattcacgaagatcatgttgtcccaaaaggttccgaaattggtactcttggttttggttttgaaggtggtcctgaaaaatgttgttcttctggatgttccggtaaattggaatcct

SEQ ID NO: 9282 - DNA, 550 bp, Gossypium hirsutum
  Clone ID: uC-gsflmaxxa003g09b1
tctttacgcgtccgattttactaaatattttcatattcacaaataaattcattcctttctcttttacttttattttattttttttacattaactcaaaaaacaaaaatggcaaagattgctttggttattgttttgatctcaatgatcgtggtcgtttcaatccattccgtcgttggtgacaccgccgcaacgtcacctacagcatcaacagaatcaaacgctgcataagctgaggcaccaggtcatgagggacacgatagttccaatgaatcatggaccgactgggccaaggacaagatcagcggtattgggggcatgttcgcttcttcaccatcatcctcaccagcatcggaaccagcaccaacaccagcaagctcatcagcggaaacacccgaagtcaaggtttgagctgcacctgtagccacaagcttggtttaatatgggatatcaaagcatggttctcatcctataatatagagattgatgggaaaagcactatcactatcaccatcactactttatttttttttttattttttgatcaaacct

SEQ ID NO: 9283 - DNA, 403 bp, Gossypium hirsutum
  Clone ID: uC-gsflmaxxa003g10b1
ttttacgcgtccgatcaattccatcactccctgagctttcaaagatgaaaaattggtttgtaataatatttgcgttccttgtgtgtcaagctaacgcttttcgaccaatcctccttctaggcaaccagaatctgatagagagaacttgcaagcaaacacccttctatgatctttgcatttggtccctcaaatcaaaccccgaaagccgcgacgccagcgtgaagaagctagctcagatcatggtggattcactcaaaactaaagcgaccgagacacttgatctaatcgacgagctactacaggatggacttgcccttgaccctgaaatgcaaaaggccttaacatcttgcgctgaacgctataacgtcattataaggggagatgtacctgagatcaacgaagc

SEQ ID NO: 9284 - DNA, 527 bp, Gossypium hirsutum
  Clone ID: uC-gsflmaxxa003g11b1
ttttctcttctctcttttcattctctccgatctcattgactcacaaatgaatccttccattctatcaaaccgtcctttagatctctatcccatgtttcagatctctcttctttgattcaattttttgacgtttttagaaagaaaaaaaatcatttgattaaatctcaggatccctcgattttctctcacaaacccagttttttttctttcatttttcgtaatgggtttcactcaaattcgctttctcttcattgtttcctttttcttcttcgttttcgcttccgtttctttttctcaggattcaggttttcaagctgagaaggaggaatctgatgggtcaattaaagatctcggccgccgcggcatgattgtttcaaagaactccgagaatggtgtagtagacgagaaggtcggtaccgatttcataggtactaatcttggtttcgatccagctggtctcggcgtccttgatgcattcgttgcaagtttttccatgatattgtcagtgagattggagatgaaacttt

SEQ ID NO: 9285 - DNA, 242 bp, Gossypium hirsutum
  Clone ID: uC-gsflmaxxa003g12b1
tcgtccacgcgtccgcccacgcgtccgagcgggtggagttcttgtttggttggttcggaggaaatggaaaaccggggaggacaaaatggggaaagagaaaaagagggaggaggttgaagaagaaggacaaaacggttaattcatggtggttgatgaagggtttgccttagaattagaggatttgttaagggcatccgcatatgtagtggggaaaagtaggagtggtatattgtataaagtgg

SEQ ID NO: 9286 - DNA, 430 bp, Gossypium hirsutum
  Clone ID: uC-gsflmaxxa003h01b1
cttttggttgaaattgtctacacaaagagggtgagttagaaatggatgctgatccatggactctttgtctttcttcaactgctaggagatatcaatcagctcttcagtcacgatctgatatgtttatggggtttgaagaaatggatggagaagacgatgtaagagaggagtttccatgccctttttgttcagagtatttcgatatcgtgggcttgtgctgtcacattgatgatgaacatcctgtggaggctaacaatggggtatgtcctgtctgtgcaacgagggcgggagcagatatggttgcgcatataacgcaacaacatggacatatattcaagcgtcagcggagatcacgtcgaagcggatctgattcaacgctgtctcttctgaggaaagagctgcgagacggaaacctgcagtccctcttcgg

SEQ ID NO: 9287 - DNA, 466 bp, Gossypium hirsutum
  Clone ID: uC-gsflmaxxa003h03b1
gtttctactccttcagatacttactatctttcggtgaaaaatggttactttcaggtttcatcagtaccaagttgttggaagggctcacccaacagagagcgatgagcatcctaagatctataggatgaagctctgggccaccaatgaggttcgggcaaaatccaagttctggtacttcttgaggaagctgaagaaggttaagaagagcaatggtcaagtccttgccatcaatgagatttttgagaagaaccctaccaagattaagaattacggtatctggctccggtaccaaagccgatctggttaccacaacatgtacaaggagtaccgtgacactactttgaacggagctgttgaacagatgtacaccgagatggcttctcgccacagagtccgtttcccttgcatccagattatcaaaactggcacaatcccagccaagctatgcatgagagagagcaccaag

SEQ ID NO: 9288 - DNA, 408 bp, Gossypium hirsutum
  Clone ID: uC-gsflmaxxa003h06b1
ctctctcgtccgattgaaatgaaatctctctgagagaggagttgcttaactgaattggttttggttgtaataagcatggtttcgctggaagattcacattctaattccaaccgctttcctttgggtcgtaacttttacacccccagttcagcttccaccaccaaaatccaccgtcatgtctgccgctccatgcgtacgattcgctccaatctttaccaaaacgacaatagtagctgctccttcaccagttccgtccctgagaggtccgcctttgtctccgaaaatctcaccgagtccgttatcgacatgcgtctcggcgaactggctgccaaaagcaacgctaaatctgttacgtctgagtccgaaaacgaggcctttttggagatttctcaagcctttagtgatttc

SEQ ID NO: 9289 - DNA, 528 bp, Gossypium hirsutum
  unsure (1)..(528): unsure at all n locations
  Clone ID: uC-gsflmaxxa003h08b1
tttttattaaagctccttcagctcccatggcgagctcaatggtccttgtttcattgatggctttaggcctcttgatggtattttcaacgacgactcaagttgaagcagccgccagggcattttttgtatttggcgactctctggttgataatggcaacaacaattacttagcaacaactgctcgagccgattcaccaccttatggcattgacactcctacccgtcgccccactggccgattctccaatggcaaacacattcctgattttataagtgatgcacttgggtcagagccaacattgccatacttgagccctgaactgaggggagaaaagctgcttgttggtgccaactttgcttctgccggtgttggaatcctcaatgacactggcattcaatttataaacattataagaatgttccggcaattacaatacttccaagattaccagacacggttggctgaacttgtcngaaacgatgaagcacagcagattgtaagcgacagtcttgttctcatcacagtcg

SEQ ID NO: 9290 - DNA, 468 bp, Gossypium hirsutum
  Clone ID: uC-gsflmaxxa003h09b1
tctcacgcgtccggtacccgtactggcagttggagtccctcagtgagatgtcctactgtgcgcatcaaaggaagttgaccatcatccctgttcccctactccttggctttgtacttgccgggtttctgaaagaaactgccttggaactttctcctcttctcaaggatgcagaagttccatggcacctgattgcaatagcaatattcttcacattgatcaaactgccaggcccatattacccgtactgggggcggattttcattcctcacattgcaaatggagcattattcaggactctatggtttatgattttgtggtatcgcagatccaaaatatcatgagctgagttgccaaatagtctggtaaatgtcagagattctgaagttgaataagccgtaatctcaacagctcggattctgtgtctgagacacgagccaggacaagctgcttgggaaatatatcagaact

SEQ ID NO: 9291 - DNA, 370 bp, Gossypium hirsutum
  Clone ID: uC-gsflmaxxa003h10b1
tttcacgcgtccgcctccttccaatctcaaagggtcgaagaaccagagaatatgggtaaatatcgaaacggttctctctcagagaactccgacgaagaaacgggaacaccatctaaacccaaaccaaaacacaaacccgactcagaatccgaagatacaaagcccagaagccacagcaaaagcgaaaaagggaaacgaccgagcaaatcacgaagaagacacgacagcagcagcggtatcagtgaagacgattcgtattcagactcagaatccgaatcggaatcccagtcggagtattcggaaacggaatcagggtattcggattctgaggaggagaggaggaggaggaagaggaagagaagggagagag

SEQ ID NO: 9292 - DNA, 488 bp, Gossypium hirsutum
  Clone ID: uC-gsflmaxxa003h11b1
tcttacgcgtgggaaaatgggagaaatgctactgctaactttactactggcatgtggtcactgaaacccattattttttctccatcactttccctagagttttttaagtactcaacaataaagaaattcccagaaagcctacatacccagaagatatgtacaagaaccaactgcaagagttggctcaaagaagttgctttaatctgccgtcttagtcatgcatccgagaaggacctgatcatgctcctcggtttaaagctactgtcaattttaatggagagactttcgaaagccctacattttgctctactttgagacaagccgaacatgctgcagctgaagtagctctaaatacgcttgccaacagaggccctttcaaagcattggctgctagaatcttggatgaaactggtgtctataagaatttgcttcaagagactgctcatagagctggtttaaatctttcagtctacacaactattcgatct

SEQ ID NO: 9293 - DNA, 383 bp, Gossypium hirsutum
  Clone ID: uC-gsflmaxxa003h12b1
tttttagattccctccctcttccttaagccttactccaaagaataatctctgactctgaactctgatctcatttcaccctctctgcttaaaccccaaactaggatttaaaatttttagggttaggccaaatattttccctattttttccaatggatttccagaggaaaagagttcagcttctgggcttcatcgtcggagtcatcgttctcagttacacagctgaaaaatgtaggcacctggttggagaggaggcatcatcccaaagtgggcaatttactttgttaaattgctttgatatgggctctggttccgtagcttgtgcagtgaaagaaggtgtgaagctttatttctataacattagatctgctcatgttgagaaagc

SEQ ID NO: 9294 - DNA, 175 bp, Gossypium hirsutum
  Clone ID: uC-gsflmaxxa004a03b1
ctctactttctcaataattaagggccattttcttcctcgttctctcaaataattttttttttacattgtccctttgatttttcttgtttaactaatttatctcttgaattttttatatagctttcaatttaacatagttggttgtttgttattcttgatttatacctatgcctta

SEQ ID NO: 9295 - DNA, 90 bp, Gossypium hirsutum
  Clone ID: uC-gsflmaxxa004a04b1
cggatgcgtgggtcggcccgggcacaacaccacggggacggtttttatagagcttggcatgctttacataacttcagtgacaccaattct

SEQ ID NO: 9296 - DNA, 170 bp, Gossypium hirsutum
  Clone ID: uC-gsflmaxxa004a06b1
tgcataaatacctcagctttccaatttagaagtctggtttcagtgctccaaagacattgtccgtatattgttatctggagacttagatcttggtattgtggggcttgatcctgtcagtgaattttggcctgggtaatgaagatcttatcattgttttatgatgcccttga

SEQ ID NO: 9297 - DNA, 217 bp, Gossypium hirsutum
  Clone ID: uC-gsflmaxxa004a07b1
tcttcgcgtccggcattcttcaggtgcagagctaccaaaactgaaaaaaccagggaggaaaaaacagaagtttcagcctaattttatgaaagtgctttggccaggaagagaattgtgactgctgaagaacgagagagagcgattaatgcagccaaagcatttgagccgactaaccctttctgcagggtcgtctcgcgaccgttttatctatacaggg

SEQ ID NO: 9298 - DNA, 173 bp, Gossypium hirsutum
  Clone ID: uC-gsflmaxxa004a08b1
tggtgtgtggaagctgcttcatatgccaatatcacagagctgtcaatcaacaaatgtcttgaagaatcatatgtcaatatgaaatgccaaaaaggatcatattagacaatgcattgaatttgagcaaccgcacgacaatagaagtttgcagtttgttcttgattaatatcatg

SEQ ID NO: 9299 - DNA, 113 bp, Gossypium hirsutum
  Clone ID: uC-gsflmaxxa004a10b1
tcctcgcgtccgatggagtccaacaccaaaatgtcagctcttcttttgctttgcatgcttttcatttcttcagtgacaccaattcttgggtgtggctcatgtggtaaagtacc

SEQ ID NO: 9300 - DNA, 113 bp, Gossypium hirsutum
  Clone ID: uC-gsflmaxxa004a11b1
ttgtaattattcattgtatataaaaaaaagagaaagaaacagttaagggacgaggtttacctggtgttgtccactccgtcgcaatcggagatcgagagaggatcggaggcctt

SEQ ID NO: 9301 - DNA, 488 bp, Gossypium hirsutum
  Clone ID: uC-gsflmaxxa004b01b1
gcttaattgccgaaggagggagcgaggaaagagaggacgcgaggaaaacaaaagatcgaagcgcagaggcgaaacgctgagaagaatcaaaagccaaagggttctcagctggaggccagagctgtagccctcaaagtcagctgccctatctgcaaggtgcaattagcaaatgaaaaacaacttggtgatcattatggctctaaacatccaaaggaaaaccctcctgctgtgtcaagttgattgctttcttcgcatgtaaaagaaggaaaagaacaaattatcttttcctgtgtgattctagatattatatgttaaccgtctttaaaaaaaaaataatttaaaccaatgaaaatgactcttttatctatttgcctttgccttttgctttcagtcatgtcgtgtgtagaaatgtgaacactagaatgataataaagcagtttgcctgccgcccgggatataaatattttatgaattcacaaggggataca

SEQ ID NO: 9302 - DNA, 227 bp, Gossypium hirsutum
  Clone ID: uC-gsflmaxxa004b06b1
gactcagtcaagagttagccgagagatccaagcaatggaggcttaggcttcctttggtttggctgtcaaagccagtgagatgcagttggggggaaaaaatagtaccaatctcactgctatgctgtctggttcagcaagttagcgctgtgtgattgcatcttcaccacactgctcagctgaaactcagctggagatttaagctgcaattgaaatcaactgtactgctg

SEQ ID NO: 9303 - DNA, 90 bp, Gossypium hirsutum
  Clone ID: uC-gsflmaxxa004b07b1
tgtttatccactagggtactcagacatcatgggaatgttttaaataaaatttggggttattaaccacatttaaaaattgattaacattac

SEQ ID NO: 9304 - DNA, 320 bp, Gossypium hirsutum
  Clone ID: uC-gsflmaxxa004b09b1
gattaaaccaaccattaagaaggagaaaaagcattggccaaaaagaaataaagaaatatctgacgatgggaagcgcaaacaccagcgctgctctaatctcccatttgcagctcaacagatgctgcttcaaactcgttgagtcaaccaggacccagctggagttcaactctctcaaattcaggctttcaaggagagggaagctggaattcgctgcttcccggcgcgggaaaggttttagaacagccgtttgttccgctgccgttgacgatgatctcaaagagaatcggccacaagctttcagtgaaaccagcagcccctct

SEQ ID NO: 9305 - DNA, 214 bp, Gossypium hirsutum
  Clone ID: uC-gsflmaxxa004b10b1
cccactttgtggctctctgagttttctcacctgaaacgctctgcactttctccctcagtgcctccatattcctctcttccaatttttttgccctcttttttctgctttctttttctttctctcaatagattttgtcttttcctctctttcatttctttctcttgatctataaaattccatcgattgttggaaagagcaagagggttcttgaggt

SEQ ID NO: 9306 - DNA, 93 bp, Gossypium hirsutum
  Clone ID: uC-gsflmaxxa004b11b1
tcggtcgcgtgggcggacgcgtggggaagcacagagggtttattaaaacaatcgttcgggttaaaacacccagagagatgcagctggggggaa

SEQ ID NO: 9307 - DNA, 107 bp, Gossypium hirsutum
  Clone ID: uC-gsflmaxxa004c01b1
gctagtgttccacgtgctcctggggactctctaggcccggcttattttcaatgccatattgttttcccccactcaattacacactctgactctctgcctcccttttt

SEQ ID NO: 9308 - DNA, 516 bp, Gossypium hirsutum
  Clone ID: uC-gsflmaxxa004d01b1
ccttccttatagagtttagtcaatttctgctctcttcctgtttttcattttcccttgtagagctaacgttctgctggtttcggttcactaattttttcagctgtgtttctttcaaatcgttttgatatgtttttcaaatcgttttgagattcatgtctccagttgtgagtgaaatcctccgatcggggtttatgataaattcctcactcagacgcaggacccatcttgttcaatctttctcagttgtcttcctccactggttctatgtttttcataaataaattctctgtaattgcttgactttcatttcctttacataataaacccaatatataagaaaacgttgcattagctacacgtagttagtatctgggtcctgtcgtcgtctttctatcagtgattttagtgtacatacatcaacatggcatcgtccagtgggaattccaattcttcaggttcgactctgcttcagatttcaggctccgaagaggatctgcatcaagtgatggaagaaag

SEQ ID NO: 9309 - DNA, 546 bp, Gossypium hirsutum
  Clone ID: uC-gsflmaxxa004d02b1
agtaaatatcacaaatcttcttctccttctcagagatcttagtatcatcactatgggctcaaatcccaaggtcttctttgacatgacgatcggtggtcagcccgctggtcggattgtgatggagcttttcgcagattgcactcctcgcactgcggagaacttccgtgccctctgtactggcgagaaaggcgtcggccgcagcggtaagcccctccactacaaaagctcttctttccatcgtgtgatccctaactttatgtgccaaggaggtgacttcaccgccggaaacggtaccggaggtgaatccatctacggatcaaagttcgctgacgagaacttcatcaagaagcacactggtcccggtattctctcaatggctaacgctggaccgggaactaacggatctcagttcttcatttgcacggctaagactgagtggctcgacggatagcacgttgtgtttggacaagttgttgaaggcatggatgtggtgaaagccattgagaaagttgggtctagcagtggaagaacttccaagccccgtgt

SEQ ID NO: 9310 - DNA, 548 bp, Gossypium hirsutum
  unsure (1)..(548): unsure at all n locations
  Clone ID: uC-gsflmaxxa004d03b1
cttattattatggtgggtacaatgaaatggctgatatattagtgaatttaacatcattagccactgaaatgggtcggttagtttccgagggttacgttttaactgtattagcacccaacgatgaagccatggctaagttaaccaccgatcaattaagcgaacccggtgcaccggaacaaatcatttattatcacataatcccggagtaccaaaccgaagaaagtatgtacaatacagtgagaagattcgggaaagtatcgtacgatacattgaggttaccacacaaagtatcagctcaagaagctgatggttctgttaaattcgggcacgccgatggatccgcttatttgttcgacccggacatttataccgacggaaggatctcggtgcaaggaatcgacggtgtacttttcctgcctgaagagaaaactaaagaagaaaagaagactatcaaagttgctacagcgaaacccagaagaggcanngtgcttgaagttgcatgcagaatgcttgtggcaattggtcaagattttcattttagcacatgc

SEQ ID NO: 9311 - DNA, 366 bp, Gossypium hirsutum
  unsure (1)..(366): unsure at all n locations
  Clone ID: uC-gsflmaxxa004d04b1
atttgcattagcccagaaatcgactatgaatcaacccctgtttcatctctaatttctcaatcctttgccacaaccaatcgaaaatctgttgcgaatcatttcctctccacaaaattctntcaatttcttttgctctctacttcaagatcccttagttttacccgaatgttgcaagccctagcttaattgttgtgatttaggactctcggttttgccactatttaaggcgttaccccatttgcgagaaaccctagtcttcgattttttttaaaattttttgtagtttgtgtacagattttgtgtacagatttcggaatttttttctaggaatttgtggtgttttggagtttaggtttgtgatatgaa

SEQ ID NO: 9312 - DNA, 315 bp, Gossypium hirsutum
  Clone ID: uC-gsflmaxxa004d05b1
cgtatcgcgtgggtcaacaatgcctgttcttgggtccttggttggagccacccttgtttctttctttgcctactatttgcagtaagccagcatgaatatacgaaagcatgaagtgttgaagaataaaaaatggtggattaataaatgtaaaatattactcggggttcaatccattttacttgcttttcttccttctttttttgttcatgacttcatttgtacgttcatcaaaaaagttgaattccatgtgatactttgcagttgaaaaaaaaaaaagttatatattttaaaaaaaaataaagaaaataacaacga

SEQ ID NO: 9313 - DNA, 418 bp, Gossypium hirsutum
  Clone ID: uC-gsflmaxxa004d08b1
cccacgcgtccgcccacgcgtccgcccacgcgtccggcgagaggaagcagggccacacgaggagctaagctgtgccgagcagaaagcattcaacccaaccccagctccacctgctgccagtgcttcctgatctttggttcagccaatttcattgttaaaatgcagttgtcaatgaagggtaatttaataagagagctgggcaattaggttgttgtaaaatcatggtctatgtcggtgtgagaaaagggcccatcaatttcatgatattatatatagctgtatacgtttgatttgctgctgttaggtggtctttataatttgcttttttgtgtgtgtgtagattttgatatatttgatgcttgttgtgctgtccacgacattcatataaaattgtatgtattgaaccaccatttttatt

SEQ ID NO: 9314 - DNA, 444 bp, Gossypium hirsutum
  Clone ID: uC-gsflmaxxa004d09b1
gcttattgtttcatctgatctgaaactccgtcgcccacttcccaaacaaagcaaatcgatggcgccgcctcctggaccatactccggcaccagcactcttgctctcgccaaggcaaggtctcaaaggaaagctgaagcaaaggctcaccactgaagcaggggtggtttttgttcatagctggtttgcatgagtgaattgagtttggcgtaggaataaagcataaaaatagtattgtaccagattttcatttcggcttaaagcttctatggacaatgacattcttgtccccaaatttttttagtattacgaactcggcacttcaagtattagtttttcggttggcaatggcactaccgatgtttagtgtctttagttaatgggaaagatgttggatgattatatgcttccatgttcaatgtaataattctcactttttggctccc

SEQ ID NO: 9315 - DNA, 377 bp, Gossypium hirsutum
  Clone ID: uC-gsflmaxxa004d10b1
ggttgtgcttgaaaagattcaggataagtggagaacggaggatctaggtaggctaaagtttcatgactccgtcgccgccaatatgtggactgctcatgagatcgtcgagcgttgtacaggaggattagttctatggtgatctggacgtgttatggggggctacaaagggagctactggccatggtactgctttatccgatgacatagatggctatgcttatgatgatcttgacgttctttatgtggacgaaagggagagggtggctgggacgattggagatgttgaaacatctcgatggggtgtggtgaagccagagcgttgtgaaagcatgactgaggaggaagctgaatataacaggctagatgatggtgtagga

SEQ ID NO: 9316 - DNA, 426 bp, Gossypium hirsutum
  Clone ID: uC-gsflmaxxa004e02b1
acctgcttttcagggcgtgttggatggaaagtatgatgacctgcccgagcagtcgttttacatggttggaggaatcgaggaagtgattgccaaggcagataagattgccaaggaatctgcagcctaatcaaatccacataccttaatttctgctgagtaatttcgaaaataatctaggtggtgttggtaatgccagcaacagaactgttcatttattttgggggtttgttgtttatgtttaatgatgttattcaagagtgtaaaagagcacttcggccccgcttttttctttgcttaaataagggaaatagaaggcggatgtgtacattttttttgttcgaaaacgctggctgctaaagccttatcctttctgactgccgtttattcggaactactgatgttttgaaatgcattcgagactaatgt

SEQ ID NO: 9317 - DNA, 555 bp, Gossypium hirsutum
  Clone ID: uC-gsflmaxxa004e03b1
cccacgcgtccgctctttatttctccccaaattttcaatgctaaatactcgatccaattgaaactcaattttgattttttaatcattattcttattatttattcgatgtgatcatgcccgcgacggattatcaaggaacttcgtcaccgttgacaaatatcggccgttcgttattaccagtgaggagggatcaagtacacgccatggaatcgccgatcggtggatcggcgtctaacgaggcggagatcgagtcctttcaaaggcaagtagctgacagatttcacgatttagcttctgtcccttccgatgaattgctttctctgccgtgggttcggaagttgctcgacgttttcctctgttgtcaagaggaatttcgggtcatgctttttaacaacatagctctagtgaagaagccgcccatggaccgtttgatcgccgatttttacgagcgtactgtcaaggcgcttgatgtttgcaatgcgattcgcgacggggattgacagatcaggcaatggcagaagcttctagaaatcgttctttgcgctttgggtgata

SEQ ID NO: 9318 - DNA, 534 bp, Gossypium hirsutum
  Clone ID: uC-gsflmaxxa004e05b1
attttatttatctggttatgggcagccatcatcatacgatcagcaacaaagttatggttctgcttcgagctacggtaatgtgacaaatccaactcaaggtggtcaaggggattcaggtcaggcacctacgtctacccaaccgtctgcaacaggccaacaagggtataatactagtcagcagcctaacccaaaccctggaagttatccacctccaggaagtactcaacctggttatggaatgccgccttcccaaactggctatgggaatcagccaccagcacagcctggttatggagctggatatggacaaccacaaacgcagaaacctttggccaatccccagatgtatgggcaggctcaacagtcgcctagcaccccaggaagttatggccagccaggatatcattcacagccgccatcttctggttatggtcaaccagagacaggttcacaacttgctcaaccaccaagttatggtgcggcatctgcccagcctggatatggagccccaacctatggagctggttatggagc

SEQ ID NO: 9319 - DNA, 496 bp, Gossypium hirsutum
  Clone ID: uC-gsflmaxxa004e06b1
ataattcccgggccttatttgctactgtaaacaaaaccctgtttgtaaaagaaatgaagctcgttttggtgacattcctgctggtttctcttgttctcagctcctttctctttgaggagtcgatggctggttcaggtttctgtgcgtacaagtgcaaggcaaggtgcgcaaaggcagattttaaagagaggtgcttcaagtactgtaacatttgctgtcagaaatgcagttgtgttccgtcagggaactacgagaacaagcacgaatgctattgctacagggacatgaagaactacaagggcttgcctaagtgcccttaaatactgtcttaaatacatgctattgcttaactgttgtagaaggcgaattttagcttttgtgggggctgtacgtcttaaagagtcttcttggacgaggacccataaaaggtttctattaagctaatataattaagggttttaaatgaataaatggtgtctttcatagcttctgggta

SEQ ID NO: 9320 - DNA, 469 bp, Gossypium hirsutum
  unsure (1)..(469): unsure at all n locations
  Clone ID: uC-gsflmaxxa004e08b1
atttaggagaacaaaaatggagaatggaggggaagatcctgtgttttcatattcgtattataggaggaaagaacgcattgcattggtagccattgtagtgcttgcttcagtggctgttgcttcgcttttagtggcttctagttactattggtatattcgtaacagggtcctctctaagcgctccaaatcccactctactgggggtgattctaaggacaaagcttgctccaccgatcttgaagttgctatggacgaagggcttcatgtctttacttttaagcagttacattcagtcactggtggtttcagcaagtctaatgtggtctggcatggtgggttagggtccgtatacaggggagtgcttagtaatggcaggagagtngctgtcaagttaatggatcaggcagggaagcaaggagaagaagtatttaaaaaggaggtggaactggtgaaacgtatacgttcttca

SEQ ID NO: 9321 - DNA, 516 bp, Gossypium hirsutum
  Clone ID: uC-gsflmaxxa004e09b1
gttgaaataaacaaattactcttttttttaaaaggaaagatggaggaggaggaaatggatggaaaaagaatcgagggcaatgaagtttatgctctagcaatgtgtgtaagtattctcctctttgctccgattgttgtgtcacaaccaataccggcagataaatcccaagtggaagcttggtttaatggcattatcaagccggtgaaggaaaggggtacaattttagaccctgaattggttcaagccgagacagaacctagaatcataaaggtgatgcaaggtgggggtggagaattcgataccataaccaaagccatcgagagcgttccatcagggaacgccaaacgcgtgattatatccatcggacctggatcttacaaagagaaaattagaattgaaagaaataagcctttcattacattgttaggagatcctaaaaacatgccaaatttgacatttgacggcaccgccaagcaatatggaaccgtagatagtgccactcttattactgagagt

SEQ ID NO: 9322 - DNA, 382 bp, Gossypium hirsutum
  Clone ID: uC-gsflmaxxa004e12b1
attctgcttatctggctgctggattagcctcattgtatgaacgtgctggtcaagataaatgccttggtgggccagaacgtacaggtagtgtgacaattgttggtgctgtttctactcctggaggagatttctctgaccttgtgacatttgcgaccctcagtgttgttcagggtttctggggtcttgacaagaaacttgctcagaggaagcatttcccttctgtcaactggcttatttcatactcaaagtactcaggggcactggaatctttctatgagaaatttgatcccgactttattagcattaggactaaggcccgtgaagtgcttcagagggaagatgatttgaatgaaattgtacagcttgtaggaaaggatgctct

SEQ ID NO: 9323 - DNA, 529 bp, Gossypium hirsutum
  Clone ID: uC-gsflmaxxa004f01b1
tcgtctagatttaccaactgaaacataacaacaaaaatggcggacggcaggaagacagtggatacccatgcgtttcttctctttaatgacacgaacttttgtcagaatgtatagaaggaaaaaaaaagaagttttaaatagatttttggttttgttttcttctggattgagcagaagaagacccatgaaagcatcaacaacaggttggctctcgttatgaagagtggaaaatacactcttggttataaaacagtgcttaagtctctaaggttctacaaagggaaactgattattatttccaacaactgtccaccattgaggaaatctgagattgagcactatgccatgctttgtaaagatggggtgcatcattataatggaaacaataatgatctgggaactgcttgtgggaagtactttcgcgtatcctgcttgagtatagttgatccaggtgattccgacatcatcaagtctctacatggtgacagctgattcgttagacagcagaacaatgtgcggttattattat

SEQ ID NO: 9324 - DNA, 559 bp, Gossypium hirsutum
  Clone ID: uC-gsflmaxxa004f02b1
cataaattgcgatgaagcgttagtgaagaacaagcaagtggttctcaagaactatgtgaatgccggtttgcccaaagaatcagatatggaaattaaagaaaaaagcattcaattgaaagttccagaagggactaaagattcaattttagtgaaaaatctctacttatcttgcgatccttacatgaggaatcgtatgaagaagctcgaagattcgtatgtgccgtcttttgagcccggatcggctatatccggttacggagtggccaaagtcgtggattcgactcatccggaatacaaaaacggtgatctcgtgtgggggatgaccggttgggaagagtattctctcttaacggtgcctggtcttttgttcaaaattcaacacacggatgtgcctctcacctactatactggacttcttggtatggctggtatgactgcttatgctggtttttatgaaatctgcaccccgaagaaaggggaatatgtctatgtatcggctgcatccggagcagttggtcagcttggtcggcaatttgcgaaatgttaggctgctatgttg

SEQ ID NO: 9325 - DNA, 547 bp, Gossypium hirsutum
  unsure (1)..(547): unsure at all n locations
  Clone ID: uC-gsflmaxxa004f03b1
atcgtcgtctccgtcgttcgaagattataaaaaaccggcgtcgtttcaaatggctacgagaacggatcttgatgggaggccaataaagccgttgacgatatgcatgatcggcgccggaggcttcatcggctcccacctttgcgagaaattgatgtcggagacgccgcacaaggtgctcgccttggacgtttacaatgacaagatcaagcatctcctcgagcctgactctctcccttgggctggccgtattcagttccaccgacttaacattaagcacgattctaggctcgaaggcctcatcaagatggcagatctcacgataaatcttgctgccatatgtactccggcagattataatacgcgtccactagacacgatttacagcaattttattgatgcacttcctgtggtgaagtactgttcagagaacaacaagcgtctgattcacttctctacttgtgangtgtatggaaaaactatggcaagctntcttcctaaagattctcctcttccgtcagatcctgcctactatgctcttaaggaagat

SEQ ID NO: 9326 - DNA, 499 bp, Gossypium hirsutum
  Clone ID: uC-gsflmaxxa004f04b1
cttattgttgcagtgcctttgagaagttgaaagcaatggagcaatcattagaaaaaggtaagcagattcaagataactgtggtgcttcgataaaaaggcttcgggctatgctccactcaactgaagatcaactccgagtgcacaaaaaaaagaccacgttcttggcacagttaactgcaaaaacccttcccaaaggtcttcattgcctgcctttgcgtcttactactgagtattataccttgaattcttcacaacagaactttctagatgaagacaaattagaagacccccgactgtaccattacgcacttttctctgataatatattagcagctgctgttgttgtaaactcaaccatttcccatgttaagcacccttcgaagcatgttttccacattgttacagataggctcagttatgcagcaatgaggatgtggcttctgtgtaattcacctgggaaagtcactatacaggttcagaacatcgaagaatttacatg

SEQ ID NO: 9327 - DNA, 531 bp, Gossypium hirsutum
  unsure (1)..(531): unsure at all n locations
  Clone ID: uC-gsflmaxxa004f05b1
ccctcgcgtccgattttctttgcgaaagaaggtgaagattgcaaactaacaccaatgaaagaaaatattcaaccgtcggtaaccgtgcctttcgaacaaggtacaggacagaaattccaacagccgcccggatcggggatcagtttctttatgttcgaggaatcggaattactgaacgtgggtgaggacgggatttatcccctggcagtgaaagcagaggcatttcccgtcaactcaaatgacggatcccgtaatactcagataactctagccgtgttcgagaaagacatcctgattctcaccctctttttcctccgaaaatcatcggagaagctcattcattgcttcttacctatggataatctcacatggggcatatttcaaatctcatgtaatcctccatggctttaaaaggtgtcttaaaaagtgcagtatttgatttcaagcattttagtgtctgtttttgcagcactttgagacactatttgcagtgaaaacaaaacanaaacaaaaaaaaaaaaactcaaaaac

SEQ ID NO: 9328 - DNA, 544 bp, Gossypium hirsutum
  Clone ID: uC-gsflmaxxa004f06b1
cccacgcgtccgcggacgcgtgggcttcactccacatttgacactctttttcaactttctcttcttctctttgttttaaagaggggctggagttttagccaaagaaaactccatggctaaacttgttgctactttcttcttggctctcattgccatctccatggttcaaactttggttatggcatcacatggacatggcggtcaccattatgataacaaacgttatggacctggaagtctcaagccttaccaatgtccatctcagtgcacaaggaggtgtagccagacacagtaccataaaccatgcatgttcttctgtcagaaatgttgcaggacatgcctttgtgttcctccagggtattatgggaacaaacaagtttgcccttgctacaacaactggaaaaccaaggaaggaggccccaaatgcccttaaattgctcaaaagaagaccctttttttttacattattatccctataaatttcctatttgaaattcaagtcattgaagcataagggtgcactgtaatactaactatatatttt

SEQ ID NO: 9329 - DNA, 503 bp, Gossypium hirsutum
  Clone ID: uC-gsflmaxxa004f07b1
cggtcgcgtggggaaacaatggagtccaacaccaaaatgtcagctcttcttttgatttgcatgcttttcatttcttcagtgacaccaattcttgggtgtggttcatgtgggaaagcacacaagcatcgaaagcctaagggaaagtcccctaaaggtcccatcactttgcctccccttgtgaaacctccaatcaagttgccaccggttgttcctccaatagttaagccacccattgacctccctccggttacggtccctccaattaaccttcccccagggacggttcctccagtaactaagccaccaagtgggaaaccctgcccaacaccaccaaccaaggacacttgccccattgacacactgaaattgggtgcttgtgtggatctgctgggagggttggtgcacattggactaggtgacccggctgtgaaccaatgttgtccggttctttcaggactcgccgagctcgagctgcggtctgcttgtgcaccaccctcaaactt

SEQ ID NO: 9330 - DNA, 529 bp, Gossypium hirsutum
  Clone ID: uC-gsflmaxxa004f08b1
cctacgcgtccgcgaaaaaccaaaccccaactaagaaactgccataaaagtaaaacaaaacatcgaaaagtcaaaccaagccacctcttcctgaaaatcttccagattttctctcacaaagtacccctttttttccctgtgtctcaaagacccagaaaaagcttcgcccctttattcttgttcacaaagatgtctttgcattgggcattgatatgccatgggttgataactcttacaatagttgtttccttcctttgtgggcagtggcctatcttccaaggaacacccatcagctctatccatcgtttcctcactttcggagcttatcaatacttcctgaggtttattggggctgtttttggagatagaggaacaaatttgatcctttccgttgagtattattgttgtgataggcctaatcctatcttacagcttatatacttggcaataattggaacgacttattacattatagtgaagacgtcttttagctatattcctgggtactatctgagtgaagttcataggt

SEQ ID NO: 9331 - DNA, 536 bp, Gossypium hirsutum
  unsure (1)..(536): unsure at all n locations
  Clone ID: uC-gsflmaxxa004f09b1
tcgcttacgcgtccgcaaaacccaagccaactcatagcaaagaaaaacacagcaatggagagaagcaaggcgatgatgatggcagtggcagctgtcggattggctttagtgctaatggtgcctcaggccgatgctacaaggtacattgttggagggggaggcatcggttggactactaatgtcaattacactgtctgggctcgaggaaagcacttctacaatggcgactggctttattttgtatatgatcggaaccagatgaatgtgctagaggtgaacaagactgactacgagtcatgcaatgctgatcatcctcttcacaactggacaaccggagctggaagggatgtggttccgcttaatgtgactcgccactactatttcattagtggcaaaggattctgctacggcggcatgaagctagcagtgcgtgttgagaaccctnctccgcctccaaaagctgctccattgaacgaaaagagtggcttctcaccaagttccattgtctacagaggccagcttgttttaccagctgc

SEQ ID NO: 9332 - DNA, 274 bp, Gossypium hirsutum
  Clone ID: uC-gsflmaxxa004f11b1
cctttgcgttcgaaaccttttaccctatctatttgggataattcaggtctcaaatctgttggcccgaagcgacatgattaccggtggtttgccacaccaattgtattgggcaggagccccttccacactggagagacttcactcaagacagcgttcgtgctgtcaagtcgtggccacaagcccgatcgtaaagagttcacgacggtccactacaaaagcagtattttgcatcgtggtgatgggatctttatgagtcttggtggagattatcttt

SEQ ID NO: 9333 - DNA, 434 bp, Gossypium hirsutum
  Clone ID: uC-gsflmaxxa004g01b1
aaaaaaaatttaggagaggcaaacaaaaaagctgcatccttctcctcacgcctctgaattttgtattttatttatttattttttctctgcgctttctcagcaaccaaacacatccttacacaatcattttactcttttgaatgagtatacacacttggcttctttgaaggttttaacttaaagaagagaaaatttggctttttccagcattttcatctactgcttctgcactagtcttaattatttggactctcgagctgttctacggttttgagatcgatcgaagctttcaattactcacttggattttgaaggagttccttttttctaaaaaaatattttattcaggttcttaggttctccaaattctgatcccatgggatatgctgatgtaaattacggaaacaatgctgtaaacagcttgagtgccccct

SEQ ID NO: 9334 - DNA, 495 bp, Gossypium hirsutum
  Clone ID: uC-gsflmaxxa004g02b1
gtaacccttaaggaagggaaaaaaatgtcaaaccttgaaaaccctagaaactggcggttcacatgggaagcgcaatctcattctccaaatctgcgtttgttcctcttcgattctcaagcaaagccttcggttcaatgcagaaacctcgaagttcaactcaatctttctcaatctcatcttctcgtttcgtggctaaaagagggggagaaggaagaggtgtcggttagggtctctactccaagagttctgatagattctgaagctccggtgagttttagagctttggatgatcacattgaggttaagcttgctttgcttcttcctgttgatcatccaagcgtttccagctttgatttgatgttggattcgtctggaaatggctataatgacccctcattggatgctgcacagccgctgctgatggatactgatttgcagagtctgtcatcaatggaaggagtacacttgtattgcagaaaatgctccactaggctg

SEQ ID NO: 9335 - DNA, 546 bp, Gossypium hirsutum
  Clone ID: uC-gsflmaxxa004g05b1
ccctcgcgttcgcccacgcgtccgatgagatcaaaccaggagatcatatttacacttacagagctgttttcgcttactctcatcatggtatctttgttggtggaagcaaggtggttcattttagacctgaacgtaacttggattccagcattgatacatcttctaatctattagatccgacattccctcaatcaacttgtccaactttccctgattgcggcttccggcagccaaacagtggggtagtactctcatgcctggattgtttccttcgaaatggatctctctactgttttgaatacggggtgaccccatccgttttccttgccaaagtgcgaggaggcacatgcaccactgcagcctctgatcctcttgaaacagttatccaccgggcaatgtatcttcttcaaaacgggtttggaaactatgacatattcgagaataactgcgaggattttgctctgtattgcacaactggtcttctgattctagacaatctaggaattggatgagtggtcaggcctcttccgtgataggtgccccatt

SEQ ID NO: 9336 - DNA, 487 bp, Gossypium hirsutum
  Clone ID: uC-gsflmaxxa004g06b1
ccctcgcgtccggccaaaacccccaaaaaatgaatgatgaaaaatacatcatcggccggccgccaacattaacttccgatcaattccccgatagctttcccccacttttcctgactttctctttatccaaacaaaccccatctctctcacccaagctacaaaatcaaaagtaaaaattaaatccttctaatggatttcaacgaactagaagcaatcgagggcctacggtggccgtggcattcatggcccacaacaaaacctgacgcttcctcattaacgatcccactcgccgtcatgtgcacgccgttgacggagttctcggagctcccaatcctcccttacgaccctctcatttgttccaagtgcggcgccgttttgaacccgtacgcgcgcgtcgattacacctgccgtgtctggtattgttctttctgcttctccaaaaactctttccctcgaacttactcttcttccttcgaagaatccaacc

SEQ ID NO: 9337 - DNA, 469 bp, Gossypium hirsutum
  Clone ID: uC-gsflmaxxa004g07b1
ccttcgcgtccggttgtctctctctctctttctctctctctatctaaaaactctctcaaaattcagaaagctatttcttttttctttggtgggtgcctgagattttaaccggcaatatttttccactattcctcgggaatccctcgtcttcttcttcctcacaatcagtatctcctccttcgcaggatataatggtccaggttttcaaggtctggtttttgatctgatagaactctgactctaaaaagtgaaaataataataataataatggcggatgagacatattcagggctagggaatgggggtgaaatagataccaaagtggtgcagacatttcagaagaactttgtgcaggtccagaatatattggaccagaacaggttgctgatcaatgagataaaccagaaccatgagaccaagatccctgacaacttgaccagaaatgttggtctaattagggagctcaac

SEQ ID NO: 9338 - DNA, 503 bp, Gossypium hirsutum
  Clone ID: uC-gsflmaxxa004g08b1
tcggattgatcaaatctcccccctccccttgtgtttcgtggtgatcaacagtttagggtttttgttctctttctgaacaacaaaaatggtggggactactgagggagtggattcatctgcctccaacaacaagaagaaccgtatccaagtctccaatacccagaaaccccttttcttctacgttaacctggccaagaggtatatgcagcaatacaacgaggtggaactctctgctcttggaatgggtattctttttttgcttttcttcacacttgcattctatttcaccttgttttctgtttagattttgagggatttgaatatgtcatttacattgatagcttccttacaaggaacaaagtgaacgttttgttttataaaacataggttgaaatacaacacattaccttgacatacatacatacatgctatgtgtacgtcatttatggcatgtaatttatgctactgttgcaatgccagattagtactcttagtttagaatg

SEQ ID NO: 9339 - DNA, 539 bp, Gossypium hirsutum
  unsure (1)..(539): unsure at all n locations
  Clone ID: uC-gsflmaxxa004g09b1
tcgattagggcaagagtttggtggaatgtattgcgtggttttgattgtgaggtccctcgttgtagctggccttcttagaatatttggtcgggaggttgccgagctccctattgtagctacaagtagaaaacatcaaggaaaaggatatttgcaggcattatttgcttgcattgagaatttactaagttccctgaatgtcgaaaacctggtgctcccggcagctgatgaagctttgtcgatttggacgaagaaatttggcttcacaaagatgagtgagcagcaagtaagtgccgtctaaatcttttacctttacaagaaagacttgaataaactttccaactctaacatgaacaccgaaacttaactcaccttgatttaaccataaagttaataacctgaatccaacccaaaattaactcaaactcgaaacaatgtagacctaagatagtctggatctgaactngaaaatgagaagtaactttaaactaaacagaatcgaagtggtttaaatttaaaactaaacctgagttgactcgaac

SEQ ID NO: 9340 - DNA, 473 bp, Gossypium hirsutum
  Clone ID: uC-gsflmaxxa004g12b1
tcactgacatcgaaggggttgactcaactaatgcgtgctatggtgggactgcagctttatttaactgtgtcaattgggttgaaagtagttcatgggatggacgatatggtcttgttgtctgtactgacagtgcggtctatgcaggtcgaaaatgctaggaagcacctatgtcttctggagcagccacaagatcaaactgagttacagaagttgcaggccgtggaaaagcatctttgcaagtgtacagatgctcggagaattagggactggaagagtgcattaagggaaactgatgctgccattgccactggagctgacttttctcctcagctttttatgtgtagagtggaagcccttttgaaactccatcaactcgatgatgctgaatcaagcctttcggttggttctaaattagaaccatgcaccaactcctgttcacagactaagttctttcggatgttttctgaagcata

SEQ ID NO: 9341 - DNA, 551 bp, Gossypium hirsutum
  Clone ID: uC-gsflmaxxa004h04b1
cccacgcgtccggctaatggaaaaaagtgaaaagggtaatggtgttgctcctgctacaaggtctccaatggctttaatggggtcatctagaaatgaaaaccaagaagtgaataccagcatgagaactgccgagaccatgctgcggttggtgcctatggctttaggggttgctgcacttgttgtcatgctcaaaaactcacagtccaatgactttggctccgtttcatactcagatcttggtgctttcaggtacttggtgcatgctaatggtatttgtgcaggctattcccttctttcagctattatagcagctgtgcctagtccttctactatgcctagagcttggactttcttcctactcgatcagattctaacatacgtaatcttgggagctgctgctgtttcaaccgaggtgctttacttagcaaacaaaggagactcagccatcacttggagtgcagcttgtgggacatttgctggtttctgtcataaagccacaatagccgtggtgatcacgtttgttgcagtcatttgttatgcggtgctatcac

SEQ ID NO: 9342 - DNA, 516 bp, Gossypium hirsutum
  Clone ID: uC-gsflmaxxa004h06b1
acttcttttttcccctcggctagtcggcgaggacagccgccaccaggagcagttactttctagaccatcaaacaccaccttcacgcccggcatcgatgacatcccaccgatcaacggcgtccgtgacttcttcagagaatacctgatagagtccaagaagctctggttccttgctggccccgccatcttcacatctctctgccgatactccctcggcgctatcactcaagtcttttccggccaagttggcactctagctcttgccgccgtctccgtggagaattcagtcatcgccggtttctcctttggcgtcatgcttgggatgggaagtgcactcgaaactttatgcggccaagcatttggagcagggcaggttgatatgttaggggtgtacatgcaaagatcatgggtcatcctcaactcaacggctttgatgttaagcttgttatacatatttgcggcaaaatttttgagggtaataggccaaacagaaagcatatcgaaggcggcccgaat

SEQ ID NO: 9343 - DNA, 534 bp, Gossypium hirsutum
  Clone ID: uC-gsflmaxxa004h10b1
tcctcgcgtccgaaaaaagttaatttataaattatatagtaacataataaataatgacgtcgttgttttggagaggtcttattatattacctcttctttttgtatatgtcaacggcgagcattttttgtaccctaaacgtcatactggcaaagccgagttagccggttacaaggggccagactctcttgccgtcgacggtggtggtttctatagcggtcccttgattgccgatgacgatggatctactgctgacggcaatcctggtggaactaccgaggtgaaggttgaaaaccttggaaaggccgacggtgataatactaatggcagtgcaaatagtgtcgaatcgactcaagttgctgccaaaaatggaattggcaacggaaatatttttgaggctaaaactacgtttaaagggagttgggaattgtttgttgagaacgccggtgtttccgccatgcatttgatattgctttctaagatcaacccagctttgatgttcgatgccacagtgtggaaaaatctcacagatgaaa

SEQ ID NO: 9344 - DNA, 427 bp, Gossypium hirsutum
  Clone ID: uC-gsflmaxxa004h11b1
cgtatcgcgtgggctttgcctttgcctctgctgcagccaatccacagccgtttaacttctccttttcttcaaccctcgcctccgcctggtttctcccatcttcttctcctctctttgaatatcaaggttttgcagattgttccactattcttttcctaaatgagaggcaggagttatactccatctccgcccagaggctacggtcggagaggacggagccctagccccagaggccgctacggcggtcgcgctcgagatcttcctacaagccttttggttcgcaacctccgccatgactgcaggccagaagaccttcgcaggccattcgaaagatttggccctcttaaagatatatatctgcccaaggattattatactggggaacctcgagggtgtgcctttgcccaatatgttgatcctgctgatg

SEQ ID NO: 9345 - DNA, 530 bp, Gossypium hirsutum
  Clone ID: uC-gsflmaxxa004h12b1
cccacgcgtccgcagttacaaaaaaatctttcctctatctgctatcattttcaattcacttcttatttgaaatctcttcaacctaggttccttggccattcctcttccaaagcaacttcattgcagatcggcacatcccttaccagggcctctgctacacacggacatgaaacattggcatgaagggtcattttttaggctttaatctctcccctccagtctcgaatgtcaaaagctgcatcgaactgtactatgtcccttgttgtctcctctctttgcccctgtgttctagcaatccccaaggtacgctttttctttcctactccttctagttctgttaaatagctctgtattttctgtactagatcccttcctgatgcgagttttctttcatgcaacatttggttctgcaagctccatataatccacagagcacagcaaaacatctgacactgttccttagtgccttttttgaaaacccaaggcattgctgaaagacatggaagctatcctctttctccgagcaacat

SEQ ID NO: 9346 - DNA, 527 bp, Gossypium hirsutum
  Clone ID: uC-gsflmaxxa005a02b1
attataactcactcttctgctcacctacttccaactaatacccttttctcttcttcttcttcaactgagactgcttataggccgtgttctgggatgtgcagtggttcaaagagtgaacataagccctcaagtttcatcatggaaggtgaattacaggagccaaaagccggttctcaatcaattttgctcgaattggctgcatctgatgatctagtagccttcacaagcgaagtagaagagacaggtgtggatttcggggaggcgagcttctggtatggccggagaatagggttgagaaagatgggatttgaagagaggacgcctatgatgatcgcagccatttttggtagcatcgaaattttgaaatacatcattggcagtggcaagattgatgcgaatagagcttgtggcagtgatggggctactgcccttcattgcgctgttgctggcggtgcacattcttcggttgagactgtcaagctgctgcttgatgcatctgccgatgtgaattgtgtagatgctaatgg

SEQ ID NO: 9347 - DNA, 416 bp, Gossypium hirsutum
  Clone ID: uC-gsflmaxxa005a06b1
gtttgatagtgacatcatttatatccttaactagttcgtataatcatttgttcgaataaactcagcttaatcttgacataaaagaatgggtctctcacgtctcccagcccgatcagaaggagagctacgagtactcttggtaaacacagctttatccatatctatggataaaggcataattcgatcaatccttcacattatcggtctgcatctgtcctcgtcctcgacctcctcctcctgctcgtcatcatcatcatcatcatgatgatcgccatactcggatcttattgaaatccctgcggtatcattcgacatcagcatcggtaatgctgatagctacattaaagagatccggagcaggatgccatcgacccggtacgatgcggtatgtagcggcagtcaaccggagcatgact

SEQ ID NO: 9348 - DNA, 467 bp, Gossypium hirsutum
  unsure (1)..(467): unsure at all n locations
  Clone ID: uC-gsflmaxxa005a10b1
cctacgcgtccgcacactctcattctctctctgtatttcctttgactctttaatggctactttcttcttcttcctcctttccttccttatctgctttcacttgtcaagtgctgagccggttattggagtgaactacggccaagtggcggacaacttaccgccgccgtcagccaccgcgaagcttctaaaatcgacgtcgattgagaaagttagattgtacggagcggatccggcgattatcaaagctttggctaataccgaaattgggatcgtaatcggagcggctaatggagatattccttctttggcttccgatccaaactcagcagctcagtggattaactccaacgtgttgcctttttaccctgctagcaaaatcatcctcatcactgntggcaacgaggtattgactacaaatgacccgaatttaataaaccaactgctacccgcaatgcaaaatatgcaaa

SEQ ID NO: 9349 - DNA, 444 bp, Gossypium hirsutum
  Clone ID: uC-gsflmaxxa005a12b1
gttcgttttcttcctcccaactaatccgtggaataaaaaaccctaacactttaaaacccttaaccattaattcttaacagagagacagaagtcgattactaattcttgtttgtttgtattaatatttactaattgtttataatctctccgataacagcaccgaaaatgagtcgatacgatagccgttccggcgatcccacctcttaccgcgatcgtagaagtgactcagggtttggtggggcttcagcttatgacggttcagtgcggtcctcatcaagcagaagggattatgatggtgctgaaccgcctaggaagttggatttggatgggttgaccccttctgagaagaatttttatattgagtcaccatcagtggcggcaatgtctgatgcggaggctgaggattatcggcggcgaagggaaattacggttgaaggtcgtgat

SEQ ID NO: 9350 - DNA, 523 bp, Gossypium hirsutum
  unsure (1)..(523): unsure at all n locations
  Clone ID: uC-gsflmaxxa005b01b1
cctatttcttcttcttcactttgaggtttgagcagatcgtatggcaccaaagaaagacaaggcccctccaccttcttccaagccagcaaagtctggtggtggcaagcaaaagaagaagaagtggagcaagggaaagcaaaaggagaaggtgaacaacatggtgttgtttgaccaggctacttatgataagcttttatctgaggctcctaaatataagctcatcactccctcaattttgtctgatcgtatgaggattaatgggtcccttgctaggaaggctataagggaattgatggcaagaggatcgattcgtttggtgtctgcccattcgagccagcagatttacactagggcaaccaacacctagatcctttgttatatttttgcttaaattagttctatgtagtatttgcctttcttgactntctataaatgatttttccttttgctaaagacctccatctaaattgtgtgagctacagtttcttgttgtactggtctaatggataagtttttgttcctc

SEQ ID NO: 9351 - DNA, 232 bp, Gossypium hirsutum
  Clone ID: uC-gsflmaxxa005b05b1
gtcccatcactttgcctccccttgtgaaacctccaatcaatgttgctcaccggttgttcctccaatagttaagccacccattgacctccctccggttacggtccctccaattaaccttcccccagggacggttcctccagtaactaagccaccaagtgggaaaccctgcccaacaccaccaaccaaggacacttgcctcattgacacactcaaattgggtgcttgtgcggat

SEQ ID NO: 9352 - DNA, 414 bp, Gossypium hirsutum
  Clone ID: uC-gsflmaxxa005b06b1
cccacgcgtccgcccacgcgtccgatcagaatttcacaaaagatcatttgaatgctcagttgactctatccgggctatcgcagctagtcatctttggcagcttgtggctgcgcgtgctgacttgaatggccacttaaaagctctaaaggactattttcttttggcaaagggagactttttccagtgcttccttgaggagagccggcagttaatgcgcctaccgcctcgccagtcaactgctgaagctgatcttatggttccatttcagctggcagccataaagaccattggggaggaagacaagcactcgtctagagtatctttgcagatgccttcatttgggatcacagtgaaatcctctcaaagagatataccgaagacaaaagcatacactgatggaagttcagagacctc

SEQ ID NO: 9353 - DNA, 558 bp, Gossypium hirsutum
  Clone ID: uC-gsflmaxxa005b08b1
gtttaatcagaatctttccttcttcgattttttcgtagctttcgacgcttaagagaagtctggtattctgcagttaatgtaacaccctagtggattaaacctgtttctgtgtctgaaaagtgaactaagtcatccatgtttcaattcaatatggatagcaaatttaaaggcatagtttgggttggtaacatttatcagaggtttgaagctttgtgcttggagatggatgatatggtctgccaggaaacattccaatacgttgaagaccagttgcagactgtgggagctaatgctaggcaattctgtacagaactaatgcaagaagtgctcccttcatctcctaccaattcgaaggaagaacttaacttgtctctattgcaaaatgctgctgtcacagccaataaagattcaaacataaatgttcataaagattgcattcagaaagaactgagccatgtcagatatattaaaaatatacatgtaggttcatcttcagggcacagcacagagaatgagcgtggcttggctcaagcatgcaagaatgaagctcatgacact

SEQ ID NO: 9354 - DNA, 274 bp, Gossypium hirsutum
  Clone ID: uC-gsflmaxxa005b12b1
tcgatccgcgaaagtgaggattggagatacgactgacggagacgaaataaagattatgacagacgcttgcataagagccgatgtggaatctatccactcttgtgccacacaggccgtgctctatctgtccggcggcgcctctctcgccttggggttgttgatgtcagttcctggagcttcaaatacggcgctggaagctgctgtgccatactgcagaatgtgcatgatccaattactggctaagatgcctgccaagtattgtagtcaacaaact

SEQ ID NO: 9355 - DNA, 277 bp, Gossypium hirsutum
  Clone ID: uC-gsflmaxxa005c01b1
ctcactttttcgaggacacagggtgggaggtatgaactggcctcaacgcaagatctttctataccatgtcacctttggactctacatgctggatatggagggagcggtgccttatcagaatgctttgatctgatgctcttgcctgaagagaaccaatctggctcaggatttgcacacttcaaaggtggttgtagcaatatgttgctcatctattacctaacaaaagttaaagcatggtcatttttttaatgcctgtgtcctgattaatactgttatt

SEQ ID NO: 9356 - DNA, 276 bp, Gossypium hirsutum
  Clone ID: uC-gsflmaxxa005c05b1
ctcggtaaccgcccccggttgagagcaaattgccttgcacccttgaagagctgtatactggttcaacaaggaagatgaagatctcaagaactatagttaatgcatcagggcggcaagcacaggaatcggaaatattaaccattgatgtgaagccagggtggaagaaaggaacaaagattacttttccagataaaggaaatgagcagccaaatcagcttccagcagaccttgtttttgtaattcatgagaaacctcatgatttctacaaaagagatg

SEQ ID NO: 9357 - DNA, 406 bp, Gossypium hirsutum
  Clone ID: uC-gsflmaxxa005c09b1
atgagactgagttcatttatgggcctacggtaatccagggaacacgactctccaccgcttatcaccaaatccttatctttaattcccttcctcacttgttgtcttgttgctccactgtgcacggtttccatatcttttctctcctccattccccaataatttctttccctttttaatgttcttcttctcccccattttcactcccttttagcttcaatttggtgggttctttggtttacttttcaagggtttctctcttcaaaaaaaccctcgagaaatctatgcgcttaacgcttactttttgattcattcgaggggttcttttccttctcttcttcttgttgttttagagatgggtttggtgactgttttttgggagattctaaagaaacccacaattggagat

SEQ ID NO: 9358 - DNA, 156 bp, Gossypium hirsutum
  Clone ID: uC-gsflmaxxa005c10b1
tggtggcctcgggaagagttatcttttctgggtagcggcctgcccaccctggaaacggctcaaacagaggaagggaacagcggacgaacgatcgccatagcgttcgtgtagcaagcacagtaattctgtaattttatattcatttgacctttattc

SEQ ID NO: 9359 - DNA, 302 bp, Gossypium hirsutum
  Clone ID: uC-gsflmaxxa005c11b1
ttggtcaccgccacagcagcacattaatgtgggttggatagagtcaagaaaatgttcgttgatatccaatctaaactggctggagctccacagtttcttctttgccttttacctgataggaaaaattctgatctttatggtccatgggagaagaagaattctctctggagttcggatttaccctcacagcctggctccaattagggtcaatagatcttctccttaccaaccctgttttttaaaattcaatgcaaagcttggtaggacttgtattccattgataaccaattgtgccaaacacc

SEQ ID NO: 9360 - DNA, 285 bp, Gossypium hirsutum
  Clone ID: uC-gsflmaxxa005d02b1
ttacttttgggggttccagcgaggaacggcagaggggataacctagaggttcattgctagtctatacaacctgaaacaggaccatcatatgaaaaatgtaacccgatgtttcgtttgcttggggccactggccatccgcctggagagacggtgttaataccgatattatagcaacataactaacaaatccaactgcacgcccttgtgctttgatcttttttggaaagggagtgtgcgcaagctgtttatttcaagaacactctgcactcaccacacctcgatctt

SEQ ID NO: 9361 - DNA, 246 bp, Gossypium hirsutum
  Clone ID: uC-gsflmaxxa005d03b1
tttggtgtttgaaacaaggaagttcagcagcataatgtgagctctacgcatgatctgcctgtacaacgtcaccttaggactctacatgctggattggggggagcgttgccttttcagcatgcttttttctgcttctcttgcctgaagagatccaatctgtctcaggatttgcacacttcaaaggtggctgaaggattctcttggtcgtttgttccctatcaaaaatggaagtctgtgcattttttt

SEQ ID NO: 9362 - DNA, 447 bp, Gossypium hirsutum
  Clone ID: uC-gsflmaxxa005d04b1
cccactcgtccgaattggttacttttagttcttatccccttttaaatccaccggaggtttctaatgctgggaggcatctctctgctgccgagttccattctgttcttcaaagtgctcggcaacttatgaagaatggaagtcctaccgatgataagcagctggttctattggatgcaagaaatttatatgagacgagaataggcaagtttcatgctccaagtgtggaaacactagatccaggtatcaggcagtacagtgatctgccctcttggatagatgataattcagaactgttgcgaggaaaacatgtcctcatgttagtattctaaatcctgataatgttctgccgatgtttattccagttctttcacacctgcccctttattcttatcaagttaaggagtttgcaatactctctatgcgtgtatgctgcattcaattaatgtt

SEQ ID NO: 9363 - DNA, 296 bp, Gossypium hirsutum
  Clone ID: uC-gsflmaxxa005d05b1
atcgtcctctttttcatgcttctatacttaccaacccgatctccctttgacaaaatagagagaaaatagagaggcctttcgatcgtttcttcggcgatatcggcggcgatagcagcagcttttatggtgaggcgaaggagcggcctattgaggagttttacaatgcgatcgagataatctatgaaccagtggcatgacatggagagtcccgattccgagagagtagccgatattattcggccgcagattagcgctaagctactccatggatgcattgcttcgtattacccgtcctt

SEQ ID NO: 9364 - DNA, 350 bp, Gossypium hirsutum
  Clone ID: uC-gsflmaxxa005d09b1
tcgcttttttcaattcataggttaagaggtatgaactgggttcaacgcaagatctttctatacaatgtcacctttggactctacatgttggattggtgggagcgttgccttttcagtatccttttttctgtttctcttgcctgaagagatccaatctgtctcaggatttgcacacttcaaaggtggctgaagtatttttttgttcatctattacctaacaaaagtcaaagtatggtcatttttttaagcctgtgaccagattatactgatattgttatacaaggagctgccttgcgttgcctagtattttctgatcggttgtggcatcaatttaactcttcccgatgttt

SEQ ID NO: 9365 - DNA, 348 bp, Gossypium hirsutum
  Clone ID: uC-gsflmaxxa005d10b1
ctcggtcaaaaggaatgcgtttctctagttggatctggctcaccatatgctcctggggtgctggatactggctatcggtatgatacgtcctgggaccattctgcactgcaaaggcctcggcctcttatgaaggccgcatgccctaccgatgacagagagctggctctattggatgcaagaaatttatctgagacgagaacaggcaaggttcatgctccaagtgtggaaacactagatccaggcctcaggccgcacagcgatctgccctctcggatagatgataattcacaactgttgcgaggaacacatgtcctcatgttagtattctaaatccctgtcatgctctgt

SEQ ID NO: 9366 - DNA, 455 bp, Gossypium hirsutum
  Clone ID: uC-gsflmaxxa005d11b1
atcgttcacgcgtccggcaattggtcgggctaggagaggagagggtccaacgttggtcgaatgcgagacatacaggcttagaggacactcattggctgaccccgacgagcttcgtgaccctgctgagaaagctcactatgctgcaagagatcccatcacagccctgaagaaatacctcattgagaacagtctggccagtgaagcagatttaaaggctatagataagaagatagatgaagtggtagaggatgctgctgagtttgcggatgaaagccccgttccttctcagagtcagctgctcgaaaatgtctttgccgatccaaaaggttttggaatcggaccagatggtcgatatagatgtgaggatcccaaattcacagaaggcactgctcatgtcttagctttcaaaggacaagtaccaaaccatttatgcacaccatttggccttacttgaa

SEQ ID NO: 9367 - DNA, 61 bp, Gossypium hirsutum
  Clone ID: uC-gsflmaxxa005e01b1
gagatggagaagaagacagaggcagggccccgggaggcttttatttagacaccctttcctt

SEQ ID NO: 9368 - DNA, 124 bp, Gossypium hirsutum
  Clone ID: uC-gsflmaxxa005e03b1
cttgttgaaaaatcagaagctgaactaatgaagaggaccaatttacacatgaccggtcattatgcaccaacatcaaacaacagtgaaccccattattatgctgctaacctactaactatagaac

SEQ ID NO: 9369 - DNA, 248 bp, Gossypium hirsutum
  Clone ID: uC-gsflmaxxa005e09b1
tcgctcacgcgtccgaaaaaaaaaaaaaaatagaaaatttactctcaactccctcttcccttttgaatctggcctagctccggtcagtacccctggcgccggaccggtcatcgtcctccgcgccggccaccgtacacggtggctggaaatctccaaaaaggtgctgtcagaggtgtggaggaggccggtggcagcattgcagcggagaaggtgccgacacaacgtgggggagcggcgcactaggggtt

SEQ ID NO: 9370 - DNA, 296 bp, Gossypium hirsutum
  Clone ID: uC-gsflmaxxa005e10b1
tgataaaaaaaaaaaaaaaaaaaaaaaaaaaaaaaaaaaaataaaaggggggcggccgtataagaaacaagctgacggccgcctgcatggagcgacataagacttctatagtggcggctcaattctttaaagggctcgccgttttacaacaccgtgatgggggaaacatctgttgttaccgcgctacataatcttgttgcacagccccctttttccagctgctgtaataggaaaaaggagggctccacccaacttttctaccaggagatgagcccgcttggcgaatggggggaccc

SEQ ID NO: 9371 - DNA, 281 bp, Gossypium hirsutum
  Clone ID: uC-gsflmaxxa005e11b1
tcgatgctttccatcaatcaaaatgaatcattcaatttcaaacctttcttcttcttcttcttcttcttcttcttctttatggttcaactacacatgcactattttctccttcatcttcttcactttcacgttctcattttccctcttttcattatcaatcttcattttaagattaaaactatggcgtaaatgttcaacttgccaatcattcctcacttcaagttggtccaaagatttcaataacctgtgcgattggtatacttaccttctttcaaaatcgc

SEQ ID NO: 9372 - DNA, 190 bp, Gossypium hirsutum
  Clone ID: uC-gsflmaxxa005e12b1
tcgataactgtaagaaaaaaccctagcgtctaccataaccagcaattagcgtccgcctttgatattcgtgaaccatgatgaaaattaagaccccaaagaaaggaagagtcaaaagggaattcgattaacgagcgccaaagctagcggaaacaggaaagaaaacactgatgcttcaaggaacaaagactag

SEQ ID NO: 9373 - DNA, 148 bp, Gossypium hirsutum
  Clone ID: uC-gsflmaxxa005f11b1
tcggatacacacaagaaaaaaaaacaagtgatctgataaattgaagactttatttctgttaacatccattatgagtactgctggtcaagtcatccgctgcaaagctgcggtagcatgggagtcggggaagccactgtcaatagaggaa

SEQ ID NO: 9374 - DNA, 88 bp, Gossypium hirsutum
  Clone ID: uC-gsflmaxxa005f12b1
ggcagggaccgggccggaacgcccggaccgacccacccgtttcaataacaccccacgcgacagaaccccagggggggggaaaataaaa

SEQ ID NO: 9375 - DNA, 72 bp, Gossypium hirsutum
  Clone ID: uC-gsflmaxxa005g03b1
attcatccaatcgaggagaacccccccccggacaggactaattaaaaaaccccgccgttaccgaaagagaag

SEQ ID NO: 9376 - DNA, 335 bp, Gossypium hirsutum
  Clone ID: uC-gsflmaxxa005g07b1
taaatatgcttccagaatatgaaacttatttggatttctttatgcctcaagttcccatcttcccccccccatctagaccttgctgcccccccaccccctcctccccctcccttcccccccccccccaccccatccccaccccaccctcaccattccccacctccccctcaacctcctttacccctccccactccccccccctctcccccttcctcctccctctctccccctcacctcaacctctcaccctccttctcccccccctaacctactcctcacctcactctccctctccccccactccctcctcccctcccctcccccctccccccccc

SEQ ID NO: 9377 - DNA, 96 bp, Gossypium hirsutum
  unsure (1)..(96): unsure at all n locations
  Clone ID: uC-gsflmaxxa005h10b1
agtaatgagccccaaacaccccnccgaacacnagaggggttaaaagagaccagaccggccgttcaccccaagcaacgccagggaagagaccacgcc

SEQ ID NO: 9378 - DNA, 74 bp, Gossypium hirsutum
  Clone ID: uC-gsflmaxxa005h12b1
ggaccggcccggaaaccccgggccgacccacgcccccggataaataacacccgcccgccgcgcaaccagggggg

SEQ ID NO: 9379 - DNA, 480 bp, Gossypium hirsutum
  Clone ID: uC-gsflmaxxa006a01b1
attttgtagaagaaaaaaatcctcttttggttttttattgaggaactcctaaagtaaatacccaaaatttctgcaaaagtttccgatcgaaaaatctgaaaaaaccatgtggcgaaactccgccactgtaagcttctcttcgaagcttctctcttattcttcttcctccgccaatcctaattacttccattacgcatctgctttctccatctttagtccaaacggcgttgtagatcagacgctttcttcttctcatcaacgcttttactgctcatcggcggtgccttcgccgtctccctcatccggttccgttataaagctaggttttctcgctagcaaatctgacgcctttcgccctttgtgtttgaaagctagagatgcggtccagcttgctcgtcactacggtcggtgttactgggagctctgcaaggctcgtctcagtatgctggtggtggcgacttcggcgactggatatgtgct

SEQ ID NO: 9380 - DNA, 481 bp, Gossypium hirsutum
  Clone ID: uC-gsflmaxxa006a02b1
cccacgcgtccgcccacgcgtccggacggatggaaactaagagcagcggcgtagccggcggcggatcagtctcagagtcgtcgaccatgatactccacaacgcggtggtcgtcacaatggattctgattgccgagtctttcaaaacggagctgttttcatcgacaaagacaaaatcaaagccatcggtcaatctcccgatattcttcaacaattctcccatgtcgctcaccacatcctcgacctccacggtcaaatattgcttccaggattcgtcaacacacacgttcacacttcgcagcagctcgggagaggaatcgccgacgacgttgatctaatgacgtggcttcaccatcggatctggccgtacgagtccaacatgaccgaagaagactcttacatctctactttactttgcggagtcgaacttattcatccgggtgtcacgtgcttcgctgaagctggagggcagcacgtgactgg

SEQ ID NO: 9381 - DNA, 490 bp, Gossypium hirsutum
  Clone ID: uC-gsflmaxxa006a04b1
gagaatttgaacatggggagataaatagactggaagcactcttggctgagggccgaatcttctgtgatatgccagccttagctgatagagacagcattcttttaaaggatacccatcttgaaaatgccctgatctgccaaccacagcagcgcaacattcatggtcgaatttttggaggttttttaatgcatcgagcttttgagttagctttctcaacagcttatgcatttgctggactagtaccttgctttttggaagttgatcatgttgatttcttaaggcctgttgacgtaggggatttccttcgtctaaatcatgtgttctgtacacggaacttgagaaccctgatcaaccactaaataatgtgaaagttgctgctcatgttacaaggccggagatcagaacaagtgaggtatcgaatacattttatttcacattctccgtacggccagaggcaaaggccaccaagaatggatttaagattcgaaat

SEQ ID NO: 9382 - DNA, 309 bp, Gossypium hirsutum
  Clone ID: uC-gsflmaxxa006a05b1
ccttaacttgtcggtttatttacttactttccgtttttctcgattttctcttttattttccttccttttttcccttcgtttttttttctttgattttgatcatcaaaaaaggcttctttcataacacaagctttccttcaacttccaaagattcgttctgaaagagggaccaaaaagaaagatggcttgcttgcaaggaccggtgatctgccccgccgctgatagcaagcaagttggggtttatacgctgccgtttaatgggccttttccgaggactagattgcatcgaagtgacatatggggatatag

SEQ ID NO: 9383 - DNA, 499 bp, Gossypium hirsutum
  Clone ID: uC-gsflmaxxa006a06b1
ttcatctcaactatcaaacccagaaagctcaaaggaaaaaaaagatggctttggagatctgtgtcaaggctgttggtgcccctaatgttcttggagactgtccattctcccagagagctcttcttactttggaggaaaagaagatttcctacaacatgcaccttatcaatatcagtgacaaacctcaatggtttttggagataagtccagaagggaaagtaccagtggtgaagtttgatgacaaatgggtggctgattctgatgtaattgttggaatcccttgaggaaaaataccctcagccttgtctcaaaaccactcctcaatttgcctctgttggatcacacatatttggaacttttgtcacatcttagaagagcacagacgctaatgatggatctgagcaggctttgcttaatgaactcatggcatagtatgaacatcttaaggcacatggcccattcattgctggggaaaagataagtgcagatgatttagctt

SEQ ID NO: 9384 - DNA, 477 bp, Gossypium hirsutum
  Clone ID: uC-gsflmaxxa006a07b1
cccacgcgtccggcgtggatagcagggctcttcatttcattttctaccttgccttgcctccctactctcacctcatttcacataaatatggttgttccaaccaaaaaagctatgaaccaaaggcttgcgtcgtggacgttggttgttgggttgtttgtagtatcgcgtgtggcagagcttgagcggtttgaacacgcaggcaaaccagatgggtctctgagcttcttggtggtcggagattggggaaggagaggacactataaccaatctcaagtggcttttcagatggggaaaatcggagagcaattagatatcgacttcataatctcaaccggcgataatttttacgacaatggtctgaccggcgttgacgatccattgttccatcaatccttcactgatatttatacagctcccagcttgcaaaaacaatggtacaatgtgttgggtaatcatgattacaggggcaacgctgag

SEQ ID NO: 9385 - DNA, 457 bp, Gossypium hirsutum
  Clone ID: uC-gsflmaxxa006a08b1
cggacgcgtgggcggacgcgtgggagaggggataaacagccttaattcataaaatttcataaaattacataagagactttaaagccaacaaaatggctccattgacgataatagtggtgttttttctctgggtaggatcactacttatggttcaaggtggagatcccaccattagtttcgagtggaaggtcacttatggcaccatatctcctttgggtgttcccgtaaaaggtattctcattaacgggcaattccctgggccaaatatgaactctaccaccaacaacaatgttatagtcaatgtgtttaacaaccttgatgagccattccttttgacatggagtggcgtgcagcataggaagaatccttggcagatggtgtgcttggaaccaactgtcctatcccccccgggacgaattacacctataaattccaggtgaaggaccaaattggcagc

SEQ ID NO: 9386 - DNA, 340 bp, Gossypium hirsutum
  Clone ID: uC-gsflmaxxa006a09b1
cccacgcgtccgcccacgcgtccgcccacgcgtccgtgatgtgcaggatgaagatggatatggtaaccttgaggaatgggtcccaattttcaagcttgctatgcctgacaaacttggcatgaggtactcaggccgccaaaccgtacgaccagctcctactagctccaaaaaagaacttgctgcggagcttggggttgctgttgatgcatggcggagtgatggctgggggaaggacgctgtaaacgggtcaaacagcagtggggttcatcggccggaggagcaccgcacgtcgcgtggtgttcggtgcgcccccagcggaccttgaaaatacttaggaccg

SEQ ID NO: 9387 - DNA, 488 bp, Gossypium hirsutum
  unsure (1)..(488): unsure at all n locations
  Clone ID: uC-gsflmaxxa006a10b1
cccacgcgtccggatcgcgagtggccgccctttctttttttttttttccaaancccttgcgatatgccattcttagctgatagagacagcattcttataaaggatacccatcttgaaacagccgtgatctgccaaccacagaagagcaacattcatggtcgaatctttggaggttgtttaatgcatcgagctgtcgagttagctttctcaacagcttatgcatgtgctggactagtacctcgctttcgggaagttgaccatgttgatttcttaaggcctgttgacgcaggggatgtccttcgtctagaatcatgtgttctgtacacggaacttgagaaccctgatcaaccactaattaatgttgaagttgctgctcatgttacaaggccggagatcaaaacaagtgaggtatcgaataccatttattttacattcttcgtacggccagagggcaaggccaccaagaatggatttaagattcgaaatgt

SEQ ID NO: 9388 - DNA, 444 bp, Gossypium hirsutum
  Clone ID: uC-gsflmaxxa006a12b1
cccacgcgtccgcccacgcgtccgtaaaaattaaacaaagtccaatccaatcaaacacaattcatagaaagtaaaactccgacgccatgtccagctccgatcccaacaagctcatttccaaagccgacaaactaacaaggctaagtcttacaaggcggagtgcagattggaaaagtgctactcttttatatgaacaagctgcaaatggatttcgagtttcaaaggattatgagaaagcaaagttggcattcgagaaagcttccaaaggacaagaaatgctagcttctccctgggatgctgctaccaaatccaatcaacaccgtgtcgttaagacccccggtgggaaaattagtctatcagactactaagaagagagcgagtgggcctaagtgtcctgttactggacagcgaattcagggtattcctcacttgagacctgctgaa

SEQ ID NO: 9389 - DNA, 482 bp, Gossypium hirsutum
  Clone ID: uC-gsflmaxxa006b01b1
attaaagatggcgtctgtaataaaatctgcaatcttaattctgtcggtgtttttatctgtaagcttcagttcgggtgttaggttgctccaggaacagcccaatgatgacctcaaaaacatggaagctattcctcccattgatgcactcaaccctaccgagttcaatggacccggtgttggcattcacgaagatcatgttgtcccaaaaggttccgaaattggtactcttggttttggttttgaaggtggtcctgaaaaatgttgttcttctggatgttccggtaattgtaatcctggtggtttcgttctaccatttcctcaaattccagaaatcccaagaattccacagatcccccagatcccacaaatcccacaaattccactaatcccacagatcccacaagtcccacaaatcccactaatgccaggacagtcgggatgtgagagtgggaagtgttgccgtcagggttgcggtgggactt

SEQ ID NO: 9390 - DNA, 470 bp, Gossypium hirsutum
  unsure (1)..(470): unsure at all n locations
  Clone ID: uC-gsflmaxxa006b02b1
cttccttttaatctttatgggtactctccatgctcacctgattactctaattatgccacgaactactatagtctgtatggaggggccactggccagtatccagtgtatggtggtggcttgatgactggtgcaggaacagcattctatccctatcttcaattcggagaaggaatggccggacccgtctactcttccggccaaggatacggtgtccagtttccacaccacctgtttccttactcaactgggagctatccacagcactatggtgcacctatggctcttgcacctactccacccttgcaataaggtgtgacattggctcttcatgctaggagacttgattccaagcttatgatatcacatttcttcagctgctctaaagtctgcaaccttgggcctaaccatggntcttttttctacctctatctatatctaacttgaagcccgccgtaggggctataaatcac

SEQ ID NO: 9391 - DNA, 460 bp, Gossypium hirsutum
  Clone ID: uC-gsflmaxxa006b03b1
cggacgcgtggtgcactggtggactcatggttagataattgacttcacctatcgaaacctgcagagagcctgggacgtggagatcaggtgcacatgcctcctcagatcgcacaactgatcttgaagtggccgaagcggtacaaggaaacatcaaatgcatatagaatttttacacaagctgggacagacaccgcatcggttagacgcagctgacggggtgactacccatggatgtcaagagcttatgatccatgcactgagaggaactggaacgagtattgtaatgggaccgaagatgaaatggcacttcatgcaagatgtactggtatgcctctatcaatgggaaacttgcagtgactaacattggatataactggacagactgtgctctgggtatgctacctatataccaagaactaatcgctgatggtatccggatatgggtatacagcggacacac

SEQ ID NO: 9392 - DNA, 489 bp, Gossypium hirsutum
  Clone ID: uC-gsflmaxxa006b04b1
agaaaatatctcaaatctcctcctcctcctcagaaatcttagtatcatcaccatggcctcaaatcccaaggtcttctttgacatgactatcggtggtcagcccgctggtcggattgtgatggagcttttcgcagattgcactcctcgcactgctgagaacttccgtgccctctgtaccggcgagaaaggcgtcggccgcagcggtaagcccctccactacaaaggctcctctttccatcgtgtgatccctaactttatgtgccaaggaggtgacttcacggccggaaacggtaccggaggtgaatccatctacggatccaagttcgctgacgagaacttcatcaagaagcacactggtcccggtattctctcaatggctaacgctggtcccggaactaacggatctcagttcttcatttgcacggctaagactgagtggctcgacggcaagcacgttgtgtttggacaagctgctgaaggcatggatgt

SEQ ID NO: 9393 - DNA, 425 bp, Gossypium hirsutum
  unsure (1)..(425): unsure at all n locations
  Clone ID: uC-gsflmaxxa006b05b1
cggacgcttgggttgaaacaatggagtccaacaccaaaatgtcagctcttcttttgatttgcatgcttttcatttcttcagtgacaccaattcttgggtgtggttcatgtgggaaagcacacaagcatcgaaagcctaagggaaagtcccctaaaggtcccatcactttgcctccccttgtgaaacctccaatcaagttgccaccggttgttcctccaatagttaagccacccattgacctccctccggttacggtccctccaattaaccttcccccagggacggttcctccagtaactaagccaccaagtgggaaaccctgcccaacaccaccaaccaaggacacttgccccattgacacactgaaattgggtgcttgtgtggatctgctgngagggttggtgcacattggactaggtgacccg

SEQ ID NO: 9394 - DNA, 480 bp, Gossypium hirsutum
  Clone ID: uC-gsflmaxxa006b07b1
gctatgggtaatttgcgtctgataatctttactgatgctatcaccttggagacctgatgcccttttcttgcgttacttttaaagcattatgtgctttgtcttttctaatttgaattgccttttggattcataattagcttgtcaagctgggttcaggttttatatcttatatttgagttatgattaagtgtatatctttatatttactgtatattgattcaaagtgtcattgtactgcatgtgacatctcgtaacaactatttagccccagttttgtttaaggggacctgtaatactgaatggaaccttaaatgggtttgctgattttcttttttcttgagttctagtcttctccagtggattattaacggtgcataatataatgtcacctcttcagaattgtgtgcgttactttttaataaaccttagttttgatttacgcttgtcatgccttcttcaagacaatctctgatattggtc

SEQ ID NO: 9395 - DNA, 472 bp, Gossypium hirsutum
  Clone ID: uC-gsflmaxxa006b09b1
cgtacgcgtgggggctgccatcggtgatttgaggttgccttctacagcttcgttcaatgcttcttcagtttgttcgagccgtaagtcatcggctccttggagcttgtcgttctcggcgtctgctctgtccggtgataaacttgttttcaaaatagctactggttgtagccgaacggaacggactgcttcaattgtttcaccgaaagcagtttcagattccaagaactcgcagacatgtcttgaccccgacgctagtcgaagtgttttggggattattcgggaaggggggagcagggacaaggctgtacccactaacaaagaagagagcttagccggctgttccattaggagcatattatagactaatcgacatccctgttagcaattgttcgaacagtaacatatccaaaatgtacgttctgactcaattcaatgctgcttctctgaaccgacacctttcccgcgcttatgc

SEQ ID NO: 9396 - DNA, 488 bp, Gossypium hirsutum
  Clone ID: uC-gsflmaxxa006b11b1
attaaagagagatggcgtctgtaataaaatctgcaatcttaattctgtcggtgtttttatctgtacgcttcagttcgggtgttaggttgctccaggaacagcccaatgatgaccccaaaaacatggacgctattcctcccattgatgcactcaaccctaccgagttgaatggacccggtgttggcattcacgaagatcatgttgtcccaaaaggtgctgaaattggtactcttggttttggttttgaaggtggtcctgataaatgttgttcttctggatgttccggtaattgtaatcctggtggtttcgttctaccatttcctcaaattccagaaatcccaagaattccagaaatcccacaaatcccacagatcccacaaatcccacaaattccactaatcccacagatcccacaagtcccacagatcccacatgtgccaaaaatgcactaatgccaggacagtcgggatgtgagagtggagaagtgt

SEQ ID NO: 9397 - DNA, 480 bp, Gossypium hirsutum
  Clone ID: uC-gsflmaxxa006b12b1
acgcggacgcgtgggctattttttttaacgacaacactctggggtgacggccgcagctggaacctgcaagcgatgaaaaccttgacgagcccttgctccaagccagactccggcaataatagagatagagggttttcttcttttcaacatctttctcttactagagctcatgggtggttattacctgctaaaaagcttgctagaatccgcttctagcatttgtgcattgggcggcctaggaccttgcagcctgtatgttgatcatgttgattctctccggacttacagggggagttggagacagcagaaactcaacctaaagaacacaatgcatcgaagaccactcgggccaaacactaagtgaagaaagagtggctaattcggggagcatttcttcatagtaggggatcatcctatgttaggctcatgggaccctgagagttgtatcccactgacttggtcagaaagacatgtttgggc

SEQ ID NO: 9398 - DNA, 63 bp, Gossypium hirsutum
  Clone ID: uC-gsflmaxxa006c01b1
atcaaatacaaagaagaaaggtggtgggaagaagaagaaaggtaagaagggtgataaagctgc

SEQ ID NO: 9399 - DNA, 337 bp, Gossypium hirsutum
  Clone ID: uC-gsflmaxxa006c02b1
gtgaggctgaggctttgcaaaactcagttatgatgcctttgattagctcacttgtttgggttccttttctccttcttcccctgctgctgctgctgctactctccaagcagaagacccatcaagttaagaaagaacacaattacaagcttcctcccagtcctcccaggctaccaattataggtaacctgcaccagcttggtgaattgccacacagttctctttcccaactttctcgcaaatatggtccagtcatgctccttcatctaggtcgtataccggtgcttattgattcatcagccgaggcggcgaaggaagccctaaaggtcaatgaacttgc

SEQ ID NO: 9400 - DNA, 268 bp, Gossypium hirsutum
  Clone ID: uC-gsflmaxxa006c03b1
caacgctctccttctgtttctggtcaagccaatctcaaaagactccccttttagctcacagctcctctcttgagtactataatgggtaaggagaaggttcacatcaacattgtggtcattggccatgtcgactctgggaagtctacaaccactggtcatttgatctacaagcttggtggtcttgacaagcgtgtgattgagaggctcgagaaggaggctgctgagatgaacaaaaggtcatttaagtacgcccggcagcttgacaagc

SEQ ID NO: 9401 - DNA, 114 bp, Gossypium hirsutum
  Clone ID: uC-gsflmaxxa006c04b1
gtaaactagacaaatttccatgtgcagtggtccgaagaggaagccaactcaaactggtttaacgatggagggtgagtctcgtaaagatgtcgagtttttttctactgtttttcc

SEQ ID NO: 9402 - DNA, 105 bp, Gossypium hirsutum
  Clone ID: uC-gsflmaxxa006c06b1
ctcactctgtccgcccacgcgtccgtctgaggctaataaacaataaagaaaaaaaattgaaggcctcagcttcaaaatggcttcaatgaggaaaaaattgaaggc

SEQ ID NO: 9403 - DNA, 214 bp, Gossypium hirsutum
  Clone ID: uC-gsflmaxxa006c07b1
tcgagtgaagagagaagagacaattgagacgatgaaccagtacgtcttcctgctcctatccctctcatgtctcttctccttctccgtttcagctgcccccgggcctgaaccctctttcatcaccttggatacccacgtggccaaaccggcttccataatgccaggcaactttcactccggccttcagaaagtctgctccgccaccgctgaaccc

SEQ ID NO: 9404 - DNA, 184 bp, Gossypium hirsutum
  Clone ID: uC-gsflmaxxa006c11b1
gtcatcgtcttcaaagaacgctttaccatcaaaaccagctagctaaatcaaccgcatttcaccaggatggctagaggattgaagaaacacttgaagaggctcaatgcccctaggcattggatgcttgacaagcttggtggttgttttgtatttcactctttctttttctttacctattttctca

SEQ ID NO: 9405 - DNA, 363 bp, Gossypium hirsutum
  Clone ID: uC-gsflmaxxa006d01b1
atccgttactgcttccgggctggcatcaatgttatacaaatcgatgaggcttgctttaagagacttaccaaaaatacattagtatcatcgagtcattccactcgcacataactgtaaatacaaaaatacctaacctcattcaaattgatgaatcgatggaagtaaattatgagaggtatatgcagaaaggaagacattcgctaccatgttttattaaacaaacgaatgtgcattgaaagccatgaacagttgatggaacctgtgatccatgcttgtcaaggaataagctacagaaagttggatgtgaatcttaccactagcattgaaaaacttgtcaaagctggagagacttccagagtcacc

SEQ ID NO: 9406 - DNA, 105 bp, Gossypium hirsutum
  Clone ID: uC-gsflmaxxa006d03b1
cggacgtgcgggcggacgcgtgggctttcttgttctttttcttcttcttcttcttcttcttcttactccagccgactttttccggcaaaacggtgtcagatcttt

SEQ ID NO: 9407 - DNA, 253 bp, Gossypium hirsutum
  Clone ID: uC-gsflmaxxa006d06b1
gtaaaatatcaaaagcaaatgagaggagagagatacaaagacttccgactctgaaaactccgtcaacgctagagcgatataagaggaagactcgtttctataacggcgtcgtatatcattcagtgttagggttttttgagtttaagatgtcaactcctgcatggtagagattgatttgggactttatgaggtttcttcttgatccctttgtctgattattcgttcactcttccgtttttcttcttttttcttt

SEQ ID NO: 9408 - DNA, 482 bp, Gossypium hirsutum
  Clone ID: uC-gsflmaxxa006d07b1
attacgacggatggaaactaagagcagcggcgtagccggcggcggatcagtctcagagtcgtcgaccatgatactccacaacgcggtggtcgtcacaatggattctgattgccgagtctttcaaaacggagctgttttcatcgacaaagacaaaatcaaagccatcggtcaatctcccgatattcttcaacaattctcccatgtcgctcaccacatcctcgacctccacggtcaaatattgcttccaggattcgtcaacacacacgttcacacttcgcagcagctcgggagaggaatcgccgacgacgttgatctaatgacgtggcttcaccatcggatctggccgtacgagtccaacatgaccgaagaagactcttacatctctactttactttgcggagtcgaacttattcactccggtgtcacgtgcttcgctgaagctggagggcagcacgtgactggaatggccagagccgttgagt

SEQ ID NO: 9409 - DNA, 87 bp, Gossypium hirsutum
  Clone ID: uC-gsflmaxxa006d12b1
tcgtctacgcgtgcgaatgagaggtgagagatacgaagactattttagtttgaaagcccggcaaaacgctagagagatataagagga

SEQ ID NO: 9410 - DNA, 153 bp, Gossypium hirsutum
  Clone ID: uC-gsflmaxxa006e01b1
catggtgtaaacgcaacctagtccaaccatcatctccattcttttccttcaaactcaaccaaaatcatttttcattttctctcttttaagccctgctacctcctaccttctcctgtttctcaactaaagtgtaaatgatgtgatctgggagag

SEQ ID NO: 9411 - DNA, 159 bp, Gossypium hirsutum
  Clone ID: uC-gsflmaxxa006e02b1
cttgcatcggtacactggtgagggaatggatgagaaggtgcctcatcgttaaaccctattgtcatcctttcttttttgtggagttttagaaattaaagatttcaactgcaattcactattttccataatgcaagtgaaaaatgaattaggttctttggt

SEQ ID NO: 9412 - DNA, 55 bp, Gossypium hirsutum
  Clone ID: uC-gsflmaxxa006e04b1
cccacgctcccgatggtttcaaaatcacatgatgtgtactcctcttgggatgatg

SEQ ID NO: 9413 - DNA, 118 bp, Gossypium hirsutum
  Clone ID: uC-gsflmaxxa006e08b1
tcgctctcgcgttcggcaccagcgcccatgtggagccttatttttgttttcaaacaagctcaaaaaagatggccaacgctgcatcgggaatggcttgtgcatgatgattgcatgttga

SEQ ID NO: 9414 - DNA, 368 bp, Gossypium hirsutum
  Clone ID: uC-gsflmaxxa006e12b1
tttatatctcaaatctcctcctcctcctcagaaatcttagtatcatcaccatggcctcaaatcccaaggtcttctttgacatgactatcggtggtcagcccgctggtcggcttgtgatggagccttgcgcagatagcactcctcggactgctgagaactgtgcatgccctttgtacggtggtgaaaggcgcacgaccggggagctcgtctgtattctacggagtctggtgttgctataaggttggccggaaactagtgtacccgactggggaattttccattgacaaggcagccatccattatacccgttgacttttgatgagttacagaacacctttggtggaattggaaaggacttcggatccttg

SEQ ID NO: 9415 - DNA, 115 bp, Gossypium hirsutum
  Clone ID: uC-gsflmaxxa006f03b1
gctctatcaaataaaatcagttctcatgcttgtataaatggaaggctttaataatgtaatctacctatatatttgcattctgcttttatatatatatatatatgcccccccccct

SEQ ID NO: 9416 - DNA, 84 bp, Gossypium hirsutum
  Clone ID: uC-gsflmaxxa006f04b1
ctctgtcttcagcgtacgggctggtgatactgaaaaaaaagtaaattaccaaacagggtcctccctatttccgacaagaggaat

SEQ ID NO: 9417 - DNA, 100 bp, Gossypium hirsutum
  Clone ID: uC-gsflmaxxa006g08b1
tcgctcatctctccctccctcgactgcacattctagtttctacagcatgcttaaggccccagagcatcaggttgcaggtcacctagccattgatggaaaa

SEQ ID NO: 9418 - DNA, 84 bp, Gossypium hirsutum
  Clone ID: uC-gsflmaxxa006g12b1
tcgcttaggtggccatgtcaaccctgcagaaacttttgggtaagctcaaggtggccaattcactatacacactgacaatattta

SEQ ID NO: 9419 - DNA, 55 bp, Gossypium hirsutum
  Clone ID: uC-gsflmaxxa006h02b1
ctatagggaaggctggtacccctgcaggaaccaggcccggaaaacaccggatcga

SEQ ID NO: 9420 - DNA, 54 bp, Gossypium hirsutum
  unsure (1)..(54): unsure at all n locations
  Clone ID: uC-gsflmaxxa006h05b1
aacgcccacgtttacggcgangccagagaaaccaaaggagggggattaaaacaa

SEQ ID NO: 9421 - DNA, 101 bp, Gossypium hirsutum
  unsure (1)..(101): unsure at all n locations
  Clone ID: uC-gsflmaxxa006h10b1
cttgnctcttttgtgatgagtggccactaatgaggcggattaatttgataccacaatcccttcaaagcacagtcaaagtcattaagacaatgtgccttatt

SEQ ID NO: 9422 - DNA, 108 bp, Gossypium hirsutum
  Clone ID: uC-gsflmaxxa008a04b1
gataatacccctcccagaaggagacccagggggaaccctaaaaacaaggcgccccaacgcaccaagcccacccgaacaaagaagactagggccaaacacaacaaaaac

SEQ ID NO: 9423 - DNA, 182 bp, Gossypium hirsutum
  unsure (1)..(182): unsure at all n locations
  Clone ID: uC-gsflmaxxa008a05b1
tnttacaataataaaaaggaaaataaaatcttctccttctgatcaattggtttataattaattgcgagaggagaaattagataaagaaaaatggttctctgataaaaatttccgtttgtttcctgagcaaatctcgggaaggaataccctttttttccccctgttgttaactcgctgtgatt

SEQ ID NO: 9424 - DNA, 92 bp, Gossypium hirsutum
  Clone ID: uC-gsflmaxxa008a06b1
cctcgcgtccgtccaatttctgtatatcatgtgatcattttgcaatgactttgacaaaattctatccctgctttaaaagttgcttcataatc

SEQ ID NO: 9425 - DNA, 212 bp, Gossypium hirsutum
  Clone ID: uC-gsflmaxxa008a08b1
ctacgcgtccgcattttccaaattttgccctgcttcattttctccttcatctgccgtcatactctctacacaatttctgcccttaaactctcttgccatatttcagatattctccttcatcttctcccatagatctgcaactttctcttcttctgctcccatatttcagtttacagatgactatgatctgtgctgatggatgctctacgatt

SEQ ID NO: 9426 - DNA, 102 bp, Gossypium hirsutum
  Clone ID: uC-gsflmaxxa008a12b1
ctcacgcatacggggaaccaagctacccataaccttattcccatgctacagggaaatgtgggcatgagcacaacaaagggcactgaataggatagatgtaaa

SEQ ID NO: 9427 - DNA, 62 bp, Gossypium hirsutum
  Clone ID: uC-gsflmaxxa008b06b1
ggaccgtccggaaacccgggcgatccacgcgcccggttataacccgaagcaccagaagcaaa

SEQ ID NO: 9428 - DNA, 58 bp, Gossypium hirsutum
  Clone ID: uC-gsflmaxxa008b11b1
tcacgcgcccggaaatacacaagaaaaaaaagcaagtgatcagataaattgaccgact

SEQ ID NO: 9429 - DNA, 484 bp, Gossypium hirsutum
  Clone ID: uC-gsflmaxxa008d04b1
cctacgcgtccgcccacgcgtccggcgagcaacaatacctaaaatccgggcgatcagccagttttaatcaacagcggtcctcctcaggcgcttacagtaagggcgctggcggcggccctgccccctcgcggtctccttcatcatcttcttcttctttatcttccaatcgaagtcttaagaagtctaacaatgcacaaggagggcaataccggttaaattcactggccgcgaattctaccgagtctagtaatacttctgctgcctgcaccaaacaaaatggcgctcatttacaaccccagctacagggagcatcagatgcatcgattgcaagcaatgttgcccagcctgttcaatcacccatcatccagaatagcactcgagctgtttcgaaagctccaacttctcaaccacccaccataagttccgacagtagtctccctacaaccgctggaaaggaagatccttccaaagcattctctttaca

SEQ ID NO: 9430 - DNA, 188 bp, Gossypium hirsutum
  Clone ID: uC-gsflmaxxa008d07b1
ataaaactcttaattccagcgttagctaaaagctggatttctctgttatatgtatatatttacaaaagaaataaatcagcatcattctgccgttgcttaatgcagaaacaatcaataacgacttttaaagctctcttctttgcttcagatctttccatttttgttttcaggttcgcattcctgaagat

SEQ ID NO: 9431 - DNA, 358 bp, Gossypium hirsutum
  Clone ID: uC-gsflmaxxa008d09b1
gtagtatccaagctcaagaggaaactacttcgggaaaatttaatggatttgacacctaatttcgcggacgctaaggatggtagtgggaaatatgattgcatcacagaggccttagctgaagccccgttgaatagctgcgatcgatttgttattcacattaaggctggtacttataaggaaaaaatcctcgtgaccaaggagatgactaatgttatgtcccttggtgatggcccaactgagaccatcatcaccaactgcgttaactgctgtaaggataatgttaaaacattcaacactgcaactgttggtgtggatggggctggtttcatggctaagggcattgggctcgataacccaa

SEQ ID NO: 9432 - DNA, 360 bp, Gossypium hirsutum
  Clone ID: uC-gsflmaxxa008d11b1
cggaaatccctggacgtcccacgcgccttataacacccccgaaaaacacagaccaggcagggggcactgtgtgagcaaacccaccccctcttgccccgaagaccagcgccgaagccatagggcagaaaccaggctatcagcccataaggaaacactgtaagcatacaagaggctcccctgcaccggctaccaaaaggaaagggaaaggaaaggaagagaggaacacggccaccaccacaacaagtgagaaagaatcaccaacccaaccacagcagactccgcagccgaacgaggcagaagccaggcaaaaaaaagagcacaccctgcacgacgccagagaatacgaatggaaacacaaga

SEQ ID NO: 9433 - DNA, 83 bp, Gossypium hirsutum
  Clone ID: uC-gsflmaxxa008e01b1
tcgtactacactcaccgccggcggctgtttgagggtggctttttaccccttacttcaaaagtttcccacaaacggcggggctc

SEQ ID NO: 9434 - DNA, 262 bp, Gossypium hirsutum
  Clone ID: uC-gsflmaxxa008e03b1
cagattgatatctactacatcactggtgagagtaaaaaggctgttgagaactctcccttccttgcgaagctgaagaagaagggttatgaggtcctttacatggttgatgctattgatgagtatgctgctggacagctcaaggaatttgagggcaaaaagcttgtgtcagctaccaaggaaggtcttaaacttgatgagagtgaggatgagaagaaaaagaaggaagctctgaaggtaaagtttgagggtctccgcacggtca

SEQ ID NO: 9435 - DNA, 130 bp, Gossypium hirsutum
  Clone ID: uC-gsflmaxxa008e04b1
agataaacccaccaaaaaaatggcgaattctaatgacaacttatcaacgacgagcaccatgaatttagccctctccagagcaaacaagtggcagaccaagatttgaaggaaaaacctagtggtaaaaagg

SEQ ID NO: 9436 - DNA, 57 bp, Gossypium hirsutum
  Clone ID: uC-gsflmaxxa008e07b1
gaccgtccggacaccctgggcgacccacgcgccgataccaccaacacaaggaccgac

SEQ ID NO: 9437 - DNA, 120 bp, Gossypium hirsutum
  Clone ID: uC-gsflmaxxa008e08b1
attccttctactggaaaagcttaaaccatgctgatacattttacaagctttcgcaatggtttccaaggcccggcatatgttccttctcttggcctaggcaatggaggctgaacgcacaaa

SEQ ID NO: 9438 - DNA, 272 bp, Gossypium hirsutum
  Clone ID: uC-gsflmaxxa008e12b1
atcaatttggaaatttcgaaaatagttgagagccgtctttttgattttgattcatgggatttcgccgcgcgacccctggttctcctgttgagaagaacactgaaagggcttaataagatcatagctaacccatctaatggagattaattcttctatcttcaatggatttgtcactatactccatactatgtttctttccatatcatacatcttcatttatttaattcttctctctttttttcctttatttttttctactttcttacatcttc

SEQ ID NO: 9439 - DNA, 95 bp, Gossypium hirsutum
  unsure (1)..(95): unsure at all n locations
  Clone ID: uC-gsflmaxxa008f01b1
gaatgaaaaaaccagacaggctcacatcgaaaaagaggacagtaagaagcngaagcccaagattccccagccaaaggaagaaaagaagggcgaaa

SEQ ID NO: 9440 - DNA, 97 bp, Gossypium hirsutum
  Clone ID: uC-gsflmaxxa008f02b1
gaataaatacgaacccaaattctaatttcaagggctgctcatcaaaacttagagccagtagatccaccttcctaatatcttctctctttttccttca

SEQ ID NO: 9441 - DNA, 83 bp, Gossypium hirsutum
  Clone ID: uC-gsflmaxxa008f03b1
accatagagaaaaatcgaaaacttctttaaacatagaaaagaaaaggcgtatttccccggatttcccacgggaagagcgacag

SEQ ID NO: 9442 - DNA, 100 bp, Gossypium hirsutum
  Clone ID: uC-gsflmaxxa008f06b1
aaataaacactcaaccacccccaaacaaaagccctaacgggctacagtctgaagaaaccaacgcctttccaccacaggcggacgcagagacggaggcagc

SEQ ID NO: 9443 - DNA, 517 bp, Gossypium hirsutum
  unsure (1)..(517): unsure at all n locations
  Clone ID: uC-gsflmaxxa008f08b1
tattgaatccggtttcattctccaatgatgtcgacaccagttatggagcgaaataggtgaatgtctgcacaataggaagatattagtggttcccattttcgaaaagcattatgttacgaagaacgaattgtctttgaccaccccatatgcatctgttcctcaaccatcagaatctgaagcagaaaataaagggagaaaaatattacttgatattaacttaccttgtgacgtgactcttccggacatgaaccaagacattgttgcagaaaattcagccatagaaaaggaagcaaatacaaagctaccaagttccccacatcagtttgacttgaactcctgtgtcgatgaggatgaagcttcttttgtaccctctgttccgagcagtggtatgaagatgactcangggatagatttggaagtgccactaattcctgagcctgaagatgtcattcatggagaagaattactggaaaagggcattgaaccacctttgcaatcagtacaaagcaaagatgac

SEQ ID NO: 9444 - DNA, 158 bp, Gossypium hirsutum
  unsure (1)..(158): unsure at all n locations
  Clone ID: uC-gsflmaxxa008f10b1
cggaattcctttgacgtcccacgcgnccggtaagaccccatcaagccaagaaggcactgaagtatgttttccatgctgctgccaacaatttcccaggaaaagaacncgaattactcattgccactcttccagacaacaacggatccttatatggcgac

SEQ ID NO: 9445 - DNA, 100 bp, Gossypium hirsutum
  Clone ID: uC-gsflmaxxa008g02b1
ccctcgcgaccgcccacgcgaccggcagaaagggtgtgaccttgcaagcctacccaccacaaccaccggaacccggccacaaaccaaggagcccaggaga

SEQ ID NO: 9446 - DNA, 176 bp, Gossypium hirsutum
  Clone ID: uC-gsflmaxxa008g11b1
taaaataggtccctattccaaggagggaaagtgttatttttttataaagcataatatcacaggttttcccccttgaacacaaaaaagcacaaaaagcacaaaaagcacggccaccataaaatatcaatctgcattttcagctatcaattgctggtactttcaagcagtagatcttt

SEQ ID NO: 9447 - DNA, 324 bp, Gossypium hirsutum
  Clone ID: uC-gsflmaxxa008g12b1
tcatcgcgtccggtcaatactcaagcaagtgaggttactctttcaagcagaggacaagcctgtacagagcaccgagaaattacagagcaatggaagccatggcagcagcgaaaccagtgatcaaagtagctgccctctgtgggtctttaagggaaggctcttacaatagaggcttacttcgctatgcaatggagctaacttaaggaagagagtgtagggatccagatcgattacatagacatttcgccggttgctatgctcaacactgaccttcaggttaatggaaaggttccagctggtgtccaggctttcaggcagaggatc

SEQ ID NO: 9448 - DNA, 199 bp, Gossypium hirsutum
  Clone ID: uC-gsflmaxxa008h02b1
acgcccgcttatacaccacccaccacaccacaaaacccccacgggggtgttttttaagaaagagtccggcgaactatcaaccttcaaacggctaaattggatagggtatccggtgactataaacctctgcattcagaccccacgaaagcaaaggccgcaggacacccaaggccaaacccgcaaggaccgcgcacccccg

SEQ ID NO: 9449 - DNA, 215 bp, Gossypium hirsutum
  Clone ID: uC-gsflmaxxa008h04b1
ttataagaccgcagggcaacaagaggggaaggagttgacattagaagaagaggggcgggaaaaagcccccccccccacaagaaagggaaaaaagaaccagaaagaggaaagcacaaaaaaaaaaaacacaaaaaacacaaaaaggggggggggggaggggagaaacaaaaaagcggggggggggggggggacaaccccaacgggggggggggggg

SEQ ID NO: 9450 - DNA, 131 bp, Gossypium hirsutum
  Clone ID: uC-gsflmaxxa008h11b1
atcctaaaccatatatccgcatatatcattggggtctttgtcattgcttttccacgaaagcacaacgaacgcagacgaggaggcggcgagactcccggcaccactacagaaacgggggcaggggggggggg

SEQ ID NO: 9451 - DNA, 274 bp, Gossypium hirsutum
  Clone ID: uC-gsflmaxxa009a02b1
tcctcgcgtccggatatatagaactggtcaagaaacacgacctggagatctcacaaccaggtttggagcccaatgtcggactaacatggcagatgacaaaaaggagagaagaccaagaagttcacaagtttaccaaggagaaacctggctggtgtagcgatccacattttccaccatgtgctgcgtattgcctctctccctgtctgtctcttatgaattttacaatttaatactgtgttagtgagcatgttcaaaatggcttcgacatcattac

SEQ ID NO: 9452 - DNA, 419 bp, Gossypium hirsutum
  Clone ID: uC-gsflmaxxa009a05b1
cggctactgagtcaccaaacgagttaaggaaaagagagacaagtttcaccaaaccatggggtcgatccccgatcctggcgagttgaccgagttaacccagccgagtttcgatgagttccagcgtcaaacgtctctgatgacgagctgtactctcctctggaaagaactgtcggatcacataaattcacttgagcagaacctgataaagcagtcggagaccttgaaacgcatcatcgaggcactggactcagcgaccaaggcttgactgatgtcactcccgacgggggtacgtagtctataggttagtgttacaaccgcggtagtgacgccgttatctacccggcgccagccctggtggagaaaggagaagaagaagagaagaaaggattgtacccaaaatttgtgttcgaagatacatg

SEQ ID NO: 9453 - DNA, 249 bp, Gossypium hirsutum
  Clone ID: uC-gsflmaxxa009a08b1
cggacgcgtgggttttttttttttgaagaagccgaaaccaaatgctttttttttctccctttccagctgttcatctaacattattcagactctaaattttttaaaagaaaatatcattgtctgatacattcagatattagtacaagatctatgatcccctgaataattaacaaaatgtgaaggaaatggcatatacttgggttgaatacaacactcacttcgagtccgtacaacgttactgagcaaaac

SEQ ID NO: 9454 - DNA, 393 bp, Gossypium hirsutum
  Clone ID: uC-gsflmaxxa009a10b1
tccacgcgtccgcaagatcagatttgagtctttgacagacaagagcaagcttgatgctcagccagagttgttcattcatattgtgccagacaagactaataacaccctatcaatcattgatagtggtgttggcatgaccaaggctgatttggtgaacaatttgggtaccatcgcatggtctggcaccaaggagttcaaggaagcaacttgtgcagaacctgataaagcagtcagagaccttgaaacgcaaaatcgaggcactggactcggagaccaaggcttcactcgactcactcaagaagcgggaactcagtatcgaggacagtgtcaagatcgcactcagccgagtcgagttcaacaccaaagctgccatgaagacccttggcgatgacg

SEQ ID NO: 9455 - DNA, 395 bp, Gossypium hirsutum
  Clone ID: uC-gsflmaxxa009a11b1
gtatggggcataaggacccacctttgggaccaaagttagcaactacccaccatgtaccaccccagacaaaatcaagggactcagagcccacacggacgccggtggcatcatcttgctgttccaagacccccaagtgggcggccttcagcttcttaaagacggggaatgggtggatgttccccccttgcgccactccatcgtgatcaacctgggagaccagctggaggtgatcaccaacggcaaatacaagagcgtggagcacagggtgattgcccataccgacggagattgcatgtggatagctaatctttacaacgcttgcatctactgccctgtaagccgctgaactcaatgcacgtgccaaggcgttgcctggtcaaaaggatgagggcttc

SEQ ID NO: 9456 - DNA, 468 bp, Gossypium hirsutum
  Clone ID: uC-gsflmaxxa009a12b1
attgatcgagacctactttgctgatcttacttgtgaggcatacaagacactcatcgggctgaagggtgtcactgcttatggccttggacttgggttccgcggaagcccaccactctaatagtttggtcaaatagcaacgtggcctaatggcaattacctctaaagggacagtagaggcattgcttacctgtatagaagtagagatttcattcactggactaaggctaaacacccttttcattcagcgcccaatacaggcatgtgggaatgtcctgatttttatcctgtttcgttatctagtaaagagggtttggatccatcttacatgggaaaacatgttaagcatgttctaaaagtgagcttggatgatgcaagatacgattactacacacttggaacatatttaactaatgaggatcaatatgtacctgacaatgcattacatgatggatgggctggacctagata

SEQ ID NO: 9457 - DNA, 469 bp, Gossypium hirsutum
  Clone ID: uC-gsflmaxxa009b01b1
cgctttttccatatctagcctcttgcagaaaactagaacattgtaataattctccaagtttcaactattcacattcattcataaaactacaaaaccatttcccacttccatgtttgtcaaacaagccacccattaaatccatctgaaaacaacttcccaacactgcgtttgttttgctctgtctcactttttttttttccttccatgcaacgaaaacaatgaagctaatccttttttcattgtttttttgggcatcattggtggtgagtgtgagctcagatctagcttccgacagggcagccttgttggctcttcgtgcagctgttggtggacgcatccgtttgtggaatctttcaagcagcccatgtagttggactggtgtaaattgtgtccaaaacagagtcgtcgagttaaggctccctggaatgggactgtcaggtcagcttcccattgccattggtaacttaac

SEQ ID NO: 9458 - DNA, 303 bp, Gossypium hirsutum
  Clone ID: uC-gsflmaxxa009b02b1
gtcatgggagaactacttgagggttccctcgttcgatggattagaactgaacccgaatgccaagtatttgcatatatgcgccaatgagaccatttacggggctgagttcaaggactacccaactccccgcaagacaaacgggggtctaggggctgatatggcgtccaatttgtgttccaaacctgctgatgtaaccaagtgtggggcgatttatgctggtgcgcacaataatgtggggccatacggggtttgcctcaggatcgagaggaaggatgttcttggtaatgcacaagagagtgcccc

SEQ ID NO: 9459 - DNA, 334 bp, Gossypium hirsutum
  Clone ID: uC-gsflmaxxa009b07b1
gtgctttctcattcagctgcatgctgtgcgatatggaactgtttcgatagttgcctctactggtggacttgttgacacggtcaaggaaggattcacagggttccaaatgggagctttcaatgttgaatgtgatgaagtggatccaagtgatgtgattaaggtggtaaaaactgtcaagagagctcttgcaacatatgggactcaagcactgaaagaaatgatccagaattgtatggcacaagatttttcatggaagggaccatcaaggttgtgggagaagatgttgctgagcctcagggtggctggctgtgaacctggcattgaaggaaaggat

SEQ ID NO: 9460 - DNA, 323 bp, Gossypium hirsutum
  Clone ID: uC-gsflmaxxa009b08b1
ccctctcgtccgcggacgcgtgggttcgcgagaaagtgagaggtcgagagagaaaataattcgcagggaattagcgagatcctgcaattttcctgcgttttctctcttcaatcttctccggctatctgatctatccgtcatcatgacaacatcaaggcgtcttgcagaaagaaaggtggagaagcttccagagaacaccacatatggaggggctgatggctgagacaaccactaatgaggggcctgactatgcttgactgactatggttctgaaggttcttatatgtagcgcacaagagagcgcccctgtgatgcttgattac

SEQ ID NO: 9461 - DNA, 505 bp, Gossypium hirsutum
  unsure (1)..(505): unsure at all n locations
  Clone ID: uC-gsflmaxxa009b09b1
cttctttccagctgcgactccaactctcagagccgacatgaggtaacgagatgtaggtatgcttatgacccctgacatccactgatcctctgctacttggtggaacataggcatatgactcctgatgcagcttatgagtatgtgagatctatcagacctagggtccttctggcacctgcacagcagcaggctgttcaagattactatcttcacaaggtgaataataatggaatctgtggagactcttgctcaatgataatgaagaaaactctagttgtagctgcaaaacaggatacggcggtcttcgacgatggctctgtagttgttgtaacagagtcggaccttgatgggtatgatgctagctntgacacagatgtgttaagtagcaagatgttggatgagggaagcctagctggcaggttgcagtttgctagtcaagcagctatgaccaggctttcttgcctatggttacgttgccgtgcggaacataaggcatctaggaagc

SEQ ID NO: 9462 - DNA, 493 bp, Gossypium hirsutum
  unsure (1)..(493): unsure at all n locations
  Clone ID: uC-gsflmaxxa009b10b1
aaaaagtgtataaaatcctccttatcgtataattttccattatttcctctgtttcatcaaatttcaaaacatcccccaaatctctgtttttttttttgtaccatggtttcctcttcttcttcttcctcgagcaaaaccatgaagaaaaaacctacggggctagtcgatacggcgtcgtggtactgttccgtaaccttattggccttaatattgatagggtcaatcagggcaaactccgtatcatatgaaccaatgtgaggcagccttgttctgaaccgtgcctgacctgtattgtttggagatgggaaagaaagggaccggctggttctctacggcgaagaaagtgttccagtcttcatctaaggacttgcccgagaaaaaggaagagagtgttgagaaatggccgtatgaggccccggaagtagtgtcatttgaacattttccggcagaagagtcaccagacatcactaaggatgagagtngaacgtcaact

SEQ ID NO: 9463 - DNA, 265 bp, Gossypium hirsutum
  Clone ID: uC-gsflmaxxa009c02b1
tttcaacagaaacgtgcttgatgtatcattgtggctgaattttgaatgtaacactaatatatctctttttgactattttggggtaaatttttcgttagttatttttgggtcttcggaattggaattttcggggaatggaggtttcggtaattaggagttgttctcaagcaacaaaccctaaaacagaattagggtttagcgattcaaggcttagtttcgggaaatttaacgagaaactattttctcggaaaccaacagtgtttcg

SEQ ID NO: 9464 - DNA, 201 bp, Gossypium hirsutum
  Clone ID: uC-gsflmaxxa009c03b1
attaaaaccctaattttgaaatcaccagcgtacttttccgagttaactcgccggctcaggggaagatgtacggatccgatagagccggtgacgatgcagagcgaacagcttttagaaaaacagaaaagaagtacaagctttattacgaaaattcgaaatccacgaaaaagaagaagcaacctaaacaggtcgatttatcag

SEQ ID NO: 9465 - DNA, 477 bp, Gossypium hirsutum
  Clone ID: uC-gsflmaxxa009c04b1
atgggtttcccctatgatctgtctcccttccatcgcaccgtttgttttgacctccgtcgcactcatccctgatttttcttctgaaggtcgagtttgcaaggtgatcacggtttgtgtttcttcccaagcgccaacatctgtgtctttgtctacacttattctaagctcaaaatgcatcagggctcgccggacatgccatattccggtggaaggccactagggaccattcattagcctgcggactatccatttaagccacccaaagttgcattcaagacaaaggtctttcaccctaatattaacagcaatggcagcatttgcctcgatattttgaaggagcagtggagccctgccctcaccatatccaaggtattgctctcaatctgctcacttttgacggacccaaatcccgatgatcccttggtgccagagattgcccacatgtacaagaccgacagggctaagtacgagacaact

SEQ ID NO: 9466 - DNA, 284 bp, Gossypium hirsutum
  Clone ID: uC-gsflmaxxa009c05b1
gtaataaacaaattactcttttttttaaaaggaaagaaggaggaggaggaaatggatggaaaaagaatcgagggcaatgaagtttatgctctagcaatgtgtgtaagtattctcctctttgctccgattgttgtgtcacaaccaataccggcagataaatcccaagtggaagcttggtttaatggcattatcaagccggtgaaggaaaggggtacaattttagaccctgaattggttcaagccgagacagaacctagaatcataaaagtgatgcaaggcggggg

SEQ ID NO: 9467 - DNA, 473 bp, Gossypium hirsutum
  Clone ID: uC-gsflmaxxa009c06b1
gcctcacgcgtgccaaagtcctcactagccgaccaggacattaaatgagctggtcagatgttaaggtgtctgcttcatgatggtccacgggactaatgggctgtgtcgttcttgtgacattcccatggcacagtttatcgtgaatttgaatgcatcgctgccagctgcacataagtttataatacatgtgctggatagcacgcactttttcgtgcaacctgatgtcgccggaatgatacgaagtgccatatccgagttcagagaccagaattcatacgagaagccaacttgactcttgaactcaatatcctttctttaatggagctcatatatgaaaaaccaataaagaacaacaaagaaattctagtgcatgaatatgtgcaattgctggcttcctattttcattttgacttcagaccctgatataattgagggctatatttggatttggattcggattttgtatttattta

SEQ ID NO: 9468 - DNA, 411 bp, Gossypium hirsutum
  Clone ID: uC-gsflmaxxa009c08b1
ttacaacagaaacgtggttgaggaatcagtggaacaatcatttagctattacactggatataatggagttaacgacaaagcaccccagaactctggggcatatgtcttccgtccaaatggcacataccacataaaagctgaacagccctcattgactgttattcaaggaccattgataaatgaggtgcatcagcagatcaatccgtggatatttcagactactagactttacaaagaaaaggagcatgttgaagctgagttcattgttgggcctgtgccaattgaggagggatttggaaaagaagtaacaactcagatagctgaccaatctggataacagtctaaaatgatacactgtacctaatgaacgacttttaatagaacaagattattagctggcctgcctctaga

SEQ ID NO: 9469 - DNA, 335 bp, Gossypium hirsutum
  Clone ID: uC-gsflmaxxa009c09b1
ttttccataacttccctttcccagaaaactagaacattttaataattctccaagtttcaactattcacattcattcataaaactacaaaaccatttcccacttccatgtttgtcaaacaagccacccattaaatccatctgaaaacaacttcccaacactgcgttaggattgctctgcctcaccaagtcgatttactagaaggcttggatttcaaagacacttcagagtcattcaatgaaaaaggtggacttactgccggaagtggaccatgtaattggggatttgaaccggcgaattttggcctggaaaataagcctgggttctattttttttc

SEQ ID NO: 9470 - DNA, 481 bp, Gossypium hirsutum
  Clone ID: uC-gsflmaxxa009c10b1
tttacaggaggatctctcagctactttttctctcaaaatttctccaattagctctggtttaggcgatggcttcaaagcggatcttgaaggagctcaaggatctacagaaagatcctcctacctcttgcagtgcaggccctgttgctgaagacatgtttcattggcaagcgactattatgggtccacctgacagtccatatgccggtggagtgtctatagtcaccattgatttgcctccagactatacatttcctccacccatagatgcgatgcaaggaaagggtggagaacctaataccatcaccaaagccatcgttagcgttccattatggaacgcccaacgcgtgactatatccatcggacctggatcttacaaagagaaaattagaattgaaagaaataagcctttcattacattgttaggagatcctaaaaacatgccaaatttgacatttgacggcaccgcccagcaatatggaac

SEQ ID NO: 9471 - DNA, 365 bp, Gossypium hirsutum
  Clone ID: uC-gsflmaxxa009c11b1
tctttacgcgtccgattatttataatcacatgtattaactttttttgtgtttgtaggaagaagaaaagaatatgaagagggtttcctttgttatgatcttgtgtgcggtggcactagcggcagcggtggtgttttcaggtgaaacacgctcggtggaagcagtgacatgcagccccatcgagctcatcccatgcttgccggcaatctcaacaccgccaaagcctccatccgccgcttgttgcggaaaggtgaaggaacagctaccatgcttttgtggctaccttaaggacccaagtgctaagccattcattgacaatcccaatattccaaaggtggctagctcttgtggagttgcacatgcatat

SEQ ID NO: 9472 - DNA, 473 bp, Gossypium hirsutum
  Clone ID: uC-gsflmaxxa009d01b1
tccacgcgtccggcccattcattttatcttgcagtattgtttacccgatccaagacctccagtcacatggccctagttcggagttttcagttggcattctccttgaggagcatctctctggatcaagaaggagagctgctacgcggtattcttgaacaaatttaaaaaggaatttacaatatgggaagtccaaataaagatcagaataaagggtttttctcagcgatgacctcgggtttatctttgtttggcaacgccatgcacagatctgtcaacgggttacttggttatgaaggggctagaagtcataaatccagaaggaggaaaagaagatgctgaggaggaagctcatagaggaagatggaagcaggaggagcgagagagctactggaaaatgatgcacaaatatataggttcagatgttacatcaatggtgactctttctgtcctcatatttgaaccgatgactatgc

SEQ ID NO: 9473 - DNA, 349 bp, Gossypium hirsutum
  Clone ID: uC-gsflmaxxa009d02b1
ccctcgcgtccgcagagcgatatttgttggtgtgcgaattggtgatcctactgccgtaggccatgccctgacgacttttaagagatccagagacaactatattagtttttggaactgcaaccatggtcatttctcggaagtcgacaaggttgacgccgtcgccgctcttgatgactgccgttgtgtaggcaaagtttgtgtggcggatatcatcggttttttatgtaaggaagaaaacctgttgaatcctggaattgctcttcaagctccagtttccgttttaattcctaaaacaggagactttgttcgacatttagaatctaatgcaagtttggcggaagccatggat

SEQ ID NO: 9474 - DNA, 381 bp, Gossypium hirsutum
  Clone ID: uC-gsflmaxxa009d03b1
ttcacgcgttcgcccacgcgttcgcggacgcgtgggctaggactggcttcatggctcaaccgattttggtcattttatttttttcctggcaggtggtagatatgggctgagtttggcgggctcttgggttacattctcgggggagaggcttttatcgcagaaaccccggggggtggaggctgcagtctctttgccaaggttcaccttaacggtaggcattatgatacagcgccaatgcattgttttcatcagcagcacctccagcatagagaaatttaaacctgcatatttgcttcctgatggaagactagaaagggctgggagagttaaaaagaattctcctctagatggcactcgttctcctgctgtcaacaatggcct

SEQ ID NO: 9475 - DNA, 362 bp, Gossypium hirsutum
  Clone ID: uC-gsflmaxxa009d05b1
ttaagttgtaggtatttctgtgctgttaaagaggtcaggcagcagcaaggggcctgttgttctaggtaggacctttgctaccataccatctgaagatctttcttatgcaagagacagttctaacagtttcagaagctctgtcggacatgggagtgtatctgcatcatcctctactgaattcagctcatctaggcaaacagatgcgcgtgtacaattaaatggtagaaaatctgagttggagaattacagatatgacttgaatgcaaagcctcaaagctttactttgtctcaaagttcaagcaataattaccaagctttaagatttgcatctagcacaaacgatgaaaattttgagggctcta

SEQ ID NO: 9476 - DNA, 407 bp, Gossypium hirsutum
  Clone ID: uC-gsflmaxxa009d07b1
ctgacctatgtctcggaaagcctgcgctgcggtccctctctgtctctgccaccgccggcgatgcctggacgtctttggagagatccagaggccactctccttgaggagcatctctctggatcaagaaggaggtttgcaaccgtctcgcagaaggtctctctttaccttggcatcctacatgcttattttctcagccagggcaggcgatcttccagagttaattcctattgttaaagcatctctgacagataaaatagttgatccttacctcaaattagttgaggatgtgagactccaggctgtgcgtgtgaaatctgatgtggacagtgtagcatatggatcaaaggaagatgatgctgctgcatcaaaagcgtctttggcaatagagctagatgatcctcatttgg

SEQ ID NO: 9477 - DNA, 337 bp, Gossypium hirsutum
  Clone ID: uC-gsflmaxxa009d08b1
cccacgcgtccgcagagcgatatttcttggtgtccgaattggtgatcctactgcggtaggccaagagcagttctcccctagctcaccaggatggccgcctttcatgagagtaaatcctatcttggactggtcatacagagatgtgtgggctttcctcttaacctgcaaggtccaatactgcagtctttatgaccaaggttacacttcaattggaagcatttatgatacagtgccaaatgcattgctttccatcagcagcacctccagcaaagagaaatttaaacctgcatatttgcttgctgatggaagactagaaagggctggtggagttaaaaag

SEQ ID NO: 9478 - DNA, 457 bp, Gossypium hirsutum
  Clone ID: uC-gsflmaxxa009d10b1
gtctcacaggttgggccaatttcaattaatctgattgtctgatatattcttctcagcttggtgttgtgaaggaccttcaaaacgggagattgtgagggagatagactaacagcatgctgttctatcattatcttgagctttctgcttcgttgctgcgtgaccacatgatactatactgaactcagctcatctaggcaaacagatgcgcgtgtacaattaaacggtagaaaatctgcgtcggggaattacagatatgactcgaatgccaagcctcaaagctttactttgtctcaaagttcaagcaataattaccaagctttaagtcttgcatctagcacaaatgatgaaaattttgagggctctattcgtaatctgaaatttgaggaagcagaggaaacagttgtagcttctctagccaaagcttcagaaaatttagaagtagatctgtcattaacta

SEQ ID NO: 9479 - DNA, 482 bp, Gossypium hirsutum
  Clone ID: uC-gsflmaxxa009d11b1
acgtatttaaatacgtacggacgggttactcagcagatcgtaacggaggtggtagcggcggcggcggttggatatttgatcagatcgtgatccaaatggctgaggacaagtataacctcaagaatccggcggtgaagaggatattacaagaggtcaaggagatgcaatccaatccctctgatgatttcacgagcctccctcttgaggagaatatatttgaatggcaatttgcaattaggggtcccagggattctgaatttgagggagggatttatcatggaaggatccaattacctgctgagtatccatttaagcccccttcatttatgttgctgactccaaatgggcgttttgaaacccagacgaaaatttgcttaagtatatcgaatcaccacccggagcattggcagccatcttggagtgtgcggaccgctctagtggcactgatagcttttatgcccaccaacccaaatggtgcttta

SEQ ID NO: 9480 - DNA, 490 bp, Gossypium hirsutum
  Clone ID: uC-gsflmaxxa009d12b1
ccctatgatctgcctcccttgcatcgcaccgtttgttttgacctccgtcgcactcatgcctgatttttcttctgaaggacgagcttgcaaggtgatcacggcttgtgtttcttcccaagcgccaacatctagcttctttttcttttcttattctaagttcaaattgcatcaggccttgttggctctgcttctctaggttgagagcccattctggtctcctttagagggtgcgttaggcctttttttcctgatctaattctgtttgtttaagcctggagtagttataatctctttaccagtggggggttcttgtttgtgcagctatagattcctcggcagaccctaactccttttgtgtcatgttgatttctttagtgggcctattttcatgcgagcccattttatcatttaaggtttctagcaattgtaaccgaatattttcttgcatcttttctctggctacgccgttgatggtcttcttctcttttga

SEQ ID NO: 9481 - DNA, 396 bp, Gossypium hirsutum
  Clone ID: uC-gsflmaxxa009e01b1
tcccacgcgtccgcctttttatggttctctataatttggccaaatcatgacatctcttgtggttggcgcgaacactctcttgttgtctaaaaccgaacctagactgaccgcaaaaaagactaccctttttgcccatttactctccttattcaacaaattcggcatcacatcccccaaaatagtcgcttttttatctcttgctctcttcatctgcttcaagtcatggctggtgtagcacccgaaggatcccaattcgatgctcgtcaatttgatcagaaaatgagtgatttgctccaaacggatggagatgatgttttcacttcttatgatgaagtttatgacagttttgatgcaatgggacttcaagagaaccttctgaggggcatctatgcatat

SEQ ID NO: 9482 - DNA, 557 bp, Gossypium hirsutum
  Clone ID: uC-gsflmaxxa009e02b1
tcgccaccacgcgcgcttttatctgtgtgcgctgggcaaattcgattgcataaggacgattcggttgcaaatactagcccaattaggagaagcattactgttgatggagatgttcaggatgttatagttggtactgggtttaaattgtctgtatcatgttgtttctatgtgcttcttgtgcaagttgtggtgctaggatttgatggttttggtttgataagagaggctggtgatgggaaagttttggattgggctagtgctgccttgcgtggtacgtaagcatgcttatgaactgttgagaaatggtgggcctaaagaagaaaatatcattggttttatgtatgatgatattgcctacaatgaagaaaaccctagacctggaatcatcattaacaatccccatggtgatgatgtttataagggtgttccaaaggattacactggagaaaatgttactgttaacaacttttttgctggtatccttggaacaaatctgctcttacagggggtagtggcacagttgtaatagtggccccatgatcatatcttatatatac

SEQ ID NO: 9483 - DNA, 471 bp, Gossypium hirsutum
  Clone ID: uC-gsflmaxxa009e03b1
atttttcttttcttctttgctttgctttccttttcagctgtctcggcatttgcacaggatgaggaagaccaaggtcttgttatgaacttctacaaggattcttgtcctcaggctgaagacattatcaaggagcaagttaagctactgtgcaagcgacagatatacactcatggatgatggcgggaaaggtaggcagatgccagttcattacggttcaagcaagcacaacttcgtcactgtttcatccccgattgcaactcagcttcctcaagctgcaggcatggcatactctcttaagatggataagaaagacgcttgcgttgtcgcctttatcggtgatggcggtaccagcgagggagattttcatgctggtttgaactttgcagcagtgatggaagccccggttatttttgtttgtcgcaacaatggctgggccattagtacaccaacatcagatcaattttcgagcga

SEQ ID NO: 9484 - DNA, 648 bp, Gossypium hirsutum
  unsure (1)..(648): unsure at all n locations
  Clone ID: uC-gsflmaxxa009e05b1
tcactattttgaaagctggcgcccctgcatgccccggcccggtatcccggggagtctccttggtgcagatcaacataacgttggcccttatgcaatttctgagttacgtgagcatttcttaaacggataccttactgaaagtacacttgcatggtctgaagggagaagtcagcggcaaccattgtcctcaattcccgagtttgttgctgtaattagtcatgaggccaacaatttttctgctacaggtggtgatgatgctttcttgaacagtatgaaggagggtgataattcaaatgcagtgccttccaatgatggtgatggtagtgatgaatttgagaaatggcagagagagattagagaggcagaagctgagacagaacgtttgaaaactggatctgtttctagaagtactggtgatgcctttggttttgatgatcaggataggcctctaacaccgccagaaggtgaagacgaattcactgatgatgatggaaccaggtacaagtgggatagaaatctgcgagcatgggttcctcaggatgacatgtcaacacaaaatgggaactatggagtagaagagatgacattctnggaagaagatgaagttttccaactataagtgctactgatgcttctgctgctgtgctg

SEQ ID NO: 9485 - DNA, 403 bp, Gossypium hirsutum
  Clone ID: uC-gsflmaxxa009e06b1
atttctttcaattttttttctccccagaatcaaactgatcctttagtttttatcatcagtttgtttcagagggtttttggttttttaaactttccttatttttggagccatacctcaggagacttcattaattcatttggtgtttcatccttttttggtttcggaaacaggaaaattagcacgggtgatagcagaaaaaaagaataaattaaaaaaatgttgggtgatttcttgaacagattgctattgttggtttttggatatgcatatccagcatttgagtgctttaaaatggtggagaagaacagggttgagactgaagaactcagattttggtgtaaatactggatccttgtggcgtttttgacaattattgagaggataaccgacatattcgtttcct

SEQ ID NO: 9486 - DNA, 231 bp, Gossypium hirsutum
  Clone ID: uC-gsflmaxxa009e08b1
ggtcgaatatcgttctatatgacatcatttggtgaagaagcggctaccatatcatccgctgctgcacttaccaaagatgatattatcttgcctcagtatcgggaaccaggagctcttctgtggcgtggtttcacattgcaagaatttgtcaaccaatgctttgggaacaaggatgatggtgggaaaggtaggcagatgccagttcattacggttcaagcaagcacaacttg

SEQ ID NO: 9487 - DNA, 419 bp, Gossypium hirsutum
  Clone ID: uC-gsflmaxxa009e09b1
ctaaaattacagatcctaccctcctcttcttcttcttcactctaaaatattttatcaattctcgaaacccaatttccctttctatattcgtccctttgctttgattcgctgaacaaatagcaattcaattgagcttttaagttgaattcttgaacaaatttaaaaaggaatttacaatatgggaagcccaaatcaagatcggaatgaagggtcttgtgtcagcgtaagacgctggtggacatcacaagaaggagcctgtctgagaaggagacagacaggagctttggcctaaggaatttcaggtacattgagaccatcaaagaagctgtagaaagggaatggcctggagttgtttcttgtgctgatatccttgttctgtctgctagggaaggcatcgccccggtgggaggcccttatat

SEQ ID NO: 9488 - DNA, 350 bp, Gossypium hirsutum
  Clone ID: uC-gsflmaxxa009e11b1
atatacttggtgaagatcaacaaaacgttggcccttatgcaatttctgagttacgtgagcatttcttaaacggatacctcactgaaagtacacttgcatggtctgaagggagaagtcagtggcaaccattgtcctcaattcccgagtttgtttctgtaatttctcatcaggccaacaatttttctgctacaggtggtgatgatgctttcttgaacagtatgaaggaaggtgataattcaaaatgcagtggctcccaatgatagtgatggttgtggggtatgcagagaacaggcttagagagatttaaagaggcggaaactgacacagaacggatggaacaagtcacagtt

SEQ ID NO: 9489 - DNA, 297 bp, Gossypium hirsutum
  Clone ID: uC-gsflmaxxa009e12b1
gctcaaatggctatgcataaggtgtttggtgcggttttatttgtgttcttaggtgtaggcatctgttctgcaactagagctctactcactctaaatgatgtaggttctcacctaccaggtattggtcatggtggtgccaccattggtgtatatggtggtgttgggctcggtggaggaggtggaggcggttcaggaggtggtcggtggttctgcggttgtaggaggaggtgctagtgctggatatggtggtggtggtggcagttgcgaagcgctaattgtaaccctggccaagcagac

SEQ ID NO: 9490 - DNA, 359 bp, Gossypium hirsutum
  Clone ID: uC-gsflmaxxa009f01b1
aaaaaaataaaagcgagagaaacgagcgggcatgacgcgaaagccaacggcgtttgggacaatcctcacccttggctcaacctcttcgtgtccaaatcagacatcgttgaattcgatcggacggtgtttaaaaagatggtgaaaaatggaatcggtgggcccatgttaatctaccctcttttacgaagcaaatgggatagtcggacatcggtggcgttgccagaaggggagatcttttacatcgtggcgttgctccagtttgctccgaaggggccgtcggtggagaagaaagtagcggagaaccgtgagatagtgaaatggtgcatcaaaaagggattggattttaagctataccttcc

SEQ ID NO: 9491 - DNA, 466 bp, Gossypium hirsutum
  Clone ID: uC-gsflmaxxa009f03b1
tccacgcgtccggtctgcacaagctgccaaacacaatggtttatttattggttccaggtcttttcagcaaccatggccccctatactttgtcagcacaaaaacaagcttctcaaaattgggtctaacttgccatattggctcaaaacacagtgtggatcccaccggtcgttaccaaggagacttggatcttcaactcgagagaatcaatgtctactacaatgaagccagttgtggtagattcgttcctcgtgccgtcctcatggatcttgaacccggtaccatggacagcatcagatctggtcccgtcggccagatcttccgacccgataactttgttttcggtcagtccggtgctggtaacaactgggctaaaggccattacactgaaggtgctgagttaatcgactctgtcttagatgttgctcgaaaagaggccgaaaactgtgattgccttcaagggtttca

SEQ ID NO: 9492 - DNA, 447 bp, Gossypium hirsutum
  Clone ID: uC-gsflmaxxa009f04b1
agttaatccgcattttaggttcattgccatcttgtcccgatcagggtataattcgtgaagttctaaagttttcattgtctcctgaggttcgcagccaagacgctatgtatgcacttgctgttagcaaggaaggtcgtgaagttgcctggacttggttcaaggaaaactgggatctcattttaaaaacctacggtagtggattcctgataacacgttttgtcagtgcagttgtctcaccgtttgcatcatttgaaaaagtgaaggaagtggaggagttctttgccaaccgatcaatgccttcgattgcaaggacattgaagcagagcctggagcgggttaacattaatgccaactgggttaagagcattcacgcagagcaaaatctgggtgaggccatacaggagttagcttacaagaaatactaagggatttgtctttggttttact

SEQ ID NO: 9493 - DNA, 365 bp, Gossypium hirsutum
  Clone ID: uC-gsflmaxxa009f06b1
gcgttttcaaacccatgaagcaatgcgttactcccttttagccggtggcaaaagggtccgcccggctctttgtttggcttcctgtgaccttgttggtggcacagaatgcatggctatgccagcagcttgtgctcttgaaatgatccacaccatgtctttagtccacgatgatcttccttgcatggacaacgacgatcttcgtagagggaaaccaactgaccacaaagttcatggtgaagatatagctgggctcgcaagggatgctcttttagcctgttaccttgtacacatatctgtatgcacagcaggagtcacacctgagaagctcgtcagagcacttcgggaattaggtaaatgtattgaaa

SEQ ID NO: 9494 - DNA, 251 bp, Gossypium hirsutum
  Clone ID: uC-gsflmaxxa009f07b1
aaaaaaataaaaaataaaaatcccattaaggcttgaactgttcttcagccaaaatgggtatttctcgtgattcaatgcacaagaggcgtgccactggtggcaaaaagaaggcttggaggaagaagagaaagtatgagcttggaaggcaacctgctaacacaaagctgtcaagcaacaagacagtcaggaggattagggttcgtggtggtaatgtgaagtggcctgctgtgaggctcttcaccagaaactac

SEQ ID NO: 9495 - DNA, 421 bp, Gossypium hirsutum
  Clone ID: uC-gsflmaxxa009f08b1
tttctctaaatttcctacatttttttctttagaaaatttcagtttctccttctcttcacaaatcaaaatgcgtgagatccttcatattcaaggtggccagtgcggcaaccagatcggagcgaagttctgggaagtggactgctcacaacacggcataaatgcccccgggctgtgcctcacgaacatcatgctgtcccaaaaggggctgaaattggtactcttggttttggttttgaaggtggtcctgataaatgttgttcttctggatgttccggtaattgtaatcctggtggttttgttctaccatttcctcaaattccagaaatcccaagaattccagaaatcccacaaatcccacagatcccacatatcccacatattccactaatcccacagatcccacatgttccacagatcccac

SEQ ID NO: 9496 - DNA, 462 bp, Gossypium hirsutum
  Clone ID: uC-gsflmaxxa009f10b1
atggaattttctcaggctatccttgatgatcgcaccaagaaagcagaggcatggcatcgtgatgctgcagctcgtgcacggtatactcaacctgcagcacctattacttgtgctacatttgctcaaaatgttattgaaggaagggcaaatgtatcgcaagcacatgaccacaaacaccagccaatgatctttggaccacaaagccttataggtgggagcctaacaagtgaaagggaaaggatggcagcacaggttttccaacctgcttatcggatgccaactataagcatcgaggaagctggtctgagggagatggaaatgatgaataagtggcaggagaggaatgcaaaaatgtttgaagaagctaactcagcatggtacaaggacaaaccaaagatgggaccaagtgaagatgatgaagacgatgatgctgcccaagagaaggcacgagcatgggatgac

SEQ ID NO: 9497 - DNA, 424 bp, Gossypium hirsutum
  Clone ID: uC-gsflmaxxa009f12b1
ccctcgcgtccgaaatctttcatttctcgagtctttttcggggttttctctttttttttttcgtcggatcttcaacacttttttcaaaaatggctgagcacgaagagaagaagcacgaggaatcgttgatggaaaggatagccgagaagatccaaggtcatgattcgtcgtcatcggattccgataatgacaagccatcggaatcatcgatcaaggccaaggtcttccgtctttttggaagagaaaagcccgttcaccacgttctcggtggaggcaaaccggctgacattttcctttggaggaacaaaaagatatcggcaggagcgctcggtgtcgcaactgtgatatggattttgtttgaaatgctcgaataccaccttctccactaggtgggcatttgttgatacttgctcttgcagtactg

SEQ ID NO: 9498 - DNA, 310 bp, Gossypium hirsutum
  Clone ID: uC-gsflmaxxa009g04b1
cgttctcgtggggaaaatccgagtcaacattttgttccccaaattcattggcctttgcgcagatttctagggcttgtggcggatttcaattcccacttctctgtttgtgattctttaaggttttaactgccggtcagatttattcaattattactctcgcttctcttaatctcaatcttcgagaatcaatcataggagaggaggaagcatttacgagtctctagaaaatggattcgtcacatgcttcaacgttagggaccagttggagccgcggaaactgattgttacgcactcaaacctatgatactgc

SEQ ID NO: 9499 - DNA, 428 bp, Gossypium hirsutum
  Clone ID: uC-gsflmaxxa009g07b1
gtaccctatctctgctccttacatctcttacttctaccctgtacttcaatttatatttctcaagctctttttttttgtgaatttctaactaaagacgaacaaaaaaaaatgtcaagtgcattagagatgtcgctagacgacctgatcatgcgtaaccaccagttctgttccggaaatccccgcggtcgacgcctttgatacggactgtgacctaaccgttgctctactttacgaggaggaaaccagtaggacatttttgggaggggggcattcctcttggagctgttcatggaattgtggagtctttgtttagaagatacactgaaaatggaatgagtgaaggatcttgcttacaaaaacactgttgaatgcattacaggaattatatcaaagaccatctcacacagggcatgttggctgtatacaac

SEQ ID NO: 9500 - DNA, 465 bp, Gossypium hirsutum
  Clone ID: uC-gsflmaxxa009g08b1
ctcacgcgtccgctggcgtggcgctgctggatgcttttttttgatcaatagaacaggaagaggagggagcctagaggaaagaccacgaaaactacatggctcaacttgatgctactttcttcttggctctcattgccatctccatggttcaaactttggttatggcatcacatggacatggtggtcaccattatgataacaaacgttatggacctggaagtctcaagccttaccaatgtccatctcagtgcacaaggaggtgtagccagacacagtaccataaaccatgcatgttcttctgtcagaaatgttgcaggacatgcctttgtgttcctccagggtattatgggaacaaacaagtttgcccttgctacaacaactggaaaaccaaggaaggaggccccaaatgcccttaaattactcaaaagaagagccttttgtttgttttttacattattatcccta

SEQ ID NO: 9501 - DNA, 106 bp, Gossypium hirsutum
  Clone ID: uC-gsflmaxxa009g09b1
ttcatgggattcttattgcgtgtgaaacgagcggagcaagacgcgaaagccaacggcgtttgggacattcctcaccctaggctcaacctgggcgggtacaaatcaa

SEQ ID NO: 9502 - DNA, 338 bp, Gossypium hirsutum
  Clone ID: uC-gsflmaxxa009g10b1
gcgcgttctcggggggactatccgtgtcatccttttgttcccgaaattcattggcctttgcgcagatttctagggtttgtggcggatttcaattcccacttttctgtttctgtttctctagggttttaactcccggtcagctttatttaattattactcttgcttgtcttaatcttaatcttcgtgaatcaatcatcggagaggaggaagaaattacgagtctatagaaaatggattcgtcacaagctctcacgttctggtcaagtggtaacggcggaaacgggttggttagcactcaaactaatgatacggccaacgctacccctaatgatgatcct

SEQ ID NO: 9503 - DNA, 470 bp, Gossypium hirsutum
  Clone ID: uC-gsflmaxxa009g11b1
gttttgcgggctgtttcacggcgactagttccttcttcttcagttttaggccaatcatttcgaaatgctcgaccttcacgttgttacagttcttcctcaaatgaggcctatgcaaagactttagtttcgagaaaagggacatcacaagttgcagggattgtgggttctctagggtttccagttggctcaaggcctctaagggacgttatttcatttgttcaaagatatcctccaatatttgtccacactaggtcattttctgccgatagtggtgaacttgttgatgctgttgttcctttcatgggggaatccatcactgatggaactctagcaagttttctgaagcatcctggtgatcgtgtagaagtagatgagccaattgcacaaatagaaactgataaggtgacgattgatgtgagtagtcctgaagctggtgtaatcgaacagctggtagccaaagtaggtgacac

SEQ ID NO: 9504 - DNA, 473 bp, Gossypium hirsutum
  Clone ID: uC-gsflmaxxa009h04b1
tccacgcgtccgcttgtttcatcggcaagaatacgacgccgtatcccactactcggtgcgtttgcgtcctgggtttggggttccccagtctctgctcaatactcccttcttcctcttacctcaagacgagttgtcctcagtctccccattttgttcatatagaaaggtcgaaatttagtacccaatcagcagataagaccgttcaggctgtgaaaatggaggggaatagcaacattgttccaagcatcgtcgtctatgttactgttcctaacagagaagcaggtaggaagttggctggaagcatcgtgaaagagaaacttgcagcttgtgtaaatatagtaccaggtctggagtcggtgtatctatgggagggaaagataaactcagatcctgaggagatgctcataatcaagacaaggcaatccctcttggaagctctaacagagcatgtgaaggcaaatcacgaatatgat

SEQ ID NO: 9505 - DNA, 437 bp, Gossypium hirsutum
  Clone ID: uC-gsflmaxxa009h06b1
gccttacaagaagtctgtctgtatcaccgagcccgaggtatagaaatcgtcgatatggtcatagccgcagtcgtagtcgaacctctattcgcagccgtagcccaagtcgaagtcgaacccctgttcgcagccgtagtccagttgattctccaagggctggacggcgaaggtccccttcacagagcaggagccgatcagaatcaaggtcttcgttgaactctcagtctccaaagaaggtgagcaaagcaaagtcaaggtcatcatcaggaagtccagacggtggaaaaggactggtctcttatgatgatggttcacctgactcaggaaggtgaaatcgagtgaaagttggttgaagatttttgcttagtggttgatgagccccatcttctgttgatgcactgaactgtgcagttttacgaacttcttgtctctgattt

SEQ ID NO: 9506 - DNA, 149 bp, Gossypium hirsutum
  Clone ID: uC-gsflmaxxa009h07b1
tcctctcgtccgcccacgcgtccgtgtatctgtaaatccctaaccccttccctcctccctttttttccccaaatcgaaaacccacctccaccgatccaccatttcacctctggtgttcagtcctcccaactccacctccgttttagtct

SEQ ID NO: 9507 - DNA, 428 bp, Gossypium hirsutum
  Clone ID: uC-gsflmaxxa009h11b1
gcgtttacgcgtactcccactcgttcaccgacccgtgggcttagactgccttcatgtgtgaaccgaccttgttcattgtatttctttcctgccaggtggtagatctggctgattttgctgctctgttgtttcatattctgctgttagactcttaaatcgaagaacccctggcatgtctagtccaatgccttgacggacaagtcttcaattgaacatattcaggctttagatcaccatgttgatcgggaaccggtttcaaagaagacaacactatgagaaaacagtttggtttcttctataactttccatgttttttcttttcatctctgataagtagagccataaattctaatgtaaagcagttgaaatctttctcaagttcaagggcacatatatatatcacatattggaaatagttcaacattttc

SEQ ID NO: 9508 - DNA, 479 bp, Gossypium hirsutum
  Clone ID: uC-gsflmaxxa009h12b1
ttctttggagaattagcaacaaatgcaggacctcagccatcagtaggatatttaagaccaacaccagaaacatgaaatccctgatgacatgtcatttgtatcctgcgaattcctaaggttcgaccgggactcaacatccgccaattcatcataacattaatacgattatacatcgatccatttacattaaaaataacatagtaaacattcaaattaaacaacattaatatgataaccattcatacaaacttaccgtgacaactaggggcgtgaaggttatatcgagctaatcagaagcttttgcattacttcgatctaggtccgtacatggtttatcttgatctaaatagaaaatttcaatctatttaatatttgtagtactcaatttagtccacatttcatatttatgaaaaattaccattttaccccttatatttttacttttcacatttagtccctaagctcataaatggaatcta

SEQ ID NO: 9509 - DNA, 558 bp, Gossypium hirsutum
  Clone ID: uC-gsflmaxxa010a01b1
ctcgagttccacaatttggaatcgtagcttgtctctccaatcctatcaaggtcctgtttgcatccaactagttgtttccaggacctaggctttgatagttaaaataaaaaccactatgggttttgctagttatagttatagttggtttttgttgtcatttttcgccctaatcccaacactaagagctcacatcgctgaatatgatgagtattggaaagcacgagaattggaagccattgagaacttgaacaaggtttatcaccccaatccggaggaggtggtccggcattacaatgaccactttgtcaataccatgcttgagtataataacaccagaagggtgttgaaaggaaagaaaaacggtccctgtgagattactaaccccgttgatagttgttggcgatgtgatcctaactgggtaaagaacaagaagaggttggccgactgtgcccctggatttgctcgtggtacgaccggtggaaaggacggcaagttttacgtggtcactgaccctagtgatgatatttctaaccccaagcctggaactttgcgtcatgc

SEQ ID NO: 9510 - DNA, 558 bp, Gossypium hirsutum
  Clone ID: uC-gsflmaxxa010a02b1
aaaacagcaatggtgaccactctttaccatcgaccgcaccgccttctcctcgatacgcaaccgaacgcatcgccatcgctaccgaatggaagcaggacgcgcaacgctttcgccaatgaagccaactttgacaccaacatggtgatcatcctagcggctttgctttgtgcattgatatgtgctctaggactaaactccattatgcgttgcactttccgttgcggcagaaggtttggtttggacgccacggaagagaccgcggcgcgtttggctgccgcgacgggcctgaagaagagcgcgttgcgtcggcttccggtggccgtgtatggttcagggatggatatgaaggctactgagtgtccaatttgccttggagaattcatgggtggtgaaaaagttagggtgttgccaaaatgtaaccatggtttccatgtaaggtgtatagatacatggttgctgtcacactcatcttgcccaacttgcaggcagtcattggtggatcaggcaactagcagcagtgatggtgcagtggagatcgaaaacggaatccgaccacat

SEQ ID NO: 9511 - DNA, 559 bp, Gossypium hirsutum
  Clone ID: uC-gsflmaxxa010a03b1
cccacgcgtccgctctctctctttcatttcttttctttttctctcccacaagttgcagttgcagagcttcgccattgttgtcttccttcaagctttttcagtttcttattcactcttcttcaacacccttttgatttttgctcttcaaccatggctgctttagtgcttccgctgctcatcctggctgccattactggccgctcaagtggcaactggtgtatatgcaaagatggtgtaagtgatacagtattgcagaagacactggactatgcatgtggtgcaggcgccgactgtaaccctatccacttgaagggatcctgttttaaccccgacactgttaaggctcattgcagttacgccgttaacagttacttccaaagaaaaggccaagctcaaggctcttgtgatttttccggcactgccaccgttactaccgctgaccccagctatactggttgtgctttcccatctagtgccagtaccgcaggcaccaccacaacaccaacaactacaccgtcattcaccacaccctcgtccgtgaaccaatcaacaacacccc

SEQ ID NO: 9512 - DNA, 512 bp, Gossypium hirsutum
  unsure (1)..(512): unsure at all n locations
  Clone ID: uC-gsflmaxxa010a04b1
gcgaaaaaaaataagaaagagaatgaaatcaaatctttagattgattcatttaattttctctcttttgctctcatttcctgcaactccgatctataaaattccatcgtttgttggaaagagcaagagaggaaaattaaatcaaagataaaacgattattagcaataaaggacgacaatgaagaactgtgaaagactcgctaatttagctttagcagggttgacgttggcaccacttgttgtgaaggtggaccctaacttgaatgttattttgactgcatgcctcgcagtatatgtgggctgctatcgttctgtcaagccaactccaccattggagacaatgtctaaagagcatgctatgcgttttccgttcattgggagtgcgatgctgttatcacttttcttactgttcaagttcttatcaaaagacttggttaatgcagtattgacatgctatttctttgtgctaggaacctgtgcccttntcgcaacaatattgcctgccatgaaacgc

SEQ ID NO: 9513 - DNA, 500 bp, Gossypium hirsutum
  Clone ID: uC-gsflmaxxa010a05b1
gtccaatttctcttcttctcttgtttcccataattttcaacaaacccagaaatagagaagagaatcgaaaacaaaaatgggagacgagaaagtaaaggaggaagccatgcggatgattgggatgttccaagttcttcctcgtttggtcgttttcgatctcgattacactctctggcctttttactgtgagtgtcgatccaaacgcgaaatgccatcgatgtacccccatgttaaaggcataatagccgcactcaaggacaaagggattgatctagctattgcctctaggtctcctactgcagatatagctaacacatttcttgacaaattgaatatcaagtctatgtttgttgctaaggaaatattttccagctggacacacaagaccgatcatttccagagaattcactcaaggactgggattcccttcaactcaatgctcttttttgatgatgaggataggaacatacaagctgtctcgaagatgggagtaacaagca

SEQ ID NO: 9514 - DNA, 265 bp, Gossypium hirsutum
  Clone ID: uC-gsflmaxxa010a06b1
gctgatcaaggggtcgatgtgattgccctggcaagtgaccaagttgatgttcctgtgtatgtggattacattgatattgatcctggagggaattcacagcatgatctttctctagcactgcatacagacacgagtaggcagccccaatattatgaggctaatttaaatggtgtggagacattcaagataagtgatccgaaaagcatcacttgcagggccgaatactgaccctggcgcaaaacaggacgtagtcaatccatcattg

SEQ ID NO: 9515 - DNA, 430 bp, Gossypium hirsutum
  Clone ID: uC-gsflmaxxa010a07b1
gaataaacaaaaacagcaagctatcacatgggtccaacaatggcggcaccagaagaagagttgaggaagaggaaccaggagttagagaaggaattgaaggagagtagggaaagagaggagcagatgagaaaggaattacgaaagatgtgggaaaggctgagggtggcggaagaggcggaggaaaggctctgttctcagctgggcgagctggaagcagagtccgttaatcaggcccgtgcttacaactcccacatacttaccctcatggaccagctctccaagggtaacaaccttctgatgaacaaccacccatccgctgcacccatctccatgctgtgattctgctgttggctgatgttctttttatctatctaaccaaaggcatggggattctaaattcgttaattttgggtatggcctggatctatat

SEQ ID NO: 9516 - DNA, 551 bp, Gossypium hirsutum
  Clone ID: uC-gsflmaxxa010a08b1
ggagcaaagcggttgatgtttcaccaaactcctgtgttggtgttcaaaaactggatcaagggcattctcgaaattcagagacctctgcgaagattgtggagttgaggaaactaggcatacagtctcaactctcggcaaaaaagcctaaatcagatgaaatgtcagaacagttccaggatgagattcaaagattaaaggtgcaaaaggttcagctccaatgcaagatgaagcttgaatcgatgcagttcaggttatgcaaggcttcgcttgaaaaggaaattcttcagcttaagaaagagcaaaggaggaacaagtatgagaagcatgtgctctcaactctcattcagaggcaaaagcatgtattgcagcagaaaacaaaagaagcttttgtggcagcaaaacgtctaaaacagctaactgaatctagaaaggctacatccggcaaaatagctggtgctagaatcgcatcaacattggaactcagggtattgagaatgactttgagccaaactgaagcttgtgagtatgttcaaatccaacatcgaattgaa

SEQ ID NO: 9517 - DNA, 562 bp, Gossypium hirsutum
  unsure (1)..(562): unsure at all n locations
  Clone ID: uC-gsflmaxxa010a10b1
gtttgctaaaaggaattcgccggtggctcatgctgggggatattgggattaccattctttgattttggctgcttccatttatgagcctttgggttttgggactactggtggtaagcgtatgcaaatgaaggaagtcgcggcttttcttgcacatgtcggcgccaagacatcttgtggagatggtgtcatagacggaggaccgttggcatggggtctttgcttcaagagagaaatgagtcctagccaggattactgtgatgattactacaaatacatgtatccatgtgcccctggagctcaatactatggccgtggtgctttgccaatttactggaactacaactatggagctgctggcgatggtataaaagttgatttgttgcaccaccctgagtatctcgagcagaacgcaactattgctttccaggccgctatctggaggtggatgaccccaatcaagaagaaccaaccttcagcacacgacattttcgtgggcaactggnaaccaaccaagaacgacacagaagaaaaacggngtcctacttttggctcaccatgaacg

SEQ ID NO: 9518 - DNA, 418 bp, Gossypium hirsutum
  Clone ID: uC-gsflmaxxa010a12b1
aaatttcatggagattttgaggcttctccggaggacaaaaaaagtgtttattttccatggaagacaaaaaaggctataaaggaaatttagtagtttcttcaaatcctaaagcacttcccaggagtagttttaggcagatcactgcgataaggaatcatagaaatgttaagggtgcagcaggtcatgtagcgatatttttgctcaaagttgctgcattagaaacagttaggcgggtctcaaaggccaagtgtccctttttatggcgcggttttcaggctctgcaagttatttgctatccgccctttaactttgtccagaaatgggttccctttaagggtttggttaaaggaatgcagatgttgtcgaggccgctattgttgtttcaatcgcgacatcgctttctgatcaagagagttag

SEQ ID NO: 9519 - DNA, 514 bp, Gossypium hirsutum
  Clone ID: uC-gsflmaxxa010b01b1
gaagagatataattgaaagaaaagaaaaatggttctgctagagaaactttgggatgatgtagtggccggtcctcaaccggaacgtggccttggccggctgaggaagatcaccaccaccccacccttgtccaccaaagatgaggcttcatcaatggcgatgccgacgagtccgacgacacctgggacaccatcgacgccggtgtcggctcgtagggacaacgtgtggaggagcgtgttcaatccaggtagcaaccttgcaaccaaaggtattggcgctgaagttttcgacaagcctcaacctaactctcctactgtttatgactggctttacagcggggagacccggagcaagcatcaccgttgattaggcggtggctgacggcggcggatggtagcaaaaccactagcagaaggttgcagctactgaaggagcaagatttgcatgtaaatatatataatcgcctttttaaaagtttctcaatgggtcaattaagtagtagtagtaagtaagatg

SEQ ID NO: 9520 - DNA, 413 bp, Gossypium hirsutum
  Clone ID: uC-gsflmaxxa010b02b1
cgggcctctatcctccatctgactccaattgcgatggagcagaaggaagatcggccactaggtacgacgcatggagggtggacgtggcatgtatggaagcgcgcgtgaggccgagggaatgccctggtggctgcggcggtggaggctcgcccttgctgctaaggtttctagttctttttctgttttgggcttcaatgtaattgggccggggtatcgggctactataattgggccattcgagtttaagtttgattttagtctgtaattttggacatttgggcctttattttatttggtatttatttgtgtacgggccgggcaatattgggccattacaatacgtattagaaaaggtagcatttttcaaaaaatgttgctatgattaaaaatgattgtaacatctaataacattc

SEQ ID NO: 9521 - DNA, 495 bp, Gossypium hirsutum
  Clone ID: uC-gsflmaxxa010b03b1
cccacgcgtccgcccacgcgtccgagaaaatcaggagtaactgaagaagatgcagatattcgtcaaaaccctaacagggaagactatcactctcgaggttgaaagcagcgataccatcgacaatgtcaaggccaagattcaggataaagaaggcatccctcctgatcagcagaggttgatttttgctggtaagcaactggaagatggccgaaccctcgctgattataacatccaaaaggagtccactcttcacctagttttaaggcttaggggaggaaccatgatcaaggtgaagactctcaccgggaaagaaattgaaattgacattgaaccaactgataccattgatcgtatcaaggaacgggtcgaagagaaagaaggaattcctccagttcagcaaaggcttatatacgccgggaagcaacttgcagatgacaagacagcgcgggactacaatattgagggtggctctgtgctgcatcttgtgcttgcact

SEQ ID NO: 9522 - DNA, 523 bp, Gossypium hirsutum
  Clone ID: uC-gsflmaxxa010b04b1
ggcttcaaaacagatggaccaagtgttttctcaccggtccaccgatttccccaactctcacttccttagggtagaagctgaagaacagcctgagatatctgaggaatactcggtttctgctgtgcctttttttgtcttcttcaaggatggaaaggttgtcgataaattggagggtgcagatccttccagtctggccaacaaagttgccaaggttactgggtcaattaaccccggagaagctgctgctcctgctagtcttgggatggctgctggccccaccgtcctcgagagtgtccaagatttggcaaaggcaaacggttcttcccaaatgggaaatcaagtgcaaactggtctcgatgacaaaattaagaaacgattgcagcaattgattgactctcatcctgtaatgctattcatgaaaggaaaccctgaagaacccaagtgtggttttagcagaaaagttgttgatattttgaaggatgaaaaggtgaaattcggaacattcgatattatatcagacaat

SEQ ID NO: 9523 - DNA, 466 bp, Gossypium hirsutum
  Clone ID: uC-gsflmaxxa010b05b1
gtttctcgagaaaattcacttcattttcctggaaattatctcttaattccagaaagttttgctcactgattagtaacaaagatttgtttcaattgttagtgccatatagtaaacatgattggatcaacggatttcattgatgagatagattgcggcagcttcttcgatgacctcatcgacttccctaacggagatgtcgaagcctacgactccaccgccgtcatcaacgccgccgcgtttcctactattttgacaactcagcccgagtcattacctttttctgactcggtttttctcaacaacagtgcttccgagctttccactgaactctttgttccgtatgaagatattgatcaattggaatggatgtcaaaatttgttgaagatactcagtgtggagcaagcttgacaaaaaagaaagaagattcctcttcaatcagtgagggatccaataatcaattccaga

SEQ ID NO: 9524 - DNA, 445 bp, Gossypium hirsutum
  Clone ID: uC-gsflmaxxa010b06b1
gaaaaaaaaaatcacctactctctcactttgctctattcttgttcctgtcctctttcaccaaactatcgccgacaacctctccaaaagaatggcactatgaagggattctgatggggatgggtaatcctctccttgacatttcgttagtcgtggacgaagagttctcgacaaaatatgatatcaagttgaacaatgcaattttagctgaggagaaacaccttcccatgtatcaagaaatggcatccaagcccaatgtagagtatattgctggaggtgctactcaaaattcaatcaaagttgcacagtggatgcttcaaattcctggtgcaactggttacattggctgcattgggaaggacaagtttggggaggaaatgaagaagaactcaaaagctgctggtgttaatgttcaatatctcgaggatgaaactgcaccaacaggaa

SEQ ID NO: 9525 - DNA, 518 bp, Gossypium hirsutum
  unsure (1)..(518): unsure at all n locations
  Clone ID: uC-gsflmaxxa010b07b1
cccacgcgtccgaataagggtcccgactccgactctcccgaggctactcgtgtagaacctgatcctgatgatggagaagataatttgccggaaacaaggcgtataccggaggaattgctgaacatcctcgacgattcagatccggttagtggaccagatccggcgattcagggactcgattcggtcatcaggagtttcgaagaagagatcttatttccggaacaggtggctttaccggaaacgatattggattccggagagtcgaggccggagttagggtttctatttgaagcttcggatgatgaactgggtttgccaccgagtttaccgtcggttgaggtggagcagagatttgagaccgcctttgatgtggatgaaggtggagggtcaggcggcgttggatttggggaaatgatggngagtgaagttcccgattccgatctacgaaccgtttgaattcggaatcggcgttgactcagataccaataacaatatccatagtaataatacccgtgatt

SEQ ID NO: 9526 - DNA, 504 bp, Gossypium hirsutum
  unsure (1)..(504): unsure at all n locations
  Clone ID: uC-gsflmaxxa010b08b1
cccacgcgtccgaaaacaggaagctacggaggaaaaaggcgaattgcagattgggagaaagagaaagaaaaaggaacaatatttcactgaaaaccatgaatactgtcttctcagttgacgatttctccgactccttctgggcggctccggcttccgatgatgcgcttgggatgacccgaagccattccgagtgggcgttggaaaggtttctggaagaattttccggcgccggagtggcgatctctgggtcgcatgcgggcgagaatgtgatcggtccgtccttgatgtcacctcagtcgtccgttttccaaagtggaagaaggtaacgtggtggagataaaaaggcctaatagccagaatcataatcatccgccgtctgatcaaacgccgacagttccgactgactcggatgattaccacacgatcctcaagagcaagctcgaactggaatgcgctgcngcgttggctgtgaaagcagaagattcgtctgccgaagctgaaaat

SEQ ID NO: 9527 - DNA, 434 bp, Gossypium hirsutum
  Clone ID: uC-gsflmaxxa010b09b1
cccttcgcttctccttctccgcctcttcttcaaccacgatggctaaacaagttttggtgccggttgcgaatgggacggaaccaatggaagctgtgattacgatcgatgtcttaaggagatcgggagctgaagtcatggtggcttccgtcgagaaagagcttcgcgttgatgcttgccacggtgttaagattgttgctgatgctctcgtcggtgattgtaaggacaccggtttcgatctcatcgcactccctggaggcatgcctggtgctaccaactttaaagattgtgcagttcttgaaagtgttgtgaagaagcaagctgcagacggacgtctttatgctgccgtgtgtgcttcacctgcagttgcgcttggttcatggggtctgttgaagggactgaaagctactttgtatcctttatttatggagcaactg

SEQ ID NO: 9528 - DNA, 340 bp, Gossypium hirsutum
  Clone ID: uC-gsflmaxxa010c01b1
gcactgaggtacacactaggaggcgacgaacattgagacgtatttgttagacaatggagctaacattcatcatgatcaagcctgatggtttccagagggtttagttttctcctttttctttttttttttcttttttttttctcttttttttcttattctctttattttttcttttatttttttttttttcttttatttcttttattttttttttttttttttattatttcttttttatttactttttatctttcatctctttcttttcttttttctttttcttctttttttttcttttatttcttattatctttaatttttttatctttttttattctct

SEQ ID NO: 9529 - DNA, 99 bp, Gossypium hirsutum
  Clone ID: uC-gsflmaxxa010c03b1
cccacgcgttcgcggacgcgtgggctcgcgccctattatggggaatttaagacttgagccatgtttcactatgccgcaaaggtagaggtgcctatagac

SEQ ID NO: 9530 - DNA, 54 bp, Gossypium hirsutum
  Clone ID: uC-gsflmaxxa010c06b1
cccacgcgtttcgcccacgcgtccgattgatatctctgagggtgtattttttaa

SEQ ID NO: 9531 - DNA, 228 bp, Gossypium hirsutum
  Clone ID: uC-gsflmaxxa010c07b1
caaagaagcctaaggttgaaaaggaaaactctaaggatggattcaccaaagagaagcttgcagttaagaagcaaacaaacaagtcatcagcaaaggtttctgctaaattactaggtatatgcttaacctgtctgaaatcttatacttgtgcttattttctatgagatttatgttgtatttctttctatttattattatttgttttaatttttttttatttttattctt

SEQ ID NO: 9532 - DNA, 69 bp, Gossypium hirsutum
  Clone ID: uC-gsflmaxxa010c08b1
cccacgcgtccgcggattggataacttggaggaagggttgtttttgaaggcagtggtgattaacataaa

SEQ ID NO: 9533 - DNA, 113 bp, Gossypium hirsutum
  Clone ID: uC-gsflmaxxa010c09b1
agatggtattatagaaatagcagactcttactccttccggggatgaactgaatccggcgttttaaaacctgagaattctaaatctagttcgaaatgcccacatttaaccacgt

SEQ ID NO: 9534 - DNA, 261 bp, Gossypium hirsutum
  Clone ID: uC-gsflmaxxa010d01b1
cccgattctgaagctcctgcgaaattaaaagctcctctttcaatctcacaaattagggttttccgtaacaaaatcccttattagggtttccctcccattcttcaatttttcgagctcgttgtcttgcaagcttgttttattagatacataaaatgtcaaggacaagggaagagaatgaagagcagatagaccttgaaggggacaatgaacaagaggagaccatagaggaggaggttgaatttgaagaaatagaggatgagg

SEQ ID NO: 9535 - DNA, 512 bp, Gossypium hirsutum
  Clone ID: uC-gsflmaxxa010d02b1
cccacgcgtccgcccacgcgtccggttaggatgcacaagtaaagctgaagctcctcttcaatggcgaactctaagcttaccacttatcttattctcatcatttgctcttgctttacagttccttcaacagcaaagacatcaactttagtacaagaaatcaagcagcaaagtcaggttcaagataaagaaccgtttgtgggtgttaacttaggcacggatgtctcagatctgctatcagcaacggacttggtttcattcttgcaagtgcaaaaaatttcgcacattcgactttatgacgcaaatcaagacatactcaaagcattggcgaagacaaagatccgggtcattatcagtgtaccaaataaccagcttttggcaataggatcatccaacaccactgctgcttcttggatcgatcgatacgtcgtcgcttactacccggaaacgctcatcaccggtattgcttgtggagatgagcgttttaacaacccgtcccgccctcaggtcctttg

SEQ ID NO: 9536 - DNA, 274 bp, Gossypium hirsutum
  Clone ID: uC-gsflmaxxa010d03b1
cccacgcgtccgctgactcacttagatggcagacaacttctcattaaaacccaacctggggaagtcgttaagcctgatcaattcaaagcaataaacgatgaaggaatgccgatttatcagaggccatttatgagaggtaaactgtacattcagttcactgttgacttccctgactcgttgaccccggaccagtgcaaggcactagaggctgtgcttcctcccaaggcattggttcagttgattgacatggagctggatgagtgcgaggaaacaa

SEQ ID NO: 9537 - DNA, 489 bp, Gossypium hirsutum
  Clone ID: uC-gsflmaxxa010d04b1
caaaagttgatggatgagataagtagtctgtcctctccatcttgctggagtaaggaatacagtaggcttggcgatatgcagcctactaatcttgctgatgcatttggatcactcgatccttccttgctatctccattgcatggactgtccgtaaaatctgcaacaccaacccagatgcaatctccaactgctcttcaaatacgccaaaaccaactccgcgcaacctacccaccaaaccattcatcctcccttgtaaggaacccctcggcatatggtttcgactcctctgctgcagtggcagcagcactaatgaactcaaggtcttccgcatttgcaaaacggagccaaagtttcatagaccgtggagcagtcaccagtcgtgccggactcactgcacctgctaattccgcaaccatgatgtcctcaaacatatccgattggagctcccctgatgggaaacttgattggggcattcaaggagatgagtta

SEQ ID NO: 9538 - DNA, 249 bp, Gossypium hirsutum
  Clone ID: uC-gsflmaxxa010d05b1
tcaaaatcccctttttctctgcagcctttagcataatctggagtattttcgaaccaaaaaaaaaggaagtataacaacaatgaaactgagactgagaaatcatgaatccagagaaaccctgagaatccaactcctatcttcttgttctttttttcaactccaggaaaccctttccctcttcctccctccgccccatactcctccctctttcctacgtttttacctcaacgccaacgacttgctcctctc

SEQ ID NO: 9539 - DNA, 86 bp, Gossypium hirsutum
  Clone ID: uC-gsflmaxxa010d07b1
gagaaattctgctttccaatacagttattgctcctttctttttatccttctcggttggcttaaggataaagactcatatataaagt

SEQ ID NO: 9540 - DNA, 284 bp, Gossypium hirsutum
  Clone ID: uC-gsflmaxxa010d09b1
tgataatcatataaagcggaagatattttagccattggcatcaagctcaaacttccttcttgcatgcgtgctcctccggaagcacacactagaataagaggtaaaaaattattggtagcatatttcgatcaaacgggtgattttatcgcctactacggatcccatactacctcctataaactgaaaattcattacttcgattgttataggaataccgcatagtctacccgagcctgctttaatagtctcagtttatcctgtatatttattgctaaatattaatt

SEQ ID NO: 9541 - DNA, 394 bp, Gossypium hirsutum
  Clone ID: uC-gsflmaxxa010e01b1
tttttattccgctattttctctctccccaaacacccttttaagccaaaaagaagacaatggccgatcagctcaccgatgatcagatctctgagttcaaggaggcctttagcctattcgacaaggacggcgatggctgcattactaccaaggagctcgggactgtgatgcgatcacttgggcagaaccctactgaggcagaacttcaagatatgattaatgaagttgatgctgatggaaatgggaccatcgattttcctgaattccttaacctgatggcgaggaagatgaaggatactgattctgaggaggaacttaaagaggctttcagggtttttgacaaggaccagaatggtttcatatcagcttgctgagctgcgccatgtctttgacaaa

SEQ ID NO: 9542 - DNA, 200 bp, Gossypium hirsutum
  Clone ID: uC-gsflmaxxa010e02b1
ctcagaaactcagtttctttttctctctcttgatttattacattcagtacaggtagatctatctatcctctacctctgttctccttacctgttgtttgtttttcattttacttatcctcaaactctttccttttgaagaaaaacttgaatttttttatctgacaaacaatggtgttcttactgtttttcttatgatctat

SEQ ID NO: 9543 - DNA, 57 bp, Gossypium hirsutum
  Clone ID: uC-gsflmaxxa010e03b1
actatctcgttcgcttaaaaccataaactctttttggcgatcctttatacaaacact

SEQ ID NO: 9544 - DNA, 406 bp, Gossypium hirsutum
  Clone ID: uC-gsflmaxxa010e05b1
cccacgcgtccgcgcaattttgcaatatattttcccccttttatttcccttgtccgaagaaacaacattgaaaaccctaaccctagccacatcttcacccaaatctttaattatttgcgcttttctcatcaaaattcatcaaatcatcggaatcgatggcagctaaaccgcttacaagtgaagcaatcgctctgacagaaaagaagatggacatgacattggatgatatcattaaaatgtcaaaaactagttcaaataaaaccaagaagcagcgaagggtactgaataaaggtccgaaaccttttaataatgctgctaaagcaaaggctttgaaggttcgacagtatatggattcgcggtcctcttgtagacagggagttctagcttaaagaagatcaaacatccc

SEQ ID NO: 9545 - DNA, 82 bp, Gossypium hirsutum
  Clone ID: uC-gsflmaxxa010e07b1
gagtaaaccaaagatattcttcttcttgatgtggctccttttaccctcggtatcgagactgtatgtgctttaattactcaaa

SEQ ID NO: 9546 - DNA, 287 bp, Gossypium hirsutum
  Clone ID: uC-gsflmaxxa010e10b1
ctcttacttctgccttgatatccttagatcaagatctcttctgatttaaccttgaatcagcaatggaggaatcatccctagctacaactttacccaaaactttaattatttgcgctttacttataaaattcatcaaatcatcggaatcgcttgcagcttaaccgcttacaagtgaagcaattgatctgacagaaattacttttatcatttactttgtattcacattattataattgtcaaaatctagctacaaattaacctctctatctcttatactatatttttat

SEQ ID NO: 9547 - DNA, 61 bp, Gossypium hirsutum
  Clone ID: uC-gsflmaxxa010e11b1
tcctatgttgatggcaacaacactataaaccccggggatatatttaaaaataataaacctt

SEQ ID NO: 9548 - DNA, 226 bp, Gossypium hirsutum
  Clone ID: uC-gsflmaxxa010e12b1
tcttattctcctaattttctttcgtttaaaccctaaccctaatttccgccttcatgtagtaacatagaattcctcacgaaaaataaagaaaaatgattccttttgttcctgccatatttcttcacgtcattttcatcttcttcgcgcttgtcaacggcgagcaggagactatttacgatatcctaaaggcccatgggctacccacggggctgcttccgaaggggac

SEQ ID NO: 9549 - DNA, 185 bp, Gossypium hirsutum
  Clone ID: uC-gsflmaxxa010f03b1
ctttctactggcgtggcgctgctggatgctttttttttgatcattagaacaggaagaggagtcagccaaaaagaaagaccaccaaaagttatgaccaccatgatatttcttattgatttgatcttatatatttctatcttctcttaaatctcttataatttctttttttcatctttattaattta

SEQ ID NO: 9550 - DNA, 162 bp, Gossypium hirsutum
  Clone ID: uC-gsflmaxxa010f07b1
tcgattcccccagaccagcaacgtctcatctttgccggaaaacaactcgaagacggtcgtaccttggccgactacaacattcagaaggagtcaactctccaccttgttcttcgtttgttcggaggtatgataattctctttttgactcttacttgattgtct

SEQ ID NO: 9551 - DNA, 91 bp, Gossypium hirsutum
  Clone ID: uC-gsflmaxxa010f10b1
ccctcgcgtccgcccacgcgtccgttttataataatagatattgttatttattattttaactcttccagtttgattgttcttcgtttttgt

SEQ ID NO: 9552 - DNA, 59 bp, Gossypium hirsutum
  Clone ID: uC-gsflmaxxa010h03b1
gaaagctgaaacgcctgcacgcacgcgacccgaatacccgggacaaccccacacgccca

SEQ ID NO: 9553 - DNA, 100 bp, Gossypium hirsutum
  Clone ID: uC-gsflmaxxa010h05b1
cgtttatatatcgtttgaaatccttacggaaacccgagaggagatgatttaaaaactgcatcttgtagctaaaactccatccttatagttattccggagg

SEQ ID NO: 9554 - DNA, 77 bp, Gossypium hirsutum
  Clone ID: uC-gsflmaxxa010h06b1
cccatgcgttcgtgcaatcataaggtactatgcagaaaaaggcttatttcaagggactgatctactgcgaaagacag

SEQ ID NO: 9555 - DNA, 54 bp, Gossypium hirsutum
  Clone ID: uC-gsflmaxxa010h07b1
ccctcgcgtccgaggagatgtaattgatgcagatgggactgacatcaagtgaaa

SEQ ID NO: 9556 - DNA, 53 bp, Gossypium hirsutum
  Clone ID: uC-gsflmaxxa010h11b1
ctataggtgaagctggaacgcctgcgagataccgaaccggaatatccacaaca

SEQ ID NO: 9557 - DNA, 505 bp, Gossypium hirsutum
  Clone ID: uC-gsflmaxxa011a01b1
cccacgcgtccgataaaaacctctgtttctctgttccattacgttatttgcttcttcttctttttgttccgcctttgtcgaatctcgtaagaactgcattttagagaccggttcttcgtctgggtttcacctcgttagccagattttagcacattctggtcaaattcggaaatcatattactaggcaaataatgttctgttatctgccataaatgtggtgtagctttggagatgagaagtttcgaggaagcccgcaattgatggactgctcacccagcagtagtgataagaaaacattgaagaggtggtttttcattgacaagagggtcggataaaaagttcttgtaaggattgaaacttcataactctacttgacaaagctgattctatcgtaaacaatctagtttaacctggtataagtgtattaaaaagtgatccgaagttatcatcgacgaaaaggaaaaagaagtggtctgaatcttatggagttgaagtcaaatcattc

SEQ ID NO: 9558 - DNA, 515 bp, Gossypium hirsutum
  unsure (1)..(515): unsure at all n locations
  Clone ID: uC-gsflmaxxa011a02b1
gtttacaaccgtgattactcgaaaaagctcaggcaaggagaaaaaaccaccagaaattggcggtgcaaggccatttcttggccacctccacctgttaggagggccaaaaccagcccacattaccttgggtaactttgccgacgcatacgggccgatcttcaccttcaggctaggcatgcacccaacactagtagtaagcaattgggaaatggctaaagagtgtttcaccaccaacgataaagccttcgccagtcgtcccagaactctagcggcggagcttttgggatacaacttcgccatgtttgggttcagctcttacggcccttactggcgtcacgttcgcaagatagcgacgctcgaggtactgtccaactaccgattggcaaagctgagacatgtacgagaatcggaaatcagagcatcaatcaaacggctttacgagttagttaccaaaaattgttcggaaccggtggttgtggagatgaatagatggttntggactttgaacataaaca

SEQ ID NO: 9559 - DNA, 514 bp, Gossypium hirsutum
  unsure (1)..(514): unsure at all n locations
  Clone ID: uC-gsflmaxxa011a03b1
gtcgaaaactggccccacattggataatactcatgtgagcactgttgtgaagggcagctttggctatttggatcctgagtatttcagaaggcaacagctaactgataagtccgatgtttactcatttggggtcgtcctttttgagatcctttgtgcccgtccagcattgaatcctacgctgcacattgtcacaagaaaggcatccttgatcagataatggatccatatctgaaagggaagatagcaccggaatgcttcaaaaagtttgctgagactgcaatgaagtgtgtagctgatcagggaatcgacagaccgtccatgggtgatgtgctatggaacctggagtttgctttgcagctgcaggagagcgccgaagagagtggcaagggaattagtgaattggaagttgaggaggggacctacgatgtaacctgtaaaggcaaaaaggatcctaatgcatcccctggttttgacatanatgtggcagattcgaggagcagcggcatgagtatga

SEQ ID NO: 9560 - DNA, 463 bp, Gossypium hirsutum
  Clone ID: uC-gsflmaxxa011a04b1
gaagcatgcaaaatcaaatctatcgcttactgggccatctggtataatcgcaacaagctatatcatgaaagagtcagagagcaggtacatgaagttgttggatttatcaaggcttactatacagaaatttctagtatgggggagatattacagaatacacatgacatgaaagactcagtctggaaaccaccggataatgacaccatctaaatttatttcgacgcctcatttaatcgaatcacaagaagctctatttcaggaatcattgcacgtgataaagagggtttgcctatggcagactgtacctttccatggataatatttcagatccatttatggccgaagcaagggcgtgtttacaagctattgtcatggcagaagagctgggttttcaagatgtatgagttgaaagagatgcgctaactattatacgaaaactgaactctgcagaagaagatcgatc

SEQ ID NO: 9561 - DNA, 320 bp, Gossypium hirsutum
  Clone ID: uC-gsflmaxxa011a05b1
gggttcttgggaagagctatcttttctggtaaacgggctgtccaccctggaaacggctaaaccccaggtaagtgacagcgagcgagagagcaccggacgtagggtggagcccgaagcgcacccggaggcccttgaaagttcataggaccggatgcctgacgagcgcggtcgtactcataaccgtattaagtgttcaaggagcacagtctctggacaatggaacactgtaggcaagggaagactgatgaatggatccgctacctcgggaaaaggattgagtctgacggctgggcacggtggttccagacccgaacccgcat

SEQ ID NO: 9562 - DNA, 402 bp, Gossypium hirsutum
  Clone ID: uC-gsflmaxxa011a06b1
gaatcgtccagtctgctcaacttgcctagatccaacccagtaataacatctgctgcatgggcatctaagcgggctgctgttgaagatctgtcatctgagactccacaatgtgatctgccccaggtggaacagttggggcccacccaaacaaacatttctcataattctatttcgttgccaccctttcctggcagggagtgctcgatagaccaagcagggggtactgatccacagagccatctcttatttggtgttaatatagagccctcatctcttctattgcaaaacgggatgtcaagccttagggggagtttggcagcgagagtgactccactaccatacccttctcttctaattatgcgagtactgcaggcactgattttttagttaatccagcaatga

SEQ ID NO: 9563 - DNA, 501 bp, Gossypium hirsutum
  unsure (1)..(501): unsure at all n locations
  Clone ID: uC-gsflmaxxa011a07b1
tccacgcgtccggtcaaaatggttgagaattttgagatgggtgtgtcaaataagactcctgagttcatcaagatgaaccctttggggaaggttcctgtgttggaaacacctgagggtcctgtatttgagagcaatgccattgctcgttatgttgctcgctcaaaggttaacaaccctatatgtggttctacattgattgattatggtcatatcgagcaatggattgattttgcagccatggaaattgatgctaatattgcaaaatggttgtatccaagacttggttacggtgtttaccttcctccagctgaggaagctgctattgctgcattgaagagagcccttggcgctttgaacactcatcttgcttccaacacatttcttgttggacattntgtcacccttgctgacattatcatgacatgtaacctctacttgggtttctcccagatcatgactaagagttttacctcggagttcccttcatgtgagaggtacttt

SEQ ID NO: 9564 - DNA, 366 bp, Gossypium hirsutum
  unsure (1)..(366): unsure at all n locations
  Clone ID: uC-gsflmaxxa011a08b1
aaaaccctctttctacatttaccgggcttagattgaaatctccagttttatttatttatttttatttttacgtttctagcattattatcacaaggatttcctttttcttcttttggtcaaaaacttagattcattttattttattttgaggcttttatccccgctgattattcaagcaaagtgttttttcccctatttcctttagttgatttattggaagcttcgagttttcagtttggtaagtcgagtttgagagtgtgttggattagtgggtaataagtgccgactttgacacagatctgagttaaaataaccaacattaagctctttgggggttttggntttttggttgaagaaaattgtggg

SEQ ID NO: 9565 - DNA, 492 bp, Gossypium hirsutum
  unsure (1)..(492): unsure at all n locations
  Clone ID: uC-gsflmaxxa011b02b1
gtattttcttaagaaagaacaactttcagcggaaacagccgcttcctccaacatggctagagggttgaagaaacacttgaagaggctcaatgcccccaggcattggatgctcgacaagcttggtggtgcattcgcgcccaagccatcgtctggaccccacaagtcgagggaatgtttgccacttattcttattctgcgaaacagactgaagtatgctttgacatacagagaagtgattgctattcttatgcaaaggcatgttatggtagatgggaaggttaggactgataagacctaccctgcaggttttgngatgttgtgtcaattcccaagacaaatgaggacttccgtctcctttatgacacntaaaggtcgtttccgccttcatgccatcactggtgatgagactaagtttaagctctgcaaagttaggtctgtccaatttggccagaagggtattccatacctgaatacctacgatggacgcacaat

SEQ ID NO: 9566 - DNA, 464 bp, Gossypium hirsutum
  Clone ID: uC-gsflmaxxa011b06b1
ctttcatcttcactccacatttcacactctttttcaactttctcttcttctctttgttttaaagaggggctggagttttagccaaagaaaactccatggctaaacttgttgctactttcttcttggctctcattgccatctccatggttcaaactttggttatggcatcacatggacatggtggtcaccattatgataacaaacgttatggacctggaagtctcaagccttaccaatgtccatctcagtgcacaaggaggtgtagccagacacagtaccataaaccatgcatgttcttctgtcagaaatgttgcaggacatgcctttgtgttcctccagggtattatgggaacaaacaagtttgcccttgctacaacaactggaaaaccaaagaaggaggccccaaatgcccttaaaatgctcaaaagacgacccctttttttttacattattatccctataaa

SEQ ID NO: 9567 - DNA, 469 bp, Gossypium hirsutum
  unsure (1)..(469): unsure at all n locations
  Clone ID: uC-gsflmaxxa011b07b1
acaatatcgagtcattgaaggaagaagtgaggaacttacctttattgactgtgttgaatgttagtcacaataagcttacagatcttccggctgcaatcggacagctttctatgctgaagttgttggatgtgtcttttaactctatagtgacaataccagaggagattggcttggcaacttctttggtcaagtttgattgttcaagcaatcgtattaaggaacttccatcctcacttggaaaatgctcagatttatcagatctaaaggtatcgaataatttgataacaagcttgcctgaagatcttacaaactgttcgaaattgacaaaactagatgtgnaggggaacaagttaacagctttatctgagaacttgtttgcatcatgtacaatgcttacggaactcaatgcatcaaagaacttgctgagtggtataccagagaacattggatgccttatgcgtctcatccg

SEQ ID NO: 9568 - DNA, 500 bp, Gossypium hirsutum
  Clone ID: uC-gsflmaxxa011b08b1
ggcaattcccttggaaaatggtgacaatgtgaaccttcatatgtcaaagaaagtacagggaatttgcatcaaaactgtttgctctgtcccacaatataaggaaagcaatgcaaatgcatgaagatctgtcacaggctttgcatagacctgctgagttgatagtgggttcttttgatgggattaaggctttgcaagagcagcaggatgctgatggttttgataagctaggaatgaggcttctgcttgccacacttccaaagatatttgattcactgcagacagcatatgaaggtcaaattgttggagtttttgtctttaatggggcatctcagccaggatcaagcctgttgatttctggagatcttattatggtgctgatcattacatatctagatttcagaaacctggagaaatagaaggtgaatttgcagagattggagtggagagagttgagaaggaacttttgactgatttccagttatcttgccaaaagggaaact

SEQ ID NO: 9569 - DNA, 514 bp, Gossypium hirsutum
  unsure (1)..(514): unsure at all n locations
  Clone ID: uC-gsflmaxxa011b10b1
gttacccatcactctcaagtctcaagatggactccagctctggagaagagtcagatcttagtgagtctgagatcaatgaatacaaagaaaagccatatgaagagattaggtctgggaagtacaaagtaaaggccttaaatggtagcttaagatgccccttttgtgctgggaagaagaaacaagactacaagtacaaggatctgcttcaacatgcttctggggtgggtaaaggatctgccaacagaagtgcanaacagagagcaaaccacctggccttggcaaaatatttggaaattgacctagccagtgaagcagatgagacctcccgaccaactgtaccacaagctgtggacgagactccagagcaaactgagctttatgtctggccatggatgggaataattatgaacattgttgctgagtcgaagaatatagacacattgcatgataaagggtactggttgaagaggtttgctaaatataaacctatcaatggtcaatgtttctggaatga

SEQ ID NO: 9570 - DNA, 453 bp, Gossypium hirsutum
  unsure (1)..(453): unsure at all n locations
  Clone ID: uC-gsflmaxxa011b11b1
ataaaagtaaaatctgctcttcgactggcagcactaacacacagagaagggaagggaagagagaaaaactaagaagatggaggctttgggatggtggttaatgctggtgggttcacttcgattagcatccgtttggttcggcttcttcgatatttgggctcttcgtcttgctgttttctccaacaccactatgtctgaagttcatgggaggacgtttggagtttggacgcttttgacttgtactctctgttttctttgtgcatttaacttggaaaataagccgctctacttgntgacgtttctgtcattcatctatgcatttggtcactttttgactgaatacctcttctatcaaacaatggccctctcaaatctgacgactgtaggcatatttgcagggacatcaattatatggatgctattacagtggaattcacgttaaccgacacatgt

SEQ ID NO: 9571 - DNA, 499 bp, Gossypium hirsutum
  Clone ID: uC-gsflmaxxa011b12b1
tccacgcgtccgccggtattagtcacccggctagctaactttttatttaaaaaaatgaagaggttttcccttattgttttgtgcgtggtgactctagtggtggtgttgttttcaagttcagaggcagcaccagcgccaaaatgtgataaccccctggagtatagctcatgcttgaacgcgtataagaagccacctccatcagccggttgttgccagaagatgaaggaacaagcaccatgttattgcgagtacatgaagatagaagatgtcaaacgtgtttttgacagagttgagattgcgaaaatggctaaattgtgtggagtttcatattcttccacctgttagaatcacgtttggtttcatatgactatctctggctgggataatgtggcatctcaataaataaaaattttatttgaaaactaatttactcataatttcaactataatttacctatgttcttttttttttttggaatgatcccggtgattttctatt

SEQ ID NO: 9572 - DNA, 86 bp, Gossypium hirsutum
  Clone ID: uC-gsflmaxxa011c01b1
gtgtatttgatgggtctttacggcgtcgacgaggcggagattccgtacaatctgaacggggaatccaataggtgtgccgacattta

SEQ ID NO: 9573 - DNA, 112 bp, Gossypium hirsutum
  Clone ID: uC-gsflmaxxa011c02b1
ctccacgcgtccgcccacgcgtccgaaaaaaaaaaaaaaaaaaaaaaaaaaaaaaaaaaaaaaaaaaaaaaaaaaaaaaaaaaaaaaaaataattataaaaaataatatggg

SEQ ID NO: 9574 - DNA, 113 bp, Gossypium hirsutum
  Clone ID: uC-gsflmaxxa011c05b1
actctcttatcaattttcccccatcttaaaactaaagaaaattaacaatgtccgctgttgctccttctttttccttgagtgtgctctgttttgctttattgctttcctttttg

SEQ ID NO: 9575 - DNA, 99 bp, Gossypium hirsutum
  Clone ID: uC-gsflmaxxa011c06b1
agatctcgctgccgcctcagatcagctttgaagtaattgaaatcaaggaagtgaacgccaatgtcatctaaattctgtattcatggtggctgattaata

SEQ ID NO: 9576 - DNA, 81 bp, Gossypium hirsutum
  Clone ID: uC-gsflmaxxa011c07b1
ttgaagctcagtcaaagtgctgtcttaaaaccctagtttttgagctctctttcagttttccggaagccatgttaaggagga

SEQ ID NO: 9577 - DNA, 90 bp, Gossypium hirsutum
  Clone ID: uC-gsflmaxxa011c08b1
tcgaaaccggagtcccgatcattttaaagtaacactaaaacactttcctactgcagctggaagcaattacgtcaaaacgctcaaaattta

SEQ ID NO: 9578 - DNA, 478 bp, Gossypium hirsutum
  Clone ID: uC-gsflmaxxa011c09b1
gaattctttttacgttttaacttaaaaaaaaccattgaaaattcagcctaacccctttcttctccttcttcttcttcttcttcttcttcttcttcttcttcttcttcttttctttttacttctttccacaaaattgacattaaaaaaaaaaaaaaagaacctaaagtaaataaaaaaagaacaagtccaatttgattccaacatgtagtgactacccaatgcctgacgcaaagccaaaattgaaaaaagaaaaaaaaaaagcaaagaaaaattatcaaaacaaaataaaaaagcctcacgaaaacaaaagctgaaaggtcttcaacaacgtcccacggaaaacgcagactagtttaagcttcctattaacccaatttctctctctctctctctctcccttcttcttcttggccggtttagtcaggcaaaaacctcaatccatacccttaagggattctttggtatttaattctttttc

SEQ ID NO: 9579 - DNA, 67 bp, Gossypium hirsutum
  Clone ID: uC-gsflmaxxa011c11b1
ctattttgtgtagcgattctcagttagtcttttctttaagcttacagcttctctccagagttatata

SEQ ID NO: 9580 - DNA, 475 bp, Gossypium hirsutum
  Clone ID: uC-gsflmaxxa011d02b1
aacaggtttattttggggaggcaaaaatggctgcaaagttctttgctgaagtaggatttccatgtccaagtcgaagaaatccatcagaccacttccttcgttgcataaattcagattttgacattgttgcagaggctctgaagggatctaacagaataactgaacttaaaaatacattagatcctttggcacacctaccaacagcacagataaaaacattgctcgttaagaaatacagaagctcagattatgcggcaaaggcaagagcaagaattcgagaaatttcaggcattgagggactcgttattgagaaaaaacacagtggtgaagcaaaatggttgactcaactatcaactttgacgaataggtcctttgtaaacatgtcaagagatttggggtattactggttaaggatagcaatctacgtggctttatcatttggggtggctctatttcttcgatgttggaacaaact

SEQ ID NO: 9581 - DNA, 122 bp, Gossypium hirsutum
  Clone ID: uC-gsflmaxxa011d05b1
ggtaatctttctctttcgattttagttttgatcgccatttttggttcttgttggtctcgcgaggtggttagtgacaatgatgatggtggtctgtataccgacattgtcactaacaggagaac

SEQ ID NO: 9582 - DNA, 55 bp, Gossypium hirsutum
  Clone ID: uC-gsflmaxxa011d07b1
ctggacaatttaattaagaatgaaattataggccaattttaatgataatttgaga

SEQ ID NO: 9583 - DNA, 333 bp, Gossypium hirsutum
  Clone ID: uC-gsflmaxxa011d09b1
gtcccataacccatctaacaatggtagcctcaaaattctgttttgctttgtctcttgctattctttcaatctgggccgttgatgctgcccaacaccatgctctggcgccctctccttcttcccccgtggactgctcctctctgattctcaacatggcggattgcttgtcctttgtgtcgagcgggagcaagacgtctaagcctgaaggaacctgtcgttctggcttgaaaactgtgctgaaagctggaccgcaatgcttgtgtgaggcttttaagagcagcgcttttctgggtccctctctcaatcctcccaactctctgccctctttctatt

SEQ ID NO: 9584 - DNA, 123 bp, Gossypium hirsutum
  Clone ID: uC-gsflmaxxa011d12b1
ttcaagctccttgatcattcctataaaattatctcattctctgcctatcaggcgcttgaataaagaaacaacccaggtggatcctagcataccaaaaacattgttggttgagtaaggaatgag

SEQ ID NO: 9585 - DNA, 103 bp, Gossypium hirsutum
  Clone ID: uC-gsflmaxxa011e01b1
tgattgactacttttacatggagtcctatgtcatttctgattatcatgagtgagggattaccatgccatttgaaattcactaatgatctaacagtattttttt

SEQ ID NO: 9586 - DNA, 134 bp, Gossypium hirsutum
  Clone ID: uC-gsflmaxxa011e03b1
gataaccttatcttcttctcccactccctcaatctcaccttcaatgtctctctccgctacactccgcgtctcttctttcctacgccacaacctctacctcgccccttctcgcgcctacgccctccgtcgtaatg

SEQ ID NO: 9587 - DNA, 55 bp, Gossypium hirsutum
  Clone ID: uC-gsflmaxxa011e04b1
tcttcgcgtacgctcttcttcactcacttctgccctagagtcaaacatttttttc

SEQ ID NO: 9588 - DNA, 58 bp, Gossypium hirsutum
  Clone ID: uC-gsflmaxxa011e08b1
ttataatgaatacttcttgttcaggaagaaggctgcgaacaatggttatctcacattt

SEQ ID NO: 9589 - DNA, 99 bp, Gossypium hirsutum
  Clone ID: uC-gsflmaxxa011e09b1
tgagcagcccgtgttcttgagaatttaggtgctgacccaagtaatatacgcacccaggtttatcgtttggtagattaggtcttatatatttattacttt

SEQ ID NO: 9590 - DNA, 304 bp, Gossypium hirsutum
  Clone ID: uC-gsflmaxxa011f03b1
attaccatggccgctacttcaccacgtgaggaaaatgtctacaaggcgaaactctccgagcaagccgagcgctactaggagatggttaggtatattgatattttttcattttttactttatttttaatttttaattttattatttattttttcattttaacttattttattttttttttatctttccttatttttttcattattatttttttattatcttttatttctttttttttttttcttctttttttattatattttttttatctttttttttatattattttattattaatctattttt

SEQ ID NO: 9591 - DNA, 61 bp, Gossypium hirsutum
  Clone ID: uC-gsflmaxxa011f11b1
tttctctgggtgtcactttgaatgtcaccaaggccatgatttagcccgatgtttgcaaagt

SEQ ID NO: 9592 - DNA, 83 bp, Gossypium hirsutum
  Clone ID: uC-gsflmaxxa011g11b1
tcgcttaaagcctgccatataatcatataaccaggctccgtcgtggtactttttggccattacaatgacgaaaatcgctttgg

SEQ ID NO: 9593 - DNA, 78 bp, Gossypium hirsutum
  Clone ID: uC-gsflmaxxa011h05b1
gtatgaaatcatggtaagtctcaaatcacttgtatctctcagttcccgatccgctgccgtagcactacttgtgttggt

SEQ ID NO: 9594 - DNA, 80 bp, Gossypium hirsutum
  Clone ID: uC-gsflmaxxa011h06b1
tctcatgcgtccgcccacgcgtccgcaaaacatcatcgattccttctaaagaaataacccactgtagatggttactttgt

SEQ ID NO: 9595 - DNA, 76 bp, Gossypium hirsutum
  Clone ID: uC-gsflmaxxa011h07b1
tcgttgattttgaatcatggattaacgatgatcatcagttgacttttaacttctttttcccggaaagtgggaattc

SEQ ID NO: 9596 - DNA, 106 bp, Gossypium hirsutum
  Clone ID: uC-gsflmaxxa011h09b1
tcgtccacgcgtccgctcgcttgaaaaaaagaaaaaaaattacttcttttggcttttcttgatgaacagtcttagactatttgaatttgattgagtaaaaatgtat

SEQ ID NO: 9597 - DNA, 108 bp, Gossypium hirsutum
  Clone ID: uC-gsflmaxxa011h10b1
ttcgttatgagaatcaattcaacacaatggttcaaacatacatgatagataaagccaaaggaagaatgagaatccgaatgaaagttagcttatcattagtaatttgtt

SEQ ID NO: 9598 - DNA, 364 bp, Gossypium hirsutum
  Clone ID: uC-gsflmaxxa012a01b1
cccacgcgtgcgcccacgcgttcgcccacgcgtacggcaacgagtgcagtggctgcctgtctgccctggtgcgagcgagataggtaaaaggaaaaaggaagggagaaaaaaagacaggacctactcaaacaatataaaacgctaggacgagaaaggaaaggacagaaatttatgaatttattgctactgtctgcataaagtttattaacaatcggaacgagtttcgatcatacacgttatacgccggttagtttaccaagccgattctgaatcaggtaaatcgataggcctcctactttgtatactaggaccactcttatgactccgaccatagggatgagggttagggcaacaggttcaacat

SEQ ID NO: 9599 - DNA, 421 bp, Gossypium hirsutum
  Clone ID: uC-gsflmaxxa012a02b1
ctctcgcgtgcgcccacgcgttcgaccacgcgtccggtaaacactgaaaccgcccctattcggtatcgatcctaatgttctttatgtttttgcaatggaatctctttcgcgttccctctccatctgcatctctaatctacgcgagacctacccaattctcaacagccacttaccatcttcttcttttagtctgatcaaagcgccaaatcaacggatcggatttctcaaattcaactctgaaacctctcagtttcataggttttatctccaagctctaccccgagaggttcctgttgatgaaggtgaagaccagctgcaggctcttacccttaataatgggtttcgcttagtttctgaagacagacaatctgtttatcagggcgattcaaatcagagtaaaagcagcgaaaaagatgtagat

SEQ ID NO: 9600 - DNA, 514 bp, Gossypium hirsutum
  Clone ID: uC-gsflmaxxa012a04b1
cctacgcgtccgtgaaaaatcctttgaatggtattagatttacccacaaacttttagaaactacagccatttctgaaaatcagaagcaattacttgagactagtgatgcttgtgaaagacagatcacggtaataattgaggatattgactttcgaagcgatgatgaaggcatggagctgagcatggaagaatttgttctagggaacgatctcgatgctgtcgtcagtcaagtcatgattttgcttaaagaaaggaacttacaactctttcatgaaactccgaaggaaatcaaggcactatctttatacggtgatcgaattaggctccagctagtcctatcggatttcttgcttaacatggtgcatcatgctccttctccagatggatgggtagaaatcaagatttcacctggtctaaagctactacgagatggtaacgagtttctccgatacaattcaggatgactcacccaggtaaaggccttctttcactcttattcaagaaatgcttgaga

SEQ ID NO: 9601 - DNA, 363 bp, Gossypium hirsutum
  Clone ID: uC-gsflmaxxa012a05b1
cctacgcgtccgggcacctgcttgatgagcaagggcaatcctttggcagtgaaggcactgaagcgcactccggctaaaccgttctgggcacattgaaagcctgggattgtaatgcagtagatgatgggttacaagggagaagatgaaagcttgacagtgcttaacaatctccttgggtttaatatcggtagatggatggtgacaattatgtatatagtatcctatttattacccatggtgtatttgggaaatggatagaatatttccaatttctgtatatcatgtcatcatttagcaatgactttgaaaaagttctattcctgctttaaaaaaaaaaactatagagacaagacagaacattat

SEQ ID NO: 9602 - DNA, 404 bp, Gossypium hirsutum
  Clone ID: uC-gsflmaxxa012a06b1
ggataaggttcataactggagagattacctacgattacactgctatcctctccacaagtatgttcctgagtggccttccaaccctccttccttcaagtaagcctcttctctattcttcttcctttttctaatctccccccaccccaccaaaaaaaaaaaaaaaaacaccttacgttagagatacgtaattcgcttaacgtcatcctttttcattctatgtgtcatgcatgttctaagtatcgatgattcagctatttgtcgacgaattgcattattttattttgcgctcaagtaatatatatttagtaatctgacaatttgatttacatattaataaaactcttgagacagacaggacattttgcatggaaaaaaaaaattttaaaaaaacccaccaataaccg

SEQ ID NO: 9603 - DNA, 85 bp, Gossypium hirsutum
  Clone ID: uC-gsflmaxxa012a09b1
tgtgatcgcgagagtgagaactaatccatccaggtgaatcttatgttcggtggagcagtccatcattatgaaaatttaaaccatg

SEQ ID NO: 9604 - DNA, 446 bp, Gossypium hirsutum
  unsure (1)..(446): unsure at all n locations
  Clone ID: uC-gsflmaxxa012a10b1
ttcaaattttcaatcctaaatactcgatccaattgaaactcaattgtgatttttttaatcattattcttattatttattcgatgtgatcatgcccgcgacggattatcaaggaacttcgtcaccgttgacaaatatcggacgttcgttattaccagtgaggagggatcaagtacacgccatggaatcgccgatcggtggatcggtgtctaacgaggcggagatcgagtcctttcaaaggcatgtagctgacagatttcacgatttagcttctgtcccttccgatgaattgctttctctgccgtgggtcnggaagttgctcgacgttttcctctgttgtcaagaggaatttcgggtcatgctttttaacaacatagctctagtgaagaagccgtccatggaccgtttgatcgccgatttttacgagcgtactgtcaaggcgcttgat

SEQ ID NO: 9605 - DNA, 280 bp, Gossypium hirsutum
  Clone ID: uC-gsflmaxxa012a11b1
tttcaatctaataataatattcttatcttgttgttattcccggctgttttgcttatccaagatattcgtaatttgaattattcaatatttgggtccatattgtcatgttaggaaggtcaatttactttagaagaaagccacgcaggatactatcgggatcttcgatcttcgctcgggagacgtgattccatcagggtcagtttattttgatctaggtgtcatggatgttctaaggatcgcttatttaattttttgtacatcaactgcatttattttattt

SEQ ID NO: 9606 - DNA, 343 bp, Gossypium hirsutum
  Clone ID: uC-gsflmaxxa012a12b1
tttagatttaagatcattgtgagaaccatcaacatcccagctaaagtctgtgacagtgtagatcgtcgatataatggaaggacaaggggaagaagaaaggagtgatgcaagtaagtgcagggaacggcagtctataggaacagctgctcaaacccaagataccaaggactacaaggaaccacctgttgtaccactgtttgagcctgccgagctatcctcatggcacttttacagggctggcattgccgaattcgctgccacttttttgtttttttacatcaccgctataactgtaatgggtgtcgctaaatcatcaaccaagtgctttactgtagggatctag

SEQ ID NO: 9607 - DNA, 547 bp, Gossypium hirsutum
  Clone ID: uC-gsflmaxxa012b02b1
catttttatagtttgttgaaatggtttaaggctttaaggagagattcaaaatcctactctccggggaaaagagagagataggcatactcttccatgggtctttgcacctccaaaccctccccaaacccttctgattctacaaatgcctctatcaatacccggaataacgatatccaccgcaagcctaactctgtttcggcttctcctttacctgatggtgtaaactccaaggaagatcaaggtaaacaaggagaagaagaaaaagaaagctccaattccaacaatgaaggcaagaaatcgccgtttttcccgttttatagtcccagtccagctcaatacttgttttccaaaaagtctccggcgagatcttcaaccaattccactccaaaacggtttttcaggaggccattccctccgccgtctccggcgaagcatattagggcagtgcttgcgcggagggacgggtctgtgaagccgaatgaggccgcgatcccggaaggaagcgaggcataggcagctgtagctaccggtaccggactggataaga

SEQ ID NO: 9608 - DNA, 396 bp, Gossypium hirsutum
  Clone ID: uC-gsflmaxxa012b03b1
cgtacgcgtgggaaaaaaactggaggactggcactccaggaaaatcgaagaggcctcatcattttcaagcaagaactagggctctgacaaggttattgatctccaaattctgacaaggtctcaagaattcgttgatcttcatcctttctagctctgcagtgacttatccgaatcatctctacgcgaattatgcagcacctttcagctaagcattgtaatgatttatgaggcttaatcagaaggtattgatgttctatgtgaaattttgtaggtaagagctattagctaccgatttgttccagacataaatcgttggcaagctaaagctctagttgcaattcaagaggtttggtaacttatccaatcttctaaactaaataaaaattgtaagaattc

SEQ ID NO: 9609 - DNA, 457 bp, Gossypium hirsutum
  Clone ID: uC-gsflmaxxa012b08b1
tccacgcgtccgcctacgcctacaacttctcttcccctcatcaaactcagaaagagggtgaaacctgcacataagcattataaaggtgatgtgggttcaaccaatagctaaaaaactagatgccaagggtaaaaattttaagaatgagaacataaaagtaccaacctgctacactgctggcagaacctctgcatctgcttctcaacaagagctttagtcgctttactatgaatctcacacactttatgccgacggtgatagtcctttgcattagaaagatcttccttacaattatcaacctgacacatggggtagctggtactcccaggcgatccaccacggacctttttgttaggcctagaaacaggctcttccacagaattcaatcccccacctagattcagttgcagtctctcatcatcatcatttgctgcagtggcctttttggatgttatag

SEQ ID NO: 9610 - DNA, 276 bp, Gossypium hirsutum
  Clone ID: uC-gsflmaxxa012b09b1
aacttacttaaattaatccctctcaaaagcaatttaacccatccagttgacaaggtctaggtattttgatgaaatcaaccttatgcaaagtgtaccgtctatatccacacttgttcatatttaagctttagaggcaatgaaagcactttctgtctctaaatccttttgtatgccatatatttttgttttgaaagtttggttgtaaatgggattttgttacaattttatttctacaaataagatttgatgtcaatgaaaattctttgttattacatc

SEQ ID NO: 9611 - DNA, 317 bp, Gossypium hirsutum
  Clone ID: uC-gsflmaxxa012b11b1
ataagaactaatttgaagattactatttttgtgtgtgtattggagggaatgagtgtacgagtaatttaaaagtgatatgagtgatttgttgggagaatctagttgtgtcggtaaacgactataactattatattaggtctctgatgataatacggatggctttgattcccatagagcagctgacatcgtagaactggatgatgatggtgatggcactggagaacagattcttgagatttcaagcttaggaagagctgtagaggtgtactatatgtctattaaatttgatattatatggaccctcaattattgtgcat

SEQ ID NO: 9612 - DNA, 416 bp, Gossypium hirsutum
  Clone ID: uC-gsflmaxxa012c01b1
ttcacgcgtccgctttcgagagaaagtcgtttccgtacgaccaaaatcacctttcagattctctccttctctccctgtcttcttattttctcttagatgcttttgggggcaaacgaaaaaaaaagggtattatctcttcttcttgattgattgatttttcattgataatctcatcaacaagaagaagaatctgctaaaaagaagaataagaagaaacagaggagagaagagaagagaggataattttttttttacttttattttttgagaggcaaaaaaaccccaacaatattcccatggatttgacttcaacaacgacgaccacgacgataaccgccgtgtccggagctgttaacgacaaagagttagctgtcgaccctttcttggttgaggctcttcaaaatcctcgtcatcgt

SEQ ID NO: 9613 - DNA, 75 bp, Gossypium hirsutum
  Clone ID: uC-gsflmaxxa012c02b1
acgtctacgcgtacgcttcactccacatttcacactctttttcaactttctcttcttctctttgtttcaaagagg

SEQ ID NO: 9614 - DNA, 213 bp, Gossypium hirsutum
  Clone ID: uC-gsflmaxxa012c03b1
gatactaccatatgactgggcgccttcgatacttccggtccaaattgtgcggatggggcaacttgtcattctcagcgtacctgcagaattcacaaccatggccggcaggcggctccgagacgctgttaagacggtgcttacttccggacacaataagcaattcgacagcaatgtccatattgttattgcaggcctgataatacttattcacac

SEQ ID NO: 9615 - DNA, 395 bp, Gossypium hirsutum
  Clone ID: uC-gsflmaxxa012c04b1
tgacatttcttttatttcctaaatctgtcagaaattacacactagaattgtagcaatgcaagggctcgtcttactatcggtgctcctttgcgccagctgccatatctccctttccttgaccaatagtactgccagcaacggtacagtggcggacggactactggaaaatggcaacttcgaaaacgccccaaatgcaacaaacatgaaaggcaccgtggttgtgggacgctacacaataccaggatgggtgaatgaggggtttgtggaatacattaagtcggggcaaaagcaaggggacatgctgctggtggtgcccgaaggggcctatgctggtaggctaggaaacgaggcattcaattagcagaagttaaggtgaacaaagggatgtattactt

SEQ ID NO: 9616 - DNA, 358 bp, Gossypium hirsutum
  Clone ID: uC-gsflmaxxa012c07b1
ctctctcttagaggaaaacagaaccacgcctccacctttctcactcttttctctgtttccttcttttttccggcgactttctaccggaatcgtaccggcggtggtcttctaagaagtgggttttccttgaaatgttgaaatttgaatgaaacccaacatttttcatcatttgagttctcagatttagccttgaaaaacttcaaaaaccgtagcgtgttggagtgtaattcttgtttctcttccacctgtgtcctctcttgtgtttgctttgccaaaaggatctctctgttttaagctacattttggcttctctctttttacctttttatctctgcaactctgctaagtaagaatggag

SEQ ID NO: 9617 - DNA, 430 bp, Gossypium hirsutum
  Clone ID: uC-gsflmaxxa012d03b1
gttagagctcactgctcactctctttcactttcattcatctccattattgtttcagatcgtaaaatcaaaaccaaattttcgtttaatttatacatataaacacccaaaaaacaaaaagggcataaaaaaggagattcaatggggatcttctccttcaatgccatagctttggccttcttattagccattatctccggcgccgtcaatgcttgccctccttccgaccgagaagcattgctagctttaagttcatcgttaaaggagccttatctaggcatcttcgattcatggaaaggcaccgattgttgttccaactggaacggaatttagctgtgaccctttctataattgagtctcagtcgttatcttctctcgttatgatcaatacatctcattctttttaattcacgttcatttattttctcgata

SEQ ID NO: 9618 - DNA, 344 bp, Gossypium hirsutum
  Clone ID: uC-gsflmaxxa012d04b1
ccttaacctcgatgaaacagaggtatcactttaacgttatggattcgagactcaaccagcacgtggagaaaggaaaagaagatgggttgtatattagctgcgtagcgtcgtcatcgaatctatgggccattgttatggatgcagggacggggtttacatctcaggtttatgagttatcaccaatctttttgcataaggagtggataatggaacaatgggagaagaattactacatcacttccgttgtcggagcatgcaacggtagtgcactggttattatgtccaaaggttccccctatacgcaacaatcctacaaagttactgacgtattttcctttcaaatg

SEQ ID NO: 9619 - DNA, 247 bp, Gossypium hirsutum
  Clone ID: uC-gsflmaxxa012d06b1
tctacgcgtccgagaaaatgggagaaaatgagaggacgatgaacaacatcaagggcaagggagttgcagagcgttcaagagctaaccacaattacagtggtgaagacgaagacgacgacaatattaccagtttctcttttccttccgtcaaatccagtcctcgcaacgcttcttccaaatacgacttcgtcaaggtgagggtctggttgggtgattacgtccttcactattatcccttatccagatt

SEQ ID NO: 9620 - DNA, 273 bp, Gossypium hirsutum
  Clone ID: uC-gsflmaxxa012d11b1
tccacgcgtccgcccacgcgtccgaattgtagcactagcaaccaattatgctttgggttttgccactactttgttgtataattctgaaaccacagctacaaaatattaatatttactgtgtattatacaggtaggatagttcacggtgagtgagagcagccaaataggcacatagagagagagagagagagagagaggggatattaggggacacctcacacgatctgtggaggagaaaaaagagaattgcggaattattaatcaatttatgcc

SEQ ID NO: 9621 - DNA, 219 bp, Gossypium hirsutum
  Clone ID: uC-gsflmaxxa012e05b1
tttggcgaacccaagtcctaaaccagaaagcctgaaaaacttcgagaacaaaagaaatatggcgggattgttagcatgggcggcggacgtagtcggaggccacggcgcgatcagcaaccaagacgatgactttaacattatcccattaatttttttcccagagcagcaacaatacgcgcacgaattggatcgaacggcttcctctcttacccgtatgat

SEQ ID NO: 9622 - DNA, 351 bp, Gossypium hirsutum
  Clone ID: uC-gsflmaxxa012e09b1
tgccaagtaacactaatccttttttttcttttaactaatgatagtatttgagtaacacttagctttcaatggatttccattactactagcttttgcttcggatctgctgctctctgtttcacgagatctcctcactttttaactcgctttgatagccaatggcgttgaagcggggactatcaagtgtgcgtgtactaagcaacaggagttctggatctcgattgcctattgctcattcttgcttttttttcagttccagtgccatttgtttcttttgtccctcccgcttctccctttaatccctctccattgccctctcaacgctattttatctctctccaacttaccttc

SEQ ID NO: 9623 - DNA, 83 bp, Gossypium hirsutum
  Clone ID: uC-gsflmaxxa012e12b1
cgtgtttacctgcacgaaacagaggataggacataaggggccatgttaacgagactcccccggcatcaggcgaaaggaaaaga

SEQ ID NO: 9624 - DNA, 61 bp, Gossypium hirsutum
  Clone ID: uC-gsflmaxxa012f11b1
ttcacgcgtccggaattttttaacatttgattgcgtaaatcagggagcttaacgtgaaaaa

SEQ ID NO: 9625 - DNA, 54 bp, Gossypium hirsutum
  Clone ID: uC-gsflmaxxa012f12b1
ttcactttctctattctttgttggttttacttgatagtctttattgattgaact

SEQ ID NO: 9626 - DNA, 442 bp, Gossypium hirsutum
  Clone ID: uC-gsflmaxxa014a01b1
tttaattatgcatatgttggtgatgaggctcaatctaaaagaggtattttgacattgaaatacccaattgagcacggtattgtgaacaattgggatgatatggaaaagatttggcatcatacattttacaacgagcttcgtgttgccccagaagagcacccggttttacttaccgaagctccccttaacccgaaagctaaccgtgagaagatgactcaaatcatgttcgagacctttaattcacctgctatgtatgttgccatccaggctgtgctctctctgtatgctagtggtcgtacaaccggtattgtgttggattcgggagatggtgttagccacacagtccctatttacgagggttatgccctcccgcatgctattcttcgtctcgatttggctggtcgtgatcttaccgttaacttgatgaagattctgaccgaac

SEQ ID NO: 9627 - DNA, 503 bp, Gossypium hirsutum
  Clone ID: uC-gsflmaxxa014a02b1
tttatttaaaagaaaacgaaaaaaagtttcgcttctttgctttctttcgagtaaaaatcaaacgaaaaacaacttaaataatattaaaagattttgattttgatcatcaaattttctgtttctgatccaccagtccagtcagagtgttgaagtattgaagctgtctggtgttttgtttgttttttgaaatctgatgtctccgccgcttcttggcgtggaggaagggggtcagaacaatgtgactttactgggttcttctggctctattgatagtgtgtgccagaataatgctgaattgaaggagcgcaattacatgggcttgtctgattgttcttctattgattgctctgttgtcaccctaggttccgacgatagcaacgtaagtttgaatctgaaggcaacagagctcaggcttgggcttccttgatcacagtcttctgaaagaaattctgagctttgcttggtaagctctgctcaacttgatgagaaacccccttttcctt

SEQ ID NO: 9628 - DNA, 555 bp, Gossypium hirsutum
  unsure (1)..(555): unsure at all n locations
  Clone ID: uC-gsflmaxxa014a03b1
ctatacattcccgattcaaatcaatcaaacaaattccccagatattttcttcctccacgttccattttctttatatatatttcatgttcaatccttttcatgcttggattaacaccatcatcggttttaagttttcagcactcgttcttaaatatctggttgtttttctgttgggaaaaaaaagttgagtcggtgatgatggagggtgaacctgctttaccttcttattataatgttctgggggtcaaggttgatgcttctattcaagatatcaagcgtgcttatcgaaagcttgcaatgcaatggcatccagataggtggacgagaacaccctctctattgagtgaagctaagcataaattccagcaaattcaagaagcctattcggttttatcagaccagaggaagagaactctgtacgatgctgggttatatgatcctgaagatgaagaggatgaggtnttttctgattttatgggcggaatgatctctctcatgtttcaaacgaggaaagaggtaatacatttggcctacattttaaaaactccatttttt

SEQ ID NO: 9629 - DNA, 319 bp, Gossypium hirsutum
  Clone ID: uC-gsflmaxxa014a04b1
ctcttcaaggcacaaaaaccccttagttccctaacttttcccttctatctgctctctatttctgcaaacatttccttcaactttcccgagaaaattctatccctcgccggaaccaatgccagtcaccggcgaaaccgatgatggcaacaataacaactctatatctcacattctttcatacaaaacgcccctgttcaaccttaagctctacttagtaatctcaatcttcctggccttttttcttcttctattctcttttacgatcttcctctgttgcccgttaaacagaaatgcccggaaacggaaagtgaagcatagc

SEQ ID NO: 9630 - DNA, 456 bp, Gossypium hirsutum
  Clone ID: uC-gsflmaxxa014a05b1
gttgtgtagaaagatgatggaaaggggttttattgttttggccttgacggtggttttcgccgcgacggtggttacggcggctgacgagagtgggttagcgaatgagtgcagcaaagattttcagagcgtgatgacttgcttaagctttgctcaaggaaaagcagcgtcgccgtcgaaggagtggtgtaattcagtggcggggattaaagagaataaacccaaatgtttgtgttatattttgcaacaaacacaaactttcggtgcttaaaatctcaaaagcttatggtgttcaaggacagataagctggtttcagttacccgtggcttggcaaattgaggaacgctagcggtaagagattgcccaaagcttttttgggttatttatcgagctcaccagacgccggcatctttaccaacttcttctttaaagcaaagacacccaggacttaacaacca

SEQ ID NO: 9631 - DNA, 396 bp, Gossypium hirsutum
  Clone ID: uC-gsflmaxxa014a09b1
tcgcttcctctttctttaaaacttcttcctatttaatttctgactaaacttgcgctgaattccatggctactgcagaggttgtaacagctcaaactgcaatccatgaggagaaacctgaagaagtggtcaaggttgaagaaattgcaacagaagaggtagtggctgttgctcctgcaacagaacctgttgctgaagaaccaaaggaagcagtgcctgaagcagcatcctaagaaccccaggctccagaaactgaagccacagttgaaactgaatcaaaggaggtggatgaagagcccagggctgtgactgaggagccagaagttgagcaaaatgaataagagactcctgaggacacaagtgcagagccagttgcggaggagtccaaggagactact

SEQ ID NO: 9632 - DNA, 348 bp, Gossypium hirsutum
  Clone ID: uC-gsflmaxxa014a11b1
tcggttttactcctttgttgtttcttgttgttacccttttacgtatttgctaccccggttttaaagctattaagacagccggacgatgtggcggagatgtcgggggtggcggcgatttggatgatacctttgcactttagctttgcgtttcagttcccattacaaaggttcttgcaaagccagtcgaagactgcggtgttagcctatgtctcgtttggtgccttaggggtgaatgtgttgacgaggtgggtgttcgtaaacgggttggactggggtgtgattggtgcttagttggcgttggatatttcgtgtgcgttggggctttggggctttatagctacactgtcc

SEQ ID NO: 9633 - DNA, 423 bp, Gossypium hirsutum
  Clone ID: uC-gsflmaxxa014b01b1
gttaatctttgttaagaccttgacaggaaagacaattactttggaggttgagagttcagataccattgacaatgtcaaggctaagatccaggataaggagggtattcagccagaccagcagaggttgatctttgctggtaagcaactagaagatggccgcaccctggctgactacatcatccaaaaggaatccaccctctatttggtgcttcgtctccgtggtggtatgcaaatgtggtggtatgcaaatatttgttaagactcttaccggaaagaccattactttggaggttgagagttcagataccattgacaatgtcaaggctaagatccaggacaaagagggtattcccccagaccaacagaggttgatctttgcaggtaagcaacttgaagatggccgcactctcgctgattacaaca

SEQ ID NO: 9634 - DNA, 485 bp, Gossypium hirsutum
  Clone ID: uC-gsflmaxxa014b02b1
gtaatttaattttcttttcggtttcagattgaaaacaggaggaaacaaaagatattaacggatcaataattcgtttgaatctggagacaaatttcaactctaaatcttaaaatttagtgtttctttttactttttagatttctttgtttcttttcatatatttttatttcaaaaaataaaatgaatgatcagtctcagatgatcaatcagccgccacaaatgatgatggacccgattcagtcgcagatgatgaatcagtctcatcagttgatggcggcggcggcggcggctgctcactctcaggcgaggagccaactgggggcggttctgtcgcagccgatgagctctggtcatcagatgatgaatcagcctcccccgacgttgttgaatagaagctacatgccttggcaatcccaggatccaaaccctaaccctagcaagaaattcccttctttcactcgtaataacaattggaaaggtaaaaa

SEQ ID NO: 9635 - DNA, 464 bp, Gossypium hirsutum
  Clone ID: uC-gsflmaxxa014b04b1
cgactgcttcgttaacgtgagtactcttcatttttcttgaaacacctgtgtttgacaatccgacactgagccttcatgatgaacagggttgtgatgggtcggtacttttggacgataactcgacgtttataggtgagaaaaccgcggttcctaacaataactcggcgagagggttcaacgtcgtcgacaacatcaaagctcggctggagaaagcgtgtcctggagttgtatcctgcgctgatattctcgccattgctgctcgtgattcggttgtttcggttaggggggtccgtcatggaaggtaagggtgggaaagaaggggattcgacaagcgctagcaagaagtgccgcaaatgcctctattccaccaccaacctctaatctaagcgctcttatttcaagcttctcagctcaaggcctctcaaataaaaaccttgtagcactttctggttcacacaccattg

SEQ ID NO: 9636 - DNA, 445 bp, Gossypium hirsutum
  Clone ID: uC-gsflmaxxa014b05b1
gttcatttcagttgccaagcataggcttgagattctcaagcttgctaggaaggaagttggagaaacccctaatagcctgtccaagctcattttggcaatcaacaaaaccagaaagagctttaacaagtatgttaacaagttggttcaccatgagaataactcgattaagctgctgccggagccgggtcgttatcgagatcagtggagaggaggattgacacggaagtgcaacagtgagaaggaggtgaacattgagcagccagtgcggagaaccaaggaagatagcaaaatttggccccttggattgtagagtacaagaaaaagttgcttgccccttctaggagccctaaaattgtcagggccactagacagaaaaatgcaggagatctggtgttcaactataagagccctgtgacatctggtcctattgatattgcaattgcac

SEQ ID NO: 9637 - DNA, 368 bp, Gossypium hirsutum
  Clone ID: uC-gsflmaxxa014b07b1
tcgttaatgatagccaatgagcaggagaatgaagtacgcttcaattgatgtcagcattggcaatatttacatgtctctatgtcgctccgatgaggccatcttctcctaccagacggcactaacagtgttcaaatcatcaaagggcgacaaccacccttcagttgccttcgtctctgtacgacttgcggatctataccacagaacaggaaagctccgagaatcaaagtgctattgtgaaaattgccgcttagagttctagaagagaacttgagaggatcttctaacagctgtagtcacagtacatcacctggacgaagcacgagcaatgggcctatcaagcgtcagtcactcggcggagctgcaaactt

SEQ ID NO: 9638 - DNA, 485 bp, Gossypium hirsutum
  Clone ID: uC-gsflmaxxa014b08b1
tcgctcacgcgttcgtgacacttacttcttcttaccacacaaaacacataaattcaaagcagagagaacagggaaaagaaaacccttgttaaggagaaataatggcgagtaaggaggaagttatttctgttgagctagcagcacctgcttgttggaagaaaatgttttctcccaagaaagtcggtgcacccagtaagactgagatcatgttcattgcaccaactggggaggagattattagcaagaaacagggggagcaatagtgtaaaagcacaccatggtaatacgacaatgacagatgatgattgaggtacctgggagacccctagaagatcagcaaggatcagttgaaaggtcaagactgctccaacaccataaaaggaaccgctaaagaagctaggccgaaaatcattgagtgcaaagaaggaaaacatggaaacagaggcctgtcctgaaaaattcgatgtgagacagaaatgaaaagg

SEQ ID NO: 9639 - DNA, 425 bp, Gossypium hirsutum
  unsure (1)..(425): unsure at all n locations
  Clone ID: uC-gsflmaxxa014b09b1
tcgtttacgcgtgggaaaaaaatgagggaatcctatctccttttcacactactagttttacttccttccaccctgcatttccaagctcatgctgcccctgctggaccattggtgaagcacttgtcttctttacttaaatggaccaggtctaccactaaagcaccccaatcagatggcaatgttcttcaatttgagaatgggtacttagttgagactgtagttgaaggcaatgagatagaagttgttccttacaaaattcgggtctccgaggatggagaattatttgctggtgatgaagataactagaacattgttaagattactccaccattgtctcaaaatagctgtggaaagattgttgccgggtcatttcaaggttacacggngcatgtggatggaaagccaagcgacgctcgttttaatca

SEQ ID NO: 9640 - DNA, 403 bp, Gossypium hirsutum
  Clone ID: uC-gsflmaxxa014b11b1
tcgtttacgcgtgggtggcgtttcacttggtggccatgaccctttcgatatcttccagtcattctttggtggcaatccttttggtgctggtggaagcagccgaggcagaagacaaagaaagggggaggatgtaatccatcccctcaaggtatcattggaagatctctacaatggaacatcgaaaaagctttctctttcacgaaacgtaatatgctccaagtgcaagggcaaagggtctaaatcaggtgcatcaatgaaatgtaccggttgtcaaggttcaggaatgaaagtctccattcggcaccttggtccttccatgatccaacaaatgcagcatccttgcaatgagtgcaagggtactggtgaaaccattaacgattagggatcgttgcccacaatgcaa

SEQ ID NO: 9641 - DNA, 241 bp, Gossypium hirsutum
  Clone ID: uC-gsflmaxxa014c01b1
cgcgatcgatctccaaaatgagcgcatattagccctgctctgttcaaggatattaataggccggggaaaagaagcgtaccaggattcccctagtaacggcgagctgaaccggaaaaagcccagcttgagaatcggtagccatcggtgttcgaattggagtctggagaagacgtctcagcgacagatcgggcccaagatccttggaaaggggcgcccgtgagggatgagatttctgcctttc

SEQ ID NO: 9642 - DNA, 94 bp, Gossypium hirsutum
  Clone ID: uC-gsflmaxxa014c02b1
gacccacgcgatcgttttctcgtagggacccatcttgccctgtgctttggtgttgaaaagtgactgtacacattaggaatgatgtagagcgtaa

SEQ ID NO: 9643 - DNA, 475 bp, Gossypium hirsutum
  unsure (1)..(475): unsure at all n locations
  Clone ID: uC-gsflmaxxa014c03b1
tttatttcctggctggtggtagccttgatgaagctcttcatgaacgatctgagcagttagactgggaagcacgtttgaacattatcatgggagcagcaaaagggctggcttatctacaccacgattgttctccaaggatcatacaccgtgacataaagtccagcaatattttacttgatagcaacttggaagctcgagtatcggactttggacttgcaaaactgttagaggatgaagaatctcatattacaaccattgtcgcaggaacttttggttatttggctccagagtatatggcaagtgggagagcaactgagaagactgatgtctatagttttggggtntttggtgcttgaagtcataagtggcaagagacctactgatgcatctttcattgaaaagggcctcaacatcgttggctggttaaatttcttaattacggagaatagagagcgagagattntagatccgaatt

SEQ ID NO: 9644 - DNA, 62 bp, Gossypium hirsutum
  Clone ID: uC-gsflmaxxa014c05b1
gtttcgtatagtccttcgccgaaaccttacaacaacgacattgttgcaagaaagacacggcg

SEQ ID NO: 9645 - DNA, 211 bp, Gossypium hirsutum
  Clone ID: uC-gsflmaxxa014c06b1
gactacaaccacaccttttcagatagcctttcccaaaattttacaatgtatttgctatccttgaccactcccttctctttccccagacaacttcaatccggatttcccgttccatctttcctctggatctgctactctatggaccgtcatttcccccaccaggtatgattcttcctttctctctaaagcctcttttgctaagctatgggct

SEQ ID NO: 9646 - DNA, 466 bp, Gossypium hirsutum
  Clone ID: uC-gsflmaxxa014c09b1
gcgatattttctggctggaggtagccttgatgaagctcttcatgaacgatctgaggagcagaacccataggcactgtcaaggataataaccaggacaaggaggggattgagtcatacacaccacggttgatctccaaggatcatacaccgtgacataaagtccagcaatattttacttgatagcaacttggaagctcgagtattggactttggacttgcaaaactgttagaggatgaagaatctcatattacaaccattgtcacaggaacttttgagtatatggctccagagtatatgggaagtgggagagcaactgagaagactgatgtctatagttttggggttttggtgcttgaagtcataagtggcaagagacctactgatgcatcttttattgaaaagggcctcaacatcgttggctcggtaaatttcttattaccgagaatagaaagcgagagattttag

SEQ ID NO: 9647 - DNA, 74 bp, Gossypium hirsutum
  Clone ID: uC-gsflmaxxa014c10b1
gtgaatagaagttacaactctaactgatgaacaagatattggaatttagggcttctgcacagccgaacttgagg

SEQ ID NO: 9648 - DNA, 167 bp, Gossypium hirsutum
  unsure (1)..(167): unsure at all n locations
  Clone ID: uC-gsflmaxxa014c11b1
gctgacgcgtggggaaacctcaaagatgagcacgtatatgagtcgcttgtttccaaaatctaattccagcatgttgttatgtagnggacaagccattaaagctgatgttttacgcttaagggatcaaacgttgttggttgacgcaggtattgtatgcttcttggttc

SEQ ID NO: 9649 - DNA, 160 bp, Gossypium hirsutum
  Clone ID: uC-gsflmaxxa014d04b1
gttgcttactgcttgatgtagtgaacttttcaaaagccaaatacaaaagcaactgtagtattacttcagagtatataaatataaatctatataggagtgaaatgagcctttaattcaaccactgcaaagaccattgaatctggttgggaaggagggggga

SEQ ID NO: 9650 - DNA, 225 bp, Gossypium hirsutum
  Clone ID: uC-gsflmaxxa014d05b1
ctaactttgatgttcaccgaacacatatatggatacccactatcaatgcccactttgctctatcggacattctggctatacaatgtccgcctcgactgttgggcgcctagaaagctgaaatcttaactgtatccttgttagaactatcaccactgcctgtgtttctgacagaggtgataccgaagagaaccgatcgccggctggtgcattggcataggtctaccc

SEQ ID NO: 9651 - DNA, 231 bp, Gossypium hirsutum
  Clone ID: uC-gsflmaxxa014d06b1
ctgactcgtgggcggacgcgtgggtccaaatcttctttttctctttactttgaaaaagcttacaactttcttccaaatctttcttcttaaacttctgggtttttctttatacgaccaagcaaacgcctcattgctgtgtcgaaagcacaaaccaaacggaaaaaattgagctccctagaaggattgggaaacttgaccagtgaaaagaggcgacttagatactaagttatt

SEQ ID NO: 9652 - DNA, 343 bp, Gossypium hirsutum
  Clone ID: uC-gsflmaxxa014d08b1
gcccggaactgcacctgggccgacccacgcgagcgttcattgtgcgggttcctgccttttcgacttactgacgagggaaacacacataattccacagattagcaactaagatagcatgaggttcattcaatattaggtattcatcctcgacaaagaaatacttgagtttggtgactgggtgattaactagcttcacacacactctctctccctctatttctggatcaaaggggggatcacagtatgccctgattcagggattaaaaagaaaaaaaagctaagttctatattctgttgaggcaatggccgctaataacagcaattgcaggttagaagaaatcga

SEQ ID NO: 9653 - DNA, 145 bp, Gossypium hirsutum
  unsure (1)..(145): unsure at all n locations
  Clone ID: uC-gsflmaxxa014d10b1
tcgctaagagcaagttcgataacttgtatggatgccgtcactctcttcccgatgggttgatgagagctaccgatgtcatgattgctggtaaggtcgctgttgtctgtggttatggnngatgttggaagggctgtgcagctgcctt

SEQ ID NO: 9654 - DNA, 305 bp, Gossypium hirsutum
  Clone ID: uC-gsflmaxxa014d11b1
tccacgcgtccgcatcagtcaaggctgctggcattcaactctttgggcaggtcaagaaggaagccactgatgcttcctccaagaccaaacccgctgcttccaagccccgccgccaaaaaggctgctccaaagcctcaggaacctaagaagaagaagggaaaaggtgggaaagcagcgaccaagcagtagttgccagccccaagtcaagcgcagacttttatgacttcagaccctgatgatctaagttaactataatactatacatacatatgttatgctcaggaaacctaatcaattagggtttc

SEQ ID NO: 9655 - DNA, 338 bp, Gossypium hirsutum
  Clone ID: uC-gsflmaxxa014d12b1
tcgttgcttctattctttgctctcccaacaaggggagtttaaggaggaagggaaatcagagacagaaccaaagggtaaattataggcaaggaaacaaccggtttggtgtgaaggcttgagctaaagaaattgcttttgaccagagttcaagagctgcaatgaatgctgtttttgtatagttagctgatgctttttgcctttcactttgtcctagagtgatttatttttcttttccttttcttactcttctcccattttattccattttcctttaattcttttctctattccttctcttaatctttttctccttctctttcttcatttttttctatttt

SEQ ID NO: 9656 - DNA, 60 bp, Gossypium hirsutum
  Clone ID: uC-gsflmaxxa014e03b1
ccggcccggacggaccggctggaccgacgcacgcgttcgtttaaagaaaaagccaaaaac

SEQ ID NO: 9657 - DNA, 99 bp, Gossypium hirsutum
  Clone ID: uC-gsflmaxxa014e04b1
ttcactcgtccggcgttttgtaggcaaaacccaggaggtttttttgtccatcggaaaagctgggcggcagaaatacgttaatcagcagcaacaattggg

SEQ ID NO: 9658 - DNA, 347 bp, Gossypium hirsutum
  Clone ID: uC-gsflmaxxa014e05b1
ctttccttcgtttcctggttcagggctttctgttgtgttatattcgctctctcccccgaaataaagtgaataagaaagctgttttgatacactacactgctgaaaaccaaaaaaaaaaaaaagataaaaaaagatgtttggaagagcacccaagaagagtgataatacgaggtactatgagattctgggtgtttccaagaatgcttcccacgatgatttaaagaaagcctataaaaaagccgccattaaaaaccatccagacaaaggttggtgatcctgaaaagtttaaagagttagctcaagcttatgaggttttgagggaccctgaaaacctgagatatatgatc

SEQ ID NO: 9659 - DNA, 92 bp, Gossypium hirsutum
  Clone ID: uC-gsflmaxxa014e06b1
gtgaatgggaggaaaaacccaaagaaagtaaagcaattgcagacggagtttgtgaaatttgtatcttgaggggcacattgtacagttgttat

SEQ ID NO: 9660 - DNA, 191 bp, Gossypium hirsutum
  Clone ID: uC-gsflmaxxa014e08b1
tcgttaaaagaaaaagccaaaaacccgatattatatccaaaagaaaccaaaattttatttgcatgcttttaaatttgatttcatggctgtaacaagcacatcaaacagaaaagaaatggatcggatcaaaggttcatggagccccgaagatgatgatttgcttcaaaaattagtccataaatttggaccta

SEQ ID NO: 9661 - DNA, 156 bp, Gossypium hirsutum
  Clone ID: uC-gsflmaxxa014e10b1
tgttcgtctacttcatcatcttcttcaaagctttcccttttcttcttgtttaccttctcgttcgcttccactttagctcgtaattccactccaccaacaacaaaaaatcctcgaagatataaattctatttgacactcgtcttcagcaaaatctcc

SEQ ID NO: 9662 - DNA, 71 bp, Gossypium hirsutum
  Clone ID: uC-gsflmaxxa014e11b1
tgtcgctcacgcgtccgcccacgcgttcgcccacgcgtttttgaaaacaggtttgggcaattgattgatga

SEQ ID NO: 9663 - DNA, 101 bp, Gossypium hirsutum
  Clone ID: uC-gsflmaxxa014e12b1
cctttcgttatcgcttgaggcgacaaacattacaaaagctacatatataagcaactgccacttcacttcagagtaaataaactataaaatctatatattaa

SEQ ID NO: 9664 - DNA, 109 bp, Gossypium hirsutum
  Clone ID: uC-gsflmaxxa014f08b1
atcgttttgccactgactacaatcaagggccaacttattttctactattcaccaacacccctcgaagccaaaaaaaaataaaaatatatacctacaaaccccaagcaca

SEQ ID NO: 9665 - DNA, 109 bp, Gossypium hirsutum
  Clone ID: uC-gsflmaxxa014f11b1
tcgctcactcgttcgtgtaggaaatactgtctaccaaagattttaaagcatgaagttataacaattttaaagcatgaagtcaaaacaatcacttattaaataactcaat

SEQ ID NO: 9666 - DNA, 90 bp, Gossypium hirsutum
  Clone ID: uC-gsflmaxxa014f12b1
tcgatctaatgcctgattgttcatatttcctgcaaggtttgtttacaaacgaaaaccgttcttatagacacgtgcatgtgaattcaaatg

SEQ ID NO: 9667 - DNA, 350 bp, Gossypium hirsutum
  Clone ID: uC-gsflmaxxa014h04b1
gcgtttactatgtgttggttgatgcaaagaaagtatttaattcttgattaaacttgctctgaattccatggctactgcagaggttgtaacagctcaaactgcaatccatgaggagaaacctgaagaagtggtcaaggttgaagaaattgcaacagaagaggtagtggctgttgctcctgcaacagaacctgttgctgaagaaccaaaggaagcagtgcctgaagcaggatccgaagaaccccaggctccagaaactgaagccacagttgaaactgaatcaaaggaggtggttgaagagcccaaggctgtgactgatgagccagaagttgagaaataatgagatgagactc

SEQ ID NO: 9668 - DNA, 75 bp, Gossypium hirsutum
  Clone ID: uC-gsflmaxxa014h12b1
tctctcataccaaaccctagcgccaagatttagtgtttaaaatttcgagaacaatgcccacctcacaacacatcc

SEQ ID NO: 9669 - DNA, 514 bp, Gossypium hirsutum
  unsure (1)..(514): unsure at all n locations
  Clone ID: uC-gsflmaxxa015a01b1
tttcttattacaggtactgagagaagaggcttgtaaggaccttcaacaggcacactaatgtaatcagcttgatctttagtgagcttagtgagcttagctccgagcttgccgaggtgaagtgcagcaactttctcgtcgaggtgctttggcaatacgtaaaccttcttattggattccatctgctcatccacctcttcatcgtcttcatcttgtaacttcattttcttcctcttcctttctggtctcttatcttcggaccgagaccgtctgcgagtcatcggtacttcatcctcgtcgtcgctagtggacacctgagcaacccttctgttcctcattacgtaacagggcttctgactttcgcctgttcttttttctttcaagacactggcgacgaggaaaacggcaatgggaagatgagcttcagggtttttcaccttcatattttccctctcgtatttcccgcactttcgngttgatttcttcttcttctttctcggcttgcttcttcttcttc

SEQ ID NO: 9670 - DNA, 539 bp, Gossypium hirsutum
  Clone ID: uC-gsflmaxxa015a02b1
gttactttgaaaattataattttttggtacccgaaggctcgatttttgctattttgccaattaaaccctagaactctttggttccaacaatgatccgattcgttttgttgcaaaacaggcaaggcaagactcgtttagccaaatactatgttcccctcgaagattccgagaaacacaaggtcgaatacgaggttcatcgattggtggttaatagagatccaaaatttaccaatttcgttgagtttcgtacgcataaggtaatttacaggcggtatgccggattgttcttctccttgtgtgttgacataaccgataacgagttggcatacttggaatgcatccatttatttgtggagatattggatcatttcttcagcaatgtttgtgagcttgacttggttttcaattttcacaaggtctatctgatactcgatgaattcattcttgctggagagcttcaagaaacaagcaaaaaggctataatagagaagatgggagagctggagaagctagagtaaagatgattctgcatgaaacag

SEQ ID NO: 9671 - DNA, 480 bp, Gossypium hirsutum
  unsure (1)..(480): unsure at all n locations
  Clone ID: uC-gsflmaxxa015a03b1
atcaattatcatcaaatcaaaatcatcctcaaactgttcaacaatttcgtctcccgttaccaaatttccccattaaaaccaaaaatgagaatcccaaatctcaccaaagcctttattttgttaatggcaataactctgatgtcaacccaagccaacagcctaatcccttacagtagatccttatgggacgtgatgctcgctgaagacccattcaaaatcctggaacaaaacccagtgaccgtccccaaaggatcagaacccgtcgctttagctcgagccgactggaaagaaaccccacggtaccatgccattaccctggacatcccagggatgaaaaaggaggatttgaagatcgaggttgaagagaacagagtgttaaggatcagtggagaaaggaaagatgaacaagaaattganggagagaaatggcatacagctgaaaggacgaatgggaagttttggagacagttcaggttgcct

SEQ ID NO: 9672 - DNA, 265 bp, Gossypium hirsutum
  Clone ID: uC-gsflmaxxa015a06b1
ctgtcatgtgcggatgtgctggcgcgggcgtggctgctggacggtacggagcgtacggcgctggcatcttacggaggtggtggcacgcgtgggaggctgacgcgcatgcaggaactgctagggtttctgttataaaattttcgggccatttgggcctatgtaattttgaggatgggcttgcattaggctattactttgaatatgcggcatgtaactgagctataggcctgctgtgactgttgttgatgatggaccactaactact

SEQ ID NO: 9673 - DNA, 537 bp, Gossypium hirsutum
  Clone ID: uC-gsflmaxxa015a09b1
tcgttcactctgcatctctaatttgtttggtttttctttttggctaatcattcgctttctgtttctcgcatctttatatttttctccgattcatacacagtcgaaatcttttatctttgtgatttgcaaagaaaagaaaatgaaggaaagtatgggaaaccctcttcacctcaaatctttgaaccacatctcccttgtgtgtagatcagttgaggaatccatgaacttttatcaggatattcttgggtttgctccaatcaggagacctggatcatttgactttaatggggcatggctgcttggatacggaattggaatacatctcctgcaatcggaggatccagagagtttgcccaagaaaaaggaaatcaatcccaaggataatcacatttctttccagtgtgagagcatgggagcagtggagaagacgctgaaggaaatggaactggaacacgtacggggcatagtgggagaaggtggaatctaccgtgaacaactcttcttccatgacccagatgggttcatgatcgagatatg

SEQ ID NO: 9674 - DNA, 469 bp, Gossypium hirsutum
  Clone ID: uC-gsflmaxxa015a10b1
tcgcctcacgcgtccgcccacgcgtccggtcggcttctccttttaccaggttaatcagtgaaaggaatctgaattcttgagatatggaaatagcaattattgcattgattttggctgtcttgcttggagcttttattttggtaccccgacatggtaaatcagctcataagaacaaggttaaatcgactgttgccaattctaaggcatccaagtcctatagtaaaacagaagttatgctacataataagaggacagattgttggattatcattaaggacaaggcttatgatgctacctcatatgtagaggaacaccctggtggtgatgccatcttggcacatgccggagatgattcaaccgaagggttttatgggccacaacacgcaactcggacgtttgacatgatcgatgacttctacatcggagatcttcagaagtaatctccaagcaactatccactattgggttt

SEQ ID NO: 9675 - DNA, 402 bp, Gossypium hirsutum
  Clone ID: uC-gsflmaxxa015a11b1
tcgtttacgcgtccggaatttggtaagaagaaaacaggtagattgtgcccataccaagcgttcggataatcctcagctggctaaagagttgaccattcctcatctcgtagcagtcggtgttggatcaacaatcggagctggagtttatattcttgctggagcagttgctagagagcattctgggccagctctctccatgtgctttctaattgccggaattgccgctgccctctctgctttttgctatgctgagcttgctagtcgttgcccatctgctggcagtgcctatcattattcatacatttgtgttggtgaaggtgttgcctggtggtctgtctgggctctgatactggagtatacaattgggggatccgctgatgctcgtggcatttcccctaatct

SEQ ID NO: 9676 - DNA, 242 bp, Gossypium hirsutum
  Clone ID: uC-gsflmaxxa015a12b1
tcggttgcacttttctctcttatatttgtggcccattaactttaccttgggaaccaagattgccgttacggtaggaagatggtcccgccctgatctggtctgcacagcaataaaaacgatgctttgtagaaaacaccaaacggacttctgataattgtggaacgagacagacaccttgtgtaaggaattattaattatgggatgcgatggctgcggcgccgggggagcagaacggggataca

SEQ ID NO: 9677 - DNA, 494 bp, Gossypium hirsutum
  Clone ID: uC-gsflmaxxa015b01b1
ctcctctccataaatctctcactcaacgcagagcgaataggcggagacttccaagaatctatcgcatcagctaatcacgctctaaagaatggatcaggttcaacacccatctatcatgcagaaggtagcaggccagctccttcgttctagccattctcaagattttcaaggttataatgggtctttcaggagtcctgctctataccaaaggcgtgctgcatatggcaattactccaatgctgctctgcagcatcctgtccgggcttttggagacctgtctatggttccatcaacagcttctgctatttgcgttcaggctcctgctgagaaaggatttagcagctttgctattgatttcctcatgggtggagtttctgctgctgtatcaaaaacagctgctgcaccaattgagcgtgttaagcttttgattcagaaccaagatgaaatgatcaaaagtggaaggctctctgaaccttacaagggtattggtgatt

SEQ ID NO: 9678 - DNA, 523 bp, Gossypium hirsutum
  Clone ID: uC-gsflmaxxa015b03b1
ataatttgtaaataataatttatatattaataatattaataatatatattaattttatttgtagttttttctccaaacaatcccgcgattacgggttgtttttttggtttctttcaatcgcccgctcgcaaatccatcgtctcgatccaatcccagaaacgtccacttttttcttgagctttcttttcgaatccgtaccgttcaaattgatggggtttccgccgccggcggatcttttcctgttttgttttgtttgaattcgcagattcctagggttttctctggtttcagatctgggttcttttttggaggcaatttcgctgttaaaatcttgcaaagatgttttggcgtatgactggatattcatctacttctcctattgatgcaattttagtcaaggacaattttacattggaggagcttcttgacgaggatgaaattattcaggaatgcaaatccctcaatgggaagcttataaacttcttgcgggagaaggctcaggttgaacaacttattcaatata

SEQ ID NO: 9679 - DNA, 368 bp, Gossypium hirsutum
  Clone ID: uC-gsflmaxxa015b04b1
gctacgtgttccgatcccggttcgggaactggaagatatgccattcgggcgggttatgggagatatggtaaggctttctacaggtgatgatgggatcattaatgcagctctgtcatctgccgagggattcgaagtggctatagacctgggtttggatacgaagctttactgttctgaccacactatgggattactggctatgatttcttaatcgtgatctgttagtagacggaatgatgcaactgaaaatttggactggacaagatttttgcatcaagagagctccacttcaattaggacggtcaagccttaaggaaattccaaactggggtgaacaagcttgctgatttggttggagtcactcttgg

SEQ ID NO: 9680 - DNA, 499 bp, Gossypium hirsutum
  Clone ID: uC-gsflmaxxa015b05b1
ttaaatctttgctgctgaaactgacaagctcaaaaaaaatggcagcactttcctttccatggtacactaaaaccctattatgtcccaaaaccaccaaggtctggtccttagcttcccatggatcaatatctactagcccttttgttttcccacaatttctcaatctctccattaatcatcacccataaaaatctgagctttacactctgttctaccctgcaagaaatagccttggagcttgaaccaggaaaacccaaaaaccgaatgtgaaaaaaaagctctttgtcttgaatttgccttgggcttctactggtgatgatatcaaagatctctttggccaatatgggaatgttaaagaggctgcgattataaagcaaaaagatgggaaaagtaggaattctgcttttgtaactatggcttctggtgatgaagctcaagctgctgtagataaccttgattctacgaagtttagggagaattataaggtagagcttgcaag

SEQ ID NO: 9681 - DNA, 396 bp, Gossypium hirsutum
  Clone ID: uC-gsflmaxxa015b07b1
tcgtttacgcgtgggcggacgcgtggggtttccgataaggcttcaaagcttgattcttttgttaaaagattagaagaagaaatgagaaagatcgatggttttaaacgtgaacttcctctttctatgcttcttttgaatgatgcgattctagctttgaaagaggaatcaacgcaatgtattagaagaagaaatgttgaacctgttttagaagaatttattccattgaagaacaatcgaaaggagaataataatcacagcgatgatgaagaagaagatgattctaagaaaaattggatgagttctgttcagctttggaacactgccgatgatgatcatagctccattgatgatgaattagatactaagagaaaccatggggatccatttaaaaccagg

SEQ ID NO: 9682 - DNA, 57 bp, Gossypium hirsutum
  Clone ID: uC-gsflmaxxa015b08b1
tctttcacacgtaagaataaatatattaataggatagattatatttaggaatgagat

SEQ ID NO: 9683 - DNA, 416 bp, Gossypium hirsutum
  Clone ID: uC-gsflmaxxa015b10b1
cttacactcactcaaatcccagcttagcaacctcacaaattttttctttaaaaaacccatctttctgggtctaaactcaccccgatccatgtctttagcatataccttcagccactaagcaatagcagccactactgcaaatggcttgcaacataacctgagctgaccttacagtttgctctgttattattgtcaacttatcatgcaccaatgcttgccattcatgcaagccaccaaagcccattccaccacctgctgcatgccctccaccaccagcaaagcctgctggttgccctaaggacacattgaagctaggtgtttgagctgacctacttggactggtgaacatagtggtgggaacacctccttcgagcagatgctgagctatgctccaaggcttggctggattagaaggt

SEQ ID NO: 9684 - DNA, 250 bp, Gossypium hirsutum
  Clone ID: uC-gsflmaxxa015c03b1
ctgttatcatactacgccatacaacgaaaagaagaaatggttgtatcctttctttccaaactctctattctaacattcactgcttcagttttagtagcttcagctctggctcatgatttctccattgtcggttattcgcctgaggatttgagttccagggataaacttattgagctctttgaatcatgggtatccaagcatgccaaattctatgaatcctttgaagagaagctgttgcggtccgaggctc

SEQ ID NO: 9685 - DNA, 66 bp, Gossypium hirsutum
  Clone ID: uC-gsflmaxxa015c04b1
ctcactcgtccgggagtaccccttgaggaccacggggcaacctatgacattaccgacgaggtttac

SEQ ID NO: 9686 - DNA, 107 bp, Gossypium hirsutum
  Clone ID: uC-gsflmaxxa015c05b1
atgcatcgcccccaaagagcacatgcaaacgataccagaaacgtaaagcttctcccatgcggaagacaagaattctactttttattgagatcaagactgctactaat

SEQ ID NO: 9687 - DNA, 412 bp, Gossypium hirsutum
  Clone ID: uC-gsflmaxxa015c09b1
ctcgtttacataaaatttgagctcatcggagagcgaataggcggagacttccaagaatctatcgcatcagctaatcacgctctaaagaatggatcaggttcaacacccatctatcatgcagaaggtagcaggccagctccttcgttctagccattctcaagattttcaaggttataatgggtctttcaggagtcctgctctataccaaaggcgtgctgcatatggcaattactccaatgctgctctgcagcatcctgtccgggcttttggagacctgtctatggttccatcaacagcttctgctatttgcgttcaggctcctgctgagaaaggatttagcagctttgctattgatttcctcatgggtggagcctctgctgctgcatcaaaaacagctgctgcacccaattga

SEQ ID NO: 9688 - DNA, 262 bp, Gossypium hirsutum
  Clone ID: uC-gsflmaxxa015c11b1
tcgactctttgttccttttccaagggagagtgtgatctgttcttcttcacttcatttcactaacccatggctctttccgtcgagaaaaccgccgccggccgcgagtgcaaggtcaaggacatgtctcaggctgacttcggtcgtctcgagatcgagttggccgaggtcgaaatgcccggtctcacggcttgccgagccgagctcggccctgcccaacctttcaagggagccaaaatcaccggctctcttcacatgaccattc

SEQ ID NO: 9689 - DNA, 159 bp, Gossypium hirsutum
  Clone ID: uC-gsflmaxxa015d06b1
ggaccggcccggaatgaccggccggacccacgcgcccgatcatttgaacgggaaaaggaaacccgcttcaccaggaaaaaatggaagagcccgccggtacaccccaacaacacagaccaacagcaaccccaccgcacaatgaacaaaccccccctaaag

SEQ ID NO: 9690 - DNA, 230 bp, Gossypium hirsutum
  Clone ID: uC-gsflmaxxa015d07b1
atcggtcaccgtgagaatcggagaccgagaatccgtctttttagggtttggttcggattttaatttttgtagcaatggcggatgattcggagagtaagcagtcggcggtggagtcgatgatggagaagatcagtgtgaagattcacggcattgattcatcgtcatcttcggattcggatcatgagaaaccggctaccccttccttcgttacggctcagattcatcggttg

SEQ ID NO: 9691 - DNA, 90 bp, Gossypium hirsutum
  Clone ID: uC-gsflmaxxa015d08b1
ttaattaaccaaggaaatgatcagcagctgggccgagaggatgaacatccacactccatcacacacaccgtccatactctattttcacga

SEQ ID NO: 9692 - DNA, 338 bp, Gossypium hirsutum
  Clone ID: uC-gsflmaxxa015d09b1
tcgattcggttttattttgcattgcagcaactctctctcaaagggtttgctggtgacactgcgaaagcacatgcgaagactagcatgattgctggcgaaggtgtaagtaatatcagaacagttgcagccttcaacgcacaaaacaagatcctttcgctattttgtcatgagctccgagttccacagatgcaaagccttcgccgcagccaagtttctggcctcctctttggcctatctcaacttgctctttacgcgtcggaagctctgatactttggtatggtgcgcaccttgtaaaccaaaggtgcctccacattttcaaaggtgatccaggtttttg

SEQ ID NO: 9693 - DNA, 78 bp, Gossypium hirsutum
  Clone ID: uC-gsflmaxxa015e01b1
cctcactaaacttataacgttcgatcgtttaacgcaaacccatttttaagcgaggcaaaggtttccgccctccctcct

SEQ ID NO: 9694 - DNA, 86 bp, Gossypium hirsutum
  Clone ID: uC-gsflmaxxa015e02b1
ctcactcgtccgggtgatgtcttgaccgaccaagttgtgtacatggcaaaactaactgattatttcaggcatgccctttattcata

SEQ ID NO: 9695 - DNA, 82 bp, Gossypium hirsutum
  Clone ID: uC-gsflmaxxa015e03b1
gaatcaaaaaaagaaaaaatagaaaccagagtaacctacattattgtctttgccactgctgaagccgccccttattcaaaga

SEQ ID NO: 9696 - DNA, 296 bp, Gossypium hirsutum
  Clone ID: uC-gsflmaxxa015e05b1
ctcactcgtccgttttattgtcctaaaaccatttcaaatccttcttttttttttttaagaatttcccaacgatgggttcgacgattccaacgagccgatcttcctttgatgacattaccgacacgacgccctttctgtcaccaacaagcaacgcttcaaacgacgactcctccacgcgtcggaccgttcgtcgccagagtctccgcgatgcggctaggttcttgcgccgagccagcagccgaaggatgatgcgtgagccgtccatgctggttcgagaaaccgccgccgagcagttc

SEQ ID NO: 9697 - DNA, 76 bp, Gossypium hirsutum
  unsure (1)..(76): unsure at all n locations
  Clone ID: uC-gsflmaxxa015e07b1
ctcggtcngatttcttctaattagtgaatcatatggccagcactgtggccctcaagcttgcatgtggtgtggtctt

SEQ ID NO: 9698 - DNA, 82 bp, Gossypium hirsutum
  Clone ID: uC-gsflmaxxa015e09b1
acctacggaacctagaaagctctttctttggcagtgaaaattgaaaatcgacggcgaaaatgctgaggctggcgtcgaaacg

SEQ ID NO: 9699 - DNA, 158 bp, Gossypium hirsutum
  Clone ID: uC-gsflmaxxa015e11b1
ctcgatagcaacgatgaagacatcccaaagattgcacccaacaaaataatgcattattgattttaatttctcctttccaatttttttgcctataaatagagagctggggataatactaactgagaacgtactcctagacatcgaaagcctgaaacagc

SEQ ID NO: 9700 - DNA, 113 bp, Gossypium hirsutum
  Clone ID: uC-gsflmaxxa015f01b1
agttcatcttaccccagcagagagacgatacattgagcagagggagcaactcgacgttcatagtttggctaagcaagctaataaatctcaccgcgatcgaatccaggatttca

SEQ ID NO: 9701 - DNA, 127 bp, Gossypium hirsutum
  Clone ID: uC-gsflmaxxa015f09b1
acctaagaaaacaacggtaaaccctgtggaaacaagccgactgcaaaacgctgcagctgaaaccctaacttttccgtttacctctatgcaccagccgctcttttatttctcttatttcatggtcttt

SEQ ID NO: 9702 - DNA, 276 bp, Gossypium hirsutum
  Clone ID: uC-gsflmaxxa015f11b1
tcggtcacttataaccgaaaactagtccaaaaaatgactgctaaaccaccattagggacaccagctagacctggttcagtcacaccaacatttattttctccttatatgatgaaaaccaaaagacaggtccaacaaccgaaagacattggggcttgttacgttccaatggaacaccgatttacgaaatcgatctcaccggtaaacgacctctctcgagttacaaaccattacctgcagttagaaacaacgtaccatataaaggtaaggtatggcgc

SEQ ID NO: 9703 - DNA, 66 bp, Gossypium hirsutum
  Clone ID: uC-gsflmaxxa015g09b1
aggaccggacgggaaaatccgggccgaccctcgcgaccgattggttaaaaccccagaagagagacg

SEQ ID NO: 9704 - DNA, 90 bp, Gossypium hirsutum
  Clone ID: uC-gsflmaxxa015h03b1
atcgtttacgcgtccgcaacaacaaaaaaaatgtttgcagtttttatgacctaacaacaaaactgaacacgtcttgctgcggagaaactg

SEQ ID NO: 9705 - DNA, 56 bp, Gossypium hirsutum
  Clone ID: uC-gsflmaxxa015h07b1
tcgataaaggcccaactaatctctctacgggttctgtttttcacaagacacaccca

SEQ ID NO: 9706 - DNA, 61 bp, Gossypium hirsutum
  Clone ID: uC-gsflmaxxa015h09b1
ttgttaaaagtgcacatcacagaatggcatcttcacccttttaaaactccactccagattc

SEQ ID NO: 9707 - DNA, 155 bp, Gossypium hirsutum
  Clone ID: uC-gsflmaxxa015h11b1
tgataactactttagaaactcaaacaaacctttcacttctcaactctctcaaattcaccatgtctgacaagtgcggcaactgcgactgctctgacaagagccagtgcgcgaagaaaggaaacagcatggccatcgagactgaaaagagctacatc

SEQ ID NO: 9708 - DNA, 389 bp, Gossypium hirsutum
  Clone ID: uC-gsflmaxxa026a01b1
tttatattggcataagtgcagacatcacaagtccaagaccttggctacatgcgcaatgtgtactgaagcaccggaaccttagatgactccaaacagggtgagtttaatttatcttttcaccattttgctagtttcaaacattttaggatttcatccatggagatgatgaggaatagtatttcatgttccaggttaacaaggaatcgtatttaaataaagaatatctctttcttctattttattttccagaattcatccatagagatgatttcatacataacgcaataacattttatgttgcagatatgcgtaccagtacccccactttttatttgcatagtgggatgcttattataaattaatattttgagtttaatcaagtttgggta

SEQ ID NO: 9709 - DNA, 345 bp, Gossypium hirsutum
  Clone ID: uC-gsflmaxxa026a02b1
ttcatgcatgcagatgctacggttatcgaatgagctcttattcttgtatatgggggagcggcattttgttcaatgatcaaccggtgacaggctcgcaagctttatctagtggtttgcggaacaagaccttgaatcatacgagtgttcactgagaaattgacgaagccctattgaaccactcgtgggttaagcagggatgaggtaacctgcgatggtttgtactcaccaggcgaattgtaatgtttaggatgttgaggctatgctactacgatcgcaggctgtgattactgcaaagcatgttgaggatacagatgtgaggactgtgtagatcatacccaaaaagga

SEQ ID NO: 9710 - DNA, 333 bp, Gossypium hirsutum
  Clone ID: uC-gsflmaxxa026a04b1
ttcattcgtccgaattcctccattggaggagcttagggtttggtggtgttctgatctttgctctgtctgaaaaataaacagaattataaaccaacaccaacgccatgggaagatttgaagagggaggattcgattcagtggtttgccctaagcctatacgaacctttagatggtctaccaacagctgttatcagactgagatggctgattcaaaagctggtgcaaagcttcttgatataatcctttccgagtttcaaggagggtatggggcccagaaccccaccgaccaaatggctttatcaccaccgtatttctgtggatcaccgccgagca

SEQ ID NO: 9711 - DNA, 433 bp, Gossypium hirsutum
  Clone ID: uC-gsflmaxxa026a08b1
tcttttacacgtccgtttcttttcccctctaaccgaggtggcttgatgacagctatgcttctgctatgggacttcatgggcatttttgctggctatgcctcttcacgtctatacaaaatgattaaaggaacatagtggaagaaaatatctttaaagactgcatgcttgttcccgggcattgtctttgacatcttctttgacttaaatgctctcatatggggccagaagatatctggggctgtgccatttgggacaatgtattgctttggtcgtcatgtggtttggaatttcagattcacttgtatttgtgggtggttacattgggttcaagaagcccgcaattgaggatccggtgaagacaaataaaattcccaagcaaatcccttgacaggcttggtatattaacccaattttcttcattctgattggagga

SEQ ID NO: 9712 - DNA, 429 bp, Gossypium hirsutum
  Clone ID: uC-gsflmaxxa026a09b1
tcgtttttattttatatacgaatccccaatagtttctcccactttccatctctttgtctttcaaaatcatcaacaggggaagcaagctaaagcagccaccccccttcccctttttctccaattattatctttattcatccattattctctctctgtgtctatgcttttgttcttctcatagtcttcttagtgttgcctaaatggcgtctttgagcttctttttcccttctggttaatggagtcctttggttattggatgatttgaggttatatcagttctaagttgtaacagatactagtataaactcaaagcttcagtttgatttcggagatttcctcgagtttcggatttgttctgagtcctgtattggaacgatgatgatgtttgaggagatggggatttgtggggatatggatttctttggtgct

SEQ ID NO: 9713 - DNA, 355 bp, Gossypium hirsutum
  Clone ID: uC-gsflmaxxa026a11b1
tcgttttccttaattttccgactcttttggctctgttccgatggcttttatttcccgagcccgccgcaccttcaccggacccttccctccatgttcttacttggcttcgattcgtctcagttcgactctcacttcccccaagcttttcattagcggtctcccaagggaaacaacagatgaacagttccaagaggcattttacccatttggccagattgtcgaagccaaagtcgtgagagatagagccacccgaaggtcaaaagggttcggttttgttacatatacatccattgaagaagctgaaaaagctagagaagaaatgaatgccaagttcttgcatggatgggttattttt

SEQ ID NO: 9714 - DNA, 232 bp, Gossypium hirsutum
  Clone ID: uC-gsflmaxxa026a12b1
agtgctaaaaccatcttcttttttctgctttctcgtatagcagcctgttttgagaaactttttttttgaggaaattagaaaatgtcatcggagaacgggaaaaggttgctggaaactgatgccggcggcttgattttgaggctaccgagctgactttagggttacctggagagcctagagtaacattcgacggtggagcttaattgggcacttaaccttgattttcggaaac

SEQ ID NO: 9715 - DNA, 380 bp, Gossypium hirsutum
  Clone ID: uC-gsflmaxxa026b01b1
tttggaagctgctgcagctgtagtggaagaatatggtcttccttgtggaaaggaggaatttcttgcagaacttcagccagtattctatgcacagttgtgcaacattaaacctcttccaggtgcctgtcggctacttaaacatttgagtggtcatggtgtgcccatggctttagcttcaaactctccaaggggaagcatagaatccaaaatttcttatcaccaaggttggaaagattatttctccgccattgttggtggtgatgaagtgactgcagggaagccaagtcctgagatattcctggaagctgctaaaaggctaaatagagaaccttcaagctgcctagtcattgaagattctatgccaggtgttacagctggta

SEQ ID NO: 9716 - DNA, 401 bp, Gossypium hirsutum
  unsure (1)..(401): unsure at all n locations
  Clone ID: uC-gsflmaxxa026b03b1
cagctatcttacatcggtggagagactaagatactggccgctgatcgaaacatcaaattctccgccatgatctctaagctctccgctctctgcggcggtggcgacggtgatttttcgttcaagtaccagctccctggtgaggacctcgacgcacttatttcggtaactaacgatgatgatctcgaacacatgatgttagaatacgatcggctatatcgagcctcggccaagccagctaggatgcggcttttcgtgtttccggcgaccggttccttgaattacgggagcgaaggggcgaaattggaccgtgagcggntcgtggaggctttaaaattccggtacgtctcagggaggcgagaaaaccgctgcaatccgcaaagcaatatggatttcttgtttgg

SEQ ID NO: 9717 - DNA, 479 bp, Gossypium hirsutum
  Clone ID: uC-gsflmaxxa026b05b1
tccacgcgtccgaacagccatcctccctctgttcccctctccctctccctctcccttctcccatttgttttccttcacattcctctcaccgttttcagccgggcctacaattttcttttaaaagaaaactatcttgagaatcaataacgaagggaaattgaaatcggatcgaagggttgagggcgagaggagaagaatgagcactaagaagaaaacatcgcagggtcacttgagtagaacacgcataggaaagtacaatctgggaagaaccctgggtgaggggagtttcgcaaaggtcaagttcgctgagaatgtcgagaccggtcagtgtgtggcgatcaaaatcttggatcgtgatcaagttctacgtcaccgtatggtcgaacagataaaaaacgaaatcttaacgatgaagctcatcaagcatcccaatgtcattaacatatttgaggttttggcgagcaagacaaagatttaca

SEQ ID NO: 9718 - DNA, 356 bp, Gossypium hirsutum
  Clone ID: uC-gsflmaxxa026b08b1
tcgtccacgcgtccgcggacgcgtgggcttgcagtttgttaggagccaagattctaattgatgataatcccagatatgctgttgagtgtgctcaagttggaatcagagttctgctttttgattacaagaactcgtatccatggtgcaagacagagtcaattgataaacatcctttggtgactagggtaaataactgggaagaagcagagcaacaaatagctgcttggatttttagttctactatcccataggaagggctctatagagccttccactgcatattattgtgcattgtttcttatacccgaaacattcgatgggccaaaaatgttgcttattgggtgattcaacccata

SEQ ID NO: 9719 - DNA, 61 bp, Gossypium hirsutum
  Clone ID: uC-gsflmaxxa026b09b1
ttcgttacgataagaagctgtaaccagtgcaagggggggttgcaagaagtgctttataccg

SEQ ID NO: 9720 - DNA, 381 bp, Gossypium hirsutum
  Clone ID: uC-gsflmaxxa026b10b1
tcggtgctgttctctgctctcaccagatcaaaaggaaattcaaaagaaataaagatcgtacaaataagaatctatattacgctactgagaactctgccgaggaaaaagcagacgcaatggccgtacagcggttagacagaggcgatctatggaagaacaaggctcgcgtcatggaactccagctgaagcagcgcttcagggtggcagtcaatcgccaccgtcctttagaccttgctgaacgttacttttactgctaggttcagcgctgggttcagcgcttgcgcgacttccgtcgcgatttcctgccttattccttttctttttacccgaaaaaagtgagtaaagactttgacgtggacgttgattcaactatttttttaa

SEQ ID NO: 9721 - DNA, 292 bp, Gossypium hirsutum
  Clone ID: uC-gsflmaxxa026b12b1
tcggtaccatcgcccatgctttggagaagacaaaatatcctgattcagatatctactggaagaagcttgaagacaaataccatttctcttgccaatttacagctgatctttttgcaatgaaccatacagatttcatcatcaccagtactttccaggaaattgcaggaagcaaggacactgttggtcaatacgagagccacactgctttcactcttcctggtctctaccgtgttgtacatggtatcgatgtgtttgatcccaaattcaacattggtttccctggtgctgatat

SEQ ID NO: 9722 - DNA, 519 bp, Gossypium hirsutum
  Clone ID: uC-gsflmaxxa026c02b1
gctgaaaaaggttaatgaaaagcaattagatgctctaaaatctatagtccattattcggaaaatcgtagtattgatgcaaccgagcttcttggttcatggcaaattaaagagaagatagtgacgttggaagaagaaattgttgagctaaaaaaaattattgaggagaaaaaaatgaagaaaagaaaacggaaagaaaagggatcatcaagtacagttaagagccaagaaatgaagcgatcacggttggcaaccgaagggtcccctttgccaaaatctgaagcaaatcagttgtgtgagcaactgaccactattctttccgaaggcgatggttcggtccctatttctagtaatgccaacaattctcctgttacctcagctgccccacatggatcaacctgttgttttccccgaaatgggatagcccagatgggaaaggctaatgaaaagcaattagatgctcttgaatcgatagtccagtatccgaaaaatttagtaatgatgtaacgagcttcttggtt

SEQ ID NO: 9723 - DNA, 535 bp, Gossypium hirsutum
  Clone ID: uC-gsflmaxxa026c03b1
tttttaataaataaaaacctgtctttctctctcttttgctagcctacagtccaactttcaaagctaaaacaaaattatttttcttgaattttaaggatttacaagaaaaacaatgagtgcaccaaagagagcttggattgtggcagcatcaatatatgtagttgaggctttgaaggaccaaggaatttgcagatggaactattgcctaaggcttgccaagaacaattttaccaaaccattttcatctttgaagcaggaggccccgccggcaatggccgtcgcaacttccggtaaaatgagggaagagatgatgaagccagagaggtctatgaaaaaggtgatggaattaagttcatggggtcctaaaacaattaggtttttaatgtaaatcttaattggtttttaagaggagaaaaaaaatttgagtatccttactttagagatatataatttttaattaaagtttgatttaacatgttcataaccgagcggttagtaatgagcttgttcaattttataaaatttttttcctaat

SEQ ID NO: 9724 - DNA, 517 bp, Gossypium hirsutum
  Clone ID: uC-gsflmaxxa026c04b1
atcattttccgatccgataatgaacctttcaagaaacacatgaaaaggtttgtgaccttgattgttgacaaactgaagcaagagaagttgtttgctccacaaggaggacctattattttagcacagatagagaatgaatacaacactattcaaagagcattcagggaaaaaggggatagttatgttcaatgggccggtaaactggcccttagcttgaatgccaatgtcccatggatcatgtgcaagcagagggatgccccagatcccattatcaatacatgcaatggaaggcactgtggagatactttctatggtccaaataagcgcaacatgccggcattgtggactgagaactggactgcacagtatagagtattcggtgatccaccattccaaaggtcagttgaagatttggcatactcaattgctcgatctttctccaaaaatgaagcatggttaactactatatgtactttggtggcaccaattttggcaggacaagtgcctcatttacaac

SEQ ID NO: 9725 - DNA, 407 bp, Gossypium hirsutum
  Clone ID: uC-gsflmaxxa026c05b1
tccttttgattttcagccatctacctgccgattgattccttataaaaaaatcaacgatgttccaaaacgctgagaagagaacgttcacgtggacagatggtgtgaattgcaaggcaaaaagtgttagggcatcatttgctgcagatgtaccctgaactttacatcttacaaagttactcataagcaccaaaacagatgacagggagcgaggcatagcactttgcttttgatcaggaactgcaagttgatccgaaagttttacattgtgagaagaggttggccaatatcatggagcatacaagatatccgcggggcttttggatacctatggacctgagagggatcttgattctccaattgctgaggctgattctgcaagtattggtgatgaacccgactactatggt

SEQ ID NO: 9726 - DNA, 517 bp, Gossypium hirsutum
  Clone ID: uC-gsflmaxxa026c06b1
gtgaagtgtttcccgttgtcctagcagtagcaggtgttcatattatcaaaaagttcatgtaccttgcccatttcaagatctccaacacattcacaaaatgccttaaatgcagttaaaagtgcagtagtggttcatgtcgaccagaggtacctagaccatgacaactgccaagttgcagtacaagtgcagcaagaactgaagagtaaccatgttcaacagctcgctttccaactttacctccacctttgaaattaagatgaaacatcataaaattatgaagaccataaaaataagataaatttcaataaatgcaattagtcaacatgcctaaagaaggaagtaagagcaaaaatagcagcttgcagaatttcatcctccaattgagtttcaaaaacaagactagaattttctccttttcctggatcactacttttagtgacacgagtctgattaagacagagatcaggtgctctaagaataaaactgacaacactgtatgtttgagaaattgctattc

SEQ ID NO: 9727 - DNA, 384 bp, Gossypium hirsutum
  Clone ID: uC-gsflmaxxa026c07b1
cttcttttgtctctttttttttaaacacagagaccacattttgaaacaaaaatggcatgccaacttgttgttctttctttggttttgatttttctcgccggtgtcgtttctaccgacgcctcatctgccagtggcagcactgcaagtgcaccagctggagcttctacagttggcagtactgctagttcctcccctacttctcaggctaccaatccaggtcttagcgatggtatccctattgatgacccatagaatgattgtcaacgaaatgtcaataaatcattaaaaaaattgcaatttaaaagaatggtgaggtttcggaaaataaataattagttctataaatagaatgttatgtttttcattaagtttatgaactgattt

SEQ ID NO: 9728 - DNA, 344 bp, Gossypium hirsutum
  Clone ID: uC-gsflmaxxa026c08b1
tctggtcgtgtaggaataatgactgagatggctccagtgtggttatgttggtgtgagtcccaaatgcattctaggctttaatatgaatcatggagaagaaatatctctccgtctacgaaccgatgacctcaaaggattcaggaaatatgagagcataaaaaaaactcttctacatgaacttgctcatatggtattttctgaacatgattcaaatttttatgcccttgccaccacagactgtactagacaatgagcttcaaaaattttttcaaatgggatttgactcgagtttcagctatggacagttttgggacccaatttggtcggttataaacctgtgcttt

SEQ ID NO: 9729 - DNA, 457 bp, Gossypium hirsutum
  Clone ID: uC-gsflmaxxa026c09b1
ctattgttcacgcgttcgcccacgcgtgcgtccacctgcaccgtcaagaccttcaccgatccacctccggccggtttgtttattcccgaatagccaagtagaagcaagcatacaagaacgaggagtttggtacaggagttcctaacacgttgaatgtgagcaccaatttcccatttctgattgagggtgttcttgggtttgttctttgccttggaggaggaagctttttcaatataagattgccaggagagctgtggggctggctgcttttctatggaggaactgcaagtgcggcttttggttctgcttattatcatcttaagcctgatgacaatcgaagactgctggacaccttgccgatgatgattgcttattcctcacttttttctactttatactcgagagactcggagaaagaattggattaaagtgccttttttactagtagatcttgctg

SEQ ID NO: 9730 - DNA, 425 bp, Gossypium hirsutum
  Clone ID: uC-gsflmaxxa026c10b1
tcgtaccacaccactacctttctccctaaactatccattgaagctattcagacagtgactccgatgaggataactgaaccacgacagacacgacaagtattggcaggggagcttgtaggacctgggattttccaaaggtgtttgaacgtggtccagtattacatgaaggagaaagaagaagactctggttggttattggctgggtggatcaaggaaacacttgtgagagctttacatgagcaaccaatgatttctggtctgttttcgaaaggggaacgaaacgatggaaaattggagattgtttccaatgattgcggcattagactcattgaggcaaggattcagatgaatttgacggattttcttgatttgaaacaaagggaaaaagctgaagctcagcttgttttctggaaagattttgatga

SEQ ID NO: 9731 - DNA, 478 bp, Gossypium hirsutum
  Clone ID: uC-gsflmaxxa026c11b1
tctttacctttcagactcactgaattgaagcagagaacgaagcaaatatgaaattcacggactcaccggtgatacagcttcaagtgcgtgatttccaactctctatccaacaagacaatggctccttccacgttggtacctccgtctggccttgttctttggttctagccaaattcgtagagcgctgggcaccatctttgcccaccaccaccaccagcgataacccttattatgacctccttgattttcacacccgccgtcgtcgcgccatcaaattgggaactggttgtggagctgatggcatgactttccgcctattgggtctccaagacatcatcctcaccgatatatcccctgttatgcctgcgctcaagcataacctcaaacgtaataaacccgttctgggtaagaacatgaagaccttgattctttttttggacaacaaggatcagatcaagggcgtaaatccttcgttcga

SEQ ID NO: 9732 - DNA, 368 bp, Gossypium hirsutum
  Clone ID: uC-gsflmaxxa026c12b1
tctttaaatcccaattgaaaactttaaagaatccacgcgccactatctctgatctcactctccgcccatggcgaccattccgatgacaaattctcaatccaccgctggcagtggaccccaatcacaacccccaataaccaaccctgcttttcgtacattcctctcacgactgacgtcttcgatccgtcagggattcttccagcgtcggccatggtacgaactcatcgatcggactgtcatggcccgttccgacaatttaacggatgcttattctcggatccgtaaaaacttttcctatttcaaagtaaattacattactctacttgcacttgtactcgctttctcggttttgtctaatccattttccc

SEQ ID NO: 9733 - DNA, 256 bp, Gossypium hirsutum
  Clone ID: uC-gsflmaxxa026d03b1
ttttatcctttcattttccgatcttcctaagggatccctgaaggccaagccctggacctaccgaaaatgcaaatggaggtttttggacctttaaggaggacttcggttatccaagaagatgatggtttgggttccattgtaaatatggaggctggatattcatgaagccattatcaaaagggtaaccaaaatggggttcattccagacctcgttgattctctttaaagagtagttttgggaaactatatttctttt

SEQ ID NO: 9734 - DNA, 486 bp, Gossypium hirsutum
  Clone ID: uC-gsflmaxxa026d04b1
tggactcgtggggcacggccaccataaaataagaaaattaagaggccggatttcaaaaccctttctctttaaaatatagagaaaagagggaccaaagtgaaaatcgaaatatagatttgattttcaatctgcattttcagggtgtggaacaatgggtgcaggtggcagaatgtcggttcctccaagtcaaaggaaacaagaatcgggctcaatgaaaagagtccctatatctaaaccaccatttactctcagtgaaataaaaaaagccatcccaccacactgtttccaacgctcacttatccgttcattttcctatctcgtttacgacttcattttagtctctatcttttactacgtagccaccacttactttcacaacctccctcagccactatttttcgtcgtctgtccatttattggactctttaaggtttaagcctcactggcggttggggtatcgcccatgaattgcggcaccatgctttt

SEQ ID NO: 9735 - DNA, 530 bp, Gossypium hirsutum
  Clone ID: uC-gsflmaxxa026d08b1
tcgtaaaccccaatttcttaacttccgaggggtttccagttagggttttactggatctaccactattggaatatttggtttttggataattcgtgatatttacggctttgggttgcttttgtttttcttggaggggttttatttgttagatttctggagctccggcttagttttaaaagggaagaatttgaatagccaatgccatatttgggtaattggtatttgaaaggtgtatttttagcgtaattttttttggagagaccgaaaaaaaagtgatcaatgtcttgggcaggccctgaagatatctacctttctacttctcttgccagttatcttgacagaaaacttttagttttgctgcgagatggacggaagctcatgggaacattacgttaatttgatcaatttgccaatgctgtttttgagggtgcttgtgaaagggttattgttggtgacctttattgtgacatccctttaggtctctatgtaattcgtggagaaaatgttgtcttgattggtgaacttgactt

SEQ ID NO: 9736 - DNA, 467 bp, Gossypium hirsutum
  Clone ID: uC-gsflmaxxa026d11b1
tttcacgcgtccggtgattagtactttattttttgccaataaaattattttctatgcactatataaagtaccttagccaattttcctcatcaccatcgtctgctattcttcacaaaaaagaaaagaaaaaatacagtgaaaatggcaacccttaaggttccagctcatgtacctgccccttctgaggatgctgagcaacttcgtaaagcttttgaaggatggggtacaaatgagcaattgattatcgacatattggctcacaggaatgcagctcagcgcaatttgatttcgaaaacttatcgtgaagcttatggggaagatctccttaagtctttggatgaggaaactttcaagtgactttgagcgagctgtggcgctgtttactttggaccctgcagagcgtgatgcatttttggctcatgaagcttcaaagagggttacattaagcccatgggttctaatggaaa

SEQ ID NO: 9737 - DNA, 240 bp, Gossypium hirsutum
  Clone ID: uC-gsflmaxxa026e02b1
tttaccaatacatctttcatctgggttgtcgtttctatagctgaagaaactcttcaatggctgaaaagagcaaggttttgatcatcggaggaactggatatctgggaaagttcattgtggaagccagtgcaaaatagggtcatcccacttacggttttgtaagggcgtccatcgtttccaaccctgataagggaaaacttgccgacaactacaagaactaatgggtccatttgttgttag

SEQ ID NO: 9738 - DNA, 377 bp, Gossypium hirsutum
  Clone ID: uC-gsflmaxxa026e03b1
tctagtaagcaaatagttgaagattggaaggttggatggagagtgaagaagaacaaggtaggtgaaggtgaacatttggtgagcagagaagaaattgcagagctagtgcgcaggtttttggattttgagagcatggagcagatggaaatgagacaaagggcttggaaaattggagaaacatgtcaaacagcaattgcaaaaggcggatccacagatattaacctagatgctttcatcaaggacattttcgaaagacaccatcattagcttgtcttagttggttccttatttgtagatccaattatgtcaacagcaatctgattcaatttgttgacaataaaacattgaattgagcaagcatggaattgctctatttt

SEQ ID NO: 9739 - DNA, 314 bp, Gossypium hirsutum
  Clone ID: uC-gsflmaxxa026e04b1
ttaaaaatggtaagaaagccttttggtatttggaagatgattgtctggatctcggatcattataacttaggttatgtcctacaagttatgcaggaaattgaaattgatgcattcatataacaagttatggggtcacctatctagagaaagatggagactggataaagctggatttgttgcccttgtaccctgagaatccacatcttgtaaacatgtttacgagacacattaccgatgtgatcgggtcgcattgctgatgaacataataaaagaaggtggagattactttgttgtacatcaaggttaaatccaac

SEQ ID NO: 9740 - DNA, 453 bp, Gossypium hirsutum
  Clone ID: uC-gsflmaxxa026e05b1
ggagcccacacaggcatcagtagtcggtcagtcactggggctttcgccatcacttcatgtgctagtgctgcgtaatagtccccccccccccccccaaccttcatcttctgcgatctggcccttataaacccaacccccctccaacctttcattccattcccaacctctctgttttctcctttctgtcacccatggaagtcctcataatgtctccctcttcatgttcttctctggtttccttttcccaggaaactccgtcttcaacccttcagcagaggctgcagtttgtaatccaaagccagcaagatttgtgggcatatgctatattttggcagacactaaacgatgacctgggtaatctgttcttggcttggggagatggtcatcttcaatgcactaaagatgctttttcaaggttgagttccagctttcacagcgaacgaactaaggtga

SEQ ID NO: 9741 - DNA, 398 bp, Gossypium hirsutum
  Clone ID: uC-gsflmaxxa026e08b1
tcttttcgctagattctttaatccattaagatatcatgggcaagggtccaggtctctacactgaaatcggcaagaaagccagagaccttctttacaaggattatcagactgaccacaagttcactctcaccaccagctcttcaactggagttgctattacatctgccggaacgaagaaaggcgaacttttttagactgatgttaacacccagctgaagaataagaatgtcacaactgatattaaagtggatacctactccaatctctataccaccataacccgtgatcaacctgcacccgggctgaaagcaatctttagctttagagtccctgatcagaggtctggcaaggttgaactacaatatttgcatgaatacccagggattagcttatgcatt

SEQ ID NO: 9742 - DNA, 312 bp, Gossypium hirsutum
  Clone ID: uC-gsflmaxxa026e09b1
tgaggagtctataaagttaaaagccgtccaaaacccaaaccaggaaagccaaacgaaaagaaaaaatggctttgaattttaatcccatcgcctcgaaatctcagaagctcccttgctttgctcttccacgaaaggccaccctcagatctcccaagttttccatgatctccaccattccttctggctccaaagaggttgggaatctgaaaaagcctttcacgccttccaaggaaggtccctgttaaataaacccattcaatgccgcttacaagaatgaaaactttaaatcctttggagggctgggctgagaac

SEQ ID NO: 9743 - DNA, 544 bp, Gossypium hirsutum
  Clone ID: uC-gsflmaxxa026e10b1
gggagattctttttctttttttcttttgctgttgtaacactaggggttttttttttatgatcaattataatccttttgttgtaaagttcttattttcagagggtactttgggggattttattgcttggagatgatggagaacagtgaagaatcagcagtggatgatcaagggtcaggatggtttcaagtgaaaaagaagcacagaagcagctcgaagttttctgtacaaagttgggttggggggtattcgaccaaaaatgctaataatttggtgagaggtcggccattgtcgaacaagaagggtggagctgtgcaaggaaaatatagatctttgcttcgatcatctggggggaattcagatggacatacccaggatggttttgcaaattctactgccgagtcaaatgaagatgaaaagagcctttatcccactttcaataaggggtttgtaagctgttagtggtgaatatgttgatgatgtattaagcaaaatgttgaaataaggtgtagcaatgagtgtaatttttaatgttcgatgatggac

SEQ ID NO: 9744 - DNA, 486 bp, Gossypium hirsutum
  Clone ID: uC-gsflmaxxa026e12b1
ttttcttttcatctcaaaaattgaaatttcaccgtcaaagctttttcccctcaggttcgagctctgaaatggcaaccgagaataacagttccagggtcggatctggatccggatctcattctgtcaacggcgacgcggctcctgaccgcaagatcgcgttgatcactggcatcactggtcaagatggttcctacctgaccgaattcctcctcaacaaaggctatgaagtccatggcttgatccgccgctcttccaacttcaatacgcagcgtatcaaccacatctacattgatccacataacgcccacaaggctcggatgaagctccattacgctgacctcaccgacgcttcctcgcttcgtcgctggctcgatactattcgacccgatgaggtttacaatctggcggctcaatctaacgtggccgtctctttgagatccctgatatacagctgacgtggtggttatcggagctcttcgcttgttg

SEQ ID NO: 9745 - DNA, 540 bp, Gossypium hirsutum
  Clone ID: uC-gsflmaxxa026f05b1
tccacgcgtccgcccacgcgtccgcccacgcgtccgcccacgcgtccgctccatttctgtctcaacggcgctcgtcttcctcgtccgctcagatcaagcctcgtcaactcgtactctaacttttcagcggtccggtcaagcgccgactcagccatggcagcactcaactcagtccgagtagccgcggttcagatgacctccgtcaacgatctcgcctccaatttctccacttgttctcgcctcgtcaaagaagcagcttcagctggggcaaaaatgatttgtttccctgaaagtttctcctttctgggtcccaagtctgaggatagtcttttggttgcagaagctttagatggaccaattatgcataaattttgctctttagcaagagaatatagcatttggttgtcccttggaggtttccaagagaaaggacatgatgcacacttgcgaaacacgcatgttatagttgatgatgctggcaacattagaagcacttaccgtaagatacactttgttgatgtggatgttcctgtaggatca

SEQ ID NO: 9746 - DNA, 363 bp, Gossypium hirsutum
  Clone ID: uC-gsflmaxxa026f07b1
tcgatttatttcactacccaacaacccaaaagataaaggaatcgtttacttgttcgtagcaatttatcgtcatttcaagctcaagtctctgaaaatttttgtgctgaactccttttttctgtttgtactaccatgtgtggaggtgctattatttccgatttcataccgccgtcgcggtcgcgacgattgacggccgatttcttgtggcccgatctgaaaaaatccgggttgaagaagggttcgggtaagaaatacttgaaccccggtgatcgacttggcctataatttgaactctgttttaagggtttaaaaagaaaaaattccaattaaagattttttacgtgtttttttttttttgggatt

SEQ ID NO: 9747 - DNA, 451 bp, Gossypium hirsutum
  Clone ID: uC-gsflmaxxa026f08b1
ttcgtcgtgtccatcgcgtggctttcctatcttcatttcttcacactctccgaccaaagaaagcatggaaaaatgaccaagtgttacccaaccggtagcgaggactaccaaaacgccgttcaaaaggctatgaggaagctaagaggtctcatcgctgagaagaactgagctccactcatgctccgggtagcgtggcactcagctggaacttttgatgtaacgaccaagaccggaggtccattcggaaccatgaagcaacctgctgagctcgctcatgctgctaacaacggtctcgatattgcagtcaggcttctcgagccgatcaaggagcagcttcctatcctttcatacgctgacttctatcagcttgctggtgttgttgctgtcgagatcaccggtgggccggaaatttcattccatcctggaagagaggacaagccttacccaccac

SEQ ID NO: 9748 - DNA, 480 bp, Gossypium hirsutum
  Clone ID: uC-gsflmaxxa026f09b1
tttcaggaccttcagttgtgtcccatctgccgaggcaccatcgatacgagaataagactctattaagcataatatgctttgcctggacttgcttatgctctctctatcgtccagctttccaagagtaagtcctttaagtttattgtgcaaaaggcttcatagctggccatgattggatgcgcattggatcttttctttagagagattgggcacccatcatatatgtatccaaagttttgtacatagttgaggatttcattcaacgaaaaaacttagtcatatagcattatctatttcagtagatcatattgtttgaatgtaatcaggcacagaacacctgggaacagacatgtctcattgtcggattagcatccgtgccacatgccaactgtaatctgtaatgtttttcatgccgggagaatgcattttccagccccaattattaaaagaaaaaaaaaaagggcggtctgtttaaaggat

SEQ ID NO: 9749 - DNA, 560 bp, Gossypium hirsutum
  unsure (1)..(560): unsure at all n locations
  Clone ID: uC-gsflmaxxa026f11b1
cccacgcgtccgatttcttcgccctttctttttctctaaccttccgcttgtcgtttctttgctttcgaggcctgaatgataatattagtaaaacagaccaaaaatcaaatccgctgaaatttttccctcaaagttccaccgtgaaatcaggaagtcatcagctttttagttcttttacacctggtgctgctataaatgattccggtttgctgcagcaaattattgtctcgtttctgatggtcattttgctctacgaaaatgtcattagaagaagttttgaaggttgtttttccttttttagatggtgtagaccttgcagcttgtatggtggtctgtaagcaatggagacacatagctaaagatgattacttttggaaatgtgtatgtgcaaagagatggcccttcatttgcaaacgacccaatccttctactgtaacctactataaactatatcacaacgtttacaaacgggagcatcagcgaacgctcctccctccaagactttcctttgatgatttgaaattcttcatngacatttggactgaagataaattgatttt

SEQ ID NO: 9750 - DNA, 516 bp, Gossypium hirsutum
  Clone ID: uC-gsflmaxxa026f12b1
ttgacgcgtgggtttcagtggaacaacagagaaatgcaaggcttgtgataagactgttcatgttattgatttattaacagctgacggcatttcttatcataagacttgcttcaaatgtagccattgccatggtgtgctggtgatgggaaactattgctcaatggacggtgtcctgtattgtaagccacactttgagcaacttttcaaggaaactggcacttaccaaaataagaatgcaaaaccctcatccgaaaagtcaaatggaacgggaaaggctcctagcaaattcgcatcattcttctctggtacacaagacaaatgcggtgtctgtaagaaaactgcataccccttagagaaggtgactgtggaaggagaaaactaccataaatcatgctttaggtgttcacatggaggttgtgtgcttacaccatcaacatatgctgcattggaaggcttcctttactgcaagcatcacttttcacaacttttcaagagaaaggcacctatgctcatttt

SEQ ID NO: 9751 - DNA, 370 bp, Gossypium hirsutum
  Clone ID: uC-gsflmaxxa026g03b1
gcgtctatttttgagagagacagagagagatatggggaaagacgaggaggagatgcgtggcgagatcgaggagcgactcatcaacgaagagtacaaaatttggaaaaagaacactcctttcctctacgatcttgtcattacccatgccctcgaatggccttctctcaccgacgaatggctccccgaccgtgacgaacctgccggcaaagattactccgtccaaaagatgatcttgggtactcacacctctgaaaacgaacccaattacctcatgcttgctcaagtccagctccctttccaagattccgagaacgacgctcggtaatatgaccacgataggtctcacctcggtggttttgggtgtgctagc

SEQ ID NO: 9752 - DNA, 526 bp, Gossypium hirsutum
  Clone ID: uC-gsflmaxxa026g06b1
ttcatagaaggatttgaaggcatttctccattgttgttttattcaattacaagctaccttttgttttggtggttttgagagtggaattagggaaaaaaatggagaagagcactccagtgaggaaaccacacacttccactgcagatctactcacttggtccgagactcctcaaccggattccacctcctccgccgcacgctccacccgtcctcaccagccgtcggatgggatcagaaaagtggtgtttggaggtcaagtgaccgatgaagaatttgaaagcttaaacaaacggaaaccttgttctggatataaaatcaaggagatgaccggtagtggtatttttgcagccgatggagaaaatgacgaatcagaaccttgtagtgcaaatcctacttcaaacaacaaaacagcaatactaatgtaccaacaatctctagctggaatagtcacatctcgtttgccgaggaagagagaattacactcaaaaagccaactactctttcttgagtggcgaagcagcgtgaa

SEQ ID NO: 9753 - DNA, 341 bp, Gossypium hirsutum
  Clone ID: uC-gsflmaxxa026g09b1
tcgttgatctactactaagcagcaaaggccaaaaccaaaagtgttgagcctttcctatccaaagcaaaaaaggagtaaacaaaatatttataaataaataaataaaattgaatcaaaaactcgaatggcgcttaaactggcattctctcttctttcatcaactcacagtctgtgaaaacttccaacacttccggcattaaggtttttccggtttatataaattcagggcttccttaatccccccaaactttcctgagtggccgtcattttatagagggaagaggccttcaaagtttcattcttttttcattaaaaaaaatctattttacgagtggtttgat

SEQ ID NO: 9754 - DNA, 313 bp, Gossypium hirsutum
  Clone ID: uC-gsflmaxxa026g10b1
cttaaatggccggcacatcctaaagctttttcatatccggacagagctcagtacgacaatagtggcactatagtgagagaaccggcatctacaccaaggcctaacgcggccatttgctttgaaccaagcatcatgacatgcctatgaaacgcaacctgactcatcagcctctattgaaccagaacctaccagatgcatgtgctacaatctatatcctattatgaaacacgcctttactgtgtagcctgtgcacaattggacattatgcgccgcaggtaccaccgctcctgctataaccgatgcacttacgcga

SEQ ID NO: 9755 - DNA, 395 bp, Gossypium hirsutum
  Clone ID: uC-gsflmaxxa026g12b1
tcgttgaaatcttctaatcctgtttgcagcttctttatgcctctacctcttcgttgctttgctcaatgttttctacaagtattggtggatacctcatcgggtacagttcatcatgaattcacaaggaatcagaggacctccttatgaatttatccatggaaacaacaaagaaattgcccaaatgctcatggaagcatctatcaaacctatggccttgacacacgatatatttcccagagtcatgcctcatgtttactcctggatcaacaaatacgggaagacttatcttagttggaatggaattcgagctcaactgctaattacagacccagaactggtcaaagaggtccttaaaaacagtgaaaaagcttttcgaaagccaaagactacatatt

SEQ ID NO: 9756 - DNA, 363 bp, Gossypium hirsutum
  Clone ID: uC-gsflmaxxa026h05b1
gtgatttttaatttatcaaataagttacaaagtcccaggtataatataatctaaccatatgacgcaacttgtcgtccattcactctcctcagctccatctggttggtgctaaactcgcgaaggagtagatcgtgagtggaatactcccctgccccactatgaattacttcctgattacggctcttttgatgcactcacccacacgcatctctccgttcgtttgaccggaggccactcactaccgtacacgtgtacgttaaacatagaggtcgaaaacaagatccagtgattaaacgaacagagaaagaccgacgaagatcttgaattcgaccgaacgaaagtaagggctggtgagaatttctt

SEQ ID NO: 9757 - DNA, 477 bp, Gossypium hirsutum
  Clone ID: uC-gsflmaxxa026h06b1
ttgacgcgtgggttcgctggctacaacaaatctgttagagtgtttgatgtacatcgacctggtagagattttgtacaatattcaacactacaagggaacaaagaaggtcaaacgggtattatatctgcaattgccttttgtcctactcacactggaatgctagcgacgggatcttacagccagactactgcaatatatagggaagacaatatggagctcttatatgttttacatggacaagaaggtgggataacgcatgtgcaattttcaaaagatggcaattatctatatactggagcccggaaggatccttatattatgtgctgggacataagaaaagctgttgaagttgtctacaagttatacagatcatctgaatctaccaaccaacgaatagctttcgatattgagtgctcaggtcggcatcttggtacaggtggccaggatgggcttgttcatatttatgatttacaaacc

SEQ ID NO: 9758 - DNA, 534 bp, Gossypium hirsutum
  Clone ID: uC-gsflmaxxa026h07b1
aaacacctcattttcctgagaaaaaaaaaacaaaaaagaagcgtaagtgaagaaggagaagaagaaaaagaaaatggcggaccagcttaccgatgaccagatctctgagttcaaggaggcctttagcctctttgacaaggatggcgatggttgcattactaccaaggaactgggaactgtgatgcggtcactcggacagaaccctactgaggcagaactccaagatatgattaatgaagttgacgccgatggaaatgggaccatcgatttccctgaatttctcaacctgatggcaaggaaaatgaaagatactgattctgaggaggaacttaaagaagctttcagggtgttcgataaggatcagaacggtttcatatctgctgccgagcttcgtcacgttatgacaaatcttggcgagaagcttaccgacgaggaagtcgatgagatgatccgtgaagccgatgttgatggtgacggccagatcaactacgatgaattcgtcaagtcatgatggccaagtaagatctctcaacc

SEQ ID NO: 9759 - DNA, 443 bp, Gossypium hirsutum
  Clone ID: uC-gsflmaxxa026h08b1
gttcgtggtccttacactggtgttgctgatggtcgagttctcttctgggatggtcaaaactggaaggattttgcttatgcttccagcaataggtctgaaatatgtaatcccaagccatcaccacagagttacctgccaaatgagcatatctgtggcaggcctttgggtctccggtttgataagaacactggtgatttgtacattgctgatgcatatttggggttgttcaaggtgggtccggaaggcggattagcaacaccacttgtaactgaggtagatggggtgcccctgaggtttaccaatgaccttgacaatgattatgaggaaacatatattttactgatagcagcagcaaattccagagaaggaacttcatgcagctagttttttctttcgagaatagtgggaggcttttgaagtataatctttacacaaaggaaact

SEQ ID NO: 9760 - DNA, 258 bp, Gossypium hirsutum
  Clone ID: uC-gsflmaxxa026h09b1
tcgttcacgcgtccgagcagaagatattgaaatggtaaaatcaaggtaattgaggaaacctgttcataccaaggtggaccatcttcgccatgggactagaggtgacactattactgtggagggaggtagcacaaagatgggattgcagaagggttgacgctgatggaccgcaagttcgacaaatgcgaactgcggaatgcctggtatgagacgagacaggaatgataatgtttaccgctagaaatgaacaagtggact

SEQ ID NO: 9761 - DNA, 493 bp, Gossypium hirsutum
  Clone ID: uC-gsflmaxxa026h11b1
ggaaaataaaaaaaaatgtcaagctcccacaattctgcaccagaacaactctgctacatcccttgcaacctttgcaacatcattcttgcggtcaatgttccatgcaacagcttgtttgaaacagtaacagtcagatgtgggcagtgctccaatctgtgttcggtaaacctggcagcttcctttcaatcaagggctggaaaagatgttcaggtgcctaattacacatcatcggagtacagaattgacttagggtcttcctccaggtgcaagaacaagttaccaaagcgagcaacaactataaacactaccactcaagaaagggttgttaatcgacctcctgacaagaggcatagggctccttcattgtacaatcagttcatcaaagaggagattcagaggatcaagctgaacaatcctgatatcactcacagggaggcatttagcacttgtgctaagaatttgggttcgcttccttacattaattttgactgat

SEQ ID NO: 9762 - DNA, 431 bp, Gossypium hirsutum
  Clone ID: uC-gsflmaxxa026h12b1
ttagaattttctaattttatttccatttctctctccctcttttgtgaaatctccggcttccaaatatacccccaatatctcaaaacttccgcgatttaaaaatccttgttcgatcctgggaacttaattataatggcgggttctttcttgaaaaaccgggattaaaggccaagaggggggattgaatcggaaaaagaaagggaatcccatgagctggttgggaaatctggggtttacttgcttctcttcggtgaattgttccaaccattttataacggggcttttaatttttattcttcattactcccattaaataccttctttggtatttaaaattgaaaaaaaatcaactgagcctttattattattgggtaaatctaattccaatcatattcctcccttacatcttaaaactaaaatctaattcccct

SEQ ID NO: 9763 - DNA, 395 bp, Gossypium hirsutum
  Clone ID: uC-gsflmaxxa027a04b1
aatctctctctgttcataatcaaagcttcttctccattctctgtgattgaaggaaaataaaatggataagcctttgctgtttggagaaactagcaatggcggtggaaggcgagatcgtttatatcgtcgctctgaagctattacgtatggctctcattaccaaagagcagctgccctcgtcgatctggctgaggatggtgttggtctgcccgaacaaattcttgataaatcaagctttggaagtgctgcaaagttctacttcatgttcattaaatttgatattatttggacccttaattattttgcattggttgtcctaaactttcttgagaagccgctgtggtgtttgagtagttcatattcttgcagtgatagggactactttttttttggca

SEQ ID NO: 9764 - DNA, 406 bp, Gossypium hirsutum
  Clone ID: uC-gsflmaxxa027a05b1
ttctcgtctctgcatcaggctagggttcaacgaataaccgagaaggcggcatcaagtttccttttatcctatcgccatgagagccaagtggaagaagaagcgcatgagaagactgaagcggaagcgccgaaagatgagacagagatccaagtagacagaaccaccagcccctctgttatacgaggtttctcaatgtcttagctaatatcggtgtacttttagggtccacttagttatctgccatttttatttcagttttaagttttttttttctcttgggtttctattgtctttcaagttggtgctaacccggcagtgggatgatgtatcatcgttgagaacagtgaattgcaaaaaaaaaaaaagcagattttaagattggagtttaatttgatttttctttttt

SEQ ID NO: 9765 - DNA, 434 bp, Gossypium hirsutum
  Clone ID: uC-gsflmaxxa027a06b1
ttttcatctctcgaggtctctttctaaaccatcatagatacacagttcggtaatgagatcaaacacattagagacaacaagcaataaaacccatcatctttcttcgctaataatttaagcaaactttatctttttgctgggtgatggatccaccagctatgatgagcgatggggggtacaatctagcagagatctggcagtatcccgtgagtgaatctgggttaaggaggggtcagtttgggaatgtgccgccgccttattacgaccaccccaatccagaggtatcgggtggtatgaggagaaggcgtgatggagaagatgaggcagctaaggttgtctccaccagtagtggcaatggcgtgagttttggtgatggaaagagacttaaagcatcaggatgcagagaggagaatgatgattctaaagttgaagca

SEQ ID NO: 9766 - DNA, 537 bp, Gossypium hirsutum
  Clone ID: uC-gsflmaxxa027a07b1
tcggtttatgcgaagagagctcacaagaaatatgcatttgagtcccacatttaccagaggatgttcagtgggtttcaacaggagaacttctccattaaattggataatgttacagtcaataaagagagcttcttccagcaatatctggctctgagggagatggatccattggacatgttgggccagaatcctgattccttattcgggaaattttcccagagcaagtacctgatggttgttcatccaaagatggaagcttcattctttggaaatttagaccagcgtaattatgtaacaggaggtgggcatcctaggactccattttaccaagccttttttaaattggctaaatttatttggcttttgcatcggctggcttactcattcaaccctaacgtgaaagtctttcaagttaaaaggggaagtgaatactcagaggtttatatggaaagtgtagtgaagaattggtaatggatgaaaccaatgagaagcctaacgttgcgctaatggcaatgcctggcttttgaatggtgggaa

SEQ ID NO: 9767 - DNA, 516 bp, Gossypium hirsutum
  Clone ID: uC-gsflmaxxa027a08b1
ttttcagcaaaggaaagggctgaaccagggtactgtcgccgtgtcaaggactttgtggttgggcggcatggttatggaagcataaagttcctgggtgagacagatgtgagatgccttgatctagagtcccttgtccagttcaacaaccgcgaggtaattgtttacatggatgacagcaagaaacctcctgttggacaaggtcttaataaacctgcagaagtaacgctgattaacatcaagtgcttcgacaaatggaccagagaagcaattgaacccgagagaaaagattcggaggctccgaaaggcactgtagagcaagctagaggattcgacaacatggcaacaaatgagaccctaagtacaaagtctgtagatgtcaggcctatggctatcgatgaaccaactggtgaagttgagcaagatacatcgaacaaagcatttgatccaattaccccaagtcttaaatcgaaacctttcaaataggttctggaggttacttggatgtattagcaacac

SEQ ID NO: 9768 - DNA, 506 bp, Gossypium hirsutum
  Clone ID: uC-gsflmaxxa027a09b1
ttgattaaaatcatgctttcaaattccatcctctactaagctgtccaaaagcttcaatccaaccacaccaattcctcgtcttacgcgtttcctttcgctacaaattctttcatttttctttcctttttttctgtaaaccaaaagcttttgcagcaaattacaaatcaatggctttctacttgaactgcaatacccacttcttcttcaagttttcactccttttctcccttttgagcttctccttctcccaatccgacgtcgtcgaggctccgtctccggccgctgattcttgcaacgggatcttcttgtcttatgcttacagttccgggaccaagttgaaacccaccgatcctacccaccagccctacaggttcgagtcggttttgacggtgctcaacaacggcgatgaggagcttaaatcgtggaaaggttccgtggagtttcaaaacgatgagtttttggtttccggttcgaatgcggttttggctgacgggacgagtttgcct

SEQ ID NO: 9769 - DNA, 336 bp, Gossypium hirsutum
  Clone ID: uC-gsflmaxxa027a10b1
ttggttttactagtatggtggaaatgtttactgtttaatgctgtttatctgcataataattctttttcttttttccttattatgtctatttagttttttagattatgtcgctgattcgattcctaacttatttaggaaccccattttaagattttggcttaatgctggtaaaatgtagcatggattccactttggtaaagcattggatgattcattgtgaggtctatctgctttggcctaatatgctttactctttttttgtttattgcttgattggtgacagggagccatggaattggcctggttaacaaaagaacaacgattttggtgccttcg

SEQ ID NO: 9770 - DNA, 431 bp, Gossypium hirsutum
  Clone ID: uC-gsflmaxxa027b05b1
gtgaaaccatcaacgataaggatcgttgcccacaatgcaaaggtgataaggttgtgcaagagaagaaagtcttggaggttattgttgagaagggtatgcagaatggacaaaggattactttcccaggagaagctgatgaagcgcccgatacggttactggggacattgtattcgttctgcaacagaaagatcatcctaaatttaaacgaaagggtgatgacttatttgtagagcatacattggcacttactgaggccctttgtggctttcagttcatactgactcacttagatggcagacaacttctcattaaaacccaacctggggaagtcgttaagcctgatcaattcaaagcaataaacgatgaaggaatgccgatttatcaaaagccatttatgagaggtaaacttttcattcacttcactgttgac

SEQ ID NO: 9771 - DNA, 383 bp, Gossypium hirsutum
  Clone ID: uC-gsflmaxxa027b07b1
tctctctcaatttctgtggtgggttttcaattaacaatggcctccaaagcaagcagctccctcttccaaagcctgagacgctacatcaagaagccatgggagataactggaccctgcgccgacccagagtacaaaaacgcggtgcccaaagccacggagtatcgtgttcgctgccctgccaccactttgcaaaagcccatcgtccctaccttcgaccctgaaaccgtcttcgacatcaaatactacagccgcgatcaacgcaggaaccgccctccgatccgccgtaccatcttgaagaaagatgacgtggtgaagatgatgaaagagaaaacctttgatgtcaacgattttccaaaggtctacttgactgctaaaggtgaaga

SEQ ID NO: 9772 - DNA, 453 bp, Gossypium hirsutum
  Clone ID: uC-gsflmaxxa027b09b1
tcttttactcgcaaaactgaaattgttaccgtcttggtcgatgctaccaagaatgcttctgaatatgaactcgaggtggatttttcaaataggtttgaatataatgcttcagctgacctcgttaaggaagttcagtttgaggaagccgaagggagtgttaggacaagaattgtgaagaaataagtagaaattgcactcgtcaaaatctaaaggtgaaatggactcatcgcactttgtggaaggttctgctcagcttggaggccacccccaaaagtatgtaccatattcttgtccactttaatgtattgttttgtaattcttatgtgagaaaaatggttgtataaactctttgcatgtgtgatatctccatactaggtagaaattgtcacaatagaagatggtctcctttgcgtatcattaatgaagtaaactattatttcttgtgtgttgcaa

SEQ ID NO: 9773 - DNA, 125 bp, Gossypium hirsutum
  Clone ID: uC-gsflmaxxa027b12b1
tctgttttattgtgtaaaaccgagatctgagatatgggtttcttggaaacaacacctaatttttgtctgagattgggatatattgcatcttttttgtacacagaatcttgatgcataccgaggtc

SEQ ID NO: 9774 - DNA, 555 bp, Gossypium hirsutum
  Clone ID: uC-gsflmaxxa027c02b1
cccacgcgtccgcccacgcgtccggttcaaagctgtcatttcttggttatctatctctgttgctgccatagctagcaggtgatttagggcactggtaagtaacttgttccagaaatatttttgctttcattgcattgaaaatttaataatagacaaaaataaaatctttgctttcatttcattcaaaattaaataaaagacggaccatgaaattattttttggtacaaaggagatcgtagataggggaggagttccaaatgtcgagatttgaaccctagacctgatgatgtcacttataaagccgtgtctacatgaactaggtttagtgtttcaggttcatgccttcaaatttttgtttagttggttatttaacctaggcacaggtattatgaagtccatttccaaagtgtattgaatttatcacaaagagaggtggtttctctttgtttatgattgcatggttcccgtcacacactcctaagattgggacacaacttatgataaaaatgtgaagataaatcttatcagatttggttacatttttaaactaaacc

SEQ ID NO: 9775 - DNA, 525 bp, Gossypium hirsutum
  Clone ID: uC-gsflmaxxa027c03b1
attttataataataaaaaggaaaataaaatcttctccttcggatcaattggtttataattaattgagagaggagaaattagataaagaaaaatggttctctgataaaaatttccgtttgtttcctgagcaaatctcgggaaggaataccctttttttccccctgttgttaactcgttgtgattgtgaagctttctttaagagaatcctagttaactcgacgcgtttacccggaaagaggtgaagatgtcaactcctgcaaggaagagattgatgagggattttaagaggttgcagcaagatcctcctgcaggaattagtggtgcacctcaagataacaacattatgctttggaatgctgttatatttggacctgatgacaccccatgggatggaggtacgtttaagctgactcttcagtttacggaggattatccaaataaaccaccaactgttcgttttgtttcccgaatgttccatccaaatattaatgcctgatgtagcatctgtttggacttttacaaaat

SEQ ID NO: 9776 - DNA, 100 bp, Gossypium hirsutum
  Clone ID: uC-gsflmaxxa027c05b1
ttttattaaaaaaaaaaaaaaaaaaaaaaaaaaaaaaaaatataaataaaaaaaaaaaaaaaaaatatacaataataaaaaaaggaccatcattaatgtg

SEQ ID NO: 9777 - DNA, 527 bp, Gossypium hirsutum
  Clone ID: uC-gsflmaxxa027c08b1
gctaaaaaaaaaaaaaaaaagcgcagaaaaaaaaaagaagagctaaaaagaacgatgtcgcaaagtaaagtgacgatggaggtcggaaacgacggcgttgcagtcatcaccatctccaatcctcctgttaacgctttagctattccaataattgatggattgaaggagaaattcgctgaggcgacggggcgaaacgatgttaaagctattgttcttaccggcaagggaggaaggttttccggtggttttgatatcaatgttttcacgaaagttcatggaaccggtgatgtgtcggtcatgcctgatgtatctgttgatcttgtcactaatgcttgagaagattgcaagaagcctattgtggctgctgttgaaggattggctctcggaggtggcttagaattcgcaatgggttgccatgcacgtattgcttgctctaggactcaacttggcttgccagaattggcacttggagtgaatcctggtttggaaggacacagtgtcttcccaggcttgtagggctttcaaaa

SEQ ID NO: 9778 - DNA, 393 bp, Gossypium hirsutum
  Clone ID: uC-gsflmaxxa027c09b1
tctcacgcgtccggctcaacgctctcttcttctgcttctggtcaagccaatctcaaaagacttcccttttagctcccagctcctctcttgagtactataatgggtaaggagaaggttcacatcaacattgtggtcattggccatgtcgactctgggaagtctacaaccactggtcatttgatctacaagcttggtggtattgacaagcgtgtgattgagaggttttagaaggaggctgctgagatgaacaaaaggtcatttaagtatgcatgggtgcttgacaagcttaaggccgagcgtgaacgtggaattaccatcgatattgccctctggaagtttgagactaccaaatactactgtactgtcattgatgcccctggacatcgtgacttt

SEQ ID NO: 9779 - DNA, 415 bp, Gossypium hirsutum
  Clone ID: uC-gsflmaxxa027c10b1
tcgttgtcgcgtgggcggacgcgtgggtcttgctccaaaccagatgctggcaattggagcatggcaatttcttccatggactggactcgtgtcggagcccttacccaagagctgaaggagaaggaggtgcttataaggggacgagtgcacacaacacgaccagtgtcgaagaatatggcgtacgtggtggtgagggagaggggatttaccgtgcagtgcttggttgctacgcatgaagcgggagtgagtccttagatggtgaagtttgtatcttcactgaatcgataatccatcattgatgcagtcgggatggtatctgtccctgggaattccattaagggaaccacccagcaggtccagaatcatgttaaaaaatttgattgtgtgaataaagcaatgcctaccttacccatta

SEQ ID NO: 9780 - DNA, 476 bp, Gossypium hirsutum
  Clone ID: uC-gsflmaxxa027d03b1
cccactcgtccgccatttcctctttcatcgccaccgcttaaaatgtctcttcaccatttgctctttcccattctaatactcgcattctccgctgcttcttcattagctgccactgcaaaagaccaaactttgaacactcatcaagctgagttctttaatcccaagcttccacccagaatcctttcctcttccaataagttcgaaggctcatcggacattgtcgacctccgttaccacatgggtcccgtcctttcctcgtcgccgatcaatatctacctcatttggtacggtagttggtctgtttcccaaaaactcctcatcaaagacttcataaactcaatttccccttccgcgacgccgtctccttccgtttccgactggtggaaaaccgtctctctttacactgaccagaccggagccaacgtttcgcggaccgtcgtcattgctaaagaacactccgacacgggttatcccgc

SEQ ID NO: 9781 - DNA, 368 bp, Gossypium hirsutum
  Clone ID: uC-gsflmaxxa027d04b1
tccacgcgtccgcccacgcgtccgcaaaatctttgcccaccgggactgttcactgcctcgtttcagctccctggtccagtgaataacgaagacgctaagagttatttggctaacggaatgcttgaagcggttgtgaagaggatgtaattctgaagtgttagaaagctagtgactgccgctttacttactttacatttctttcccatgcatccaactcagtagttatatgttataggctttaagcatctctaaaaccgctgttgtttaaactttaatctcttcctttagaaccaaactggtgttccttctctatgttttttcctttaaaaataataattaaattatggtatcaatcattcaacatataa

SEQ ID NO: 9782 - DNA, 418 bp, Gossypium hirsutum
  Clone ID: uC-gsflmaxxa027d05b1
gtcaggttcttcctcaggctgaacctttggctgccgctggacctgctttcaaccgagtagaagtagtggcagataaagatattgcgatggagggtcggagtgctgataaaatagtcggagttgaagaagaagctagcaccacccctgttcctgaaacggtacaagtgggtaattctcctgtatataggttagaaaggaaattgggtaagggcggttttggccaagtttatgttggccgaaggacaagtggtggtagtgatagaattggacccgatgcaattgaggtggccttgaagcttgagcatcggaacagtaaaggttgcaattatggtccgccttatgagtggcaagtgtaccaattccctaaatgggtgttatgggattccttctgtgcactacaagggtcgccagggagact

SEQ ID NO: 9783 - DNA, 266 bp, Gossypium hirsutum
  Clone ID: uC-gsflmaxxa027d07b1
ttgttttacgctccggtcgtctcacaagattgagatctttaaatctttggagggctgggctgagaacaacattctgactcacctcaaaccagttgcgaaatgttggtcacccgccgactatttttcagatcctaatttctgacggattttatgagcaagacaaagagcttagggaaagggcaaaggaaatcccagatgattacttcgtaattatggttggtgatatgatcactgaagaagccctttcaacttatcaaacaatggct

SEQ ID NO: 9784 - DNA, 441 bp, Gossypium hirsutum
  Clone ID: uC-gsflmaxxa027d09b1
tcgtccacgcgtccgattccagcgaagggagaggagacacacacacacacacacacacagagatcttcaaatttcatcaatggatcattcaaaggttcaagagatcgtggagaagcaggtattgacggtggcgaaggccttcgaggaccagatcgacgaagagattgcggctttagatcgactggaccatgacgatctggaagctattagagagcggaggttgcagcagatgaagaagatggcggagaagcgaagtcgttggatcggtttaggccatggtgaatactctgagattccagctgagaaagacttcttttctattgttaaagttagtgaacgagtcgtttgtcacttttatcgcgaaaattggccttgcaaggtaatggacaagcacttgagtgcattggcaaagcagcatatagagacacgtttcgtgaaaat

SEQ ID NO: 9785 - DNA, 298 bp, Gossypium hirsutum
  Clone ID: uC-gsflmaxxa027d10b1
tcgttctctcaaagctatgaatggagttcatcacatgtgcatcattacaagcttcatcgcgggatgacgttagctgtgattcaagatatttgatttagccctttcagacagtggattgccattgttccaactcggggtacttgccatatatattgatctttccccatatggtggtgagaatggcactccaaattcagaaattctaatgtacattgggcatattcttatcaaccagctgtatcttctcccctttggttggaccaactccaaattttcgtgaacatactttcaaacattt

SEQ ID NO: 9786 - DNA, 422 bp, Gossypium hirsutum
  Clone ID: uC-gsflmaxxa027d11b1
ttgttcacgcgtccgcggacgcgtgggctttattttgttttttgtttacaacaacattggctggacacacagtttacaccctttcagatgagtcttgatacaatatctcaagaacgatctgttggcttgtcatcaatggccgagttctaatcgtaacaaagtttctggatgaacattcagtaggagaagaggtgttgttggaattagcatggaaggatgcgacgaatgaattcaacgatatcggacattgcatgtcggtttaaaatttgctccttaagtattaagattggtgttttccagggtcacactttaaagaattatgaaacaggttggtttaaaccgaggtagcccaaataatgaaagagatgagtgcaattcattatcaaaggatgaccttgacccctaattatgctggaagtatt

SEQ ID NO: 9787 - DNA, 407 bp, Gossypium hirsutum
  Clone ID: uC-gsflmaxxa027d12b1
ttcaaccaccgccctcttcttcctcctcctcctcttctccacctcaaatgcacacaacatcacacgcatactcgccaaacaccctgagttctccaccttcaaccactacctcaccctcactcatttggcttccgagatcaaccgacgcgaaaccattactgttctggccctcaacaatgctgccatgtcatctctcttgtctaaacaactctccctctacaccctcaagaacgtcctctctctccatgtcctcgtcgactactttggttccaagaagcttcaccagattaccaatggaactgctttgacgtccaccatgttccaagctagtggcgccgctcctggttcctttggctacatcaacatcactgatcttaaaggcggaaaagtcggctttggggctgaaa

SEQ ID NO: 9788 - DNA, 553 bp, Gossypium hirsutum
  Clone ID: uC-gsflmaxxa027e01b1
cccacgcgtccggttgctttcgccttaagcggtcacaatatttcggttaatatgggaaccaccgtcaaaggggttgtgctgtcgctgttcatctcgtccctgttgtgttctgtagtacttgcatccaatgatgggctggttagaattgggctgaaaaagatgaaattggatccaaacaaccggcttgctgcgcagcttgactcaaaggatagagaggctctcagagcatctattgctagaaagtatcgctttcgtaatgatctaggagactctgaggaaactgatattgttgcactgaagaactacatggatgctcagtactaatggggagatggtataggaacttcaccgcaaaagttcactgtgatatttgacacaaggaagctcaaatctgtgggtaccatcaactaagtgctatttttcggtcgcatgttcttccattccaagtcaaggcaagtgagtcaagtacttataagaagaatgggaaatctgcttctattcaataccgtactggagctatttctggtttctttagtaatgacaatgttaaagt

SEQ ID NO: 9789 - DNA, 458 bp, Gossypium hirsutum
  Clone ID: uC-gsflmaxxa027e05b1
cttggtttcggctttggcgttgcacgcaaatctctcgctcaacgctatgtccgaaacgactgagggatccgaacttcaaaatggtttccagccacaaccccgacccgaacccgaaccggaatcggaattgaaagtagaatctcaacctgaacaacaaccggaagaggaactgaaaccggaacctgtagtaactgatgccgatccgaagccggagccgaacaatgagagctcgatccaatcgaatgagacgaccaaacaagcttcaaccgaccaagttgctcctccagggcggcgtaaagatgaggagaaccggactttcacgatgagagaattgctaagtgagttgaaaagcgacgaagatgatgcagggtcttcttacagtcaagaaaacaagcaacgtcagtcctaccaaataatgctgcaaggagttgatcaatagtgtcactgtactgatgaga

SEQ ID NO: 9790 - DNA, 525 bp, Gossypium hirsutum
  Clone ID: uC-gsflmaxxa027e06b1
ctctctctttattttctgccaggtttctttcttctctctcaaaaatctctcaaatccaatagactctccgctcctctgatcttttcttcgacttggtttatgagctcgaaggagaaacccactcttggcggtacgcggattaagacccgcaaacggaatattgctgcacccctggacccttcagcatttgctgatgcagtagtccagatctatttggataatgctggtgacctggaacttgttgccaggagcattgaatcttcagatcttaacttctcaagatacggtgacaccttctttgaggttgtttttgctggaggccgcacacaaccgggcacacttaaacctgatgaaggggagcgccacccttactctatcatagagtgtgaggctaaacgtgatgccattttaccatctgtgatttacattcagaaaatcttgcgccgaagaccttttctgataaagaatcttgaaaatgttatgcgaaggctcttgcagtccttggagcttttcgaggaaatgaga

SEQ ID NO: 9791 - DNA, 436 bp, Gossypium hirsutum
  Clone ID: uC-gsflmaxxa027e07b1
agagaagtgagcgggtgggtgggtgagtgttttggggaagaaaacataaaaacaaaagcgccgtatttgattatagttttggagttgagagatcataaatgcttttgctgaagcgatacattggttggcagatcttggggagaagaaagtgaatggaaatgcaaggtgggaaaatggagaaagatttcgtgttgcaatggggaaacagaaagaggctaagatgtttcaacaaacttaaaaaacagcaccagcaccagtttggcgacagcggcggcggcacctctaccacgccgcactccttacctttgtccaacaagaagatgggctcctcgcctgttgccaatcgtcttaaaatgtaaggaatggatattgtttggttgcttgattacccaaaactagtttatttttagttcagaagtgtaaatatagatctggg

SEQ ID NO: 9792 - DNA, 539 bp, Gossypium hirsutum
  Clone ID: uC-gsflmaxxa027e08b1
tcggtgggctgcctgcgccacaaggctgagatggtgatttttgaagctgcaagagcaatcacagagctcaatggtgtgacaagccgagaattgacaccggcaatcactgttcttcagcttttcttaagctcttctaagccagtgctgagatttgctgcagttcgtacgctgaacaaggttgcaatgtctcatccaatggctgttactaactgcaatattgacatggagagtttaatttctgaccaaaatagaagcattgccacacttgcaatcactacccttctcaagactggaaatgagtcaagtgtggatcgcctgatgaagcagattactaattttaatgtctgatattgctgatgaatttaaaattgttgtggtggacgccataagatcactatgcttaaagtttccattgaagcacagatactttgatgaattttttaagcaatattttaagggagggaaggtggttttagtacaaaaaggccattgtagattaaatgtgattctatcagagatatccctgagcaaaggaaagt

SEQ ID NO: 9793 - DNA, 439 bp, Gossypium hirsutum
  Clone ID: uC-gsflmaxxa027e09b1
tgtgttgacagtgttattcagcagtacttgtcctaaggctccaactacatttctcattataaatgtggagaattcttgctctactttccattccatgcaacactagcttttagattccctttccattgcactgctctttctttctttagaattagtcactcctgttctagatgaaggttctctccccaattcttgcttgcctagcgcttgctgtggtggcaagtcatgctgctctctcacccgagcaatattggagctataagctgccaaatacttcaatgccaaaggctgtcaaagaaattctacatccagaactgatggaggagaaacgtacctctgtaagtgtaggaggtgggggtgtaaacgttaatacaggaaaagggaagccagggtgtggcactcatgtgaaccgttggcccaaaggggttggagtgaacac

SEQ ID NO: 9794 - DNA, 470 bp, Gossypium hirsutum
  Clone ID: uC-gsflmaxxa027e11b1
tcgtttaaaacaaaaggttaagtgaagatgggagcagaacaagcactgaagagaatcccacgcattaagtttcctcaaagacacccaaaaccctcgccttcaggttcaaactcttgaatacaagctacacgcaaagatggaggtgtcattggtaacttcattgcaaggtcaaggttgagctcagatgttcctgctccgtccagcaacactgttgtaggaggaaaagcatctcttttgccaaaacgtactcttgtctctgagagggaaatcgtggctaatttgttaggcgcctgcttctgaaatttcagctgtcaaagctagcttttcccgaagcttgaaataaaaattctgaactgttatattacttccaatctttagtttctgatatgtaaaaaactgtttactgaaatttttaaaagccacataagaattaaaaatggccttctaaaaaaccattgtgggatgagact

SEQ ID NO: 9795 - DNA, 465 bp, Gossypium hirsutum
  Clone ID: uC-gsflmaxxa027e12b1
tcgttcgtagcccctcctcccccgatcccttccccgtccgtcatccccgtcgtccctccttttgtctctaaccctacgacggcgactacggtggctggtggtccaccaccgagtttcgatcacccatcttactctgacatgatatgcgaagctatcggggctttataagacaagatcggttcaagcaaaagggctatagcttagtacatagagttagttcacaaggacttgccaccaacacacttggccttgttgacttaccacttgaagcgctttgaaaaccaacggtatcttagtcatggtcaagaaatcttacaaagcttgcttttactgctagatcctggggtcctatcccggattctactacttccaacccttccgatgttttttctctcctggattcaaacgaagccgtggtcgttctcctaacccaaacccacatttctggtcctgcgacccttttct

SEQ ID NO: 9796 - DNA, 478 bp, Gossypium hirsutum
  Clone ID: uC-gsflmaxxa027f06b1
cggacgcgtggggaataatctaggtttaaattatataaataataaaaatggcattgttttggagagggcttcttatattacctctcctatttgtgtatgcaagcagccattttatatatactaaacgacattttgataaacccgaggtagtcgggttcaaggacctcgattacctccacggcgatggcggtggtttccttagtagccccatagaagacgatgatagtgtcaaagcttcgaagaccgtcgttgaagatgagagtgacgatgatgacaatgacaatgacgatgatgataaaaagagtaaaaagaagaagaaaaagaagaacaagaagaataagaaggagaaaaagatgagcaaaaaagaaaaaaatacgatgaaagtttccatacattaccagtcgaaagccttgtaaatgaaaagggtggtgacgaaaataccgacgattcgtctggagtcgtgttgataatggtaatg

SEQ ID NO: 9797 - DNA, 508 bp, Gossypium hirsutum
  Clone ID: uC-gsflmaxxa027f08b1
gaacctataaagctgatcttcagaaactaaagaaggagaaggaagaggaggagattaggcgactcgaagcattgaagatggagagacaaaagagaattgctgcaagaggcagttccgttccagctcagtcatccgtggcttcacaaagcaagaaacaattgccatcaaaactttctccaagtactcataagggatcaaagtttactgatggtgagcctggaccatcatcgccgctacaaagatccatcaagcctgcttctgtgggatcagtttattctcataaagcctccaaaccgagtaaattgaatggtggaactccgtcccgtggaaatagattaagccactcagtttcatcattgctggaaccaaagaaagacattggcggtgtaacttctgattcaaaggcatctatggcaaggattaggaagttatcagagccaaaaacaagtagcagtccacttgtttctttagtgaaagcacggcactttgaaccaaaagtcgaaacaaa

SEQ ID NO: 9798 - DNA, 333 bp, Gossypium hirsutum
  Clone ID: uC-gsflmaxxa027f11b1
tttacgctgggtctgatgctgactatgcatatgttgacgctgcttctattcgggaggagttgtctagcggaccaaaccaaaggctacgcatgcctttccctttatcctcatcaacggctgaggaacagatcaacctggagcatgatcatgattaatatgatcagtggccatcacctgatgatccatcgatgcatgatgcttaaggatatgagatgagacatggtggactgactgcctgttctttacactcctcttgatggtgaggaaaagtttattcacgcatctgttactattcaggataactgttcatcatcatccttcaaattacggtta

SEQ ID NO: 9799 - DNA, 284 bp, Gossypium hirsutum
  Clone ID: uC-gsflmaxxa027g01b1
gcggaacacttctcgaggggcctactacgctagcttgattacacactaggctacctcactgggtgggctgaagatacggagggctctagaggccggcgtgtcggtaggagaacccttaggaagaccaacttaccatggcgggatgggacgcgctccttgatctgttgactagaaaacttgccaaactgttggcacgttgcgctcgcttattgttacagaagccggtgcatagacaacccatgtctatcaatcaaaaacctcccaaggggaaaagggaggcttgc

SEQ ID NO: 9800 - DNA, 459 bp, Gossypium hirsutum
  Clone ID: uC-gsflmaxxa027g02b1
cccacgcgtccgcccacgcgtccgcccacgcgtccgggttttcatatttcccctctttttttaatagaggagctcttaatcaaccgacccaatcaaattcataaattttagagttttgaatgggtacggagagaaaaaggaaggtgagcttgtttgatgttgtggacatatggtgagttacatttttatttttgttcccattatttcctttaacatatgttttgcatggtttaattattatcataagtggattgatttgccaattaaatcacttatgtaatcaatccaaatatatgtgagtattaagttgattggagcctggcaagggccaggggagggggcaggtcccttctaaaatgaaaaaattattttatttgggcctttatattttataaaattataaggaagtaaatggattaatttgatttttgaccgcaaaaatataaataataataatat

SEQ ID NO: 9801 - DNA, 334 bp, Gossypium hirsutum
  Clone ID: uC-gsflmaxxa027g04b1
gttagctatgtcaggggagccgtccttcgagcggagctcccgccgagggcgcacatggagggtgtacagcgcaagggtgattcagaaaccctagggtttctgaattgttttaggctattgggcctttgggcctgtaggaattgggttaggggtttaggttttgtctgaaaaatgggttaaatgtgatttgggctttggtaaatagattgtaataattttggacttttcaattctttgggttttattattattgttgggttttctgacgggccgggcaaatttgggcttgtacaatgaccttttacttcttttatgagattataaaattttagtc

SEQ ID NO: 9802 - DNA, 530 bp, Gossypium hirsutum
  Clone ID: uC-gsflmaxxa027g06b1
cccactcgtccgcacatcaacaaaatcatgaggagcatttgtgttgtgcttgttatctctttgcctttccttctcggcattgcccagggtttcgatttccacgacaatgatttagcgtcggaggatagtttgtgggatctatacgagcgctggcggagccaccacacggttgccaggagtctcgacgagaaacatcggaggttcaatgtgttcaagcagaatgttttgcatgttcacaacaccaacaacaaggacaaaccttacaagttgaagatcaacaagtttgctgatatgaccaaccacgaatttaggaatgcttaccctagttccaagattaaacatcataagatgttccaaggacagtcccgtggcgccgggagtttcatgtacgagaacgtcgaccgtgtcccgccgtccgttgattgccacagaaaggtgccgtcactgctgttaaggatcaaggccagtgtggtaagtttgctgggcattttcaacagtttgagcatttgagggaatcaatcaaattaaac

SEQ ID NO: 9803 - DNA, 392 bp, Gossypium hirsutum
  Clone ID: uC-gsflmaxxa027g07b1
tcgcccacgcgtgcggggagatggtcaaccaattggacgatacgatgatatgtgggctggctggtgcaccaaggttatttgtgatcacctcggatggggagtgaagaccggactttcctacatttggcacagcaaagcgagcaacccgtttgtgaaccttaagaaagaatacaaaggaatttactggcaagaagagttgattcctttcttccaatccgttgcccttccgaaggactgcaccaccgtacagaaaagctacattgagatctccaagcaagtgaaggcgaaactcggcaaggtcgatgactacttcaataagctggcggatgctatggtgacatggattgaagcttgggatgaactgaacccatcgggcgatatatccgcaagat

SEQ ID NO: 9804 - DNA, 473 bp, Gossypium hirsutum
  Clone ID: uC-gsflmaxxa027g08b1
aaattgcctgccttcttctctccaaaaattccccgtcgatttcatatccccaaatcaagccaaatcgattcgccttcatcttcttccaaccaaagcgactgagaaacactagcgggaagggaggtaatctttttctgccctcatcaagcttcatcctctccgacgtttcccttccattgattgcagaggaacgaaaaatgtcatcactttcacatatttgatcttctagcaccgccgcctgtgcctctactaccagtgagaataccttgtcttctttcctttaatttctacacttcagatctttatctatgtttcccgattatcctaaatttagcggtattatttatttagtttaaatttttatttagccttcaacttttctttctcctcaaaaaataagaaaaaggaattaaggtggagaactatctgtgcttaatttcgttgtgaaattaataaaattttatactattttt

SEQ ID NO: 9805 - DNA, 509 bp, Gossypium hirsutum
  Clone ID: uC-gsflmaxxa027g09b1
cgtcggttgcaaatcacccagccaagatccaatgctccgcaggcttcaatttcatgaagtctcaatcccccaaccccaacattctggtgggtgcagtcattggtggtcctgaccagaaagacaggttcccagatcaacggtccgattatgaacagtctgaaccagcaacgtacatcaatgcaccccttgtcggagcgttaacttaccttgctcattcttttggtcagctttagggccctacaggcgttactactactactactactttttagggttatcagtaactttttaacatatttaggtgttcgtaatgtattcccttttagttaattttaaaatattaaaaggttatagtaatattcctctggaagtgcacaaagcggtcaggcaaaagggttcagacctaaggcttgagccacaaaccttgaagactgaatgcacaattgtcaaagatgaatgccattgtggggggcgtgtttgttttttcatctataacaatattattatta

SEQ ID NO: 9806 - DNA, 78 bp, Gossypium hirsutum
  Clone ID: uC-gsflmaxxa027g12b1
tcgtgattctcatcttgttcttttatccttatcgatgaaataaattttatttattttattagtacacaattttcttcc

SEQ ID NO: 9807 - DNA, 353 bp, Gossypium hirsutum
  Clone ID: uC-gsflmaxxa027h01b1
gttaatcgtgaaggataatttaaatgaaaaactttcatatagagactgtgaaaagattgcaaaggatcttaatctgaccttggaacaggtacttcgtgtatattatgataagcggcaaaagcgtcttaatagatttcggggtgttccaaatagcaatggagagcagtatcaaggagaaagagataaacagtcatcttctcggaaaagaaagagatcaactgtcaaatcaatagaaggaataaaggctgatgcaagaatcatacaattaggtgaaaaggagggtggtacactatctgatggaaatgatgagctaaaagaagattatcatttaacttcttcagtgggacctgatg

SEQ ID NO: 9808 - DNA, 398 bp, Gossypium hirsutum
  Clone ID: uC-gsflmaxxa027h02b1
ctcacgtttccgcccacgcgtccgcccacgcgtccgcccacgcgtccgggagaagtcataaactctcacactgccccctccaatataccttctttggcttttcctttttttccatctgatacaatacttttatcaaagtctgttctttttgcattcttgagaaggagaaaacaaataaaggtgatagatcaactcaagcaaaggacacccttttaaatcccactcattcttgggtcattgatagatctctgcttgattttctacaatccttttttttttctttacacgaaagagacaactcagaaacaagatctaccaagatttagaaattggctttagagaaaaaccaagacaatgttgcctataaagccagcaaaagaagcaatagtttcaaactt

SEQ ID NO: 9809 - DNA, 457 bp, Gossypium hirsutum
  Clone ID: uC-gsflmaxxa027h03b1
cccacgcttccgcaaaatgttgagcacaaatgcgattagaaccatcgttgggatcatcggaaatatcatctccttgttcctgtttctctcgcccgttcccacatttattaaaatatttaaattgaaatccgtggaagagttcaagccggatccatatgtagcaacaatcttgaactgtgccatgtgggtgttctatggtctccccatagtccatcccgacagtcttttgatcattaccattaatggtgttggcctggtgattgagggtgtcttcgtaaccatcttctttatcttctctaacaacaagaaacgaaagaggatttgcttttaatcttttgatcgaaatcatcttcatggtagcccgagttttgattactttacttgtgtttcaaacaaccccaaaaagggccatgtttgttggaattttggccattgtcttcaacattggaatgtacac

SEQ ID NO: 9810 - DNA, 499 bp, Gossypium hirsutum
  Clone ID: uC-gsflmaxxa027h04b1
ggtgattgtgccaatgcgggtgcctgtagatgagagcccagttttcctactctatcaggattgggcattgggtctcattttccttaagatctggactagactggttatgctggatcatatgatgctcgcttctccacaccgctgttgatctagtgaatgagactaagctagacgatgaaatcaaatcgtggctcgcatttgctgcccagaaagttgttgaagtcaatgcacttgccaaggcattggctggtcaaaaggatgaggccttcttctctgccaatgctgctgctcaggcttcaaggaagtcctccccaagagtgactaacgaggctgttcaaaaggctgctgctgctttgaagggctctgatcaccgtcgtgcaactaatgttagtgctagactcgatgcccagcagaaaaagcttaacctttcaatcctccccaccacaaccattggatccttccctcaaccttggagcttaagagagttcgtcgtgaattc

SEQ ID NO: 9811 - DNA, 499 bp, Gossypium hirsutum
  Clone ID: uC-gsflmaxxa027h05b1
tgattgacaagtcacctcctataggatcgattgcacgcaccctgtcgtgggatgatttgtgttcagatacagccacattaaattcatcaaaaccatctaaggtgtccccaggtgccaaggaagaagaacatgattgggttttatcggtccaaacactgttatcatctgctggtctcaatgacaaggagtattttgagtcatttattgatggatggcattcacctgaaagtccattggacccgtccttgagagacaaatatgccaacttgaacgacaaggaacctctacatgaggctaagcgacgacaatggagatcaaacaagacgctcgtattcgactgtgtgaatgcagccatagtggaaatcacaggttatggatcaaacaatcgcatgaacgagatgtcattgcgcaggtcttatatgagggacatggagagtgcatcgcccacattggttgaccatgtgtgtgcccaaattaggaatgggctttcggtgaccgt

SEQ ID NO: 9812 - DNA, 526 bp, Gossypium hirsutum
  Clone ID: uC-gsflmaxxa027h06b1
gtcaccctcaccacaagaaaccttctgaaaacagtgtcgatggatgtttgtcgggccaccaaactattcagaagtaccgttagatcgagcaaacttctcgcttaggaaacgttggccatcattagcagaggagaaacgtctaatggatggaggagacagaccgtcgtaatcctgattgtaacggtagtagcgtcattgagccgaatgaccgtagtgactgcaaatctgacattgaacccgtggccgaaagtcgctcctattagaaccagataaagaacgaccgccgtcatgagtaggaccggccaccgtcgtgtttaacggtacctcaaccatgttcacatgaaacggtacatcatgcatcgtacgaagctgctgattctcaaaatccaagagaaccccaatgattttttgaaacagatgtggctcagaggagaaagacgtcagcgttatcacggaatcaaaatctgatgaaagtacctctaccttttcggccttcgagacgacagatccagacgcctccaagaga

SEQ ID NO: 9813 - DNA, 231 bp, Gossypium hirsutum
  Clone ID: uC-gsflmaxxa027h07b1
gttatggaaaaagatttttttctactcaagaaatggcgggaagagctcaaattccgacaagtaattcagcactaattgccatgattgctgatgaggatacagtaactggatttttgatggctggagttggaaatgtggatttaaggagaaaaacaaactatctaatcgtcgattcaaaaacatcaagaggaagcaatttgaagatacattcaaagactacaccacaaggga

SEQ ID NO: 9814 - DNA, 484 bp, Gossypium hirsutum
  Clone ID: uC-gsflmaxxa027h08b1
tcgcccacgcgtccgctttcatcttctttttccttcataccaaacacttcacgagaaaaacagagaaagagtactttcttttttcttcttcttttggttctgtttcactgccatggcgaaaacgcaaacaccccatatagcgattcttcctagtcctgggatgggtcatcttattccactcgttgagttcgctaagcgatttgtacagcaacacaatttcactgtcacttttgttatccccaccgctgattctccttcgaaagctcaaatatcaaccctggattccctttccaagtttatagaataatgtttcctttctcctggtgacttgagtgaccctccttaaagacgcaaagattgaaaccgtgatttttttaacggtggctcgctctctgtcgttccttcgggatgctttgaagtcgctggctgcaaagacaaaaactcggcggtttggtgggtgatctttttgggacagacgcatttg

SEQ ID NO: 9815 - DNA, 480 bp, Gossypium hirsutum
  Clone ID: uC-gsflmaxxa027h11b1
tcggtcagggcaagaaactgcgattgttcgagaagaagataaagttaaattaaaaaaaaaacatgttttttcacatagtattagagaggaacatgcaattgcatccacgccacttcggtcgtaacctacgggaaaacctcgtatccaagctcatgaaagatgtcgagggcacttgcagtggtagacatggttttgtggtggcaataacgggtatcgaaaacgttgggaaaggtttgattcgagatgggaccgggtttgtgacattccctgtgaagtatcaatgtgttgttttcagaccatttaaaggggaaatcttggaagctgctgttactatggtgaacaagatggggttctttgccgaagccgggcctgttcaaatttttgtttcgaaccatttgattccggatgatatggagtttcaatccggagatatgccaaattatactacgtctgatggatcggttaagattcaaaaggaca

SEQ ID NO: 9816 - DNA, 448 bp, Gossypium hirsutum
  Clone ID: uC-gsflmaxxa027h12b1
caatactgtagtacagtgagaaggaaaaaaaaaatggagttgggagctcaagattatgctgataggaagaaagatatcagccaattcctgtctcaagatatttaccaagatgaaatcaaggcaatgataaatcacaagcgtcgccgtctcatcgtcaacatctccgatctacactcttttaacaacttggctactaggattctgaagaatccgagtgaatatatgcaaccttttttcgatgcggtgactgaagctgctaaaagtattgacccaaagtacttgaaagaaggggaaatagttcatgtgggatttgaaggtcctttcgtttctcgtcgcgtcacacccagagagctcctttccgaatttattggctccatggtctgcgtcgttggcattgttaccaaatgttctctggtaagaccgaaggttgttaaaagtgttcactttt

SEQ ID NO: 9817 - DNA, 551 bp, Gossypium hirsutum
  Clone ID: uC-gsflmaxxa028a01b1
ttcaatttcacattatttcccacaccaaaaatggctcagaaagtggtattgaaagttctaaccatgaccgacgaaaagaccaagcaaaaatccatagaagctgctgcagatatcttcggggttgattcaatcgctgcggatctaaaggatcagaagctgacggtgataggacaaatggatgcagtggcggtggtgaagaaactgaagaaagtggcaaaagtggatataatatcaataggacctgctaaagaagagaagaaggaaggaaaaaaggaagaaaagaaagaggaaaagaaacaggagaagaaagaagagaagaaggaagagaagaaagaggaaaagaaagaagaaaagaaggaagaaaagaaataaatttaaaaaataaaatgaaaaaaccccaaaccatcttaaaggttttcaacaaatctctgcttgtagtgttacagtgtatgctctgggtattctcttttcttttttggtggaaaaaaaggttttttttagtgattgtctgaaaaaaatgagaggggcaattagcaatgtgaaaagggttt

SEQ ID NO: 9818 - DNA, 493 bp, Gossypium hirsutum
  Clone ID: uC-gsflmaxxa028a03b1
tttttgtatctgctatcggaaaatgtctacgtcaccgtccgtcaccgaactccaggtggagaactttacgttccctccgacggtgaagccttctggttccaccaaaaccctgttccttggtggagcaggggagagaggattggaaatccaagggaagttcataaagttcaccgcaattggagtttacctggaagatagcgccgtgaattgcctcggcgttaagtggaagggtaagagcgcggtggagttaacggaatccgttgagtttttcagagacgtggttacaggtgattttgagaagttcatacgggtgacaatgatattgccattaacggttcaacaatactctgagaaagtatcagagaaatgcgttgctatttggaaatctcttggaatctacactgatgcagaagcaaaagccattgaaaaattcattgaagttttaaggatgaaaactttccaactggctcgtccattcttttcactattttag

SEQ ID NO: 9819 - DNA, 349 bp, Gossypium hirsutum
  Clone ID: uC-gsflmaxxa028a04b1
tttctatctctgatcataatcaaagctccttctccattgtctgcgattgaaggaaaattaaatggataagcctttgctagatgcagaaactcgcaatggcgtgagcaggcgagatcgactgtatcggccttctgaagctattacgcttggctctcattaccaaagagcagccgccctcgtcgaactggctgagcgaaggtggtggactgcccgcacactttattgatatatcaagctccggaagtgctgctaacttctacttcatgttcattaaatgtgacattatctggaccctccatgatattgcattggatgatcaaaactctcttgagaagccgatgcagtggtt

SEQ ID NO: 9820 - DNA, 531 bp, Gossypium hirsutum
  Clone ID: uC-gsflmaxxa028a06b1
ttcacgcgtccgtatagctctgcctctttttgtttatatgttagtactcgtaattttctctttatctttttttattatttaattccagtttcttggtcccttggtaattgatcacatttgataattgtggtttcagttcttctcaggggatatagcgacgccaaaacgatgaagcgagtagtactgaaaagggtggagccaccaaggcccgttacgactgtgagatatgtggagtgccaaaagaatcatgcggcggctgccggaggccatattgtcgatgggtgcagggagttcatccccagtggagctgaaggaaccgatgcagcctttacttgtgctgcttgtggctgccataggaatttccatagaagggttgaaagttaaccttgttggccactgttcttcggctccatcttctaatggagcataaaaataatatatttatatttcaaacctctttcgttacctataatttgggtatatatgtttcttgaaagaagggtttttttttttttttgacctaacttttta

SEQ ID NO: 9821 - DNA, 498 bp, Gossypium hirsutum
  Clone ID: uC-gsflmaxxa028a07b1
tcttttctaaaagaatcaacagatcaagctgcaacgtgttcaggcaacatcgatgccccattcgacgagactttattcgatatcgagaaagagattgatgatttattgcctgtcgaagtaaaagaacagcgtctaagtaactttgttacaagctaccatggtaggcggttgtgttgcagcaatgcctatacttaaaaagatcccaacttcggtcctatggggttactttgccttcatggctatcgaaagcttaccggggaattaattttgggaaaggatcttattgctcttcacggcaccgagtagaagatacaaagttcttaagcagaaacatgcaacatttgtggagactgttccattcaagacaattgcgattttaaccgtttttcaaactatttatttacttataatgtttcgggttaacttgggtaccgataggccgctgttatggttcctttgatgaacatgccttttagtccatgttgacaatacttgttg

SEQ ID NO: 9822 - DNA, 418 bp, Gossypium hirsutum
  Clone ID: uC-gsflmaxxa028b01b1
ttgactcgtggggcagtaatggctccttcaactctcacagagcttgcagggaaggaaaccttacaggcaagctttgttcgtgatgaagatgagcgtcctaaggttgcttacaaccaattcagcgatgaaatccctgtgatctctcttgccggtatcaattatgtaggtgaaaagagggcggagatatgccagaaaatcgtcgaggcttgtgaaaattggggtatcttccaggtcgtggatcatggtgtcgacactaaactcatttctgagatgacccgtcttgccagagagttcttcgctttgcccgccgaagataagcttcggttcgatatgtctggtggcaagaaaggtgggttcatcgtctccagtcaccttcagggagaaacggtgcaagattggcgggagattgtgacctact

SEQ ID NO: 9823 - DNA, 410 bp, Gossypium hirsutum
  Clone ID: uC-gsflmaxxa028b04b1
ttctttcgtccgcccacgcgtccgaaaaaaaaagatggcgtctgtaataaaatctgcaatcttaattctgtcggtgtttttatctgtaagcttcagttcgggtgttaggttgctccaggaacagcccaatgatgacctcaaaaacatggaagctattcctcccattgatgcactcaaccctaccgagttcaatggacccggtgttggcattcacgaagatcatgttgtcccaaaaggttccgaaattggtactcttggttttggttttgaaggtggtcctgaaaaatgttgttcttctggatgttccggtaattgtaatcctggtggtttcgttctaccatttcctcaaattcccagaaatcccaagaattccacagatcccccatatcccacaattccacaaattccac

SEQ ID NO: 9824 - DNA, 457 bp, Gossypium hirsutum
  Clone ID: uC-gsflmaxxa028b05b1
ttgtttcgtgggcggacgcgtgggcggacgcgggggattaaatggttacatgtgggtttattatggagttgtgaagcccaatagtattctggtagccactgttaatggctttggtgctgaccttgagcttgtatatgtcatcatcttcctaatctttgcacctcccagagcgagagccataactgccgtactttttggtgttttggatgaggtgttcccaatagcagctgtgttgataactcagatgtcctgtaatagagaaatgcatataactattgcaggcttcttgtatctggttttcagtgtacttacctatggttcacctctttctatcatgaaaacagtagtgagaacaaagagtgaggactacatgcctttcctcctatctttcatccttttatcaatggactaacttgcactgtttatgctgtgctactagagactggtttattggaat

SEQ ID NO: 9825 - DNA, 284 bp, Gossypium hirsutum
  Clone ID: uC-gsflmaxxa028b10b1
ttgtttatggaggagaataaaagtaaacaaaacaatgttaaaaggcccaagggaggaatgatcgccatgcccttcattatctcaaacgaggtgtgtgagaagttggccgtggctggaattttatgctaacatgattagctacttaacaacgcaagcttcatatgccggtaaccaaagcagccaacactctcacatacttcggcggaactgtaagctggacaccataggcatggggcatttcgtcgccgatgcatacgccggacgttactggactctaactgttg

SEQ ID NO: 9826 - DNA, 282 bp, Gossypium hirsutum
  Clone ID: uC-gsflmaxxa028b11b1
accccagcaggcaccggacagaaatagccggaaagacccacgcgtttgttttaagaacagagagaaaagcaggcaaccatcttcatcatcgtaccataaacatctactagaatcaaaagggggatcagatctcaaaagagcagtcgaagcagagggaacaatatctgcacaaaagctgaccacctaaacaccgattaggggcagctacatggaaaaacttcccaagatagccaatgacactactcaacctgaaggcaaaaaaataaatttccaaaaggatga

SEQ ID NO: 9827 - DNA, 246 bp, Gossypium hirsutum
  Clone ID: uC-gsflmaxxa028b12b1
ttgtttacgcgaccgcttttctcctatggttaaaaccccaggtacagggagaagagcgtgaaatttacttatttttttctattcatattattattaaaaaaatttcgcccacactcaaaagtgaaagaattcgagctttccgaggagaaggaatcgatggatttagatcaatggatatcaaaggttaaagaaaggcagcatctcttggaagacgagctccagcttctttgtgaacacataaaagaa

SEQ ID NO: 9828 - DNA, 467 bp, Gossypium hirsutum
  Clone ID: uC-gsflmaxxa028c02b1
ctgcatcagcagcagcagcagcagcagcagaagtaaaagcagaagccgaagccgccccagtggaagcacccaaagaggaagctgcaaaggaagaagagaaaccagctgaagctcaagctgagaatactactaccgagtaaataagcttgtaagatggggaatcaatggaagcttgtgtagtgggcttactgttagctaagtttgcatgttgaaatcaattagtttcaattctagttgaataaggatgtgatagtattaaggtggatgaggcttgggactggggcatggaaatgacccaccaatgatagcttgcctattggctaaactaacatgcaattggcatatggcagggagagagagtttagagaaggttcaagcaggcattttggggggggggggcatttttcatgttcaatctggtctctgtaatgggtggttcctgggtcccaagcaggtcgttaaattta

SEQ ID NO: 9829 - DNA, 559 bp, Gossypium hirsutum
  Clone ID: uC-gsflmaxxa028c03b1
gtagttcactttggcggcagtttctcagttgtcttcttcttcgctttcttcgtcttcgtcttcttcttcttcggtgattgctcgtttcagcgctgattctggagttgcagagctgcggtttcaccgagattcggaatttattgatggcttcaatgtcgatattggaacctcgcagctcttcaagctgggaccggttcaatcgctttgtgtttcagagagttctggtgccagtaaagagaaatcatattcacgggcagtgaccatccagtttagaaacgaggatgaaagcagggacttccattccgcatttgagcaatggcagaaggatgttattcaagcaggaattcatttaccaaatggggccattgctgcttctaagagcaagtttgattataaaattgagccatcttctgctaaaatgtatttccactattatggacaattgctacatcagcaaaatatgttacaggattatgtgagaacaggaacctattatgctgctgttatcgagaaccgtgttgatttacaggtcgtgtggtggttgattgttgaactggaa

SEQ ID NO: 9830 - DNA, 401 bp, Gossypium hirsutum
  Clone ID: uC-gsflmaxxa028c04b1
ttttcttcatgggcatgctgaagtttcttttgagaatgttcgtgtgccagcaaagaatattctattgggagaaggacgcggctttgagattgcccagggaagacttggccctggaagactgcaccactgcatgagactgattggcactgctgagcgtggcatgcagataatggctgaaagggctcttaatcggaaaacatttggaaaatatattgcccaacacggttcatttctttcggattttgcaaagtgtcgaatagaactagagcagactaggttattggttcttgaagcagctgaccagcttgatcgacttggaaacaagaaagcccgtggaaccattgcaatggcgaaggtagcagctccgaacatggccctgaaggtactggacagggcaatac

SEQ ID NO: 9831 - DNA, 325 bp, Gossypium hirsutum
  Clone ID: uC-gsflmaxxa028c05b1
tttgactcgtgggctttgtttaaaaattttcaaatttatttttgcatattaagatctaaccttttcatttgcagacgcactctcagatcccagctctagaacttcaattctctccctaaagtaaacctcccaaatatctctgttttttttgtttgaaaaccctaaaaccctaattgtttcgagttgctatcctatttaaaaccctaatattttctgcttgatgtagagtttgtagacaaatgggagaaacaagagacaacgatgtctacgaggaagatctcctcgatttcgatgaaaaagaagagaaagcccctgactctgtcac

SEQ ID NO: 9832 - DNA, 498 bp, Gossypium hirsutum
  Clone ID: uC-gsflmaxxa028c06b1
tttcttcgtccgaagagagcgcaaaatatgggcagagagagctccgtggcttgcaatggataccgtcgattcttagatctcttaaccctagccatttttattttttatcattctgatcgagcattgtttctaacgaagaaatcaacttttaggtttcatttgattcagttctggctggttttctgattttacctgcatttcgcgttctatttcgtcgtggttgctttgctgattgtttcgcctaaccaaacattgtatctgacgaagatatcaacgtttctgttccgtttgattcagttctggcttgtttcgatccggtttccttctgattttacctgcatttcacgttctgttttgaattttggagaagtctagaagttgtctgttagggtttccaagaagaaaggaagaggatggaaatgatgaagtgtatgtgaaagcagagaaggagataggagaaacgaggcgtgataatggacgattgaagaggttcatttg

SEQ ID NO: 9833 - DNA, 556 bp, Gossypium hirsutum
  Clone ID: uC-gsflmaxxa028c09b1
tcgttcacgcgtccggctttcgcgtttctttctgaaactagagctgagaaaataaaacccaaagccttaaaaactatcaaaaatggttcaaaggctcacttaccgtactcgccatagctatgctaccaaatccaatcaacaccgtgtcgttaagacccccggtgggaaattgatctatcagactactaagaagagagcgagtgggcctaagtgtcctgttactggaaagcgaattcagggtattcctcacttgagacctgctgaatacaagcggtctcggttgcctaggaaccgtaggacggtgaatcgtgcctatggtggtgttttgtctggaagtgctgttagagaaaggataattcgagccttcttagtggaagagcaaaagattgtgaagaaggttctgaaaatccagaagaactaggaaaagcaatcctcaaagagctaggaattttaaatgctgatgaagctgaattggtttggcttgttagatttacctgagagaaaattttgttgtattattgcgaattgatgaaatgtgaactgagttgagactttt

SEQ ID NO: 9834 - DNA, 563 bp, Gossypium hirsutum
  Clone ID: uC-gsflmaxxa028c12b1
tcgtatattttatttatttttatttaattatctttgaagattcttcctggtttgggccctagactctctaatcttcgctgtttatcttactttcttcatcttttttctcagatcctttcgattttcttcactgatttctgtcattaatcttcgtcttggcttttatggagatttgatttaactcacactttacgagtgttgcagtgtgtgatggattcggataatctcttgtctgcgggtgggcttgaggttgcccatcaaaatggtgtttatccgcaacttcgggtgtctggggacgacagtggtattttgaataatgttaatggaaatgctgaggaaactgtcgggacttgttcgcagaatggaatagatgacaatggagcaactatggaagctagagaacgatcgaatgacttagtcgataacaatggatcaattggttctaatgaaggaggagttaaatgatcatgtgaatgtgagcaatccaaacctcaaaggttcaaagcagaccagaatgagaagcctttggtccagaatgctttttagcttaatgagaaaagtaa

SEQ ID NO: 9835 - DNA, 363 bp, Gossypium hirsutum
  Clone ID: uC-gsflmaxxa028d02b1
tttcatctcataccagcaaaggttgatcttcgctggtaagcaacttgaggatggccgcacgttggctgattacaacatccagaaggagtccacactccacttagtgctttgcctccgtggaggaatgcaaatttttgttaagactttgactgggaagaccattacattggaggtagagagctcatataccattgataatgttaaggccaaaattcaggacaaggaatgccttccttatcatgaatataggctgaattctgctggtaagcaacttgaatatgggattgactcttgcatattacatcatccagaaggagttcacccttcacctgttccttctacttcgtggcgggatgcaaattt

SEQ ID NO: 9836 - DNA, 558 bp, Gossypium hirsutum
  Clone ID: uC-gsflmaxxa028d04b1
ttctttcgtccggagagagagaaaggatggttttctcaacggtgttaacatcagttccaaatctataccttaccaggaaacccaagaatattcacatccaaattcgatgcctatcgtcaccatctgtatcaatttcaagtcaatcaaatttgacccaattcgatttaaaggcttactgggctaccctttatgcagaaatcactcaaaagcttgaagaagcaatcccagtgaaatacccagatcagatctatgaagctatgaggtactctgttcttgcaaagggtgctaagcgagccccttctgttatgtgtgtggctgcctatgaaatctttggggataatcgactcgctgcttttactactgcttgtgctcttgaaatggttcatgctggcttactatatcatgatgaacctccttgcatggatgatgctctagaacgcaaaggcccaccttcgaaccataatgcctttggtgatgacatggcaatccttgctggtgatgcctctttccttttggcttccacatattggcatgcttacgccttctgagcttgttcct

SEQ ID NO: 9837 - DNA, 489 bp, Gossypium hirsutum
  Clone ID: uC-gsflmaxxa028d05b1
tcactttcatttcttgttgaagtcaaacaaggaaaagaaaatcattcagctcagattcatggctacgcttatgacaaatctgctgctcacggcatgcattgctcttttcttggtatcagctgccaccgccgtcggcgactcccccttcatcatcgctcacaagaaggcatcgctcaccagactcaaatccggcgccgagtgcgtctccgtctctatcgacatctacaatcaaggcttctcgacggcatatgatttgagtcttgtggattatagctggccccaagatgcatttgatgttatcagtggaaatatttctcagtcatgggagaaacttgacgctggtggtattctatcacattcatttgaattagaggcccaaaaacaaggcatgttctatggtgccccagcagttattctctttcgcatttccacaaaggctgctctacaggaggcatattcaacttcaatcttgccgttagatgtcctttc

SEQ ID NO: 9838 - DNA, 524 bp, Gossypium hirsutum
  Clone ID: uC-gsflmaxxa028d06b1
ttctctcgtccgatggcaacgagtgatgccgaagtgaaagttttgggcacatgggcgagtccattcgtgatgagggtaaggattgccatgaacatcaagtctgtggcctatgaatttcatcaagagaggttatgggaaggcaaaagcgagcttctcctcaaatcaaacccagttcacagaaaggtccctgtcctcattcatggtgatgacaccatctgtgagtctctcattattgtccaatacatcgatgaggtttggccttctgctcccattcttccttctgatccccatgaacgtgccaccgcccgtttttgggctgcttatcttgacgacaagtggttcccttccttgagagctattggtatggctgaaggagaggatgcaaggaaagcagccatagggcaagtggaggaagggctgatgcttgtagaggaggcatttgacaagtgcagccaaaggcaggcattctttgggaaggatcaaattggatatctcgacttaacatttgggtgctttttggggtg

SEQ ID NO: 9839 - DNA, 284 bp, Gossypium hirsutum
  Clone ID: uC-gsflmaxxa028d08b1
tcgttcacgcgtccgggaactcatcagttctgctaaaagattgaagaccggcaactaacatagtgagcaacggtgaatatgacttaacattcgagccgagacataatttaggtgtaattataacattatagtatatccaactaagagactaatagggacgagtattcgatcgaacaactggactatgctcgcggattctaaccttgtaatatagggatagagccctgagtgcgtattctagtataaacactattccaaccatctaaagaattgagggtaggcga

SEQ ID NO: 9840 - DNA, 524 bp, Gossypium hirsutum
  Clone ID: uC-gsflmaxxa028d09b1
tctttaacctgctggtgatgtccaaggacctgttgggggaattatgattgaatgcggtactgattcccccatggaacaagtgctttcccaggatgatgcagaatgttgcatctgcctttctgcttacgaggatggagttgagctaagggaacttccttgtcgccaccatttccactgtgcctgtgtagataagtggctatacataaatgctacctgtcctctctgcaagtacaacattttaaagagtagttcccaagaggaagtgtagaagaaccaaaaataaaacaatcatttacagtcacgtctaagacctttgcatagggattttagctcgagagtattataatgcagtatgttccctgacataatagagaagactacaactgaaactattgttcttggtgtggcaactcagaaaatgcactttgagggatctgagatgggagttggggttgagggtggatgcccgtgtggagacaactgcaaatgcaacccttgcacttgcgggtagtgaacaacaaaaa

SEQ ID NO: 9841 - DNA, 481 bp, Gossypium hirsutum
  Clone ID: uC-gsflmaxxa028d11b1
ttgttaaatcgtcgagcttatggtggagagaattcactaggtaagaagattatcctgttgttgatacgccgactccttcggattaagctcaagagtaccatcatgtgcttgtacaaatttcgactgcacagtaacagaaccatcaagaaaaccatataaactataaccattaacaatgaaccgaacctgttgctttcactgaaggaaggtgccttcatcgagcttgacaacgccatgccgaggaaaggaattaacaacacgatcagcagttaaaatagtgccatgaggttcgacagagtctgatgcatcagaatgtgtgtgtgccatgaccgaggatcagctagcgactgataccatgaatagaaatatgtaaaataataggtaaatctaattgtcttttataattgaattagacctcattaattttttaatacaaacaagtaattgtatttatagtaattgaattagcttgcttactttt

SEQ ID NO: 9842 - DNA, 461 bp, Gossypium hirsutum
  Clone ID: uC-gsflmaxxa028d12b1
ttcacgcgaccggctcggttaactcctttccctcgctcttaaaagaccccgccgtctctctctgtctacatatcactctctctatctgtgtcgctgtatgtgtgtgcggggcattccctttgccatatgctgcagatgctgatatcatatgggcggtgatgaatagatctctgcttagaaactaaggatcaatagagatgggcgcttgtgtgtctagacccgaaggctgtggtggccactggtcgaggccttctaagaacaacagtcgacagagaaggcaaacctttaagaaagggcgcactccgcgtctttgcgactgttcactctgataaggaccagcgctggtctcactctaccaacgcacctgttcaaggaagccaagagctgtggttggatccagttgcaggatttgatctcgactgcgaagaggatgatgaaagcgttcaagaggatacgttgtc

SEQ ID NO: 9843 - DNA, 474 bp, Gossypium hirsutum
  Clone ID: uC-gsflmaxxa028e04b1
ttctttctctgcactgaactagaattagcagcaatggaagttactgcaatatggttgctgctgctattgccttgctcctttcctagtttcctcatttcatcatgcatgggaaaccagattgactacctcaacaggttggttgcatcacgcagatcctcgaaccctcgtcgcccagagtcatgggctcagctagatgatcaaggaaatagtcatagctctccagtgtttgtaggatctcagaaagggttgatgcaagctgacaagatcgacaaactgccgggtcagcctgaaggggtggattttgatcaatatgcaggctatgtaacagtagatccggtggctgatcgagcattgttctatttttttgtggaatcaccggttaattctccgaataagcctctggttttatgggtaaatggaggtccaggatgctcgtctttaggatatggagccatgcaagaacttggacctttt

SEQ ID NO: 9844 - DNA, 548 bp, Gossypium hirsutum
  Clone ID: uC-gsflmaxxa028e05b1
ttacttccaaaagtttattcagtttcagctgacagtgaatgttgcagccttggtcatcaatttcattgctgctgtatcttctggagatgtaccattaactgcagtccaactattgtgggtgaaccttataatggacactttgggtgcactggccttggctaccgagcaacccactaatgatctcatggacaagcgacctgtgggtagaaccgagccacttataacaaaagttatgtggaggaacctcattgctcaagcactctatcaggtagctatcctactgattttacaatttaaaggcaaatccatttttggtgtgtcggaggaggtcaaggataccctgatattcaatacatttgttctctgtcaaatctttaatgagttcaatgcaagaaatatggataagaagaacatattcaaggggatacataagaacaggctgtttttggccattatcggaatcaccttggtcttacaagcaataatggtggagtttcttcagaggtttgccaatactgagaggctaagcttggagcaatggggggctt

SEQ ID NO: 9845 - DNA, 491 bp, Gossypium hirsutum
  Clone ID: uC-gsflmaxxa028e07b1
ttctttaaaccgcagaacaaccaagaatgcgaggggaggaagaaggagttggagtcagcgagggagcaatacatcgccgtcgcgacggaactcgatgccaagaagcaagagctgaataaagtcaggcaggatttcgacacggcgttggaagtgaaattggcggcgtttcagcaggcggcggaggcgcagctctcggctaaaatgcattccgagagggttaccgagctgacgaagcaaatcacggtgatgaaggaagcgattaagcaagtgaaattcgctacgcaacaagtgtacaaagagcaggagagcatagcggcggataaagaaatgttgcagaaatcttatgagagtgctaaagaggaagcggagaagaaattgaaggctgcgagggaagcgtatgatccagagctagcgagatctcttgaggagaagcttaaggaaaccacggaggaggtcgaagcgttcaagattgagatgaagaaagtcatgct

SEQ ID NO: 9846 - DNA, 567 bp, Gossypium hirsutum
  Clone ID: uC-gsflmaxxa028e08b1
ttcttgacgcgtgggttcgttcatctccattattgtttcagatcgtaaaatcaaaaccaaattttcgtttaatttatacatataaacacccaaaaacaaaaagggcataaaaaaggagattcaatggggatcttctccttcaatgccatagctttggccttcttattagccattatctctggcgccgtcaatgcttgcccttcttccgaccgagaagcattgctagctttaagttcatcgttaaaggagccttatttaggcatcttcgattcatggaaaggcaccgattgttgttccaactggtacggtattagctgtgaccccaccacttaccgagtcaccgaccgtttcctacgcggtgagtccgaagaccccattcttcaaaaaaccggccactcatcttccggttacatgaccggtaccattaacccttctatttgtcagcttgaccgggtcactactttaatcattgctgattgaaaggtatcgccggtgagatcccatcatgcttggcgtcgttgcccaacttgagaagtttggatcttatcggaaattccttatcgggaa

SEQ ID NO: 9847 - DNA, 464 bp, Gossypium hirsutum
  Clone ID: uC-gsflmaxxa028e10b1
ttcacgcgtccgctagaaatccacctccagcctctccctcccaacatcaaacagaacctgcgagcgaagtcacctccagcctctccctcctcaaaacacgcttttaagtttctctcttccgccaccgtcttcttcatcatcttcccctctttctttattttttttaatttcaacacctaacatacatgtttcatttcgcagaagccatctttatctgtttctcatgtgactctgaagcctcattctttccttcaacgtacccaagacaatactgctgatgttttggaatttaagttgaaggagctctcagccgtccattcgaaatccccttccgttcatcaattctctgtcgccttcaccaagacactgacccctctctttcaaattctaaagtgaaccgccaccgtgcaacgtgttgtatgctttgtttcagcaaggtcctgccccgagaacccaacgacact

SEQ ID NO: 9848 - DNA, 565 bp, Gossypium hirsutum
  Clone ID: uC-gsflmaxxa028f02b1
ttcttatttttttctcttttcccaaagcaaaacaaaagccatgtctcagactgttgtgctcaaggttggcatgtcatgccaaggatgtgttggagccgtgaagagagttctggggaaaatggaaggtgtggaatcattatgaagtagatttggagcaacagaaagtgactgtgaagggcaacgtccagcctgatgctgtgctgcagaccgtgtcaaagaccggaaagaagactgccttttgggaagcagaagctttggctgaatccgaggcgaagccagccgaatccgaggtgcagccagccgaaaccgaggcgaatccagccgaaaccaaggtgaaaccagccgaaactgaggcgaaaccaacagaacccgatgtaaagcccacggaagctgttgctgcagcttaatctgttccccagtttgattcatggaatggtaaacttaatgcagttcacatggattgtagagtatgtatactttcctttaacatggaagcttaaataaggagtggcgggcatgtcactgtgctttttatcttaaacaaacctgaatggtttgttattga

SEQ ID NO: 9849 - DNA, 507 bp, Gossypium hirsutum
  Clone ID: uC-gsflmaxxa028f05b1
ggtatcagctttcgatcaatggcaaccctgacaacctcacactttgtttcgacaagttctcatttcagcagccatggagcagacactaaggccaatcttgcacaggttggtgccaggaatcaagccatgactcacaatggtttgcggtctttgaacaaggtcgataggttgcggatgaggaccaccaacgcaaaggctgtcgttacgaaagctatgaaacaggcagattacaggcctttgggaaaaattatttgcggaatagggatgaatatagtgtttgtgtcagctgagtgtggcccctggagcaaaactggtggactcggtgatgtcctcggtggactttcttccgcaatggctgccaaaggacaccgtgttatgacagtgtgtcctcgctatgatcagtacaaggatgcatgggacacaagtgtgttagttgatctaaagtcggagacaaagttgtaactgttcggtttttcactgctacaacgtggagttgttcgtgttttg

SEQ ID NO: 9850 - DNA, 560 bp, Gossypium hirsutum
  Clone ID: uC-gsflmaxxa028f06b1
ttctttcactcttattcgtgatagaaagtatcgtgttctctccaaccagatcgatacttccaggaaaaaggtgaggaatgtggaagagatacacaaaaatctcttacatgaactggaatccctgaaagaagatccatatggattagttgataatggaggggattatgataccctgatcgggtatcaaaatggaggtcctcgtatatttgctttacgcctgcagccaaaccatcctagccttcacagtggcggaggctccgatctcaccacctatcccttgcttgattaaaatatctatctcgtgatgatttccgtatccataagctaagttcatgctgttaatcatataatattgctgtgaaagcaaaattggtgtgtactgttacttttacttttaaaattatcgtcacttctattatgtgcctatgttgtatcgtatctgttggagattatgtatttgatgatgatggaacattttcctgtttgtcgtttttaaattcttgatttaaatcttatgttaagaaatatttggatatgtgtatgctttgattgttggatac

SEQ ID NO: 9851 - DNA, 510 bp, Gossypium hirsutum
  Clone ID: uC-gsflmaxxa028f07b1
tcgtccacgcgtccgccctttttctttctttcctctcttggccttttttttaaaaaaaaatgcagagaatcatagcagtggtgttgtttttattttgcgccacttctcaattggcctcttctctcaatgatggtttgttgccaaatggaaattttgagtatgggcctaagccatcggaattgaaaggaactaaagtaatgagccctaaagcaataccgaattgggaaatttcaggctatgttgagtacatcaaatcaggtcaaaaacaaggtgacatgttgctaatagtacctgaaggaggctttgcagttaggttaggcaatgaggcattgatcaagcagaagattaaggtgattaaaggtattgttttactttctaaccttcagcgcggctcggacatgtgcacaagaggaaaaagttggatgtttcgggtttttctggactacgagaaaaaacgactttggttttgtccccatttaaacgatgtatagtagcaattggatgggattc

SEQ ID NO: 9852 - DNA, 457 bp, Gossypium hirsutum
  Clone ID: uC-gsflmaxxa028f10b1
ggttctctctccggtttcacctccgttcacttcgaataatggcctctcacattgttggatatccccgcatgggacctaagagagagcttaaatttgctttggaatctttttgggacatgaagagcagtgcctaggatttgcaaaaggttgctgctgatctcaggtcatccatctggaaacaaatggctgttgctgggatcaagtacatccctagcaacactttctcttattactaccaggtgctcgtagcaacatcgatccttggagctgttccacctagatatggttggaacggtggagagatcggatttgacacttacttcttaatggccagaggaaatgcctctgtgcctgccatggaaatgaccaagtggtttgacaccaactaccactttattgttccagaattgggccctgatgttaactttttcttatgcatttcacaaggcaggttgat

SEQ ID NO: 9853 - DNA, 559 bp, Gossypium hirsutum
  Clone ID: uC-gsflmaxxa028f11b1
cttcatcgacagggtttacaagggtttgaggctgccgcaaccaatggcccccaaagttgataagaattcagatccaaaggcacaggccttgaaagcagagaaagcagtgaattctggagccacatttaataagaatgccaagaagattcgtaccaaggttacattccacaggccaaggaccttgaagaaggataggaccccaaagtacccacgcattattgctccaccaaggaacaagcttgttcattatcagattcttaagtttcccctcacgactgattctgcaatgaagaagattgaagacaacaacactttggttttcattgttgacatccgtgctgataagaagaagattaaagatgctgtcaagatgatgtatgatattcaggccaagaaagttaacaccttgatcaggcctgatggtacaaagaaagtatatgttaggttgacacctgaatacgatgccttggacgttgcaaacaaaatcggtattatctaagctagttgttgctaacttgtcgagcattaattttccttttgtttgcaaagagaaatattt

SEQ ID NO: 9854 - DNA, 507 bp, Gossypium hirsutum
  Clone ID: uC-gsflmaxxa028f12b1
tttttcacgcgtacgcccacgcgtccgctttttctcacttcttcaagaaacagacggttaaagcaccgagtaagagatagcatagataaaagaaggttgtgagtgagcttggtagctatggcgggagaacaattgcaggtgcttaatgctcttgatgtagccaaaacacattggtatcatttcacagctatcatcattgctgggatgggtttcttcactgacgcatatgatctcttctgcatatctctcgtcaccaaaattgcttggccgaatatactataatgttgatggtgcggagaagcctgtaagtttgcctcccaatgcattggttgcagctaatggtgtagtgttctgcggaacactagcaagccagcttttcttggttggcttgggataagctaagccaaagaagtgtatggtatgactctaatgctcatgacatatgctctgttgcataagtctttctttgggcaatacccttaaatctgcattgcaaccctttgcttt

SEQ ID NO: 9855 - DNA, 508 bp, Gossypium hirsutum
  Clone ID: uC-gsflmaxxa028g03b1
ttcattcgtccgcccacgcgtccgttacaacttctttagaagtttcctcctacaaatcttcatcactaccacccgctttcgcttccttcaaacctctggcgcacttcttgtttttgcttcaaaaatattgtgggtaaaagcttatagatgggtcagaaacttgatacgatgcgcccaaagccatcaaaagacgagttgctttatcaggctgcaattgccgggaacgtggatggcattaaatctctttgcagagaaggtactggccttgagtggatagacagagatggaaagactgccctcattgtggcatgcatgaatcctgaattaatagatgtggccaagacactgattgagatgggtgccaatgtcaatgcttaccgccctggacgtaatgcagggactccgttacatcatgctgcaaaaagaggcctggagcaaactgttaagctgcttctttctcgtggcgctaattttttattgaggaatgatgattgtcagacaccgcttg

SEQ ID NO: 9856 - DNA, 557 bp, Gossypium hirsutum
  Clone ID: uC-gsflmaxxa028g05b1
ttcattcgtccgcgctctccttctgtttctggtcaagccaatctcaaaagactccccttttagctcacagctcctctcttgagtactataatgggtaaggagaaggttcacatcaacattgtggtcattggccatgtcgactctgggaagtctacaaccactggtcatttgatctacaagcttggtggtattgacaagcgtgtgattgagaggtttgagaaggaggctgctgagatgaacaaaaggtcatttaagtatgcatgggtgcttgacaagcttaaggccgagcgtgaacgtggtattaccatcgatattgccctctggaagtttgagactaccaaatactactgtactgtcattgatgcccctggacatcgtgacttcatcaagaacatgattactggtacctcacaggctgactgcgctgttctcattatcgactcgaccactggtggtttcgagctggtatctataggatggtcgacacgtgagcatgctttgttgcgttacccttgtgtcagcagatgatttgctgtgaacagatggatgcacaactc

SEQ ID NO: 9857 - DNA, 518 bp, Gossypium hirsutum
  Clone ID: uC-gsflmaxxa028g06b1
ttttattccgtggatgactgggaattgtcgaggtccttctactgcattctgccttctttacaagttttttaccatgaaacttactgtcaagcaaatgcatgggctactgaagcaccctgattcttcttacattagagcaattggattcctctacttgagatatgctgccgatccgaagactttatggagttggtttgaaccatacatcaaatatgaagaggaattctcccttgtctttggcgtccagattgctatctctgcatccaacacagggggtgcttgtgataacgctaaaaaatacattgaggcgggtgcttcagaccatgcatgaacttttggtcccaaaggatcggatccacataatgcagttgttattgggacaccatttgagactcttttaaggattcattttgggccattactggacatactaatcaagcttatggctgttgaatcacttcgttttgcttccttttttgttcacattgtggactgctgtttaagatttttaatataaa

SEQ ID NO: 9858 - DNA, 409 bp, Gossypium hirsutum
  Clone ID: uC-gsflmaxxa028g07b1
tctttctacgcgtccggttatctctgaaggtgtcttaataaacgccttcgatttaccttcgatttccatttacttctctattgctacgtttttgaatttttagtgagcgaaaatgagagagtgcatttcagtccacatcggtcaggctggtattcaagtcggaaatgcctgctgggaactttactgccttgaacatggaatccagcctgatggccagatgccaagtgacaagactgtcggaggaggtgatgatgcttttaacacctttttcagtgaaactggtgctggaaagcacgtccctcgtgctgtctttgtggatcttgagcctactgttattgatgaagtgaggactggtacttaccgtcagctttttcaccctgagcaacttatcagcggcaaggaagacgct

SEQ ID NO: 9859 - DNA, 528 bp, Gossypium hirsutum
  Clone ID: uC-gsflmaxxa028g08b1
tttcacgcgtccgctttactatctttcctcctcaagaaactctctactacccagtataagccatgagtcgtcatcctgaggtgaaatgggcacaaagaaccgataaggttttcattacggttctattacctgattcaaagaatgcaaaagttaaccttgagccggaaggagtgtttaatttctctgctactgctggaactgacaataacacatatgagttgaagttggatctttttgataaggtcaacgtggaggaaagcaaaattaatattggagttaggagtatattctgcatcttggagaaggctgaaaaagtgtggtggaaaaaattattgcgcggggatggcaaagccccccattacgtcaaagtggactgggacaaatgggtggatgaagatgaagacaagggtcttggtgatcttgacttaggaggaatggacttttcgaacttcgggggaatgggcggcatggcgacatgatggcggcatgggccgatgggcggcatgggtgacatgatggtgcatgggc

SEQ ID NO: 9860 - DNA, 473 bp, Gossypium hirsutum
  Clone ID: uC-gsflmaxxa028g09b1
tctttacgcgtccgaaccggtagaatttccacccaaaaaagaaacactgtttaatcacatttcaaaggtcactgctgctcagtttgcagccaaatgctaagggagatgcaaaaaccgtagcaaaagagcaatgcccaccaactttgtttcttccaggataatggaatggcgaaacttggattgcacaaacaaattgtgggtgatctttcactgcccgactcttctccttttgctaagcttttgggttcctacatccaatccaagtctttccttgatatacgtcggttacatgttcggataatcaaatctaattttgcgtctgagacttttatcctaaacaggcttatcgatgcctacggcagatgtggctccttggaggatgccgggaaggtgtttaacagaatgcctcaaagaaacactttttcttggaactcggtcatatctgtattgacgaaattgggttacgttgatga

SEQ ID NO: 9861 - DNA, 481 bp, Gossypium hirsutum
  Clone ID: uC-gsflmaxxa028g10b1
ttttcaatttaactcagctcagctcagctcaactcaactcacttaaatcttttctgctgcggtggcgatgggggcggcgatgttgtcggagttggcgacggagatcgtggtgccagtgtgcgccgtgattggaatagctttctcgttggtgcagtgggtgatggtgtcgcgcgtgaagcttacctccgagcgccatgcgtcgtcggcgaatagtagcaagaatggttacggtgattacttgattgaggaagaggaaggaatcaatgaccatagcgttgtcaccaagtgcgctgatattcaaaacgctatctctgaaggtgcaacatcctttctttttactgaatatcagtatgttggcatcttcatgattgctttcgctatcctgattttcctcttcctgggctctgttgaaggcttcagcacgaagagccagccttgcacctatgataaggagaagatgtgcaaaccagcttttgcgact

SEQ ID NO: 9862 - DNA, 414 bp, Gossypium hirsutum
  Clone ID: uC-gsflmaxxa028g11b1
ttgtttcaggcgatcgagtcatcgatttggctcatgggttcggttcggaccaatcggtttggaagcactaggtccctcacttagtcgacgatttccgtgtcgtattgtacgacatcatgggtgcctgaaccaccaacctcgaatacttcgatttcaatcgttatgcttctctcgaaggttatgcttatgatttgcttgcgatccttgaagaaatccacgtcgattcatgtattttcgtttgccactccgttttccgcatggttggcgccatagcttctatttcccgacccgattttttctctaaaatcatcatgatctctggttccccaaggtatcttaatgacgtggattactacggtgggttcgagccagaagacttagaccaactcttcgaagcaatgggagccaattcaa

SEQ ID NO: 9863 - DNA, 447 bp, Gossypium hirsutum
  unsure (1)..(447): unsure at all n locations
  Clone ID: uC-gsflmaxxa028h02b1
ttcactcgtccgcccacgcgtccgaaacaaactttttagttctcaactctctcaaattcaccatggctgacaagtgtggcaactgcgattgcgctgacaagagccagtgtgtgaagaaaggaaacagcttggtcattgagactgaggagagctacatcagcaccgtagtggtcgagcctctggcagagaacgatggcaagtgcaagtgcggaactagctgcagctgcacaaactgcacatgtggcagtcactaagcagacatatagaatgatgaagtttgggacctaaaaagaataaaagttgggttgaataatttgtgtcttttgttgtagtttgagtgtgttttcttgtctatctgtccgatgattgtctatgtctctcattntatacaatgatggaatgaccatgtcaatggcctttgtctgattaatgaactattattagtat

SEQ ID NO: 9864 - DNA, 507 bp, Gossypium hirsutum
  Clone ID: uC-gsflmaxxa028h03b1
cccacgcgtccgattttctctctccccaaataccataatctttccgagaaaatagtacaaagaaaagaaaatggccgatcagcttaccgacgaacagatctctgagttcaaggaggcttttagcctcttcgacaaggatggcgatgggtgcattactaccaaggagctgggaaccgtgatgcgatcacttgggcagaacccaactgaggcagaacttcaagatatgattaacgaagttgacgccgatggaaatgggaccattgatttcccggaattccttaacctgatggcaagaaagatgaaagatactgactcagaagaggaacttaaagaagcattcagggtgttcgacaaggaccagaatggtttcatatccgctgccgagctccgtcatgtcatgacaaatcttggtgaaaagcttacagataggaagttgatgagatgatccgtgaagcttgatgtgatggtgatgggcagatcaactacgatgagttcgtcaagtcatga

SEQ ID NO: 9865 - DNA, 263 bp, Gossypium hirsutum
  Clone ID: uC-gsflmaxxa028h04b1
atgcatcccgatgctgctcctgaaatcaaagtgaggggtttgtttgttatatgtagagtttataaatgtagtaactaaatacattatccattttccttgtcatacaggttgtgttgtgtatttcaagttcttgccatggaaatgcaaaaaaaaaaaaaaaaaaaccactgtaggattatgtttaggcacagtgcatgctttttgaacttagtagcagtggagcataatgtagaaatcagtgaaaaatatagaaaactttcaca

SEQ ID NO: 9866 - DNA, 395 bp, Gossypium hirsutum
  Clone ID: uC-gsflmaxxa028h07b1
tcggttcagctgctccgtattatatagtcaactactatggcaaccagaatggctgttagatacgtttctcgtaggttctcgagtgggagtgggaagatactcagtgaggaagaaaaggctgctgaaaatatttacatccagaaaactgagcgagagaaattggagaaacttgcacgcaagggacccaagccagaggagaaaccggatgctggttcagggggtgctgcgaccgatggtagcactacctctacatcgggaacatctgctgagaaagtatcaaccgattagtaccgaaactacggggttctcgctggtgttgcaacccttggtgctgctgtgggatggtatctcaactctaaagacaagaagcaagaggcctgaaatgggggttaatg

SEQ ID NO: 9867 - DNA, 371 bp, Gossypium hirsutum
  Clone ID: uC-gsflmaxxa028h08b1
tcgttcacgcgtccgcggacgcgtgggcggacgcgtgggcgggagcaaatatgagctcggagacgaagtaggaagaggccatttcggttatacttgtacggcgaagtttaagaaaggagagcttaaaggacaacaagttgccgttaaagttatacctaaagcgaagatgactactgcaattgccattgaggatgttagaagggaggtaaaaatattaagagctctatctggacatagcaatttagtacaatttctatgatgcctacgaggaccatgataatgtctacatagtgatggaattatgtgaaggaggggagctcttggacagaattctttctaggggcgggaaatacactggggaagatgcaaag

SEQ ID NO: 9868 - DNA, 338 bp, Gossypium hirsutum
  Clone ID: uC-gsflmaxxa028h09b1
tcgttttagcgtacagtaaactctttaaatcaacttctccttcttagatatgttataatgagggccatgggctttaaccccaaggaactccatggcatgactagcggcggctatccctctggccgtaatgggcatgtgcatggttcaaacttcggttatggcactgcttggacctggcgggcactattatcctgacaaaaaggctggacccggaagtgtaaagccttacccatcaaaagctcatctcacaaggaggtgatccctgactcaatgcgccaaggaaggcacgttattgtctcaaacatgtcccgaggcatgcctatgtgctgctccaaggt

SEQ ID NO: 9869 - DNA, 354 bp, Gossypium hirsutum
  Clone ID: uC-gsflmaxxa028h11b1
gtccaaccgctcgcttttcgcgtaaatatagcacaacggagaaaaattattctgatgtgagtgctcgatccccggcggactaggcgtacgaggtccatcctgcgcttgaacaaatgttcacggaacattggcgatatccatctacgaaaacatatctaaactatgagccatagataagtgcacccaacctgttgctaactatgaaagacggagaattcattgagcttgacagacgccgttcaacggattggtattaacatcactatcagcaccaaaaataacgacatgaaggacgacagactatgattccggatagtgtgtgcttgccatcaccgtagatcatctaacgactga

SEQ ID NO: 9870 - DNA, 514 bp, Gossypium hirsutum
  Clone ID: uC-gsflmaxxa028h12b1
ttgatttcgttcttggagaagaagctttctcttttctacataagaaatctgtgcatcaaaaacaccaaatcaataaaaaagaagaaggaacaagacaattccaaaggaacaagagagaaaatgagtcgaggaagtggtggcgggtacgatcgccatattaccatcttctcccccgaaggtcgtattttccaagtcgagtatgcgtttaaggcagtgaaagccgctgggatcacatcaattggtgttcgagggaaagactccgtctgtgttgttactcagaagaaagttcccgacaaacttttggatcagactagcgtcactcatcttttacctattactaagttccttggattgttggctactggcatgacagctgatgcaaggaccttggtccagcaggcaaggaatgaagcagctgagtttcgtttcagatatggatatgagatgcctgtggaagtattgtccaattggattgctgacaaaatacaggtttacactcatcatgcttattatg

SEQ ID NO: 9871 - DNA, 185 bp, Gossypium hirsutum
  Clone ID: uC-gsflmaxxa029a01b1
cacgcgattgatttaaaatccgaagggaatcccaatttctgcggtgggcattactaccgcttacatgtccgctttttattaacctccggctatggctaccaattatgattctttaaaacaatcccttcttcctagcttcctttactcttcttcccccaacttaaatctctctggatcgactcctt

SEQ ID NO: 9872 - DNA, 355 bp, Gossypium hirsutum
  Clone ID: uC-gsflmaxxa029a04b1
tcgaccacgtttccgttcaaatccagagggaaatgggtgattcctaccgtgttaggatcagaaccgacgcgatatgaatgccattcagctattcttttgaatgaagattggataatggttatcaccttggggtttcaccccagatgactgtatttggttttttagagatggatactcctattccttaagcaatcagaaaaagtctttggtgacttgaattattgcttggagtaagggtgtcaaggttgatgctctaaaactagttttttttaattgttcttttcgaagttggtaaggtgtcatttattaaacctgctttttaaggaaatttccaccaatgttcggattctttgtc

SEQ ID NO: 9873 - DNA, 128 bp, Gossypium hirsutum
  Clone ID: uC-gsflmaxxa029a05b1
ccctattttttcgcccacgcgttcgcaccgcattcctaatggggggttatttttcaatcttcatcctaatctttcaaccaaacaaaaaaagtcaaatcggtgggaatagcaatgggttttgagaagat

SEQ ID NO: 9874 - DNA, 458 bp, Gossypium hirsutum
  Clone ID: uC-gsflmaxxa029a12b1
cccacgcttccgaacggagtcaactttttcgacaacgccgaggtttatgccaatggtcgagccgaggagatcatgggtcaggctattagggaacttgggtggaaacgatcggatatcgtggtttctaccaagatcttttggggtgggccctgggccaaatgataagggtttgtctagaaaacatattgtggaaggaaccaaggcgtccttgaagaggcttgatatggattatgttgatgtgctctattgtcataggccagacacacagacttcaattgaggagactgtgagggcaatgaattatgtgattgataagggttgggcattttattgggggacaagtgagtggtctgcacaacagattaccgaagcatggggagtagctgagaagttggacctggtaggccccattgtggagcaacccgagtataatctattgactaggcacaaggttgaat

SEQ ID NO: 9875 - DNA, 341 bp, Gossypium hirsutum
  Clone ID: uC-gsflmaxxa029b01b1
gtcggatgatctttaccgatgctttccaggaaactccaattggtggggtaacaaggactattacgaagcataattatcttgttcttgatgtggatgatattcctaggattgttagtgaggctttctttttagcttcctcgggcaggccgggacctgttctgattgatgttcctaaggatatacaacagcaacttgctgttcctaaatggaaccattctcttagattgccagggtatttgtctaggttgcctaaagctcccggtgaggctcatctccaacagattgttagattggtttctgagtctaaaaagcctggtttatatgttggtggggggtgtttg

SEQ ID NO: 9876 - DNA, 402 bp, Gossypium hirsutum
  Clone ID: uC-gsflmaxxa029b03b1
catcatcagagcgtaagggtataaagaagaggatggcggccaaaaggaagacccccggcaagccccgaaacccagatctcattcgtggcgtcggaaagtattccaggtcttaagatgtaccacaagcgtgggctttgggcaatcaaggccaaaaacggcggagttttcccccgccatgaccccaaacctaaggcccccggcgtcggcgtcgccgagaaaccccccaagttttaccctgctgaggatgtcaagaagcccctttctaacaagcgcaagcctaagcccaccaagctgagagctagcattacgcctgggacgggggctgattttgttgggctgggtagaattatggggaagagagttggtttcttaaaggcaaacttcctttggggcttctttatg

SEQ ID NO: 9877 - DNA, 179 bp, Gossypium hirsutum
  Clone ID: uC-gsflmaxxa029b07b1
actcaattatgagatagcatgaactcatactttgatgggtggggtaatgctttaaactaatcgtggttatacctttaagctctatgagaaagctctggatagtctaaatgagaaagaattgaatgctgattatgctacaatgaaccacttcccctgttctgaagacccccattttcaat

SEQ ID NO: 9878 - DNA, 158 bp, Gossypium hirsutum
  Clone ID: uC-gsflmaxxa029b09b1
cttgttttttgtacccaaatcatatgtaacataaaaaaactggggaattgattatgaactttttatttttagagtctcgcttttttcacaaggtttattattgtatcaaaatactgaagggttcttttaaacaaaaaaacttatatcaaacaaaattc

SEQ ID NO: 9879 - DNA, 348 bp, Gossypium hirsutum
  Clone ID: uC-gsflmaxxa029c01b1
aaaaatcatatcctcagaaaaaagaaaaaaaacgcaaagaagggagagaatggctactttgggtgggattagccaggtcgatggaagcgccaatagcctggagattgaaaacctcgctcgttttgctgttgatgaacacaacaagaaagggaatacgatgctacagtttaagaaggtgacgaatgtaaaacaacaagtggtttctgggactatgtattacataacattggaggcgatggatggttacatgactcaaagttttgaagccaatgtgtgggacaagccatgggtggtattcaaggagctacaggatttcaaggctattggctatgctcccaccgggtgtac

SEQ ID NO: 9880 - DNA, 442 bp, Gossypium hirsutum
  Clone ID: uC-gsflmaxxa029c06b1
cggactctaggtttgacgcgtggggccgttttgcatcatcatcatcatcatcaacctccaatcgtctatctctatgttagtgtcatattttccttacaacgaagttcttggaattgcatgttgctcgccgcctggggggcctggctgaagaaaggtcttagctgaattgcacaaaccgtgaatggggagggagttttgtttcttttacaaggaacggtgatggcggttaagaaggcgagtgaattcttctccaagaccttaattgaggaagttcacaaatggggttgcatgaaacagacctgcgttagcttgaggtacatgatggaatttgggtcttagcctactcaacgaaacttgttgatttcggtcacgtttttcataaggagcttcctattagaattgcccgaaaagcaattgaccttgagagcctccctttggtctt

SEQ ID NO: 9881 - DNA, 569 bp, Gossypium hirsutum
  Clone ID: uC-gsflmaxxa029c07b1
ccctctcataattcatcagcaattacacgaaatggaacctcccctcttcctttcagatgaaaggcatgaaatcatagaaaaaaacgagagcattccttcttgatctgataaagtcggagtccaaaagtcattaatccttttgtcattcctgttcaaccatcatcggtcctgatctgcctctctttccactctctccggagcttcttcaatccagtacatagagcaagcatgatacttcccttcctcagccaagatatgagcagtgttgtctgcttttcgagtcaaggtatccccttccaccataatcctttgaaaacccaaatcttccgcaaagattagggattgtagacaagcaggtgcctccgccactgtggaatccatcacatactcattcaggacttaccgagtaaaggggcactcacggatcaagtggtccactgacttcgcagcagatcgacaaacagggcaagatttatcgcagcaatcccttcgcgtctgtaaaataagtagcgtaggcagatagttattagcaatctccatattgtatcctaatttttctgccatgttta

SEQ ID NO: 9882 - DNA, 241 bp, Gossypium hirsutum
  Clone ID: uC-gsflmaxxa029c08b1
ctcttttttaataatttaagcaaactttatctttatgctgggggatggattcaccagctatgacgagcgatggggggtacaatctagcatagatctgtcagtatcccgcgagtgaatctgggttaaggaggggccagtttgcgaatgtgccgtcgccttattacgaccaccccaatccagatgtatcgtgtggtttgaggagaatgcttcatggacaatatgaggcatttaacgttgtctc

SEQ ID NO: 9883 - DNA, 91 bp, Gossypium hirsutum
  Clone ID: uC-gsflmaxxa029d02b1
ggtaagctggtacgcctccccggccggtaccggaacagacttaccggcccgtcccacccgatacgaattctcttttcttaattctctcaca

SEQ ID NO: 9884 - DNA, 481 bp, Gossypium hirsutum
  Clone ID: uC-gsflmaxxa029d09b1
cccacgctttcggggaacgggccatagcagtgagcgggggcggatcttcttctttattacaaagatggttgctttcaggtttcatcagtaccaagtggtggggcgaggtctcccaacagaagcagatcagcatcctaagatctacagaatgaagctttgggccaccaatgaagtccgtgccacatccaagttttggtattttctgaggaagctgaagaaggtgaagaaaagcaatggacaagttttagcaattaatgagatttttgagaaaaaccctaccaagatcaagaactacggtatttggcttccatatcaaaagtcgaactgtgtatcacaacatgtacaatgaataccgggacacaacttctaatggtgcagttgaacagatgtaccctgagatggcatcttcttacaaggttagggttccatgcatttaaaatcatcagaacagttactatcccagtcaaacttttgcaagagg

SEQ ID NO: 9885 - DNA, 249 bp, Gossypium hirsutum
  Clone ID: uC-gsflmaxxa029d11b1
aaacccttttttgtcaccctaccttttccagctgtagttgcagtcgaagtcgcggcatatccagtttaatactcctaccgtaaagatgaacaaggaaaggctcatgaaaatggctggtgcagtccgcactggtgggaagggtagcatgagaagaaagaagaaggcttgccacaagacaaccaccaccgacgacaaacgattgcagagcacccttaaaagaataggagtgaatgctattcctgcaattga

SEQ ID NO: 9886 - DNA, 394 bp, Gossypium hirsutum
  Clone ID: uC-gsflmaxxa029e03b1
cttttagcacttgagtatctgcacatgatgggcattgtttacagggacttgaaaccagagaatgttttggttagagaagatgggcatattatgctatcggatttcgatctttccttcaaatgtgatgtctgtcccaagctgttaaggcgtagtaagcccaacttggaagacaatgaagatgacgataacttttgcttgacaccttcatgtgcttcccccatgcaaccggtgctgtcttgtttctcatcttccaacaggaaaaagaaaggttctagggttacaacaattaccagaacaagcttgatagtacgccgccgcccaagaagttggtccctaaattggggctgaaccacttaatgctaagtccaagtccttcgttggtacccacgaatac

SEQ ID NO: 9887 - DNA, 258 bp, Gossypium hirsutum
  Clone ID: uC-gsflmaxxa029e07b1
ctgttcgctttggttcaatggcaaccctcaaagttccaggtcacgtttcttttccttctgatgatgctgagcaactccggaaagcttttgaaggctggggtacgaacgagcaattgattatcgacatattggctcacaggaatgcagcacagcgcaattcaattcggaaagtttatggtgaagcttatggggaagatcttcttacgtgtttggagaaggaacttacaagtgatttcgagcgggcttggctgcttttta

SEQ ID NO: 9888 - DNA, 553 bp, Gossypium hirsutum
  Clone ID: uC-gsflmaxxa029e08b1
gggaaatttagggttttatttgaattaggggaaaatggcgaggaggaaagtttacagcgagatacatgggatgaaattgaaggaagttcctggctacttcaagccgatgctatttatgggttacttgaagaaatctgatcataggggtttggacaattaccatgctaagtacattgagactgattctatctaacctctctaccatgtcttgtttcggtgggatgatcttttcttaccttgttgcttttcccaaccgagcgcctccaccctttagcacaagaagcattgctgagcaacaactgtcatcatttattccatctagctttaaagatggttttggatcccttgctgtgccccttcttcgttttatccagaaacaattcgatttgcttaatgcttttttggtcgtaatttgggaaccatggacgccgaagaagatgcttgtcttattcaaatgcaaaaattaaaaaatccatttttttaaaaaaagtgaagactttttaactccatggacacccaaaaaaaaaaataaaacggcggccttttttaggat

SEQ ID NO: 9889 - DNA, 406 bp, Gossypium hirsutum
  Clone ID: uC-gsflmaxxa029e09b1
cccacgctttcggaaacccttaggcggcgactactcgggcttcatatcacccgaagcttttaactatggcggatgtagagacggaggttgcgacggccggtgtgcccaagaagagaacattcaagaagtttagcttccgaggtgtcgatttggatgctctccttgatatgtccactgatgagcttgtcaagctcttccctgctcgagctcgcagaaggttccagaggggtttgaagagaaagcccatggctttaattaagaaagcttcgcaaggcgaaaagggaggctccacctggtgagaagccagaaccagttagaaccccacctgtgtaacaatgatcattgtacccgaaatgattggaagcattatcggtgtgtacaatggcaagacattcaaccaagttga

SEQ ID NO: 9890 - DNA, 431 bp, Gossypium hirsutum
  Clone ID: uC-gsflmaxxa029f01b1
cggacgcttgggctcgagttccacaatttggaatcgtagctgggctgttctatcctatcaagggcctgtttgtatccaactagttgtttccaggacctaggcttcgatagttaaaataaaaaccaccatgggtattgctggctatagttatagttggtttttgttgtcaattttcgccctaattccaacactaagagctcacatcgctgaatatgacgagtattggaaagcacgagaattggaagccattgaaaacctgaacaaggcttatcaccccaatccagaggaggtggtccggaattacaatgacccctttttcaggaccatgcttgagtataatagcaccagaagggcgttgaaagggaaaaaaaaagggtcccttggagattacccaaccccgttaatagttggtggccatggtgaacctaact

SEQ ID NO: 9891 - DNA, 321 bp, Gossypium hirsutum
  Clone ID: uC-gsflmaxxa029f02b1
gaagatattaaggtacaagcaaagctaattgctgaggaatgggaaccaaagctggatgctcttgacatggatgctagtaacggtaactcattggaagctcatgcttttctgcaacttatcgatacatttggtattgcttctggtttcaacgaagaagaactttcaaggctgataccaatggtctctcgtcggcgacaagcagctgatctatgacgtacccttggtttatctgagaaaatgccaggtgtaattgaagttctggtgaaaaaatggaaggcagattgatgcaactaacctggcttttgcattcgagctaacaga

SEQ ID NO: 9892 - DNA, 477 bp, Gossypium hirsutum
  Clone ID: uC-gsflmaxxa029f04b1
gcaagttttagttttcaccattttctgacagtggagttgttggggaggagtcctatgaggaccaaaatgaccaggatagtcacagtcctcttggtgggttttatattgggtgtaagaagtggtgaggccaggaaaggaaaggtgacagagtcctttgcgtacactgggataagttgcagacgacacactgcatcaatcacagactttggaggagttggtgatgggaaaacatccaatactaaagcattccaggatgcagttaatcatctcagcaagtatgcatctgatggaggggctcagctttatgttcctgctggaaaatggctgaccgggagttttagcctaaccagccacttcactttttatctttaaaaacacgctcttctttttgcttctcaggatatgaaagaatggcctgttttgaagcctttgccattctatggtccgggaaaggatgcaactggtggaaggttaacc

SEQ ID NO: 9893 - DNA, 546 bp, Gossypium hirsutum
  Clone ID: uC-gsflmaxxa029f12b1
cattttccctttatttcctttgccgcccctagggtttaattgcattccgcacatggcttctgcagatgtcgagtaccagtgctttgtcggaggtctcgcatggaccatcaacgaccgtgctctcgaagaagccttcagtgcttacggcgagatcgtcgattcgaaggtccgtttgtcgcagtgatcggactccagatctgactcgaatccaacccgacctgggcctccatgtctatgatctgtgatccttgatctgttattttgtgttactactcgataatctcttgttactattctaaactgttttctaaagtctcgctgatcattaacgatcgtgagactggaagatccagaggctttggcttcgttactttccgtgatgagaaatcgatgagagatgctattgaaggaatgaacggtcggagtctcgatggaaggaatataaccgtcaacgaagcacaatctcgcccaagccgcggcggaagtggtggtggaggatttggaggaaaaggtgggtacaaccgtggtggaagccgtggatatggt

SEQ ID NO: 9894 - DNA, 247 bp, Gossypium hirsutum
  Clone ID: uC-gsflmaxxa029g04b1
cgctcaaggttttttctgatttgaattccccgaggatctaaatggtggcgttatttgaagtagctcggtcgcgacttgttgggtgatcaatggagaagggttgtatcgggttgttgggatctccgtggaaggaggtgtctgtccatattgtcctgtagtgagttgtgctgttgatggctgtaacggtggtggcccagataggtctggttttgactcgattcctactcagaattagagttctttttta

SEQ ID NO: 9895 - DNA, 438 bp, Gossypium hirsutum
  Clone ID: uC-gsflmaxxa029g06b1
gaatacttttcttccagaaattgaacaatatcttttttttagtatgggtaatttcgtgcttttccctcacattttactgcctagcatctaatacattccaaaaccaatatcttatcacttccattgaactgtataaccgatgaacatctgtcagctttttccccatgacattattggcaattttttcccaatgtaaacaataaacaaaatgaaggaaaagggggagagtggaggaaggagcaaagaaaacaattgaacaaagtattaaccggttcttaccacacaagctggagcaagaggaacaaaagtgagatttttcttgctgtcttcagtttgcatatttaaagtctgaaaatgttggcatcgtgttactttaaaagttaataaaacaagttaaaagaagattttttaccctttcaataaaacagctaattaacg

SEQ ID NO: 9896 - DNA, 367 bp, Gossypium hirsutum
  Clone ID: uC-gsflmaxxa029g07b1
ggtagctttaaaaaggcgaaaacaatggtgttcggaggtggtgtgtgaattaagaaggtggtggtggatgcccgacaccacatgttggggcggttggcttacatcgtggccaaggagctgttgatcatacatagcgaggaaaatgaaagatgctaggagatctgcatgtagagaggactggttcgacagaccatgaattacatgagattcctgccaatgcgggttaacggtggacactaacatagtcctactcattgctgagcaaccgccaagatcttttggcgcactgttcgcggaatgatacctcataagactaagcgtggagcggctgtccttgctagattgaaagcttatgagggaattgctt

SEQ ID NO: 9897 - DNA, 472 bp, Gossypium hirsutum
  Clone ID: uC-gsflmaxxa029g09b1
cggtacgcttgggttttaccattcatagcatagcagctgagtccaactccacacccaccaccattggctgtttgtaatcatccgaaaaagaatggtgaccgtggaagaagttcgtaaggctcaacgtgcccaaggccctgccaccgtgttggccatcggcacatcaaccccgcctaattgtgttgatcagagcacataccctgactactatttccgtatcacaaatagtgagcacaaaaccgagttgaaagagaagttcaagcgcatgtgtgaaaaatcgatgatcaagaagcgatacatgtaccttacagaagagattttgaaagagaatcccaatgtatgtgaatacatggctcctttactggacgctaggaaagatatggtggtagttgaggtgccaaagctaggcaaagaagcagccaccaaggccattaaagagtggggccagcccaagttcaagatcaccccacct

SEQ ID NO: 9898 - DNA, 391 bp, Gossypium hirsutum
  Clone ID: uC-gsflmaxxa029g10b1
caccactttagaacggtgccggactgtgtcccgtcagtccaccatactacccaagcccaccaaaaccagtataccaaccactgcgcatctccgatccagtatgagcaaacgagaatcgcgccaccgtcggagcagttagaccatcatactcacggttgaaccggtagaagcaccgttacgctagatggccataataaccgtaaatttggcactgtatacgaggacgaaagccacgcccgcgcaaacgaccaccgtgcacatcactcaaactagagtcagtctctaaaggagtttcgaccagattgacatagatcagtatgtcaagcaccgtctgtgtttgggggctttcgatctctaacaagaacgtgacaagcttttggaacggaagaac

SEQ ID NO: 9899 - DNA, 531 bp, Gossypium hirsutum
  Clone ID: uC-gsflmaxxa029g12b1
ctgaaacttaaacgaaccctaaaaaatggcaccaaaggccgggaaaaattcagcagagaagaagcccgcggaggagaagaaaacaatagctgagaaagctccggcggagaagaagccaaaggctggtaaaaagctaccgaaggaaggcggagcagccgccggagacaaaaagaagaagaggatcaagaagagtaccgaaacctacaagatctacatcttcaaggtccttaaacaagttcatccagatattggtatctcaagcaaagctatgggtattatgaacagtttcatcaatgacatctttgagaaactcgctcaagaagcttcgagactcgcgaggtacaacaagaagcctaccattacttctagggaaatccagaccgctgttagacttgtacttcccggtgagcttgcgaagcatgccgtttctgaagggactaaagctgtgactaagtttaacttcgtcttgaagaaagggatttgtgcgtttgtctttttagatagggtttgctttaagttgatgatttgaga

SEQ ID NO: 9900 - DNA, 506 bp, Gossypium hirsutum
  Clone ID: uC-gsflmaxxa029h01b1
gggaggaggaaatgcccaaaaatccaagatggctcgtgagaggaacttggaaaagcaaaaggctgccgccaaaggaagccagcttgattctaacaagaaggccatgaccatccaggtagtatctttgcttcatttgttaggttcaacactctgtttttttttgctcgatctgttggctttttttttgatcaaatgatttatgattattttgtttccttgtacatatagatcaaacttgacaaattgggttgaatttattttcactgtttttttcctgggttaatatattcatttcttgttagttggttttcactatttgatttgtgtacatgctttctagattcttacattaagttgtacagctactggaacttatttgcctggattccctgctaaaaattgatgtccaaatcaaagtttgggagttaatcatttacttaaaaaagtaaatactttttattttccttttaagattctagtccaaaagttgatgctcggtttttttt

SEQ ID NO: 9901 - DNA, 437 bp, Gossypium hirsutum
  Clone ID: uC-gsflmaxxa029h05b1
cccacgcgtccttaaaatccccaaaaaccaaagatctcaaaggcagggacttacacaacttgagctaagatgccgaacctcgaatgtcgaatgtacgaagccaagtatccggaggtggatatggcggtgatgatacaagtaaagaacatcgccgacatgggtgcgtacgtttcgctccttgaatacaacaacatcgaaggcatgatcttgttctcggagctctcccgccgtcggattcgtagcgtcagcagtctaatcaaggtcggacgaaccgagcccgtcatggtcctacgtgtcgacaaggaaaagggttacatcgatttgagtaagaagagagttagcgaggaagatattcaagcttgtgaagaaaggtataataagaggtaacttgttcactctatcatgcgacatgttgcccagacttttgatatcgattt

SEQ ID NO: 9902 - DNA, 493 bp, Gossypium hirsutum
  Clone ID: uC-gsflmaxxa029h06b1
cccacgcttccgtccacgcgtccgctgctctctgcctctgcggtgcgtcactctgctatttttgattttcagctttcgatcctactgctcgttacttattacgccgtatcatctcatcttttctctctctgtttactttggtgagaagcagatatttgttttaaagctatccgtttagcggaaatagataaagttatcgccgctattttccgttacaccgcctattgagatctttatagtggcagacggggccgatattgcaaaatagcgacccgcggcatcgatatttgaaacactgccaatactacgtgcagtaacaagcggaaagagagagactttggcggtgaaacccgaaacagcaagaagttcaaaaagtattccaactccaaaggaccgatgaagaaaaacaagaacgatactagaaagaaggggaaaggtcctcgcttgccttctgcgctacgaacggagcttgatcgcctggaccctaaatagc

SEQ ID NO: 9903 - DNA, 450 bp, Gossypium hirsutum
  Clone ID: uC-gsflmaxxa029h08b1
accgccgtttgcatcttcgcctccccctccacctgcttgtctgttcagctcagaaccttctcagccttcttcatcaaatccaaaacaagggatgtcagctgttttccaagaaattagtagtgggaatgtctctgcaggcctgaagaaggttactgctgatatgaagacaaagaaccgtacagatagaacaggtgttgttagtgccagtggaaaggaaacacgttcaagctccccttctttctcaaaagccggaccacccaaactagagctgcaaatgggtcgcaagtgggctgttgagaaccaaattggaagaaagaacttagttattgatgactgtgatgccaaacagtctgtgtatatttatggatgcaaagattctgttttgcagattcagggggaaagtcaacaatataaccattgacaaatgcactaagatgggagtggtattta

SEQ ID NO: 9904 - DNA, 444 bp, Gossypium hirsutum
  Clone ID: uC-gsflmaxxa029h11b1
cccacgcttccgtgcttctgacggtttttgttgctagagaggggaaaattctaaccgattcattgctgattttcttagccagctcagttctgtgggcaatacaaggggtagtcattcatgcagctagtggtagctcagaatactatgaaccagatcccttcacatgcaaccgtcatccagacgttactaacgcaacacagtcaccggtgccgccacctcagtttccgttctttcctcttaccaatggatctccaccttttgcaatgctttccacttattctgctgagcctagtgaaattcagtcatgtgagtcacagttgcagtctgttgaaacttgcttccaagaccttgtcaatgtgtttttgactaacgagctgaaccttggacccgcatgttgccaaacaataacagcgatcaaaacaaggttgcttggatagcttattt

SEQ ID NO: 9905 - DNA, 525 bp, Gossypium hirsutum
  Clone ID: uC-gsflmaxxa029h12b1
cccacgcttccggattgttacccccgaggttatgaatgttggcatcatgggaagtggcacagaagcaacttgttcgggtttgaatcaacatagagttccaaatccctgcaactcttccgtggaaggaggcatctctccatttgttcctgaaggtagggtgcatggtgggagtttgatggcaatgcttgcaggtggttctggtcttggttcaggcaactgcgagggtttggctggtaatccatcagagccaaataaatctcatatggcgccccaaaagtggatgtaactacaacttaacaacaattgtcaaagtggtgttggaagttggcctccttttcatgcttgtttgtgtcctttgcgttagtccctaagtgttagaaagtcgtcgtcattcattggtctagatagtgatatgacaaatgtggtggaaaatgtatgaaggggatatagttagcaattaatcaggtctctgttatttattgtaaatatttagatatgtccagcaggttgttgtgaatacaggta

SEQ ID NO: 9906 - DNA, 450 bp, Gossypium hirsutum
  unsure (1)..(450): unsure at all n locations
  Clone ID: uC-gsflmaxxa038a01b1
cgatatggggaagatcaagatcggaatcaacggatttggaaggatcgggcgtttggttgccagagttgctctccaaagtgaagatgttgagctcgttgctgttaacgatcctttcatcaccaccgattacatgacctacatgtttaagtatgacagtgttcacggtcaatggaagcaccatgagcttaaggtgaaggactcaaaaacccttctctttggtgaaaagcctgtcactgttttcggcatcagaaaccctgaagaaatcccttggggtgagactggagctgattatgtcgttgagtctactggtgttttcactgacaaggacaaagctgctgcccatttgaagggtggtgcaaagaaagtaatcatctctgctcccagtaaggatgctcccatngttgttgtgggtgtcaatgagaaggaatacaagcctgaccttcacattgt

SEQ ID NO: 9907 - DNA, 488 bp, Gossypium hirsutum
  unsure (1)..(488): unsure at all n locations
  Clone ID: uC-gsflmaxxa038a03b1
ccctcgcgtccgtgaagaacaagaatggattctgccatagctcagaaaacatgggaattagaaaacaatatacttaccgtcgagacacctgacccttcatcggattctatattctactacgacgaggcggctcaagccaagttccagcaagagaagccttgggccaatgatcctcactacttcaagcgcgttaagatctctgcgctcgctcttcttaagatggttgaatctaattctgatgatccagtgaatcacagattgtctgaacggattatccgtccggattcagtacttaagcattcgtcacagtgggagcatgcagatatactaattttcaactcatatttgtggtggagacaaggcccagtaaagcttttatggagttctgaagaaaatggaaactgtgaggaactcgatgggctaggagccatggcatgttttcattacagctaaagctnctgcacgtctctctttcagcggaaactata

SEQ ID NO: 9908 - DNA, 362 bp, Gossypium hirsutum
  Clone ID: uC-gsflmaxxa038a04b1
atctctctctgtatcttcactcacttcacctgagattttgttttcttttgtttttcggtaatggggaagattaagatcggaattaacggatttggaaggatcgggcgtttggttgcgagagttgctctccaaagcgaagatgttgagcttgttgctgttaatgatcctttcatcaccactgattacatgacctatatgttcaagtacgacagtgttcacggtcaatggaagcaccacgagcttaaagtgaaggactcaaagactcttctttttggtgaaaagcctgtcactgtttttggcattaaaaaccctgaggaaatttcatggggtgaggctggcgcttaatatgatgttgagtctac

SEQ ID NO: 9909 - DNA, 517 bp, Gossypium hirsutum
  Clone ID: uC-gsflmaxxa038a08b1
cttcagtcaagaaataaaccatggcaacgaatgaagtaaaagttttgggttcctggccgagtccatatgcgatgaggccaaggattgcccttaacctcaaatccctcacttacgaatacattgaagagaagttatgggaaggcaaaagcgagcttcttctccaatcaaaccctgtttacaagaaaatcccagtcctcattcacggcgataacaagccaatctgcgaatctctcatcatcgtacaatacatcgacgaggcttggtcttccggtccttctattcttccttctgatccctgtgaacgtgctgtcgctcggttttgggctgcatatcttgacgacaagtggttcccagcggtgaaaagtataggagtcgctaaaggagaggaagcaaagaaagcagcaatagcgcaagtggaagcagggttggctttgatggaagaagcatacgacaagtgcagcaaagggaagggttactttggtggggatgaagctgggtaccttgatatagctttttg

SEQ ID NO: 9910 - DNA, 476 bp, Gossypium hirsutum
  Clone ID: uC-gsflmaxxa038a09b1
ctttagtcaagaaataaaccatggcaacgaatgaagtaaaagtattgggttcctggccgcgtccatatgcgatgaggccaaggattgcccttaacctcaaatccctcacttacgaatacattgaagagaagttatgggaaggcaaaagcgagcttcttctccaatcaaaccctgtttacaagaaaatcccagtcctcattcacggagataacaagccaatctgcgaatctctcatcatcgcacaatacatcgacgaggcttggtcttgcggcccttctattcttgcttgtgatccctgcgaacgtgctgtcgctcggttttgggctgcatatcttgacgacaagtggttcccagcggtgaaaagcataggagtcgctcacggagaggaagcacagaaagcatctatagcgcaagtggaagcagggatggctctgatggaagaagcatacgacaagtgcagcaaagggatgggttac

SEQ ID NO: 9911 - DNA, 386 bp, Gossypium hirsutum
  Clone ID: uC-gsflmaxxa038a11b1
cttacatatttctatattatatatagtatccacccctttctttctttttctactcagcataaagtaaagcatcttacttccttttttctttagtctttgttctttaatggagttgggttcggtttcaaaagatacaagctggtgggtttatactcttccagctttctttggatccaaaaatttgttcgatgggtatgttttgttttccctctttatggcatttctttccattgcccttttttcttgggcttttgctgttggggggaccgcatggaaagatggaaggtacccatacgggaccctatctattggtgagcctggggagaatccgtgtttttggtagcctctttactttgagtccggggttggctcaccgtgcgctcgcc

SEQ ID NO: 9912 - DNA, 553 bp, Gossypium hirsutum
  Clone ID: uC-gsflmaxxa038b02b1
ctattttctccttcttcactcctctgtttcagaatcaaaatctctctttctcgtcaatatggcagcaaatggcgttgtttctgacaagagcttgatcgtcagcttcggtgagatgctgatcgattttgtccccactgtctccggtgtttctctagccgaagctcccggcttcctcaaagcccctggcggtgctccggctaacgtggccattgctgttgctagactcggaggcaaagcgtcatttgtcggaaaacttggggacgacgagttcggtcatatgctggccgatattctcaagcaaaacagtgtctccggtgacgggatcttgtttgaccaaggcgctagaactgctcttgccttcgttacgttacgcgccgacggagagcgtgagttcatgttctataggaatcctagcgccgacatgctgttgaagccggaggagttgaacgttgatcttatcagatcttccaaggtatttcactatggatcaataagtttgatcgtggagccatgcagatcagctcatttaaaggcatggcagagccaaggagct

SEQ ID NO: 9913 - DNA, 526 bp, Gossypium hirsutum
  Clone ID: uC-gsflmaxxa038b03b1
ccctcgcgtccgaaatgtaactggtattccttatcaatgggaaacttgcagtgatgttgttggatataactggacggactctcctctctctatgcttcctatataccaagaactaattgctgctggtattcggatatgggtatacagtggagacactgacgcagtggttccagtgactgcaactcgatactccattgatgccctgaaactacctaccattaacaagtggcatccttggtatgacaatggcaaggttggtgggtggagccaagaatacaaagggctgacatttgtgacagtaaccggagcaggtcatgaggttccactgcatcgtcctcgtcaagctttcattcttttcagatcattcttggagaacaagtcaatgccaagttacttgtattcattatccgccgtgaataagtggaaagagttttagactagttcataaatcgggttgcggaaataaaaaataatataagttgtaaaatgataaactactagcccgattaaactctgtgcaatcatt

SEQ ID NO: 9914 - DNA, 312 bp, Gossypium hirsutum
  Clone ID: uC-gsflmaxxa038b04b1
ctgatatttgaatactctctcattttacgatatttcttagtgtgttttggatcgggaggttagaggtttatcatcaatggcggatactgagacgtttgcatttcaagctgagatcaatcagcttcctagtttgattatcaacactttctacagcaacaaggagatcttccttcgtgagcttatcactaacgcctctgatgctttggataacaccatgttccagagcttcccagacaagagcaagcttgaagcacagcctgagctcttcattcatattgctccttactagaccattaacactctatcaatcat

SEQ ID NO: 9915 - DNA, 552 bp, Gossypium hirsutum
  Clone ID: uC-gsflmaxxa038b05b1
attctaaagccatccccccaaaaaaaataatttcctttttgaaccctaaatatcccttttttttccccttaaacctcaattgaaccgctcaatctcaccatgaacggtacgaaaagatttgccttatcgagctcggctgccgatgccaatgattctgctttccgcaacaaaagaataatggcaggatctccttttgatcctcaaagggcagaaccatctcaacagcagccgaatgcaacaccaccattagacccgcagcgagctgagttgtctcggcggcatgtgaaagctctcaacatccaatttgcaagttgggtgcagtcacaactgaagaatcaccctgatgagctttggcaagatggtgttagtgattacctaagtcatgcttcaaacattatggaaaagttcagtgatgttgtcaattggctcacagcgaatgcggataatggtgacagtttgtctgctgctgaatcccatataaatgaaagcaaaatggttcctgaaaccaagaatactgagattagttttttcagggaaaattggattacttca

SEQ ID NO: 9916 - DNA, 318 bp, Gossypium hirsutum
  Clone ID: uC-gsflmaxxa038b06b1
tgtctcgtgggttttagccttcgattttttttatttccttttgttctttaaagatccgtttcactggttttcggatatatttttttgcaccgaatccgattcagatcggataaaaaatggcagcatcgagacgattacgtgatctccaatcgcagccgggtaacaagacttgcgtcgattgcaatcaaaagaatcctcaatgggcatcggtttcgtacgggatcttcatgtgtttggagtgttccggtaaacaccgtggtttaggtgttcacatctctgttcgtacgatctgttactattgaatttgtggtctgagat

SEQ ID NO: 9917 - DNA, 502 bp, Gossypium hirsutum
  Clone ID: uC-gsflmaxxa038b08b1
cccacgcgtccgggaactgcatccatctcatctcatctcatccaattccttcaatcaaaatccaaaccttttccatcaatttccctacttatgaaacaaactgtttgaaaaagaaaaaagaaaaaaagaaagatgagccctttcctttgctttgttttacaagcatggaatcctagctcttgtcaagtttcctccatggaaacttctcgttttctcagagactatgctgtttgggaaatcaatgcttttctttggatttctcttataactattacttattttctttcttataagctttttaagttgtttaagttatggaatcaagcttgcaaaatcccaggtcctccttctccttccttttatggtcatttcactagtctctccaaacaaaatctcacagaggtattgtcagattcacacgaggaatatggttcaattgtgaagttatgggtgagtcctaaacagcttttggtttcaataaaagaacccagaattattaaag

SEQ ID NO: 9918 - DNA, 462 bp, Gossypium hirsutum
  Clone ID: uC-gsflmaxxa038b09b1
ctcggagttcaactccaaactatcgccaccgatttccagaggatttataaagtccacgatcgcctcttctcggtctctccggcctcgccaccgatgctcaaaccttgtatcaaaggcttgtctttcggcacaaactgtatcagctaagagaagaaagagacatgaaacctgagacttttgctaaccttgtttctgcgattctttacgagaaaaggtttggtccatacttctgccaacctgtaattgctggattaggagatgaagacaagcccttcatttgcaccatggattccatcggagccaaggagcttgcgaaagattttgttgtagctggcactgcctcggagtctctctatggtgcctgtgaatcaatgttcaaggagggcatggaacctgaggaattggttgagacggtttcccaagctctcctttcatcagtagatcgcgactgtctgagtggtt

SEQ ID NO: 9919 - DNA, 237 bp, Gossypium hirsutum
  Clone ID: uC-gsflmaxxa038b11b1
tgttcaccggccgatcgtcggccactgtctgtcgccggcgccagccacagcgcacggtggccggagaaggtactggggcggtggagcagagagtgggtgaacggtgggtggctgaatgttagaggattcggcgtcacaagctaggattagggtttaggtattttttgtttctgatttgtggtattgggcttagtgtttagttgggctaagggttttgtattgggtttgggtaatggg

SEQ ID NO: 9920 - DNA, 538 bp, Gossypium hirsutum
  Clone ID: uC-gsflmaxxa038b12b1
attctctttcggcaaacacagaagaattttggttagatcaacgatgcaacaaggagattacagctcctattatcaatatccttacctttcaaaccccaactccaaccccaaccctaaccctaaccccaaccccaatccagtaccctccgaatttcaccaagcaccttacgcatctgcaccaccttttagctccggttatgcctcctctgattactccgtttatcccccaaattaccctccgtattcccaaaatcttgatgctgcccctcccactgcttccgcttatactcctccgccctcagccacaaccactccaccggctccggccatagctccacaatcgtctttcaatcaacaacccatggcgccaccctcggcgaccgcggctccttcttttccgccatatgattcacatgttccctatcagcctccggcctcccagcctccttatttccagcagtatgatcagcatcagacggctttcagctacggtcctgctcctcaaaccccaccctaacccacgcctatccgtctacta

SEQ ID NO: 9921 - DNA, 598 bp, Gossypium hirsutum
  Clone ID: uC-gsflmaxxa038c01b1
cattcttttgctttcaaaattgaaggaccttcaatttttcatcggagagagcatgcacgatgatggatgtttggtatttgcttactacaaggatggtgctgttgtcccttcttttttgttcttttctctttcttcgtattgattcatactactttcttttttcctctctcttttcccttttctttcatttcctttatcttctctcttttctctttctccttgttcttctacctttacatccttttctttatttttttcctttttctctttcttctttacttttatttttatctttctattttctttcttcctctcttttctcttctctcccttttttttctattttctttctttttattcacttcttttacttatttttctttaattttttattttattattttcctttacctttttctctttttatcttctttatcttcatttttttctctttttcctttttttttttcttcttcattattcccttttatttctctttgtatctccctcattcttcattctatctctcttctcattatcttttcttcattatttttttatcatagattctcttttctatctctttttttttctcttt

SEQ ID NO: 9922 - DNA, 209 bp, Gossypium hirsutum
  Clone ID: uC-gsflmaxxa038c02b1
cctacgcgtccgcatcactgtctctttagcctttaccctttgtttcgttgatttgtttctaaggatttaatctccaaaccttcttcccatttcttcattacattgttcaagaaaaaagaagcaaaaaaacatggccaaagttctgttgttcattgcactatgtgtgcttccagctttggttagtgctacacgcattctgaataatcaat

SEQ ID NO: 9923 - DNA, 418 bp, Gossypium hirsutum
  Clone ID: uC-gsflmaxxa038c03b1
gattgacttgatttgagagagaaattttatattttaatatccatttttcttttaaaaaacattacaccgtataaaatgccagaccattgaaccaggggtggaaaccttgttttattacagcccacctcttccttctctccctttttccttttttgcattacagaaatctccctctttcattctgttgtctctgagatggcccggaacggtggcgttgcttggatgaggacgacggagaagatagacggctacgatctttctacttctgatactgaagaagatcatgttcttgccgttgatgatagcctcgttgatcggaaagtcattgaacgcttgctcagaattttctcttgtaaagtgactgcagttggatagcggtaggagagctttgtcatacctgggatttgttgtggagttt

SEQ ID NO: 9924 - DNA, 97 bp, Gossypium hirsutum
  Clone ID: uC-gsflmaxxa038c05b1
cgtactcgtgggcggacgcgtgggatcatcgtaggcgaatgatgacatatcgaacggaactgtctccatgccaaaacaagaagattcaaagttagtt

SEQ ID NO: 9925 - DNA, 111 bp, Gossypium hirsutum
  Clone ID: uC-gsflmaxxa038c07b1
ctcacgcgtccggggagctctcgggcgaaattgaaataccactacttttaacgttattttacttattccgtgaatcggaggcggtgctcggcccctctttttggacccaag

SEQ ID NO: 9926 - DNA, 532 bp, Gossypium hirsutum
  Clone ID: uC-gsflmaxxa038c09b1
cttacgcgtgggcagctttgtgcggagaaattgaggataatggcggacatttcgaagctcttctccttctcttgaaattacactctttcaccaactgtttagctaactaactttattcattcattcttctcgattttgccccccgtttttccctctatatttattttttctccagctctcgctcgctttctgattgtcgatttgaaaaaaaatctcttcctcttccaatggagtcctccgctgttctcggatcatttcaccattctgtatgcgctgtttcacaagcaccttgctcactcgaaaggcctggtactgcttgtatgtattctggcggctggcccgcttcaagaaaatcatgtctcgcaggcttgatatttggcgagaagaactgttttccaaaacaacaaattgtaactctaatatcatgcatgaagacacctgatgctactggaacagttccttctgatagctccaaaaaaggctcattggagaagaaaacttcaccgactgcaactttttcaaatggatttga

SEQ ID NO: 9927 - DNA, 386 bp, Gossypium hirsutum
  Clone ID: uC-gsflmaxxa038c11b1
ttctaactctccaactgttgcttccacttcctctcttccagatctgaatcgcaaaagggaattttcagttgaaaaagatgggtcgcggagttagcagtggtggtgggcagagctcattaggttatttgtttggtagcggagaagctcctaaagcagggacaaacaactcccaagctgctcccgctgaagcaccagctgtctccaaacctgcccctgctcctgaaccagtagatatttccaagcaaattccggctggtattaacagtatttccgcatacaattacatgcgtgctgatggtcagaatactggctatttccttacggatcgaccttccaccatggttcattctgtcccttggaggcggatcttttttgtacttcctatt

SEQ ID NO: 9928 - DNA, 241 bp, Gossypium hirsutum
  Clone ID: uC-gsflmaxxa038c12b1
tctacgcgtccgggagggtccttagctttctctctctctccaaaaaaaaaaaaaaagaaaacgaaaaaaagtttcgcttctttgctttctttcgagtaaaaatcaaacgaaaaacaacttaaataatattaaaagattttgattttgatcatcaaattttctggttctgatccaccaagccagtcagagtgttgaagtattgaagctgtctggtggttttgttggtttttggaaaccgatg

SEQ ID NO: 9929 - DNA, 469 bp, Gossypium hirsutum
  Clone ID: uC-gsflmaxxa038d02b1
ctttcgcgtccgcccacgcgtccgcccacgcgtgcgagatgggatcgttatgggagtggagaagctgatagcatcaaagatgatgttacctggttctaatcgtagaatccactcggttcatcgtcattccggcatggcggtggctggattagcagctgacgggagacaaattgtggcccgtgccaaatctgaagctactaattaccaaagtgtgtatggtgaacccattcctgtcaaagaacttgctgaacgtgttgcaagttatgtgcatttatgcaccctttactggtggctcaggccctttggctgtgggataattctcggaggttatgacagagatggtccccaattatatatggttgaaccatctggcatctcctatagatattttggtgctgcaattgggaagggaaagcaagctgccaaacggaaattgaaaagtgaagctgtcagaaatgacctgcaggga

SEQ ID NO: 9930 - DNA, 541 bp, Gossypium hirsutum
  Clone ID: uC-gsflmaxxa038d03b1
ctgtcgcgtgggaacatcgtcgtcttctacactcttctctggtaagttcatcgaaagatcaaatcaagatccctgccaaaatgaacgacgctgatgtatccaagcagatccagcagatggtgagattcatccgccaggaagcggaggaaaaggctaacgagatctctgtttccgctgaagaggagttcaacatcgagaagcttcaattggtggaagcggagaagaagaagattaggcaggagtacgagaagaaggagaagcaagttgaaatccgaaagaaaattgagtattcgatgcagcttaatgcatctaggatcaaggtccttcaggctcaagatggtgtggttaatgcaatgaaagaatcagcatccaaggaccttctcaatgtgagccatgatcaccatgtttacaaaaggcttttgaaagatctaattgttcagagtttagttagactgaaagagcctggagtcctactccgttgtcgcaaagaagatttgcatttggtggagtctgttctggattcagcacaggagggatatgc

SEQ ID NO: 9931 - DNA, 557 bp, Gossypium hirsutum
  Clone ID: uC-gsflmaxxa038d04b1
ctcctccactgcagcaggagcagagggaaaaaggataaaagcatcgtcgtgttctcgcttcttcaactctgtctctacgtctctgaacctcctcctttcgttcttttcttattcagtattgtaaaagatggccgatgctgaggatattcaacccctcgtctgtgacaatggaactggaatggtgaaggctggttttgctggtgatgatgctcccagggctgtttttcccagtattgttggtcgaccccgacacactggtgtcatggttgggatgggtcagaaggatgcctatgtaggagatgaagcacaatccaaaagaggtattcttactttgaaatatcccattgagcatgggatcgtcagcaactgggatgatatggaaaagatctggcatcatacattctacaatgagctccgtgttgctcctgaggagcaccctgttcttctcacggaagcacctctcaaccccaaggccaacagagaaaagatgactcagatcatgtttgagaccctcaatgtacctgccatgtatgttgccatccaggcagttctttctt

SEQ ID NO: 9932 - DNA, 528 bp, Gossypium hirsutum
  Clone ID: uC-gsflmaxxa038d05b1
atttaggcctctcgctcttcatatttttttttctctctctctctctcttttgttgggtggatgctgcaaaatcgatttttcgttctctctctttctatcactctctaatttttcatattgtctctgctaattttcggtggaatctgattgcagagttgtcaaaaccctagatcttgcttgtttggttcctgtatttcgtctgatttgggcatttagcggttggatctcgatgttttcgtaaccgtttcagctcgatttccgaagatcttccccattaatttacgtgaaagtttcgggagcaaatattttgcttattagaccgttagttttttcatcttcttttaattgattttgtcgatggcttcgaatcctccattccatgtggaggatacgacagatgaagattttttcgataagttggttaatgatgatgacgatgacataggccccaccgtttcaaaatttacggagggtaatgactcggacgaagctagagccctcgccaatttgactgtcagtgaagatttt

SEQ ID NO: 9933 - DNA, 482 bp, Gossypium hirsutum
  Clone ID: uC-gsflmaxxa038d06b1
ccttctcgtccgctttcctcctcctcccgtgcttgtccttcttcaatttgtgcaaccagttcacttcgcaaatctccaggtaagttatttatctccttcttcaagctttatttgttatgattctgatgatctgggtttttcagtgagtggattatttgttgagaaaaaagacgagattttttataatcccctgtttgtttgttttttttgaacggtgcatcctggttttgctttatttttgacaatccgaccaaactttttagtcatttatggggaattctttgcttctgttctttcatggaggaccagcgttttgcttttgttctttcatggaggaccagtgttctttcatggaggaccaaacttttaagggatccttcagatcggctatttggtacctttgggagcaggggtgctaagcagaattcatagaagaaatctttggatgcattgataaaaagactccgggatgtgagctaatt

SEQ ID NO: 9934 - DNA, 419 bp, Gossypium hirsutum
  Clone ID: uC-gsflmaxxa038d08b1
ttcagtcgtgcgggttgtgcacagtgtatacgctttgtctgcagaggcatcgattagagcacaacgggcacaactagtaatactggacgcactaaatacaggaactcaagcctttctggattcaaacattagttgatgccaaacttccctcattgaggtgttggcgtacagaagacacaaaaacattgaatgttagaaccagttaccggcagatgacgtgccctgcgaaccgagcgccaataggaacggctagggcaatctatgcatgggtggaatctgcaacaagcgtgattttgaagcaaatacctgccggtggaatgagagcgagatatgctaccatcgtactcatactgattgtgctattggtgatgggcaaatcagggtgggccctggtgttgaaagtggatcaggtgctactg

SEQ ID NO: 9935 - DNA, 474 bp, Gossypium hirsutum
  Clone ID: uC-gsflmaxxa038d11b1
gctgggcttacattgtgaggcaggctgcaaagagcattgttgctaatggactagctaggaggtgcatcgtgcaagtctcctacgccattggtgtacctgaaccattgtctgtatttgtggacacttacggtactggaaagatcccagacaaggaaattctcaagattgtgaaggagacctttgacttcagaccaggaatgattgccatcaatcttgatcttaagagagggggcaatagcaggttcttgaagactgctgcgtatggtcattttggtcgggatgaccaagatttcacttgggaggttgtcaagccactcaagtgggacaaggtccaggcttaattggagcttcatcacattggttctatgtctgatttatttgatctgctgtctgctaccatatgaggctgcttttcttacaatttcctttaatttcttttttgggtttgaaaattgattataatttatatttatg

SEQ ID NO: 9936 - DNA, 521 bp, Gossypium hirsutum
  Clone ID: uC-gsflmaxxa038d12b1
cttagggtgtggttaagcggtgccttaactaccttacaaacatgtgtagactcatacgcggaggtaaataaagaacaagcggaaaagatgaattcaattttgaagacttcaatggagcttacccaaaattctttaaccatggtgactaagttatccaccatcttgaatgaccttaacattccaggcatcaatatcgacacaactgggtttgaacgtaagctcctgtctaacgatggacctgagtggatgggccacgctgagaggagactacttcaagcaaaaccaacagatttgaagcctaacgttgtggttgctaaggatggtagtgggaaatatgataccatcaccaaggccttggctgaagtccctcaaaaaagccccaatcgatttattattcacattaaggctggtacttacaaggaacatgtccttttacctaaggagatgactaatgttatgttcatcggtgatggtccaactaagaccatcatcaccaatgaccttaactgcattagggatca

SEQ ID NO: 9937 - DNA, 484 bp, Gossypium hirsutum
  Clone ID: uC-gsflmaxxa038e01b1
ctttcgcgtggggagaaattcaaggagtcagttcataggcttgagaaagaatcagggtttttcttcaacatgaaatactttgaagagaaagttcaggcaggtgaatgggaagaagttgagcggtatttatcaggttttacaaaagttgatgataatcgatattccatgaagatattctttgagataaggaagcagaagtatctggaagcacttgatcggcaagacaaggcaaaggctgttgaaatattggtcggtgatttgaaggtgttttctacatttaatgaggaactctacaaagaaatcactcaacttttgaccctcaacaatttcagggaaaatgagcagctgtccaaatatggggatacaaaaactgctcgcagtataatgttggcagaactaaagaaactcatagaagcaaatccacttttccgtgataagcttgctttccctactttgaagtcctcaagactaaggactttgatca

SEQ ID NO: 9938 - DNA, 228 bp, Gossypium hirsutum
  Clone ID: uC-gsflmaxxa038e02b1
ttttcgcgtgggttccgcttagtattagcgatgatgtattgtccctttttaaaatgaagatcatcctcatgattttgtcttttggaaaaatatacactgttgatttactttatgtagtcatagtgtaattaagtttgtaatttcatgagagcttgtattgtacaagcgtttaacgcgcttaataatgtatgttttttcgtttttcaagaagtttaacattatttactc

SEQ ID NO: 9939 - DNA, 351 bp, Gossypium hirsutum
  Clone ID: uC-gsflmaxxa038e03b1
cgtgtcgtttattttaattgagtggttatggcggagccatcttcgtctttatcgtcttccaaggacgagctgtttcagctcatcaagcgtcttggaacttatctcgccctcaagatgtcaaatcttttctcgatctctctccaaaaactggatccgcgatctgttggggctattgcagggcttgctgttgcaattatctttacctataggttgatgagatcacctgcagtacccccaagaaggcaaccaaaacgtcaagctccaacaactagtagctcttctatcagtacccagtcaaatgcaacattgatgccttctggagcctgttcaccttcagaggatttaagagca

SEQ ID NO: 9940 - DNA, 502 bp, Gossypium hirsutum
  unsure (1)..(502): unsure at all n locations
  Clone ID: uC-gsflmaxxa038e04b1
cttttaatttattttatatattatcttttatatacatatatatatgtgtgtgtgttttcatgctgatctattttcgttgttctctccttgttgaaatccaaaggctctctttatcgttccttcaatggcagttgaagctcggcatctgaatattttctcttctcagttcatcaccaatagtcacagcagggtttttattaaatcaaatcaagggattggggaaatatacaatacccagatggattcttgtgttcctttaattgattcaaattcaatgcatgaaggttcacaacttttaccattatatcaacccctcctttgtcatccaaatatttcagccaacaaagctgatagcggtcttacaacttacaacatgagtatcccagtttcagctccaagaaaaaggtctagagattcattcaccaatggctntgattcgtattcgctccctcaaaacatcaacctttctggtgcttcctcagacgttgatgatgatgtcttc

SEQ ID NO: 9941 - DNA, 501 bp, Gossypium hirsutum
  Clone ID: uC-gsflmaxxa038e05b1
ctctctttcatttcttttctttttctctcccagacgttgctgttgcagagcttcgccattgttgtcttgcttcaagctttttcagtttcttattcacacccttttgagttttgctcttcaaccatggctgctttagtgctcccgctgctcatcctggccgccatcactggccgctcaagtggcaactggtgtatatgcaaagatggtgtaagtgatacagtattgcagaagacactggactatgcatgtggtgcaggcgccgactgtaaccctatccacttgaagggatcctgttttaaccccgacactgttaaggctcattgcagttacgccgttaacagttacttccaaagaaaaggccaagctcaaggcacttgtgatttttccggcactgctaccgttaccaccgctgaccccagctacactggttgtgctttcccatctagtgccagtatcctatgcaccaccacaacaccaacaaccacacccttattcaccaca

SEQ ID NO: 9942 - DNA, 544 bp, Gossypium hirsutum
  Clone ID: uC-gsflmaxxa038e06b1
cttagacaagacaccatgaagctacctgctctgttcaagcctaaagaacccacctccaagcaaccatggcaatggccttcatgcaagcaccccaagaccctttctttccgagcaggtgacgacgttttcaagaccgttaactccatgttcttcgaccctaacagcaacaatgacagtggtgttgaaaccccacagtcatggttcaccaactcttccgactcacccagtttatccaccaccaccaccaacgactcagatcatcaaggctttgatggtgagtctttagagacagtcgtccgtggagctcgttccgagaggctgttcttcgagccaggcggtgacacgagttccatcctcgaagaagccaaagcagccggtggtggtggtgaatgttcttgtccccgtccaaagaaagcgtgattctagctatggaatctgatgatccgaacgtggactttcgtaagtcgatggaagaaatggtggagacacatgggatgaaagattgggaatggtagaacaactgttgggatggtatttgaaggtg

SEQ ID NO: 9943 - DNA, 527 bp, Gossypium hirsutum
  Clone ID: uC-gsflmaxxa038e07b1
tttacgcgtccgcccacgcgtccggtgcttttattcttccaagggttccatcaggccttctttcttaagctttgggttttcaagatgaatcattgcaatcttcagcagaacgccaccgtttcggcttacgaagagttgagagggtttatctcaatcactgatcatcaaaagggcggtgccgttgtttgcaccaagcctcggcgaattcaggtcctcgccaataaccctaccaagccattgagattgcatatgagtcatcaagccgaggtaagcgattcgaaagctggtgcagaccttcttgatatcatcctcaataaggaggatttagggacagaagaagaacaatctatagcatcatcacctccgtttttttgtgggtcgcctccaagtagggctgcgaatccacttgtgcaagatgctcggttcggagatgaaaggcttgcacaagccctttcgactttggagattccatctccatcttcgccgtcgtcatttgcacgtaaaggagggtgtgttaggatgaaatt

SEQ ID NO: 9944 - DNA, 478 bp, Gossypium hirsutum
  Clone ID: uC-gsflmaxxa038e08b1
ctcacgcgtccgcccacgcgtccgctttttctttttctcgctaaacaaacagaaaatcagcaaccctcttcttttacattctgtggtaatttaactaagagctgaatcttatggcgtcttctttggcttctccgtccccaacttcttcctttatcaggaacaagaaagatttgggtttctctgctttcccttcaacatctcaaatcgcaattcagaaatgtaagaaacaagtttcgaagaaaatcgtctcagtcatggcacctcagcaatcagagcgtaaaccagcgaccacaggctctgtgaagactggaatgacaatgacagaaaagattcttgcaaaagcctctgagaaaccacagctgagtcctggtgataatgtttgggttaatgttgatatattgatgacacatgatgtttgtggtcctggttccattggtatcttcaagaaagaatttggtcaaaatgcaaaggtttggga

SEQ ID NO: 9945 - DNA, 539 bp, Gossypium hirsutum
  Clone ID: uC-gsflmaxxa038e09b1
cttacgcgtccgcccacgcgtccgcggacgcgtggggaaagaaaagaaaaatggttctgctagagaaactttgggatgatgtagtggccggacctcaaccggaacgtggccttggccggctgaggaagatcacaaccaccccacccttgtccaccaaagatgaggcttcatcaatggcgatgccgacgagtccgacgacacctgggacaccgtcgacgccggtgtcggctcgtagggacaacgtgtggaggagcgtgttcaatccaggtagcaaccttgcaaccaaaggtattggcgctgaagttttcgacaagcctcaacctaactctcctactgtttatgactggctttacagcggggagacccggagcaagcatcaccgctgattgggcgatggctgaccgcggcggaaggtagcaaaaccactagcagaaggttgctgctactgaaggagcaggatttgcatgtaaatatatatattcgtctttttaaaagtttttcaatggtcaattaagtagtagtagtagtaagtaagatgt

SEQ ID NO: 9946 - DNA, 528 bp, Gossypium hirsutum
  Clone ID: uC-gsflmaxxa038e11b1
cttagaagaaaaacttaatcatggctcggttgacgttggtgtcctccatcatccttctgctatgctccgtcgccgccggatcaactttcgaggactccaaccccatccagatggtatccgatggcctcagcggcttcgaatcctccgttcttcgtgtcatcggtcacactcgtcatgctctctccttcgcccgttttgcatacaagcatgggaagaggtatgaaaacgtggaggagatgaagctacggtttcagattttcaaaggcaacttggatttaatcagatccactaacaagaagggactgccttacactcttgctgtcaatcagtttgctgattggagctgggaagagttccagaaacacagattgggggctgctcaaaactgctctgctaccacaaagggcaatcaccagctcactgatgtcgtccttcctgattcgaaagactggaggcgagtgggcatagttagcccagtcaaagatcaaggctcttgggatcttgctggacattcagtaccactggagc

SEQ ID NO: 9947 - DNA, 572 bp, Gossypium hirsutum
  unsure (1)..(572): unsure at all n locations
  Clone ID: uC-gsflmaxxa038f01b1
cttttggtttgaaacaatggagtccaacaccaaaatgtcagctcttcttttgatttgcatgcttttcatttcttcagtgacaccaattcttgggtgtggttcatgtgggaaagcacacaagcatcgaaagcctaagggaaagtcccctaaaggtcccatcactttgcctccccttgtgaaacctccaatcaagttgccaccggttgttcctccaatagttaagccacccattgacctccctccggttacggtccctccaattaaccttcccccagggacggttcctccagtaactaagccaccaagtgggaaaccctgcccaacaccaccaaccaaggacacttgccccattgacacactgaaattgggtgcttgtgtggatctgctgggagggttggtgcacattggactaggtgacccggttgtgaaccaatgttgtcccgttctttcaggactcgccgagctcgaagctgcggtctgcttgtgcaccaccctcaaacttaaggttctcaaccttaataattatgtgccactggctcttcaactnctgtcacatgtgggaaaacaccccc

SEQ ID NO: 9948 - DNA, 564 bp, Gossypium hirsutum
  Clone ID: uC-gsflmaxxa038f02b1
gtgctttggtatttttttgtcctatattcttaaacctaggtttcagcttgaaggaactattttcatttctgtgcactattattttcttcatttcaaagtaatggaagatcaagctctggaccctaatggtccgagccatggttcagagagaagtgaaccagtaaggtcaaggtggacaccaaaaccagaacaaatcctcatactagagtccatcttcaatagtggcatggttaaccctcctaaagatgaaactgtgagaataaggaagctgcttgagaaattcgggtctgttggtgatgctaatgtcttttactggttccaaaaccgacgttcgaggtctcgtcgccggcaacgacaacagctgttagctgccggtgcacgggaacaaaggaataaccaatcacaaatactcggtaacggcggtggcggcggtgcaattcagtatgaaaataatgaggtttccatggggtttgcaaattctccctcaaacttgcttctttcctaattggtccttcttcttcatatggtgttatgaatgatgatggaatgggaatcttctctcat

SEQ ID NO: 9949 - DNA, 538 bp, Gossypium hirsutum
  unsure (1)..(538): unsure at all n locations
  Clone ID: uC-gsflmaxxa038f03b1
ctctctttctatttttcttctctctttttttttaccctatttgatagggttttcatgtccttctagctccaatccatctcatgcattcgtgtcttccagctacatacgttgacgttttagccttctcccttgtcgggtctctcttttttctctctttggagggtttttgggcggctaacggtgcagatttcaccttccggggtttttttgagctgtacccatgtcaaagctcttttcttttagtggaactgatgatttttgccctggggggtcgatctacacaaaccccaaggaatcaagtctctttttgtcccttggacgtcatgtggatgtatattttccctctcgcaagaggtcccgcatcagtgcgccttttgttttctctggagagaggtttgagaagaagaaatcatcaattgaggttctccctgatgaatgcttattcgaaattntgagacgattaccagggggacaagagaggagttcctgcgcttgtgtcttcaggcgttggcttacaattgtaagcaacatccgcagc

SEQ ID NO: 9950 - DNA, 471 bp, Gossypium hirsutum
  Clone ID: uC-gsflmaxxa038f05b1
gttgtcttgtaatcttcaaacgcttttggtgactaattcacagcttttacttacacactcgtcactctttactagtttctgctctgttttcatggagttgatgagaatttttagctatgcttcgattattctttcgatttcagtttatttgcttccaattatggttaattcgattgggatcaattacgggcaaatagcagacaatcttccttcccctgaaaacgtagtgccgctcgtgaaatctattggggtcaccaaagttaaactttacgatgcagatccgagagtgctcggcgcattcgccaactccggcgttgaattcatgatcggattaggcaacggggacttggagaagatgagagacccgaacaatgctcaagattgggttaaacaaaacgtgcatgcccatttaccggacacgaaaatcacctgtatctttgtcgggaacgaggttctcactttcaacgacac

SEQ ID NO: 9951 - DNA, 463 bp, Gossypium hirsutum
  Clone ID: uC-gsflmaxxa038f06b1
ccttctcgtccgcccacgcgtccgcccacgcgtccgatcaaaacttcatccacatgtcggagcttagtttgaagaaaaagtggaagaaaaggttagggttatgagatgaataatgatcaagtagacagaaaatggagggaagggttaattatccatgcatgttatcattttagctatagaatatcatttttttgtgtatgtgtgtatatatgtatattatattgagctcattgtgaatattttgaaatattgaatagaaagaagaacgagaaaggaaaaaggaaacaaggggaaagtaaagctggaagcttgaagaaggaattttagagaccttttgagctattttaagttgaagttcgcgttgaaagatgttagcagactctcgagggctgtcaatggcgaagcaatgaatcatgcatcggttgaagcagaagatagaggtcctgatcaggcacaacaacag

SEQ ID NO: 9952 - DNA, 550 bp, Gossypium hirsutum
  Clone ID: uC-gsflmaxxa038f08b1
gtaatgctctccttgcagctcttctccgcaaatcctaagcccactctcctcgactctccgctcaacccccttttgtaccccaaatgcctaaaacctccaaaaccctactccaaatcgaagcccgcccccatttcttctgtccttcaatggaatagaaagcctgagctggccggtgagaccccacgcgtcgtcgttataacatccggaaaaggcggggtcggaaaaaccacaaccaccgccaatgtgggtctttccttagcccgtctggggttctccgtagtggccatcgacgccgacgttggcctacgtaacctagacctcctgttaggcctggagaatcgcgtgaactatacggtcgtggaggtactcaatggcgattgccgactggaccaggcattggtaagagataagcggtggtcgaacttcgaattgctttgcatttccaagcccagatcgaagctccccattggattcggtgggaaagcgttggttttgctagtggacgcactgaaagcgcgtgaggaagggtcaccgattcatactaatagat

SEQ ID NO: 9953 - DNA, 507 bp, Gossypium hirsutum
  Clone ID: uC-gsflmaxxa038f09b1
cttttagattccctttccattgtactgatctttctttctttagaattactcactcctgttctagatgaaggttctctccccaattcttgcttgcctagcgcttgctgtggtggcaagtcatgctgctctctcacccgagcaatattggagctataagctgccaaatactccaatgccaaaggctgtcaaagaaattctacatccagaactgatggaggagaaaagtacctctgtaaatgtaggaggtggtggtgtaaacgtcaacacaggaaaagggaagccagcgggtggcactcatgtgaacgttgggcgcaaaggagttggagtgaacacgggaaagccagggggtggcactcatgtgaatgttggaggcaaaggagttggggtgaacactggaaagccaggaagtggcacccatgtgaacgttggaggcaaaggtggaggagtatctgtacacaccggacacaagggaaagccagtaaatggtaatgtgagtccgtttcttta

SEQ ID NO: 9954 - DNA, 454 bp, Gossypium hirsutum
  Clone ID: uC-gsflmaxxa038f10b1
cccacgcgtccgcccacgcgtccgcagaaactatagaaaactcaaacaatcatcaagctagttctgtggttgaaggtatgactccaacccatgaggccgctactttggatgatgctcctgttgaaaaccgagatgtggagggtcaatctgggggaaatgactctaagaaccctatacctgagccagttctttctagtacaactgaatctgctgatatagagcttgttccacaagatggtggagccttgctacaatccccggtggttcgagataaggagggtgatgttgctgagattcgccatatggtagtagatccctgtgagaccaagttgtcttctttgaaagattttactgctgaatccgccaacagggattctgctacagaagttgatggtgggaagcaattgtctgcgggagttcaaactaccaagattgacaatgttgaacattgatc

SEQ ID NO: 9955 - DNA, 267 bp, Gossypium hirsutum
  Clone ID: uC-gsflmaxxa038g01b1
cgttctcgtgggcggacgcgtgggcggacgcgtggggggaaatcatcgatgattgcggcaatggcaaacctattggactacgatgtttatgatctcgaactcactgcagtgaaggaaaacacggagttgagaaggcttttgcttgatacgtcaagcaagtcgattatcgtgatcgaggatattgattgctctatcgatctcacaggccaaaggggtaagaagacggagaaagatggaaacgaagacgagccctcggatccggtcacc

SEQ ID NO: 9956 - DNA, 556 bp, Gossypium hirsutum
  unsure (1)..(556): unsure at all n locations
  Clone ID: uC-gsflmaxxa038g02b1
cctttctagtgtaaaaggaacccccattattattgctttcactgcacatccccatccctctaaacctccaactcttctttataaacgccaccaactttctcctccaatccccacttcttcttcgctgcttcttactttcttactttctttctttcaatgatgctgctattttctttttgtttgttttatatatatcttgtctcctttgggaaagttcctacatctcttcatctttgtcttgggattctgggttctatttcattggtttagagatcaataatgattggcatatcatgtagcagtgtttttcatctaaagtcttgcatgtggaaacgaggttatctatctatatgtgatacagccaaggatgacttgccggctcacttctacttaacataaatcatgctctctacataagcagctaaaagttagagcactaagctaaaacctgtatatgttgtcatcaattaatttataataaatgttaattgatcggcangtcatctgtggctatatcaattgctcattttctcattctagatttatgatgaaaata

SEQ ID NO: 9957 - DNA, 152 bp, Gossypium hirsutum
  Clone ID: uC-gsflmaxxa038g03b1
aagtacctttttatccctgtttgaatgttattttcatcagtctatctttgcttctgaaattgaaacttttctctatggaagttcaattttggagataatgccttaatctgttattatttttttaatgatccgtgtttgatacatattcggat

SEQ ID NO: 9958 - DNA, 551 bp, Gossypium hirsutum
  Clone ID: uC-gsflmaxxa038g05b1
cttttatggcaggcgcagcaaattgggtttccataaccttactgttttcagtatgtttatcggcgtcctatggtaagaggaccggaatctccaccatggctgacggagccgatgggtttcaaccaagcaacggttttccgcatgaagctgatcctgattcttcaacctctatcgatcctgatcctaccggattcggtgctggcataggtataggttatgaaagaagcccttactgtatcgactgcgacgatgtggatatcatgggcggcagcttttgcggcacctgcaattacggatgcccttaccgcaggttcaataatgggtgtggtggtggtatcgcttatatggatgaactcaaacgaacgattaaggaccttaccatgaaacttgatgccaatggtcttttagggaaaaagaaggccatgaatatacaagctatggcgccagaatcttcatagatttatatatagattatagaaactaccgtttcttttcaaagagaaagataataaagaataacccagcagctggatatatgattgaattacaat

SEQ ID NO: 9959 - DNA, 513 bp, Gossypium hirsutum
  Clone ID: uC-gsflmaxxa038g06b1
gctgacttgtttaataattttgtccgaaaatattgcccatctcgtctggctccgtctccgatcaggttgaaggtgattatgtttactggatatatcttggagaggggctgtgatcttttcaggtgttctggtagcagtagcctttctgaaagattccatttcaattatccccttggttggtaacaactatgctaccgactggggcaaaagatactcatatccgtgatagcagcaatcaaaaagtccaccctcaacctatggaagagagcatgaaccagaacccagaagctgtggaagctctaatatccaaattatttacgaacatctcctccctcaagtcagcttatattcagctacaaactgctcatactccctatgaccctgaaaaaattcaagctgctgataaacttgtaatatctgagctgaagaatatatctgaactgaagcacttctatagagaaaagaaccccagccagtgtgcgttctcctcaagatctcgtttagcttgctgag

SEQ ID NO: 9960 - DNA, 479 bp, Gossypium hirsutum
  unsure (1)..(479): unsure at all n locations
  Clone ID: uC-gsflmaxxa038g07b1
cttatatcaccctaaaccaccaaaacatccaccggatcatcccaagccacctgttgtgaagcctccatatatacccaagccacctattgtaaagcctccaccgtatacacccaaacccccggttgtgaagcctccatatatacccaaaccaccggttgtgaagcctccgccatatacacccaaaccgccggttgtgaagcctccgccatatacacccaagccaccttactatccaataccgccggtcatatcaccaccaatactgcctccaaagccaccagtccaccccagtccaccaatagtgaacccaccaacaccgccgattctaccaccaccatcaccacctattgtgaagccaccaacgcctcctatcgtgaagccaccttcaccggaaacaccgtgttctncaccaccacctncggcacaacaaacatgccccatagacactctcaagctaggtgcatgtgtggacgtgttgg

SEQ ID NO: 9961 - DNA, 519 bp, Gossypium hirsutum
  unsure (1)..(519): unsure at all n locations
  Clone ID: uC-gsflmaxxa038g08b1
tctactcgtccgcggacgcgtgggtttccccatttccaatcagacaactaaaagggattcgtccccatggcggcaaccggaccttctctgtttgtcgccagtccgttagtgacgtcaacggccggaaactcggtgaggaaccggtgcttaagctcatttcgagcgatggcggtgtctgcagatcagaaatcgtcaccggcgacggttgcaacgaggtcaacggagaagggaagatggttggaagagaagaataggaagggaaggaaggaagaagaagagttaacatcgaatatttactcgaatcctcaggaaataaccgacgagaatggaaacacgttgagagaatatttccaagagtgcaaagatttgatgatccaatcaaaggcagggccgccacggtggtttactcctttggagtgcgggtcccatgctcctgattctcctctcctnctttttttgcctgggattgatggcatggngcttggaccttttaacatcatcataaactgggaaagattt

SEQ ID NO: 9962 - DNA, 417 bp, Gossypium hirsutum
  Clone ID: uC-gsflmaxxa038g09b1
ttttagagaagatgaatactaacagcaataataaccctattggatttatcaccaaagctgaaatgagaattccagttcaagaaaggagtccggacttgaatctggacctgagaattagccctgcttattaccagcatacccaaccagagtcattcaaaactggaggaagaactctttgatttatttgcagcttgggagttaaaaacagcagagattgcacttgcatgcaccattactactgctgctggtagcagcagcatgtacgcagtagccacatgaacagcaacaacagcagcggttatgacattcttaggcttgaaagctggtatcttggaatatagcaggtcggaaatgaaataatagagtgaaaatttggactcctaactatgtagtgcaactacgtcccacgccccccca

SEQ ID NO: 9963 - DNA, 524 bp, Gossypium hirsutum
  unsure (1)..(524): unsure at all n locations
  Clone ID: uC-gsflmaxxa038g10b1
cttttgttggccaaatcatgaccactctcgtgaccggtgtgtttctcctcctactatccgtcgccggcgtcgtatccgccgctagatatatcaccggtgatgttctccggttaccttcggaagcttcaaggttcttccgatggaggagcgatgatgatgaagttggtggcacaagatgggcggtcctgattgctggatctaatggatattggaattacaggcatcaggctgatgtttgtcatgcttatcaactcctaaggaacggtggtttgagagaggaaaatatcattgtctttatgtacgatgatatcgctttcaatgtagaaaaccctaggcctggtgttatcattaacaatcctcatggcgatgatgtttataagggagtcccgaaggactatactggagaagatgttaatgttcacaacttttttgcggctctcctcggaaacaagtctgctatcaccggnggtagcgggaaggttgtcgatagtggcccttgtgatcatatcttcatatactacact

SEQ ID NO: 9964 - DNA, 480 bp, Gossypium hirsutum
  Clone ID: uC-gsflmaxxa038g11b1
tttaaaaacaaaaaggaaaatcttcctcttgttttgcttgaatggagatttgagccctgaaagtactgcatttgtgagtttctcctgaacttcgcgaaatgggaaaatcaccgggaaaatggattaaggctgtgctttttggaaagaagtcttccaaatctggttatcataaaggaagggagaatgttgccaatgtaaacgaggtgttggtttcagccagggcatcagaagctgaagtccctgtggctcctcccttcccttcacagcttaatcaatatgctaatgagagaaatgagagagatgaagggaaattagaactggaaaacaaggaggctgcaaatatctataacgatgacaggatatcactaccagtgagtcaaggcataggttctcaggaatccactcttcaagatttccaaaatgatcctgaaagtatgaagcaaaagcaagcagcaaccatcgttcaggctgcttttaggg

SEQ ID NO: 9965 - DNA, 528 bp, Gossypium hirsutum
  Clone ID: uC-gsflmaxxa038g12b1
cttacgcgtccgggggcatcacaacgcattcgctatgcaactctctacactttctcttttccctttctctgttcccaaatttctgcatattaaggcgagccgtgagcgtgaatctcggtgttattttactctaaatcagggattcaatagatcaaacaaattgtccagatacatagttacaagatctcaacttggtgggactgggatccttgatgctaccaattctttatcagaaattaagccgagtccgaaatttagaggagtatgcttctatggtatgacagttatggcaggcgttttaccgtttgggatactgatagtggctcatcccttggcgctcatctttgatccctacaagacaaaattttacaatcttattccaaaactatgggcaaccgcaagtattgctcccttcttcgatatcgagttggaaggattggagaatctgcccccgcagaatgctcctgcggtgtatgtttcgaaccaccagagtatcatagacttctatccgcctgtaactctgggaag

SEQ ID NO: 9966 - DNA, 375 bp, Gossypium hirsutum
  Clone ID: uC-gsflmaxxa038h01b1
ccttctcgttcgcgcatttgcccgcacgttgttgtgtgctctgtgtttctcaataaattccttattcctacaaaacccccaaaattaaagaaggatcaaaccgaccctttgcaattccaagacacaagaaccaagagacataccacgatggcaacaacgacggagaagcaagccatggttgttggaatcgacgacagcgagcacagtacgtacgcgctgcagtggatcctcgatcacttctttgctcctttcgcttccaatcctcctttcaagctcgtcatcgttcatgccaagcctactgcttcttctgctgttggtctcgccggacctggagctgctgatgtattgccctatgtggatgcggatttgaggaaa

SEQ ID NO: 9967 - DNA, 530 bp, Gossypium hirsutum
  unsure (1)..(530): unsure at all n locations
  Clone ID: uC-gsflmaxxa038h03b1
gcttttgcataataacatccccatcgtaaaacaggctcactctcagagttttttagaaaaaaaattaaaaagtcgtaagagaaatggcaaaattcccagtgatcaacttggagaaactgaatggtgagagagcagcaaccatggatctaatcaaagatgcctgcgagaattggggcttctttgaggtattgaaccatgggattccctatgattttatggacacagtggaaagcttgacgaaggagcattacaagaaatgcatggagcaaaggtttaaggaactggtggcaagcaaggcccttgagggtctccaggctgaggttactgatatggactgggaaagtactttctatttgcgccatctccctgaatcaaacatggctgaaatcccagatctaaccgatgaatacaggaaggtgatgaaagaatttgcattgaaattggagaaactagcagagaagctgctggacttgttctgtgagaaccntggtctagaaaaggatatctgaaaaaggcttttatggggcaaa

SEQ ID NO: 9968 - DNA, 539 bp, Gossypium hirsutum
  Clone ID: uC-gsflmaxxa038h04b1
atttcttgtcttcttgtaagttctttgctatctgatgtcccagtttcagtttcattttctcttttggtctttaacattttcaaatcctttatatattatctccatcttcacaatcacttattgcaaagtataaagcacctatttcattttttttggttgaaaaatgttttatggcggaaggaaagcatcaagatctcgctctcattactcattattgctccacattatgtttttttctttttcctttttatgcttaatggttcgaatgatcacagtctcacattgccgcatttacactgaataatgcgagcttttgactctccaacgatattgcatctcacatttctccattttacgtattctctgctcaatattttactatgaagtttggttttgtgcgaaatgatttagactcttctccggggcagagcctagatggaagtttcagataatccaactctgttatctctacccattctgtgtccggagtttcatcttcaagcaagattttcaacttcaaaagaagctacaagggctga

SEQ ID NO: 9969 - DNA, 526 bp, Gossypium hirsutum
  Clone ID: uC-gsflmaxxa038h05b1
tttctaaatcaaagtaattttcaagcagattcagaacattcccatctcaagaagtgtgttcatgatttgctgaaaatgacatctgttgagggaaatacggctgagcctcggaaaactagtaatccggctgctaacactgctaagattcagagttcatcattgtcattccgaaggtggggtaggaagtatccttttatcagatatgggcttccaatgatttcgttgacagtgtttggggcagttggccttggtcatctcttgcagggcagtgaatatatctgctgtgcagagaacagcatatatcattttaactttgaggggcaaaccatgttatggcgtaaataattggctcagttctgttcacggtgtatttctcatgatcggagttggacctatggtattaggccgtcagttctgatggtggtatatagttgtaaatttttaaagttggagaaaagaattccaatgacaataggatgtaatcatatgattggaaatagaaggctatttttgcattcttgttgac

SEQ ID NO: 9970 - DNA, 464 bp, Gossypium hirsutum
  Clone ID: uC-gsflmaxxa038h06b1
cgtgaatctccaaatattctcgagaaaagaaaaaaaaaacccctcagatttctaaaacgattcgtttgttttttttggaattgtttgtttgtggttttcgaattctgggtcatcatcatcatcttcactgcaacttcgcttttttttttttggcctatagtctgcctcagggatggcaatctccggtcggccgcatacggtataagggcgagattgatggttggagtgaggatgttagtttctaagttctgagatttatgaggaaattgttgaagttggttgacatttgactgttggagaaccaaacattagggtgtttgagattagatatagtggaatttgggtattgatgaatgtcagggcagctcaagttcgctccctcctttcctcgcgaagacgtatgagatggtggatgatccttccacagattctatcgtgtcctggagtgcaagtgataagagttt

SEQ ID NO: 9971 - DNA, 398 bp, Gossypium hirsutum
  Clone ID: uC-gsflmaxxa038h07b1
gtttaaaatgtcagaagtggtccgaatgcttggaggtgactgcttagcggaacgatgggaagctatacacagagccgaatcaaccaaatgcaagcctcctaatgaattctcatcgatggaccgatattccgatctcaccgacgactcatcattactcgttcaagccatggaactgtctggaccaaggtgaagcagaaccaaccccttataaaacgtaactataaatcttttcttcttttctttccggagatttcagggagacttagaaaattatagctaaaactcctatagatgcataataacgggatagcataggatcaaagggctatgattttttcggctgtggttttttactacaagtgtacagattttatgtctaaggagacattattgaagat

SEQ ID NO: 9972 - DNA, 513 bp, Gossypium hirsutum
  Clone ID: uC-gsflmaxxa038h08b1
ccttcagctgcaccacaactacagagaagagagtgaaggggaaaaaaagcgtcgtcgtttttgcttcttcttctacttcgctctctctccttctccgaagttcctctttcgttctttcatttattcagtattgtaaaagatggccgacggtgaggatattcaacccctcgtctgtgataatggaactggaatggtgaaggctggttttgctggtgatgatgctccaagggcagtttttcccagtattgttggtcgtccccggcacactggtgttatggttgggatgggtcagaaggatgcctatgtaggagatgaagcacaatctaaaagaggtatccttactttgaaatatcctattgagcatggtattgtgagcaactgggatgatatggaaaagatctggcatcatacattctacaatgaactccgtgttgctcctgaggagcaccctgtgcttctcacggaggcacctctcaaccccaggcccatagaagaaagatgactcagatcatg

SEQ ID NO: 9973 - DNA, 203 bp, Gossypium hirsutum
  unsure (1)..(203): unsure at all n locations
  Clone ID: uC-gsflmaxxa038h09b1
ctttctcgtccgcccacgcgtccgaaaaaaaagtgttgaatggtttggaccggatgggcagatgagagaagtttgtttaacataagctgtgctaactaggatatttcttccttcttgtttgaaccaggaatggcctttcaaatacaaacttgggacttgcgacttaacttgcagtgcagatagtcagtcttcccgtttccnaa

SEQ ID NO: 9974 - DNA, 519 bp, Gossypium hirsutum
  Clone ID: uC-gsflmaxxa038h10b1
tttacgcgtgggcggacgcgtgggttcgcaacgaccagtctagggtttactattgagaaattaaataagaaccaatcagaaatacccattctcaagtaagaagctatgctataaatatgtaatttagggttagggctatggccaatacatgagactaaaagtacgatttgggaatcgatcaacgaaaatgaggaagcgacaagtggtactgagaagggaggagccaccaagaagcagcagcaccaattcatcgttgacaagtagaagtgtgagatatgcagagtgccaaaagaaccatgccgctggggtcggaggttatgctgttgatgggtgccgggaattcatggccagcggtgaagaaggaacaactgcagcccttacttgtgctgcttgcggctgccataggaatttccatagaagggaagttgaaactgaggtagcttgtgactgttcatcacctcctcctttcaatggagcataatatatatgtagctttattaaataaaatcacttctcatg

SEQ ID NO: 9975 - DNA, 472 bp, Gossypium hirsutum
  Clone ID: uC-gsflmaxxa038h12b1
ccttgggttgagtgtagagatgaggaaaatcatgggtgccaaagttcttttcttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttgtctgagaaggagacagacaggagctttggcctaaggaatttcaggtacattgagaccatcaaagaagctgtagaaagggaatgtcctggagttgtttcttgtgctgatatccttgttctgtctgctagggaaggcatcgtttcgttgggaggcccttatattcctctcaaaactggaagaagagacggtagaaggagcagagcagatgttgtggaggagtatcttccggaccacaatgagaccatctctggcg

SEQ ID NO: 9976 - DNA, 544 bp, Gossypium hirsutum
  Clone ID: uC-gsflmaxxa039a01b1
cctactcgtccgccccacctcaccttctcatacgacgccgtctcccttcctttactcgcctcctcactctctctctccaccctcacgacaacccccacgatgctcgccgccgctcctccgcagtctctcgacgcgccgttctcctcactccgtttctcgccgccgctggcactctcctcctacaacaatcccagtccttggccgaggagataacgctgccttcctctccggtgacttcgcctccgcctaaggtggtcgtagaggaggcgcttgtgtcggcgaggatatacgacgctacagctatcggggagccgttggcggtggggaaagataagagcagagtgtgggagaagttgatgaatgccaggattgtttatttaggagaagctgagcaagttccaattagagacgataaagaattggagcttgagattgttaagaatttgaaaaaacgctgcgttgagaaccagaggcccgtggctctggctctcgaagctttccttccgattacaaacccactcgatcagttatggctaaaggatag

SEQ ID NO: 9977 - DNA, 401 bp, Gossypium hirsutum
  unsure (1)..(401): unsure at all n locations
  Clone ID: uC-gsflmaxxa039a03b1
ggtgacatctattgcagctcgcttctctagaaaggccgcggcctcggcgttctccggctgccgctacgtcatcgcttcccgtagtttctccacggaggctgccaaaacgatctcgccatcgtcggatcaagtgaagtgggactacaggggtcaaagaaaaataatccctctcggtcagtgggtccctaaggtagctgtcgacgcttacgttgcccccaacgttgtcttggccggtcaagtaacagtcaacgacggagcctcggtgtggaatggttgcgtcctacgtggcgacctcaacaagatcaccgttgggntctgctctaatgtccaggaacgctgcgtcattcacgccgcttggtcctctccgaccggacttccagctgagacatcaattgagaggt

SEQ ID NO: 9978 - DNA, 327 bp, Gossypium hirsutum
  Clone ID: uC-gsflmaxxa039a04b1
cttatatttttacttctcaactctctcaaattcaccatggctgacaagtgcggcaactgcgactgctctgacaagagccaatgtgtttaagtaatccataatcatccatccatgatggagcttgccagaagaaaggaaacgccttggtcattgagactgagaaaagctacatcagcactgtagtggtcgaggctatggcagagaacgatggcaagtgcaagtgtggagctagctgcagctgcacaaactgcacatgtggcaatcattaagcagacatatagaaccatgatgtttagtactccataattaaattaagttgaataattg

SEQ ID NO: 9979 - DNA, 157 bp, Gossypium hirsutum
  Clone ID: uC-gsflmaxxa039a05b1
gaaatacagaaaaagtggaagcttttttgcttataaaaaatttgaaatagatctataaggccagttgttgaagaagaagcagatcaatggcgaaggagttggaaggattcaatttcgagcaaaggcatggaaaggcgagggtgagagtgggtagagt

SEQ ID NO: 9980 - DNA, 332 bp, Gossypium hirsutum
  unsure (1)..(332): unsure at all n locations
  Clone ID: uC-gsflmaxxa039a06b1
atggcggattgcatcgaagtgatcgacgactctatcgacgagctccaaaaatctataggtgaaattgctcgtatcagacgctccaactntgtgcttattatgagtgatcttcanacctgggttagtgctgcactgacagatgaagatacttgcatggatggattctcaggcagggctatgaatgggtacgcgaagatgatggtgaggaaacgaatcgntaagatcgcacatttgacgagcaatgctttggctctcatcaataactatgcttcatctcagatccttgattgattttctcgagaaaatttcgatggcaacgaaagcactgcgtt

SEQ ID NO: 9981 - DNA, 523 bp, Gossypium hirsutum
  Clone ID: uC-gsflmaxxa039a08b1
tttatgggccttgatgcgctacctaggcagcagcataattcatctgcacaaagatgccgttttaaaggcccttctcgacattcttcgtgtcactgtgagataccagtggaaagctgggagcaggatcaaagctttccagatgagcaaatgcaatgcgaagtaagtccctatgaagtgccgaacaaatacaaagatgtgtatgaaatctggcaacaatccccaagaactacttattcaagagacagctctccacaaaaagggaggtatagtgataatgcaaatgagaataaaatggctttagttcgtcagaagtttatggaagcaaaacatctagtgacagatgaaaagcttcgccagtccaaggaatttcaagatgcactggaagtcttaagttccaatagagagttattcctcaagtttctggaagagccaaattccacgttctctcagcatctcaacaatttccggtgttcatctctaccgccttcgacaaaacgtataactgttcttagaccttctaaga

SEQ ID NO: 9982 - DNA, 425 bp, Gossypium hirsutum
  Clone ID: uC-gsflmaxxa039a09b1
tttcattttattgttccttccttcgccgtctactgcacttgtgacatcgatttcaagtgaatcagaatgggtaaggaaaagagtcacattaacattgtggtcattggccacgtcgattccggaaaatcgaccaccactggccacctgatctacaagcttggtggtattgacaagcgtgtgattgaaaggtttgagaaagaagctgcggagatgaacaagaggtcattcaagtatgcttgggtgcttgacaagctcaaggctgaacgtgagcgtggtatcaccattgatattgccttgtggaaatttgagacgaccaaatactactgcactgtgattgatgcgcctggacaccgtgactttatcaagaacatgattactggtacctcgcaggctgattgtgctgttttgattattgattccaccac

SEQ ID NO: 9983 - DNA, 202 bp, Gossypium hirsutum
  Clone ID: uC-gsflmaxxa039a10b1
gtagatcagggaaacttctgcaactcgacaccgacaccgacaccgtcaccgtcgcctctctatattacggaaagtgtctactctaaccgagatttatatcccgagcactagtggctcagatgcagatatggaggataatggatgcgagtactccgatgaggaacctgagagacaagacgtagatatcgagaatcaatactac

SEQ ID NO: 9984 - DNA, 434 bp, Gossypium hirsutum
  unsure (1)..(434): unsure at all n locations
  Clone ID: uC-gsflmaxxa039a11b1
tttgtcgatgcttattacgataagttgctggctggggaaagcgggatcggactcatcgaccggttcgatgcttccaagtttcctacccggttcgccggtcagatccggggtttctcttctcagggttacattgacggaaagaacgataggcgacttgacgattgcttgaggtactgcattgttgcaggaaagaaggctttggaagatgctgatctcgggggcgataagttatccaagatcgataaagagcgagctggagtgctagttggaactggatggggtgggctanncggtgttctctatggcgttcaaaatctgatagagaaaggctatagaaaaataacaccattctttattccctatgctataacaaacatgtcatctgccttgctagccattgatcttggtctcatgggtccaaattattcaatttc

SEQ ID NO: 9985 - DNA, 519 bp, Gossypium hirsutum
  Clone ID: uC-gsflmaxxa039b01b1
cgttttgaaggggtaaaagaacttcaatagtttgagtttagggtttttagatcgaagattatggggcgttttgctcttctccttttactagctttcgcttcatttcaagccctttgcttcgccgctgatgatgatacggtcttttatgactcatttgatgagccttttgacggacgatggatcgtgtccgataaagatgattacaaaggtgtatggaaacattcgaagagcgaaggacatgatgactacgggcttcttgtgagcgagaaggcacggaagtatgcgatagtgaaggagctcaatgagcctgtgagtctcaaggatggaagcactgtgcttcagtttgagactcgctttcagaatgggcttgaatgtggtggtgcatatttgaaataccttcgtcctcaagaggctggatggaaggctaagggaattgacaatgaatccccttactctatcatgtttggacctgacaaatgtggagccacaaacaaggttcacttcatctttgagcataag

SEQ ID NO: 9986 - DNA, 429 bp, Gossypium hirsutum
  unsure (1)..(429): unsure at all n locations
  Clone ID: uC-gsflmaxxa039b03b1
gtgttgacaagaaatgccctggcgagtcccgcttccctgctcaggttcgggtgttaacaaggaaaatctgtgagccacttgaggaggactcctttaggccaattctccaccactacgatggtcccaagttccgccttgaactcaacgtgccggaggcactctccctattggatatatttgctgaacaagatccttaagcaaacatactacaaaggacatacaaatacacaaagataaaggaagggaagaataagtagagagaatatagagagcatatntgggagttttaagacgttatctatggggtgaactgaatgcaaggatccataacctgcgagttgtaaacctttttgctcacaggattgctatggctgccatttatttgttatacagtttgtcttatacataaataatagtgtacttatcact

SEQ ID NO: 9987 - DNA, 396 bp, Gossypium hirsutum
  unsure (1)..(396): unsure at all n locations
  Clone ID: uC-gsflmaxxa039b04b1
attattaacaatggcgacggttcttcttacaacaatcctcttgtcttctttccttgttgtttcatcggctgaaatctcgagcaagattggtataaactatggtcgaatagggaacaatttgccatcaccatatcgaaccatcgagaccgtgaaatcgatgaatgccggccgtattaagctctatgattccgaccctgaaatattgaaacttttatcagggaccaacattcatgtatctgttatggtacaaaacaatgacataatccgtatcgcttcgagccaagctgttgccgaacaatgggtacaagacaatgtcttggcttattaccccgacacaatngattcgttcgtgttagttggtacgaaagtcctaagccaccaagatcgaagaatttg

SEQ ID NO: 9988 - DNA, 307 bp, Gossypium hirsutum
  Clone ID: uC-gsflmaxxa039b09b1
gtttatgctgagcgtttggagcccacccctgataacgagagtgagcatccgcttcctgatgatgaaccatgggggataccacggatagtatcatggctgtagaaggcggtctcggctgtgacacaggtgttgaagcccaatcgtgtgctcccgactgtgctcttacatgcgacgtataactcaatggaatgaagcactgaatacgctatgacacgggaagcctacttgctaactgacctgatccacgctggcgattgctgctgtagctggtgctaatgaccctgtaaatgatgcatttgaaccattt

SEQ ID NO: 9989 - DNA, 448 bp, Gossypium hirsutum
  unsure (1)..(448): unsure at all n locations
  Clone ID: uC-gsflmaxxa039b10b1
tttttcctttttcattaccaagcttcgtaatttcttgcatattatcaaatatttctcataaaacccatctttaaaacccttttaaaattcatttttagcctttttctttaatttttacctttttttttgcttggtgttaactctagatgttaaagccatggatatagctcttgcaagcaccgcaccaaaatcgccagaggctgagcccgagcctgagccagtgagtgaaacaccaactcggatccaacccaccaagcctgtatctttcaccaacggtgttctcaagcgtcacaagccttaccaccaccaccaccactaccaagcgccacccatcgtcataacctacaaagaatgtctgaagaaccatgcagccagcttaggcggccatgctntagacggttgcggtgaattcatgccgtcgccaacagccaccccaactgacccaact

SEQ ID NO: 9990 - DNA, 201 bp, Gossypium hirsutum
  unsure (1)..(201): unsure at all n locations
  Clone ID: uC-gsflmaxxa039b12b1
ttttatgagtttcattttttctttgatttgtttgtgtagagaaaacatagaaaagatttaaaagaacanaaaaaaaaaggataaaaatcagatcagatctttcaaaaaaattttttttacttaatttttaatatcgctactaacatttttttccagaaattcctccacattttcccacaaagttncttcttttacttttat

SEQ ID NO: 9991 - DNA, 458 bp, Gossypium hirsutum
  Clone ID: uC-gsflmaxxa039c03b1
attcatcagatcctaaagcccctttcctctctcattcggccgaactctaatgtcatcttgcaaacaccgatcctgggtttcatcggcgttaacgcctccacctccacctccgccatggtacttgacccgagttacggcaaaacgagaggacacttcctttggttcgatatccaagtcaaaaaacggtctccgaagatcgaaaccgccggtaagtatctctgaaaactctcatttgcttgttttcaacgagaaatattaaaagcaaaataaaaataggcagactatgaatcgaaatcaccttctagtattggttgcttttgtattcaatatgcgtttttttgtgcctgtaaaaaaaaagaaccccttacaattaaaaatcaaaaaggctttatagcccaaatcaaaatgaatattaaaaaggacaacaattttcttttttctgtcctatttgctgctgt

SEQ ID NO: 9992 - DNA, 302 bp, Gossypium hirsutum
  Clone ID: uC-gsflmaxxa039c07b1
tttagaaaccctaaaaacgctccgattcccagaaaaccgaaatgaaaagggaccaatcgcacttaatatttcaataatacgtggagtttttatgtaacaacagcttagcaaaatttaaaaaagaaaaatccccccttctgtctcgatccaggatcagaatttccagtttgtattgatagggttttgagagttaagaatggggattcaaactatgggatcccaaagcaatggacaacagtctcttttacagccatcttcattggtgaggcagaattcatggcatagtcttactcttaatgaag

SEQ ID NO: 9993 - DNA, 372 bp, Gossypium hirsutum
  Clone ID: uC-gsflmaxxa039c09b1
attcgactagatcccttaatgaagttgtaaagtaagttcaaagatcgagagctaggtatttgatatccaaatcattctctgaaaacccaaaaggggggttggattctgtttcgtcggaactatgtcgtcttgctcggaatctacggctatgaaaccggctaggtcactggagaagccaagttttgcccaaacttgtaatttgttgagtcagtacttgaaggagaaaggtagctttgggggtttatctctgggaatgacatgcaacggtgaagctaatgggacaccagtggtgccgtctccgaccatgaatctgttccctgtcgatgacatgtgctttaatgtttgaggcctaaacggagggaattctaagaa

SEQ ID NO: 9994 - DNA, 562 bp, Gossypium hirsutum
  Clone ID: uC-gsflmaxxa039c10b1
tcatactacaacaggtatggaggtggagccaacactctagcagatggttacagcacaggcactggtttgggtgcagaaattattggaacctttgtgttggtttacactgttttctctgctactgatcctaagaggaaggctagagactcccatgtccctgtattggctcccctccccattggatttgctgtattcatggttcacttggctaccatcccaatcaccggcactggcatcaaccctgctagaagtattggagctgctgttatcttcaacaacaagaaagcttgggatgatcattggattttctgggttgggtccatgattggagcagccatagcagcattctaccaccaatttattttgagggcaggaggctgttaagcttttggttcattcagaagcccaacccatgtttgattcatttgcctttccttgacacttttttagaagacccttcaaaaaacacattttttaaattgtgaaatatgtgggaattgtttggtttacctgggttgttaattgtcctctagaggcttcttttttttttcaatttctcctt

SEQ ID NO: 9995 - DNA, 114 bp, Gossypium hirsutum
  Clone ID: uC-gsflmaxxa039c12b1
gtcatttttgtgtagcgattctcagttagtcttttctttaagcttacagagttttataatgggtaaggagaaggttcacatcaaccttgtagacactgggcatgaagaggaaac

SEQ ID NO: 9996 - DNA, 560 bp, Gossypium hirsutum
  unsure (1)..(560): unsure at all n locations
  Clone ID: uC-gsflmaxxa039d02b1
atttatgagcgacaaccggaagtaaaagttgttgatactggtcgaagggtagcagagaaagatgtttatactacagactttgacaaacagccctctactttttcgtcaggttaccctttcaatgggagggaggaaagtggaaaggcttctggcccaacggatagggagagatttgaagtgaatagtaattatggtggttcttcgagccaaagagtttattcatcaaattctcaaaattcagctgatacagaagagaaagtgccaaaggtgtcaccacctcgtagaaaagcaactagagaagaaaaactggaaaagacaaggaattgggcaaagaaagacggaggaggatctgattcgtatgcttcaaactcgaggcaggtgaatgctgttaataataacgaaactaataccattggacatagacaatatgatccagaagaaaaacaggaaaagacgaggaattgggccaaaaaagatggaggatccgattnttctgcttcnacttgaggcaggtgatgctgtaataataatgaactataccgtcggagtagacaattgat

SEQ ID NO: 9997 - DNA, 429 bp, Gossypium hirsutum
  Clone ID: uC-gsflmaxxa039d03b1
cttacgcgtccgggcgagactatctctagcgatcaaatatgttcaggctttacaaaggtttcaaggagctgttagcttcctctgcaacggcgtcggtaccgtcgacagcagccaagttttatgctgctgctgctgcgaaatcagcttctccaaaagtggctcagaaaactccgaaaaagccgaccgcttcaaaacccaagactaaaaaaccagctgctcttcgatccgagactcgacccactgggatttctaaagttaccccggtttctcctgctttgggacagttccttggagcgcaacaagctttccgtactgaagctgttaagcagatctggtcctatatcaaattccaaaaccttcagaatcccaataacaggaaggagatcttttgcgatgagaagcttaagaccatttttaaatggaaagaaa

SEQ ID NO: 9998 - DNA, 445 bp, Gossypium hirsutum
  Clone ID: uC-gsflmaxxa039d04b1
ccttcgcgtccgcccacgcgtccgggaggccatctgggaaaccctacaaccctctcgattcctctccttcgccatcccaaaccctaatcccaccctcaatccctcactcgcctccccactcattcgaatcgctgtcctcgactcaccgattcagccctcctctcctctcattcccagtgtcgccgccatgatcgtccccaagcaccgcgagtccgactggatcttctcgacggagtccggtcatctccaactcctcctctcctcccctaacatccaacgcctcatattaatcggacaagaacaacaaccaatcatcaacggctctagttcatcttccatttaccgccgttggatcgatcccgattccctaaacaacctggagatttcgctaaagccactggtaattgcattatctcctaaaagttacttccataatgaaaacttg

SEQ ID NO: 9999 - DNA, 498 bp, Gossypium hirsutum
  Clone ID: uC-gsflmaxxa039d05b1
gtttttagcaccactacatatacgggattccaatgtaccgtttcggaagaaacctcggaaaagttcaagggattgcccggggttctttgggtgttaccggattcatacatagacgtcaaaaacaaagattatggaggtgataaatatgtcaacggggaaataattccatgcaaataccctacttatcaaccaaaggcaagaaaagaatccaaatatgtgagcaaaaaatacgagagacgaaaagacggccctcctgcaggacagttccgaccaaagcaagcagcaagtcagtcggaatcatcgtcttgacaaggtaccagaaatgctgtttcgagactactcatacttatggtggtctaaagtccagtttttcatcatgcaacttagtttctctcgtttgttattcatcaatgtttcactgctaggaccggtaaataatattcgagctgatatcaaagatttgcatgttattgaaatacatgttctgcgatgtcatgt

SEQ ID NO: 10000 - DNA, 421 bp, Gossypium hirsutum
  Clone ID: uC-gsflmaxxa039d06b1
gtttttaatatctctcaataacaattaacaggttttctattagcttgagctgaccgccattgaagaactaaatcaaagcttgtaaaaaaaatatttgaagttgttaagagttgaaattggggtgaattaaaggtgtgggtgttttttattttaaaagaattgaattgggtttttttcagaatttggattttgggtttgttcttcgtttttctgctatggagtcaaacgcggggacattggagaccagatctaataaaacggcgttggaaagggaggaagtagcggcacttgaatcgctacaatttacagacgaaatccactgtttgatgtcggctccggcgaccgacaatgccagttccttcacggctttgcttgaactccctgctccccaagctgttcagcttattcactctccggattc

SEQ ID NO: 10001 - DNA, 440 bp, Gossypium hirsutum
  Clone ID: uC-gsflmaxxa039d08b1
atcaaattactcttttttttaaaaggaaagaaggaggaggaggaaatggatggaaaaagaatcgagggcaatgaagtttatgctctagcaatgtgtgtaagtattctcctctttgctccgattgttgtgtcacaaccaataccggcagataaatcccaagtggaagcttggtttaatggcattatcaagccggtgaaggaaaggggtacaattttagaccctgaattggttcaagccgagacagaacctagaatcataaaggtgatgcaaggtgggggtggagaattcgataccataaccaaagccatcgagagcgttccatcagggaacgccaaacgcgtgattatatccatcggacctggatcttacaaagagaaattagaattgaaagaaataagcctttcattacattgttaggagatcctaaaaacattgccaaa

SEQ ID NO: 10002 - DNA, 160 bp, Gossypium hirsutum
  Clone ID: uC-gsflmaxxa039d09b1
tcgtagaaatcttcttgattcacattctctctccactgaactcttgctaaacggtatcgttttaggcagtctttcatcaatggcgaaagaaccagttcgcgtcctcgttactggagctgcaggacaaatcgggtatgctcttgtccccatgattgcttgg

SEQ ID NO: 10003 - DNA, 482 bp, Gossypium hirsutum
  Clone ID: uC-gsflmaxxa039d10b1
tttctctgttgctctgtttacttgaggcgtggcttttggctttcattactctctctttcctctgtctcacagtggcagccatcaacaacccatcaatgaaaatgtctgctttgagccaaaaaaagaagagaaagggagatagcgagagccagtctttgtcttcaaaatgtcttctccttgtttttttcacatgattaatcatggacgttgttgccattaatactctctttctctttcactttgtatccagcttttgacatcctttgaagcagacaatatcattcatatcccactgatcgattctcttgtttcttccctctcttcttttctattcttttcttttttcctttattttattaagtttttcactctataaagccatatggatatgtgcgttaaattcccagaagattatcggtaccgaaccaggagagaaaacccatctttctcttccactctccttgattctatctaccgttcga

SEQ ID NO: 10004 - DNA, 477 bp, Gossypium hirsutum
  Clone ID: uC-gsflmaxxa039d11b1
ttttcgcgtccgcccacgcgtccgcttcctcttccttcctttctcaaaattccttttggtggttggagtgcttttgattttcgccgttcttcctattgatcataacagtaaatttgggctgagattggccaggtatatatgtcagcacatgtccagttattttccagccactcttcacgttgaggacatcaacgacttccatcctgatcgtgcttacgttctcggttatgccccacattcggtgttgccgatcggagttgttacgttggctgaacgtacaggtttcatgcctcttcccaaactgaaatgccttacctccagccctgtattctacacaccatttttgaggcatatatggacgtggttgggtgcttcaccagccacaaggaagaacttttgttccctgttggaagctggttatacttgtatagtagtgcctggaggagtgcaggagacattccttatgccgcatgattc

SEQ ID NO: 10005 - DNA, 484 bp, Gossypium hirsutum
  Clone ID: uC-gsflmaxxa039d12b1
ttttatttctcgcaagcagcttccgccgcagggaaaataataatggaggcagcgagaactgtgaaggacgtttctccccacgagttcgtgaagggctacgccgcccacctcaaacgctccggcaagattgagcttcctccatggaccgatattgtcaagggtggtaaattgaaggagcttccaccgtacgaccctgattggtactatataagagctgcttccatggcaaggaaaatctacttgaggggaggtcttggtgttggtgctttcaggaggatatatggaggagccaagaggaacggtagccgcccacgccatttctgcaagagcagtgggtctattgctcgtcatattctccagcaattgcagaatgtgaacatcgtcgatcttgataccgaaggtggtaggaaaatcacatcgaatggccaacgggatctcgatcaagttgctggaaggattgcagttaccctctgagaaatttcac

SEQ ID NO: 10006 - DNA, 421 bp, Gossypium hirsutum
  Clone ID: uC-gsflmaxxa039e01b1
ctttttcgtgggcggacgcgtgggtgacaagcttactcatgtgtacactgcgatcttgaagcctgacaacgaggttagaattctgattgatggagaagagaaaaagaaggctaacttcctctcagctgatgattttgagccaccacttatccctgctaagacgattcctgatccagacgataagaaacctgaggactgggatgagagagccaaaattcccgacccaaatgctgtaaagccggatgattgggatgaggatgctcccatggaaattgaagatgaggaggctgtgaaaccagaaggatggttagatgatgagcctgaagagatagatgatcctgaggcaaccaagccagaagattgggatgatgaagaggaccgtgagtgggaaagccccaaaaatgataacccgaagtgtgag

SEQ ID NO: 10007 - DNA, 423 bp, Gossypium hirsutum
  Clone ID: uC-gsflmaxxa039e03b1
cgcaattcccgggtggccccacacgcccctgatactggcagaacattgaaataccaccaagaaagaggaagtaaaagaaagttcgcttcagattattgttttgtttggattgtaatatctgaaaaaaaacaacttgctacgcccttgccccgttgggacttctcacaattagggtcaccaccaagctacaatcttacttttcgtgataagatagcgtctagcagtgatccatatgttgtcatcaccaccactcaacagaaagtgaaaacaaatgtggtgaaaaaaaactgaaatcccgagaggggtgatgaagtgagtctttcaatcaaagatcttaatgatccaatcgagttaaccgtgttctacaaagacacgttgggtgcggatgatcctatgggacctgcagagattgacttaaaacca

SEQ ID NO: 10008 - DNA, 443 bp, Gossypium hirsutum
  unsure (1)..(443): unsure at all n locations
  Clone ID: uC-gsflmaxxa039e04b1
ngtactaatccacttcctcaagagaaccaaaggggaaaatttatgcagaacgcaggtgaagacagatcaggaaagaaaattaaagtcgggttggttacgggttttcgagctttgtgcgtaaaacatggtgtataagtaacgcaatgactagcattatggatgcaaaacatgacaagtatagcatgattaatttcgaagagacggagttacgttgtaggattacacacaggcattgaaaatgatgatgaaaccgccacaaataatgggaaaagagggtattcggatatggttgatttgaagcttaacctttcaacaacaaatgaagtatcaatggatgaagctgaaaagatgaatgagaaaaacaactgtaaaaacttcgtgtaggcacatgtggtacgatggccactggtcaagttctttttgaaaaacatcatgaccggtca

SEQ ID NO: 10009 - DNA, 510 bp, Gossypium hirsutum
  Clone ID: uC-gsflmaxxa039e05b1
tttataaacaaattactctttttattaaaaggaaagaaggaggaggaggaaatggatggaaaaagaatcgagggcaatgaagtttatgctctagcaatgtgtgtaagtattctcctctttgctccgattgtcgtgtcacaaccaataccggcagatatatcccaagtggaagcttggtttaatggcattatcaagccggtgaaggaaaggggtacaattttagaccctggattggttcaagccgagacagaacctagaatcataaaggtgatgcaaggtgggggtggagaattcgataccataaccaaagccatcgagagcgttccatcagggaacgccaaacgcgtgattatatccatcggacctggatcttacaaagagaaaattagaattgaaagaaataagcctttcattacattgttaggagatcctaaaaacatgccaaatttgacatttgacggcaccgccaagcaatatggaaccgtagatagtgccactcttattactgag

SEQ ID NO: 10010 - DNA, 501 bp, Gossypium hirsutum
  Clone ID: uC-gsflmaxxa039e06b1
cctactcgtccgcccacccgtccgcccacccgtccgcaagcacattgctaaccttgccggtaacagcaagttggttcttcctgtccctgctttcaatgtcatcaatggtggttcacatgcaggaaacaaacttgctatgcaggagttcatgattcttcctgtaggagcatcatcctttaaggaggccatgaaaatgggtgttgaagtctatcaccatttgaagtctgtgattaagaagaagtatggtcaagatgcaaccaatgtcggtgatgaaggtggctttgctcctaatatccaggagaacaaggaaggacttgaattgttgaatactgccattgctaaagctggttacactggcaaagttgttattggaatggatgttgctgcatctgaaatttacggaacagataaaacttacgacctgaacttcaaagaagagaacaatgaccgtaaacaaaagatctcaggagatgctttgaaagatttatacaagtcattcgt

SEQ ID NO: 10011 - DNA, 69 bp, Gossypium hirsutum
  Clone ID: uC-gsflmaxxa039e07b1
tcgtccatggggtggaccacgagatccagcagatgggtgtttaaagtggaacatcccgccttcttctac

SEQ ID NO: 10012 - DNA, 496 bp, Gossypium hirsutum
  Clone ID: uC-gsflmaxxa039e08b1
tatcactgcaagaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaaaagcccaccctcggcacctgaacagccaggcacttgccccagagatgcactgaaactaggcgtttgtgctgatttgttgggctcagtgcgcgttgttgttggaccgtccaggaccaaatgctgctctctcatttcgggtttggctgatctcgatgctgctgtttgcctttgcactgctattaaagctaatgtgttgggggttaacctaaacgttcctcggtcattgtctttgctctcaaatcctgcgaaaagcaaatgcctgctggttacaaatgtgcttaagctcatttccactgtttcctcagaatagttggggttttcttttacgggttctttttttt

SEQ ID NO: 10013 - DNA, 507 bp, Gossypium hirsutum
  Clone ID: uC-gsflmaxxa039e10b1
tttctattttctttttgttttgaaactttctctcttccattcttcatctcctgaggctttcctagtctggctcgctcaccccatcataccgtgtttgatcctcagcatactcgggaactcccatttccaggtatatttcctctcttcttcttagcgtttctgttgcaagaatatgtgcaagattgtttgcagatcttggtgtatgttgaaatctgatattatttagtccatgtattttctgttggatatcataaatgtatgcccctaccattgatcgatcttgaccctttgtgctacatttcttgattattgcgagggaatctccttcaaagatgagtgactgccatcccttttcaactcctacttggactgctttccaacaggctattgcttcagcagcaaaagcagatgatatgtcatcgtggatttctgaacaagataaaagaacttttccttccgaatctctggccacaatacttgaagctgaccgattttggctctcattat

SEQ ID NO: 10014 - DNA, 481 bp, Gossypium hirsutum
  Clone ID: uC-gsflmaxxa039e11b1
cttggaagggtgaagattaaaacatttatcaatgcttgcggcaacgtaaaccgattttccaaggcggaccataaaaaaagaaaagaaaagaaaaaagcagtaatggcggtggcaggcggtgtttgtcgcggcggaaacgtttgcctccggcgccgcgattctttcaatcttttcaacttccataatcagaatgctcgcccacgttgtttcatggtctcaggttcacaatcgtcatcgggatcaagaaaagaaaagatgctggcgtcgtctaaggtaagaagagtaagccttcttcaaccattgttgaaacaagaaaagacgagagggaaggaattgtcgtacgagaaaatagacgagtggatgagagattctgtggcggacatcgtgaagaggttgccggaatctcctttattggtccaggtgttctcccgacgtaaaaataacaccacgagaacaaggacggaaaaggccgtggaagata

SEQ ID NO: 10015 - DNA, 448 bp, Gossypium hirsutum
  Clone ID: uC-gsflmaxxa039e12b1
tgtggacgcgtgggctgaaaactccgatcgacaatgtcaggattggaccgtttgcaaaggatgttcgccggtgctggcggcgctttgggtcatccgccgccggattccccgacccttgattcttcggagcaggtctatatctcctctctcgccctcctcaaaatgctcaagcatggaagagctggagttcccatggaagttatgggtttgatgttgggagagtttgttgatgagtacactgtgcgtgtcgtggatgtctttgcaatgccacagagtggtaccggtgttagtgtcgaagctgtggatcatgttttccaaacgaatatgcttgacatgctcaaacaaactggaaggccagagatggttgtgggttggtaccattcacatccaggattcggctgctggctttctggtgtcgacataaacacacagcagagtttttgaagct

SEQ ID NO: 10016 - DNA, 549 bp, Gossypium hirsutum
  Clone ID: uC-gsflmaxxa039f02b1
cttaaaacaaaatatcttttttcactcagatatttgattactcacagcttaaaaatcttcaacatttgtagagaagctgcaaagccatatcccttccatctttgaaaacaagaaacgacaatggaaagcgaaacagcaagacgcagaatcagcaacattgcatcccatttttcaccctgtgatgatactttatctgtttctcaccttcttcccatgaactgtagtgggagatgtgataatagaatgtactttgcacgtcaaggttcagcatttcaagcttgcttcatgagacaagtttcaagaccagagagaactgctcctcagtgttttgcacctcccaaatccgtttccactccattggagagttctaatgctattgaagcaccattattttctagacctacaatgatggattcaaacttgtcaaatttatcaaaaatagaacctctgggactaagatggagattatccatgcctgacccttctaagtttgctagacccaaataaaatacaagtgataagatgccattcaatctaagaagaatcatg

SEQ ID NO: 10017 - DNA, 479 bp, Gossypium hirsutum
  Clone ID: uC-gsflmaxxa039f03b1
ctttttcgtccggaggattcccagcagcaatcagctggatggagagactcctggaacaaggaatgttttcgagaaggtggtagtcggacactctcctaggcgaccaagacattcaaggaagttttcaatggatagtacaaattcattcatttctagggagatgggttcagagtttatcagtgactctcctaggtgtaactttggttctcccaggtttaataccagcttcaagaagatggaatgagcttccgaaatggatgagatttctagcacaagaagaatggataatgcttcacaagttggagatgatatgactgacagagtgtatactattgattctgtccataatggagtgccatatagtggaactagagatcacaaatctgggtttggaatttctgataattatgcatacactccaagggaggcatttaatctaccagatgtttgtgatcctgatatcaagaagctctacatga

SEQ ID NO: 10018 - DNA, 435 bp, Gossypium hirsutum
  Clone ID: uC-gsflmaxxa039f04b1
tttccttttttgctttatttttcccaataccggagaatcttttaaacagctgtatttgaactgatttgaaaccctagcatttggatccactttgaagttttagatgtgaagcaagcttctctctttggaaagatttttttttggatttggttgcatttgggggttgaagtggtgagaggaagtgtttgaatcggagatggcggatattgacggcgaagcggtggaagtaggaaacaatgcgaggagtgagtcgcctgtgagggtgacgtcaagctcgacgggagtacctccgtcgctgacggtgtcagcgtcgtttaaagagagtggaaggaaaggttcgtcgaggaggaaagctgttagacctagctctcatgcgggtaatgagttcattacgcttgtttacgggtcggatccggagaaagtagagcttcaatc

SEQ ID NO: 10019 - DNA, 472 bp, Gossypium hirsutum
  unsure (1)..(472): unsure at all n locations
  Clone ID: uC-gsflmaxxa039f06b1
tttgtttnacatcctatctctttctttcgaccaaagactcagatccacgcgtgaatctttgttccagcttgttagaatggagacatttctattcacatctgagtctgtcaacgagggtcaccctgacaagctttgtgaccagatctctgatgctgtgctcgatgcctgccttgcccaggaccctgacagcaaggttgcctgtgaaacatgctccaagaccaacatggtcatggtctttggagaaattaccaccaaagctaatgtagactatgagaagattgtgcgtgacacgtgccgcaacattggatttgtttctgatgatgtgggtcttgatgctgacaactgcaaggtcctggtcaatattgagcagcagagccctgatattgcccagggtgtccatggccactttaccaagcgcccagaagatattggagctggtgaccagggccatatgtttgttatgccactgatg

SEQ ID NO: 10020 - DNA, 366 bp, Gossypium hirsutum
  unsure (1)..(366): unsure at all n locations
  Clone ID: uC-gsflmaxxa039f08b1
gttaattactaaccctagagaatggacaaagataaacacgcaaccaaacgctcccgagaccgcgacggccggcatcaccgtgactccgatcaccaccacgacagccgcgattcccaccggcgatcggatcatagatcttccacatcgcgccgtgacgagcgcgagagatcttttgagagggaaggatcgagagataggaagcatcgcgagggttcctatgaagaagttgaagcgaagaggaagaggaaagagagggaagagagtgaggagaggggggagaagaaggantnaacttggagaagaaaatagaagagaaaagagagagaggcggaggattggggataaggctaaagaagatgatgaaat

SEQ ID NO: 10021 - DNA, 484 bp, Gossypium hirsutum
  Clone ID: uC-gsflmaxxa039f09b1
tttcagttgagctgtcaacacttaacagaacagaaaatacttgaaatggcagctaaataattttcaagtgttgaagtattgaagctgtctgtgttctgtttgttttttgaaatctgatgtctccgccgcttcttggcgtggaggaagggggtcagaacaatgtgactttactgggttcttctggctctatggatagtgtgtgccagaataatgctgaattgaaggaacgcaattacatgggcttgtctgattgttcttctattgatagctctgttgtcacccctggttctgacgatggcaacgtaagtacgaatctgaaggcaacagagctcaggcttgggcttcctggatcacagtctcctgaaagaaatcctgagctttgcttgttaagctctgctcaacttgatgagaaaccccttttccctttgcatccttcaagtgatggtcactgctttccatctcaaaagactgtagtttcaggcaa

SEQ ID NO: 10022 - DNA, 395 bp, Gossypium hirsutum
  Clone ID: uC-gsflmaxxa039f10b1
tttaaacggagtaggtatccttggatctcctgatttggttggacatggtggcacccaaagcattaaaatttctccattgatgaaaaaaaaaaaaaaggcctgtgaagaagggtagaagagtggtatggcttattttctaaactcgctgttttccttttcatcttttataagattatggttttcttggtcatctggtacacttttcttgacgttttgaaactttttatggcattgtaaattgctttacttactctattcgtgtcactttgttcatactttccttttttctttttcatttttaggaaatttatattcttttgtttcactttcccttaaacagtgtgacctattttatagtatctatttttaattaataaattgttgagcttaagctc

SEQ ID NO: 10023 - DNA, 479 bp, Gossypium hirsutum
  Clone ID: uC-gsflmaxxa039f11b1
tttattttcccatataagaaaagattctgagaaaatggtgcccaaatcattgatctatgcatttgtatctcgtggaggagttatattagctgagtatactgaatacagtgggaatttcaattccatagctcttcaatgcctccaaaagcttccttcttcaaacaacaagttcacttacaactgtgatggccataccttcaattatcttgttgacaatggatacacttattgcgttgttgcagatgaatcagctggaaggcaagtgccgattgcttttttggagcgtatcaaggatgatttcgtgtcgaaatatgataacgggaaggctgctacagctcctgccaacagcctgaacaaggaatttggaccaaaactgaaagaacatatgcaatactgtatggagcatcctgaagaaataagcaagctggctaaggtcaaagctcaggtttctgaagttaaaggtgttatgatggagaata

SEQ ID NO: 10024 - DNA, 511 bp, Gossypium hirsutum
  unsure (1)..(511): unsure at all n locations
  Clone ID: uC-gsflmaxxa039f12b1
tttttcgagctaagaaagaggcagaggagaaaaatggagaatcaagtgctagtggcacttctaagtctggaaaacgacatgttaaacctgtagacccagatccttatggagaaagattattgaagactgaggatcctttgtcagaagcaactaagtatttgaagttgcttcagaagaattcacctgattctttagagacgcacttgctttcatttgaagtcaatatgagaaagcaaaagattttgcttgcctttcaggctgtaaagcaattgctaaggttggatgctgagtatccggattcacatcgctgcttgattaaatttttccataaagtgggctcaatgcctgctccagcgactgatgcagaaaaacttgtttggagtgtcttagaagctgagcgaccatccatctggttctctttgaaatggctntatgatatcaatttcaggagaaaactcttactgaggcaaatgaaattttccttcgtaaacatcaagattctttgatgcat

SEQ ID NO: 10025 - DNA, 542 bp, Gossypium hirsutum
  Clone ID: uC-gsflmaxxa039g01b1
tgtgttttgcctctcgtttgctttctgcttctctactgcttaagaggtaagtatcatggacctccaaagagtttcccacttgttgggatgataccacagtttctcttcaacattcctcgactgcacgactggtttaccgacacactcgagatatgtcactgcacttttcttttcaaagggtttgctaagatgaacgtactggttacctgcgatccttccaacattcactacattatgagttccaactttaacaacttccccaaaggacctggattcaaacagatttttgacatcttgggagacgggattttcaatgtggatatggatttgtggagaaaacaaaggatagctgctcaagggttcatgaggcatcagctgttctaccggtttttgtcaaggactaccggagccaaggtggaagaggggctcattcctcttcttgaccatgttgccaaacgaggtttagttgttaacttagaagatcgttttcagaggttcgcatttgatgctacctgcatcttggttactggctatgaccccga

SEQ ID NO: 10026 - DNA, 263 bp, Gossypium hirsutum
  Clone ID: uC-gsflmaxxa039g02b1
ccgcgcgggccccggcgcggtatccggggggagccccacgcgcgctgtgtttgggcgcccaatagataaccgcatatgacctgggttaaacgaaatatggatgtaaccctctcgagcatcctacacagcaacatcatccttcattttctctagaccacgccggactttgagctctggcatcgaacgcactacggaggtgcgacggacattcttatggctgggggagagaccaatatactaccctgattgcgggaaagagaccg

SEQ ID NO: 10027 - DNA, 344 bp, Gossypium hirsutum
  Clone ID: uC-gsflmaxxa039g03b1
ctctttcgtccgctgagggtgcactagtttgcggtgctgataaattcagtagtactgaagatggcttcaaggaggaagaagcattcgactcaaatgagccaatgaacgaaaacttccgagatgaggatgacgagaatggcagtgattttgccaaaagggcatgaactaaatctgtctttagtagtaaaattgttttggtttttagttatatcgtcatcacttttgaaacaaatttttatttgatcaaatgacgtgagctattgtctttgtaaaacttaatactttctgaagtctccttccatggagaactgaaatccttatgggaaaaaataattttatgttca

SEQ ID NO: 10028 - DNA, 98 bp, Gossypium hirsutum
  Clone ID: uC-gsflmaxxa039g04b1
ttttagggtggtacacattttttcagtaaaccaaaattttaatatccagtgcactacactcaacctcagatagccacaacagtgtgcccagtcatgtg

SEQ ID NO: 10029 - DNA, 388 bp, Gossypium hirsutum
  Clone ID: uC-gsflmaxxa039g05b1
attttcatcatcggttttaagttttcagcgctgattcttaaatatctggttgtttttctgttgggaaataaaagttgggtcggtgatgatgaagggggaacctgctttaccttcttattataacgttctgggggtcaaggttgatgcttctattcaagatatcaagcgtgcttatcgaaagcttgcaatgcaatggcatccagataggtggacgagaacaccttctctattgagtgaagctaagcataaattccagcaaattcaagaagcctattcggttttatcagaccagaggaagagaactctgtacgatgctgggttatatgatcctgaagatgaagaggatgagggtttttctgattttatggaggaaatgatctctctcatg

SEQ ID NO: 10030 - DNA, 183 bp, Gossypium hirsutum
  Clone ID: uC-gsflmaxxa039g06b1
gttttcccttttttttttttttaacgaatcgaagcgacaaagggctgaatctcagtggatcgtggcagcaaggccactctgccacttacaataccccgtcgcgtatttaagtcgtctgcaaaggattctacccgccgctcggtgggaattacgctccagggaggcgcccgcgacttgtccgcc

SEQ ID NO: 10031 - DNA, 345 bp, Gossypium hirsutum
  Clone ID: uC-gsflmaxxa039g08b1
gttaactaatcgtcgtttcctttttatcatcttctctagatccctttacctctccaataaatactttcaaacaccaaagacaaaaataaaggcttcagttttctaaagactaaagaagatttttttttctttttttttaaattttcagtttggctttttgcagattcaaatggttgtgggagagatttaaaatcctacactgtttgggggaaagagacagagagataggcttgctctgctatgggtctttgcacttccaaaccatccccaaacccttcttttcctcctgattcaaggaatactcctatccatccccccgataaagatatccaccataagtctaac

SEQ ID NO: 10032 - DNA, 466 bp, Gossypium hirsutum
  unsure (1)..(466): unsure at all n locations
  Clone ID: uC-gsflmaxxa039g11b1
ctcacgcgtccgaccaaataaaaacatggcaccacaccttaatattgttccttccatgtttgtacttttattattattcatttcaacctctaaagttcaatcagatgcttttgatgttgttgccaagtttggcgcaaaagctgacgggaaaacggatttgagtaagccatttttggatgcttggaaagaagcatgtgcctctgtaactccatcaacagttgtgattcctaaagggacatatttattatcaaaagtaaacttagaaggtccatgcaaggctcctattgagattaatgttcagggcactgtacaggctccggctgatcctagtgctttcaaagaccctaattgggttagattctatagtgttgaaaatttcaaaatgtttggcggaggaattttcgatggtcaaggaagcattgcttatgagaagatacttgcgagaatcgngaatttcgttccaaac

SEQ ID NO: 10033 - DNA, 324 bp, Gossypium hirsutum
  Clone ID: uC-gsflmaxxa039h01b1
gctcccacatctaagaaacgaagcattctgtctgttcctatctatataagaaatctgtaacaaggaaagaagaacgaaaattatatgattttttgaggctttgctaagaataaattgaaagcactggcaaacaatgttgctgttatcgagatctgttcggtgttcttgctggcagcaagtggtggcatcagcggtgggtgttacgcatttaaaaaacaatggtgattccaaaagcggagaactatcccgttcgacgaaagcagtgcaaactgtttgttgacccgcacagctcaaagaggcatgccataagagcctggagtcatc

SEQ ID NO: 10034 - DNA, 496 bp, Gossypium hirsutum
  Clone ID: uC-gsflmaxxa039h05b1
cttactcgtccgcggacgcgtgggcttttgatgcagcaagaatgtcatgtgatgatcccagatattcttttgatgaaccaagagcttcctgcgatggatatctgatggggagaatgttcccaagaatgcccacaatggtttccgttgcggaagatgctccagttcatcatgttatgaggtctgatactcagatccctgtggaggacccgacggctatgaattctgttactgaggaggatgaatcgcttcctggagggtcagctcaaacaagggattattattctgattctaggagaagaaaaagtcttgacaggtccagttctagtaggaagactgctgcagctatagtggctgaaatggaggaaatgaggtcggtttctagtacaaaggtttcccctgcaactgttgattacacccatggacctaagcctgtcattcctgatagggattccagggattcaaattctttgagggatgattattcagacacttttga

SEQ ID NO: 10035 - DNA, 369 bp, Gossypium hirsutum
  Clone ID: uC-gsflmaxxa039h07b1
tttatccctctaattttaaagctaagagatttaagttaacgaagcatttggtcggttcgaagtaatggaaactaccggaaaagtaaagaagggagccggaggaaggaaaggtggtggcccgaagaagaagcccgtttcaaggtctgtcaaagccggtctccagttcccagttggtaggatcggccgttacttgaagaaaggaaggtattcacagcgggtcgggaccggagccccggtttacttggctgcagttcttgagtacttggccgctgaggttctggaattggctgggaacgctgcacgtgacaacaagaaaaacaggatcatcccaaggcacgtgctacttgccgtgaggaacgacgaagaatt

SEQ ID NO: 10036 - DNA, 552 bp, Gossypium hirsutum
  unsure (1)..(552): unsure at all n locations
  Clone ID: uC-gsflmaxxa039h08b1
tttcacttcctctccacccttcacaatcctttcgaagaaacaaatcgttctatccggtcacctacacatcttcctcgccggagtaagtgaaagagttccgattctctcgagccacgaacaactctagcgtgtcttggtcgagaccccagccagcttcccttctaaaatcctccgttgccagacaatgcgcagatctgttcgccgaacgtgaaacttagataatgaatcaccctccaccatcacctccctcaaccccagatcccccccccactttgagcggttggaggcatgcaagagcttcggccgcgaaaggtgaagatattgatgtggtagcctggaaagcggcatcaaatttgatttttataaaagggactttcggtggcctgcacctctcgcaccccaccttggtgacagaccaaagagaccaaactgcacaaacaatctttcgacagatgccaggtttcaattgcaaacagacagttgcgaaaaccatccttcaacgtctnctcacttctcaagcattttgggcaagtcgctgctccaccaatcttt

SEQ ID NO: 10037 - DNA, 402 bp, Gossypium hirsutum
  Clone ID: uC-gsflmaxxa039h09b1
gcgtttatttcaccgtcaaagctttttcccctcaggttcgagctctgaaatggcaaccgagaataacagatccagggtcggatctggatccggatctcatactgtcaacggcgacgcggctcctgaccgcaagatcgcgttgatcactggcatcaccggtcaagatggttcctacctgaccgaattcctgctcaacaaaggctatgaaggccatggcttgatccgccgctcttccaacttcaatacgcagcgtatcaaccacatctacattgatccacataacgcccacaaggctcggatgaagctccattacgctgacctcaccgacgcttcctcgcgttcgcgctggctcgatactattcgacccgatgaggtgtacaatctggcggctcaatctcacgt

SEQ ID NO: 10038 - DNA, 569 bp, Gossypium hirsutum
  unsure (1)..(569): unsure at all n locations
  Clone ID: uC-gsflmaxxa039h12b1
tttcaaaccccaaagaagacaagcccaagctgccatgtagccaccgccaacggtggccgacggagggtggtccattcggattctaaccccgttcagacttgcgatcaagaatctaacctctatgatagcaaggaatcaaaaagatagtatcaccctctttattagatttggtttcaacagagaagaaactccgatatataccaacggtctacgattcaggtgagttacccgcttttatccttttcttttctttttataaacagtccaaaaaaaatgaaaaaagaaagaagaaccacgcaaaaaaaaaacagtgaaatattgggtcgaatcgaaagagaaaaaaaaaggaacaatcacctctttgctttgaaaatttttgattaatattctgtaacctcttttttgtatttcaaatctcttttttggattcaaaataaagaacaaaacccccaaaataccaaatcgttttccccgttccaaatgatagattcaggctttttaaagccgatctaccaaacattcattccatattntttttggttttgggtcctttggttatttttttccca

SEQ ID NO: 10039 - DNA, 356 bp, Gossypium hirsutum
  unsure (1)..(356): unsure at all n locations
  Clone ID: uC-gsflmaxxa040a02b1
gntttctactcacacggacgggagggagacgagaaaaggaagacaacgatggtgtctctgaagttacagaagcggctcgccgctagcgtcctgaagtgtggccgtggcaaggtttggcttgatcctaatgaaatcaatgaaatctccatggccaactccaggcagaatgttaggaaacttgttaaggatggttttatcatccggaagcctaccaagattcactcccgatctcgtgcacgcagaatgaaagaggccaagagaaagggtcgtttttctggctatggatagaggaagggtaccagtgaggctcgattgtctaaaatgatttctttggttgagggtgaatgcctgttcta

SEQ ID NO: 10040 - DNA, 470 bp, Gossypium hirsutum
  Clone ID: uC-gsflmaxxa040a07b1
ttggcttctatcttagaactatcacaggacatggtcaaggatcaaacatacttcctttcgcatctctcacagttccagctcaaacaacttattttcccacttggatgtctctcaaaggatgaagttcgccaactagctgctaaatttgacttgcctaacaaaggtaggaaggattcacaaggaatttgctttcttgggaagataaggttcagtgattttgttgcaaggcatattggggagatggaaggaatcatattagaagccgagacaggagatttccttgggaaacatagagggttttggttctacacaattggtcaacgccaaggcctacgtctccctgggggaccttggtatgttgttcagaaggatgtaaaaaataatgctgtatttgtgtcaagatattatttctcgttggacaaagaaggcgtgtgtttcgtgttggctctttgaggtggtttagtgggtca

SEQ ID NO: 10041 - DNA, 480 bp, Gossypium hirsutum
  Clone ID: uC-gsflmaxxa040a08b1
ttatctcatatctctcctttgtttccccttttctctctcttttttcaaccctaaccctacctcaccaaccaggattcaacatgaagggaggaaaatctaagtcagatactaagagtgccaagctatccgtgaaatccaaagctggaaagaaatcggggaaggctgccaaggatccaaacaagccaaagaggcctgctagtgccttcttcgttttcatggaggagttccgtgagcaatacaagaaggatcaccctaaaaacaaatccgttgccgctgtcggcaaagctggtggagataaatggaagagcttgtctgaagctgaaaaagcaccttatgtagccaaggcagaaaagcgaaaggtcgagtatgaaaagaacatgaaggcctacaataagagacaggctgagggtcctaaagacgaagatgttgagtctgacaaatcagtgtctgaggtgaatgatgaagatgatgatgaaaaag

SEQ ID NO: 10042 - DNA, 530 bp, Gossypium hirsutum
  Clone ID: uC-gsflmaxxa040a09b1
gctttactctgtcgtatctctccttctaaaaccctacttatctcctcctcgcaaaaccctagccccttccttttttctttcgtagtaatcatccatggagttctggggtattgaagttaagtctgggcagcctattaaagcagatcctggtgctaactacgttatccatctttcccaggcttcacttggagagtccaagaacaaagcagaatccgttccactctatgtgaatgttgatggaaagaaacttattctgggaaccctttcccaccagatttgccctcaattatcttttgatttagtatttgacgaagagtttgagctctcccacaactggaaaaacgggagcgtatatttcctcggttataaaactttcataccagaggaaggtgatgattttggtatgtctagtgaagaagaaagcgaggaggaggaagatgaggagcttcctgtcgctgctgctgctgctgctgctgcagtaaatggaaaaggctagccagatgcaaaaacagcccaagctaatgctggga

SEQ ID NO: 10043 - DNA, 495 bp, Gossypium hirsutum
  Clone ID: uC-gsflmaxxa040a10b1
tcggtcttctccattttccctcctctcaagtacctaatgtacactccatcgtttcactcgctgcatcacacacagttcagaaccaactactcattattcatgccattctacgattatatctatgatacaatggataaatcttcggataccttgtacgaaaattcactcaaaagaaaagaggaaacgcccaacgtggtgcatctaacgcacttaaccacaccagaatccatctatcatctccgctttggatttgcctccttggcctctaaaccttactcgtcagcttggtacttgtggttgctctggcctgttacattgtggtccatggtgcttaccaggatttatcgtcgaacttttgttgttgaaaggaaccgcttccatcagctcagattacaaacatgggccattcccaagtacggaatacagtaccgcttgatatggcaaaaggaatccgtcaataacatgattgaggaagctgtttaaaggctgaggaaa

SEQ ID NO: 10044 - DNA, 327 bp, Gossypium hirsutum
  Clone ID: uC-gsflmaxxa040b02b1
tcgtttttacagggaggctatgcgcaaggttctgaagttccatctcactcgggcacaagatcggatgaaacagatggctgacaaacgaaggtcggaacgcgaattccaggtaggcgatttggtttacttgaagctgcaaccatatcgtcaacattccttgcataagtttaaaaatcaaaagttagcacctcgatactttggaccttttccggtagaagctcgagtcggccaaattgcttacaaactctcgctgccatcatcggcccgtattcatcctgtttttcatgtctcacaattgaaaaatcatataggctcagcagtgagtgc

SEQ ID NO: 10045 - DNA, 540 bp, Gossypium hirsutum
  Clone ID: uC-gsflmaxxa040b04b1
tttcacgcgtccggcgtttattcagagtatctcggaagtcctcgatccttggcttgacaagctcacaaattgaaattgcctagttctttttcagccacaaaaaaaatataaaaaataaaaataactaggtacaatttgtttgcattcacataatgaagagtccattttttttttggactacaaattgtgggaatgtagatatggcttatccaagggcctaaagctttcattattcggtttttttttttctttcttccttttactctgtcaattaatacttgatatatcctatcagtatatcgaacagagtcaaagataatcgagttgttactcttctaagacactccatagatcacaggattatagctcaaaaatgagcaataaaacttgtacatattggtcgcttctattctggaggtgtgtaaacctttattgttcagcattttgcagcgaaaagttatctcactgggcccgtttttcctaactcttcaggttgatttgtattcaacattattttacgttgtataacatttttttttg

SEQ ID NO: 10046 - DNA, 353 bp, Gossypium hirsutum
  Clone ID: uC-gsflmaxxa040b05b1
atcctctttactttctcatctcatcttgatttcccttttagcttttaacgaactcctttctttctctagatctctcgtccttccatctctggttttctttttatcttacattaatataatcaatatctcatagttctttccttgttgttcctcttattcgtgtgtttttgaatgctcatcaacatcttgtccctgatgtttgaggactcatgtctcccgtactcagtgaaatcctcctttctgggtttatgataaactctactctgaggcgcaggacccatcttgttcaatctttctctgttgtctcctttactggttctacgttttttcatgaactctctctctctctctcc

SEQ ID NO: 10047 - DNA, 455 bp, Gossypium hirsutum
  Clone ID: uC-gsflmaxxa040b08b1
ttgttaaaagatttggcatcatactttttacaacgagcttcgtgttgctccggaagaacaccccattttacttaccgaagcccctcttaaccctaaagcaaatcgtgagaagatgacccaaattatgtttgagaccttcaacgcacctgctatgtatgtcgccattcaggccgtgctctctctttatgccagtggtcgtaccaccggtattgtgttggattctggagatggtgttagccacacggtccccatatacgagggttatgccctcccgcatgctattcttcgtatcgacttggctggccgtgacctcaccgataaccttatgaaaattttgaccgagcgtggatattcattcacaaccacagccgagcgggaaatcgttagggacgtgatggaaaagctatcatacattgctctggatttcgagcagggaatagagacctctaaaacaa

SEQ ID NO: 10048 - DNA, 464 bp, Gossypium hirsutum
  unsure (1)..(464): unsure at all n locations
  Clone ID: uC-gsflmaxxa040b09b1
tccacgcgtccggcgagaagtgagaaactattgtaaacctctcataatattctgagcttttttctctttttgtttcctataattttgatctgagccaaggttgataatcgagtttttataagcggttgatcctggcattccaaaatttgaattgtgtggctgaatgatctatggagactaagggagggaaaaagaagtctagtagtagtaagtcattattctacgaagctcctctcggttacagcattgaagacgttcgaccaaacggtggaatcaagaagttcagatctgctgcttactccaactgcgctcgcaaaccatcctgatattcgtaacgcaagtgcccccttctgaccactgttaaagtggtcaatttatttttatttgctttattacttaggattaatatctatcttcggccggcttnctccccctctcttcttgcaactgttttctttgtatct

SEQ ID NO: 10049 - DNA, 131 bp, Gossypium hirsutum
  Clone ID: uC-gsflmaxxa040b10b1
tctctttcttaattgtagaaaatggaatgttgcatatccttgtcttaagtgttgacagtaaacatgtcatttttagttttgcaattaaggaataaaatgagatcagcatatgtggctgaagttgacgtgtt

SEQ ID NO: 10050 - DNA, 550 bp, Gossypium hirsutum
  Clone ID: uC-gsflmaxxa040b11b1
tttctcccgcaaaaccctcacgacaaaagaattctcttttctatttttcaccactctcctgcaaaaatgtttcgatccgttgctagatcggccgccggtaagaacctcctccgacgaggatatgcaaccgccgtacctgaacggaaagtcgctgtcttgggcgcagctggagggatcggccaacccttggctctcctcatgaagcttaaccctcttgtttctcaactggctctctatgatatcgctaacactcccggtgttgccgctgatgtcagccacatcaactctagatctgaggttgccggatacgttggtgaagagcaattggggaaagctttggagggatgtgatgttgtcatcattccagctggggtgcctagaaagcccggtatgactcgtgatgatcttttcaacattaatgccggaatcgtcaagggtctatgttctgcaattgctaagtattgccccaatgcacttgtcaatatgatcagcaaccctgtcaattcaactgttcctatcgcagctgaggttttaagaggcaggacatatg

SEQ ID NO: 10051 - DNA, 419 bp, Gossypium hirsutum
  Clone ID: uC-gsflmaxxa040b12b1
ttgttaggatctctcagctactttttctctcaaaatttctccaattagctctggtttaggcgatggcttcaaagcggatcttgaaggagctcaaggatctacagaaagatcctcctacctcttgcagtgcaggccctgttgctgaagacatgtttcattggcaagcgactattatgggtccacctgacagtccatatgccggtggagtgtttctagtcaccattcatttccctccggactatccatttaagccacccaaggttgcattcaggacaaaggtctttcaccctaatattaacagcaatggcagcatttgcctcgatattttgaaggagcagtggagccctgccctcaccatattcaaggtattgctctcaatctgctcacttttgacggacccaaatcccgatgatcccttg

SEQ ID NO: 10052 - DNA, 77 bp, Gossypium hirsutum
  Clone ID: uC-gsflmaxxa040c05b1
actcaatgattccccgggggaaaaatagagatgtcttctacgttacccataacatgtggcaagtgttgtgaatttat

SEQ ID NO: 10053 - DNA, 147 bp, Gossypium hirsutum
  Clone ID: uC-gsflmaxxa040c06b1
atgcatgtccttcctatatgcagccggctgttaaatcaagagatatttcgagtctcaggaatgatggccaaccaaggatttggcgaccttgaccggttgaggcatagaagccccagtcccatggcttcttcaaaccttatgtcaaat

SEQ ID NO: 10054 - DNA, 279 bp, Gossypium hirsutum
  Clone ID: uC-gsflmaxxa040c08b1
ttcacgcgtccgattccaaacaggaagtcctagagagagagagagagtgaaaggaaagaactttcaggaattttctctctctagaactcgcctttctgtgtttgtttccctagaaaaaaaaaccccaaaatttcccccaattcaagatttgtgttttcttcttcaaattgaatccgaatcttttataaaatttctcttttgggttctcaagtgatgtctttattgccaaagagcgattcaattcatatccgtgaggtatgggatgataacgttgaggaa

SEQ ID NO: 10055 - DNA, 341 bp, Gossypium hirsutum
  Clone ID: uC-gsflmaxxa040c10b1
tcggtatctcagaaacagcctagaagggctcctccaaaacatgattctcgtgcagggtaccctttatctcagaatcttccattcgattttcccaatgcccagatttactatccctatcctatatgtgttcctggaagttacttgcattaccctccaaatcatcagaatggagtgaggctcataaccagtcctatggcacaaatttcaaccgtgcgtggaccatatacttctcatctaagtggtaaaaagcagaggtataatacaaggttccaggcaaatttaagtcgcagttatccgcagtgtggcggcataatggctgctcacggcagcctatatggctc

SEQ ID NO: 10056 - DNA, 506 bp, Gossypium hirsutum
  unsure (1)..(506): unsure at all n locations
  Clone ID: uC-gsflmaxxa040c11b1
tcgtttcaccatggaagcaggcaaaacctacaagtataggatttgcaatgcgggtatcaagacatctctgaacgtcaggttccaaggccacaccatgaaattggttgagatggaaggtgcccacacagtgcaaaatgactatgaatcccttgatgttcatgttggacagtgcttcgctgtgcttgttacagccgaccaagaaccaaaggattactttgttgtggcctctacccgttttaccaaacgcgaggttacagcaactggtgtcatccgttacaccaatggcaagggcgcaccctcacctaagttgccaccaccaccagttggttgggcttggtcactcaatcaattccgtaccttgcgttggaacttgactgccagcgctgctaggcctaacccttanggctcctacaaatatggttccgtttacattacccgtaccataaagctggcccacactgctcaaaaagaagatggcaagctttgatatgctattaatggagcct

SEQ ID NO: 10057 - DNA, 514 bp, Gossypium hirsutum
  Clone ID: uC-gsflmaxxa040d02b1
ttcacgcgtccgcccacgcgtccgctatgtagttccccccacatcatcccaattctccttgcatcaagtcactctaaatccttcccattttcttctcaaacttcttcttcttcacaaggcagtaatggcgatttcctttgggatttatcttctttttctactgaatttcttctcatttggggcgatattttcttcagcaacaagctttacactcgaaaatcgttgtagtttcacagtatggcctggttccctgaccgcaaatggccctccccttggtgatggtggttttgcattggctcctggttcatcatcccggctccaccctccacctggttggtctggtcgcttttggggtcgaactggctgcaatttcgacaactctggctcaggaaaatgtgtaaccggtgactgtggtggcgcgttaaagtgcaacggcggtggcatcccacccgttttcctgatcgagttcaccctttatggacatgacaataagggacttttatgacattagtct

SEQ ID NO: 10058 - DNA, 246 bp, Gossypium hirsutum
  Clone ID: uC-gsflmaxxa040d03b1
ttcattcgtccgggcgagactatctctagcgatcaaatttgttcaggctttacaaaggtttcaaggagctgttagcttcctctgcaacggctgttggtaccgtctacagcagccaaatattatgcagctgctgctgcgaaatcagcttcttcataagtggcttcataaaacttctaaaaagcccaccgttttaaaacccatgacttaaaaaccagctgcttttcgatccgagacttgatccactgg

SEQ ID NO: 10059 - DNA, 510 bp, Gossypium hirsutum
  Clone ID: uC-gsflmaxxa040d04b1
ttcacgcgtccgcccacgcgtccgctatgtagttccccccacatcatcccaattctccttgcatcaagtcactctaaatccttcccattttcttctcaaacttcttcttcttcacaaggcagtaatggcgatttcctttgggatttatcttctttttctactgaatttcttctcatttggggcgatattttcttcagcaacaagctttacactcgaaaatcgttgtagtttcacagtatggcctggttccctgaccgcaaatggccctccccttggtgatggtggttttgcattggctcctggttcatcatcccggctccaccctccacctggttggtctggtcgcttttggggtcgaactggctgcaatttcgacaactctggctcaggaaaatgtgtaaccggtgactgtggtggcgcgttaaagtgcaacggcggtggcatcccacccgtttccctgatcgagttcacccttaatggacatgacaataaggactctatgacattagt

SEQ ID NO: 10060 - DNA, 506 bp, Gossypium hirsutum
  Clone ID: uC-gsflmaxxa040d05b1
tccacgcgtccgcccacgcgtccgggtgttgtgcttttggtgtgcagctaagtacactcctagccataagtgtactaagtctcaattgtatcagttggttgtagagcctcaatctgatatggaaagtgaagtcaagagtctccaatctgaagagtattaagactgtccggatcaatttgaacctaatgactaagaggaggagacatgtacactattgactatatctttgcatgccttacaagggtcgcaaagaccaagaaccatgagggtggttgcacaaatagggaattccaatgtactatactagtggatttaggaagcacccataattttatggatgccaagttggctcgacagtcgaaccttcctgtggaactctctactaagctgcaagtcattattgctgatgggggtatcatgtctactcagaatgtgtttatatttgtacagtggtaggcacaaggtcagcaatttgtaacaaatttattagtcttagctctcaggat

SEQ ID NO: 10061 - DNA, 525 bp, Gossypium hirsutum
  Clone ID: uC-gsflmaxxa040d06b1
gtttgctaacaatcataatgatcgccgttctgtagacaggagtgggaatattttgcctggcactgtggtggactccaaaatttgtcacccaacggagtttgacttctacttatgcagccatgctgggattcagggtacaagccgtccagctcattaccatgtgctatgggatgagaacaagtttacagctgatgcattacagtcccttacaaataacctttgctatacatatgcaaggtgcacacgatcagtgtcgattgttccccctgcgtactacgcacatcttgctgcattccgagctcgcttttatatggaaccagaaacatcagacagtggatcaatgacaagtggcacagctgcagggcgtggaggtggagctgcagctgctggtgggcgtagcacaagaggacctggtgctagtgctgccgtcagacctctgcctgccctcaaggaaaatgtcaagcgtgttatgttctactgttaagggagtgcttgtattttgagcatctattttgctgggctttg

SEQ ID NO: 10062 - DNA, 415 bp, Gossypium hirsutum
  Clone ID: uC-gsflmaxxa040d07b1
ttcttcacgcgtccgcttccttcgccgtctactgcacttgtgacatcgatttcaagtgaatcagaatgggtaaggaaaagagtcacattaacattgtggtcattggccacgtcgattccggaaaattgaccaccactggccacctgatctacaagcttgctggtattgacatgcgtgtgattgaaaggtttgagaaagaagctgcggggatgaacaagaggtcattcaagtatgcttgggtgcttgacaagctcaaggctgaacgtgagcgtggtatcaccattgatattgccttgtggaaatttgagacgaccaaatactactgcactgagattgatgcgcctagacaccgtgactttatcaagaacatgattactgggacctcgcaggctgattgggctgttttgattattga

SEQ ID NO: 10063 - DNA, 515 bp, Gossypium hirsutum
  unsure (1)..(515): unsure at all n locations
  Clone ID: uC-gsflmaxxa040d08b1
gtcgtagttctgctacagagtatgaaggacactcctaatgttgctgagaaggcctgtggtgctctctattttcttgctcaaggttatgaggaggtgggtccatcatctcctttaactcctttcttccaggaaattgtgcagtctcttctcactgtcactcaccgagaagatgctagggaatctcggttgaggacagctgcgtatgagacattgaatgaagtggtgagatgttctacagatgagacagctccattggtgttgcaattggtgcccgtcattataatggagcttcataacactgttgaggggcagaagctctcatctaatctataataatttacgagcaaaataaaaggaagaattagttgtttcgtatgttgatttgttccttattgttgtgacccacgcatgccagaaacatgtcccttgataaagnattttatttttatttcttttgggttttttctgcttttgtgcgttctaatgcttttttttttactatatgcaatcattca

SEQ ID NO: 10064 - DNA, 510 bp, Gossypium hirsutum
  Clone ID: uC-gsflmaxxa040d09b1
ctaaaaaaaaaaaaaagaaaacgaaaaaaagtttcgcttctttgctttctttcgagtaaaaatcaaacgaaaaacaacttaaataatattaaaagattttgattttgatcatcaaattttctgtttctgatccaccagtccagtcagagtgttgaagtattgaagctgtctggtgttttgtttgttttttgaaatctgatgtctccgccgcttcttggcgtggaggaagggggtcagaacaatgtgactttactgggttcttctggctctattgatagtgtgtgccagaataatgctgaattgaaggagcgcaattacatgggcttgtctgattgttcttctattgattgctctgttgtcacccttggttccgacgatagcaacgtaagtttgaatctgaaggcaacagagctcaggcttgggcttcctggatcacagtctcctgaaagaaatcctgagctttgcttgttaagctctgctcaacttgatgagaaaccccttttccctttg

SEQ ID NO: 10065 - DNA, 512 bp, Gossypium hirsutum
  Clone ID: uC-gsflmaxxa040d12b1
tctttcacgcgtccgaaaaaattgaattcgttgagcttggaaaaacaatgttgataacaatcacaattcgagatcttctatttccagtttcatttctcttgcttcttccatgtgaagcagttgctgcaacacttggaatctgctatggccgtgttgcgaacaacctcccaccaacctcggaagtgatcaacattctcaaaaccaatggcatttcgaatgtccggatcttcgatcctgatccgtttactttacagtcattttcaggcactgggatcaatatcatgatcggtgtccctaatgaagtcctcccttcacttgcctcaggcccacctgcctctgcactccaatggctccaaaccgacatattcgcgcatattgttccgagccaaattcgatatattgcggttggaaatgaggtcctctttaaagactcattatattctccctatcttgtacccgctgttgttaacctttaccaagcacttaaaatgctaaaccttgatggtactatc

SEQ ID NO: 10066 - DNA, 461 bp, Gossypium hirsutum
  Clone ID: uC-gsflmaxxa040e01b1
aaaaaaagttaatttataaattatatagtaacataataaataatgacgtcgttgttttggagaggtcttattatattacctcttctttttgtatatgtcaacggcgagcattttttgtaccctaaacgtcatactggcaaagccgagttagccggttacaaggggccagactctcttgccgtcgacggtggtggtttctatagcggtcccttgattgccgatgacgatggatctactgctgacggcaatcctggtggaactaccgaggtgaaggttgaaaaccttggaaaggccgacggtgataatactaatggcagtgcaaatagtgtcgaatcgactcaagttgctgccaaaaatggaattggcaacggaaatatttttgaggctaaaactacgtttaaagggagttgggaattgtttgttgagaacgccggtgtttccgccatgcatttgatattgct

SEQ ID NO: 10067 - DNA, 509 bp, Gossypium hirsutum
  Clone ID: uC-gsflmaxxa040e02b1
ttaactcagccccgtcggcagcccttcgtccggcaacatatcagacagttcttctaaagaacaagaccggttcctccccatagctaacgtgagtcggataatgaaaaaatccctccccgccaacgcaaaaatatccaaagaagccaaagagacagtgcaagaatgtgtgtcggagttcatcagtttcatcaccggcgaggcttccgataagtgtcagagggagaaaaggaagaccataaacggggatgatctgttgtgggcaatgacgacactgggttttgagaattacgtgggtcctctcaaggtttacctcaacaagtatagggaaaccgaaggggagaagaattccatggctaggcaagaagaccatcaccatcaccatcaccatcaatcacccacatcgtacggtttgatcagccacggtggggctaatgaattcaacaatgtaagtgcgggtatatcgtcgtcggctaacgctgccgatcatttccaggggtataacagtggtg

SEQ ID NO: 10068 - DNA, 485 bp, Gossypium hirsutum
  Clone ID: uC-gsflmaxxa040e03b1
ttcctttttagcatatagacaatagcaaatacagcaatggcttccagtgggcagcttcatgtggatttcgagctcaagtctcctgcagaaaaagtgtggggaaccattagggactccaccacgattttccctcaagccttgtcccatgattacaagagcattcaagtgctataaggcgatggcaaggcccctggatctgttcgtcttattaactatgccgaagggtctccaatcgttaaggtatcaaaagagagaatcgaatcagtggatgaagctgagaagaaatatgtttacagcatcattgatggggatctcctgaaatactacaagactttcattggcaagatcattgtggttcccaagggagagtcgagcttggttaaatggtcctgtgagtttgagaaggcaagtgaagagatccctgatccaagcgtcattaaggaatttgcagtgaagaagcttaggagatcgatgactatcttcac

SEQ ID NO: 10069 - DNA, 481 bp, Gossypium hirsutum
  unsure (1)..(481): unsure at all n locations
  Clone ID: uC-gsflmaxxa040e04b1
gttgggttcgttgttactgaaagagtttgcattactctttttggggttccagaaaaggaataacgtttaaagatgctacagttgttgttcacggtgatattcgcagagatggcggtgatcatcgtactatgcttcaagacaccgttaaggaagctggtgttaatggttctggatcgggccaagaggggacgaggtccggtcatagtgaagacggtgggcggaacagtatccgttgtgatgttgtcgtacatattcagcatgatgatgctcaagaaacgctggatcgttgatggaaacgcttctctaacggacgagattctcatggccaaaaacctcctcgaaactactctcatggggggattgctattcctatctctaattatagacaaattacaccattatattaaagaactccgtataagaaggaagaccatggagactgccaagaaacaaggtcagggatttgaagagcangtgggtc

SEQ ID NO: 10070 - DNA, 498 bp, Gossypium hirsutum
  Clone ID: uC-gsflmaxxa040e05b1
ttgacgcgtgggtttaatttatttgcccacaatcgctctctctctctttcagttcacttctacagccttctcttctccaccaatccaaaaaaaccaaagatgcagtacaaaaacctgggcagatcaggcttaaaggtgagtcaactatcgtatggagcatgggttagtttcggtaaccagctcgatgttaaagaagcaaagtcacttctccagtgttgtaaagacaacggagtcaactttttcgacaacgccgaggtttatgccaatggtcgagccgaggagatcatgggtcaggctattagggaacttgggtggaaacgatcggatatcgtggtttctaccaagatcttttggggtggtcctgggccaaatgataagggtttgtctagaaaacatattgtggaaggaaccaaggcgtccttgaagaggcttgatatggattatgttgatgtgctctattgtcataggccagacacacagactccaattgaggagact

SEQ ID NO: 10071 - DNA, 473 bp, Gossypium hirsutum
  Clone ID: uC-gsflmaxxa040e06b1
ttcactcgtccgggctccagttacctatatggattttttgatcaagcatggaaggaaggaatgacaaaggatgaagctgagcaattagtggttaaggcggtttcccttgccattgctcgtgatggtgctagcggtggtgtcgttcgcactgtgattatcaactctgaaggagtcacgaggaacttctatcccggtgacaaactgcagctatggcatgaggaattggagcctcagaactcgttgctggatttactgaattcttctaatcctgaacccatgaatatttaatcaaatcaaaggctaaggggaaattttttattatttttatgtggaaatttttgggtagatccaagaaatcgcttgaaattgatctaacaaatcccagatgattcgtcttataatattttgtttggatacaagtaccattaatattatatttttatatatagataaaatctataggaaattcatat

SEQ ID NO: 10072 - DNA, 499 bp, Gossypium hirsutum
  Clone ID: uC-gsflmaxxa040e08b1
tcggtaaattgaaacaaaggtaaattaaagtcctttcttttcttatatttatatattactaattatttgttaaccccaaaactttcattaaatcaaagatctaaagcttctgccaggatgagaattactgtaatgactgcagatgaacagatccttagcttggatgttgatcctcatgaaactgttgaaaatttgaaagctttgcttgaagttgagactatggtgccattgcagcagcagcaactgttgtttaatggaagggaaatgaacaactctgagaaattgagtgctttgggtgttaaggatgatgacctagtcatgatggtctctggtgttgcttcaagtggcagtgcatctaggaatgacttgaacttgaatcctgatggatctgccgtgaatcctgcagctttccaacaacagattcgacaggattctaatctaattggacaattatttcagaccgatcctgagcttgctcaagccgttgtcggaaacgatc

SEQ ID NO: 10073 - DNA, 425 bp, Gossypium hirsutum
  Clone ID: uC-gsflmaxxa040e09b1
ttcttcacgcgtccgctttctcattgcatcagagttttcactgtaaaatggcaacttattcgaaagaagctagaagagttaagttctgggttaatggcgattgaaaactgtggttcaagttctgctcaaaacatagaggtcttttctgcgttggttccttccattttagtcaccgtaaatgaatgtcactgtctcgcaagagcatgtgtggatctttcttatagtgggaaactcttgatgcaaagctacctcgatgtaatacttgctaaattcgacaaccatgtgaaggatctttctgggttttacactactgggattttaagccatggtttcgccattgttgtttcaaggcccggtgttactgctttcaaagatgacatgaggttttacataagggatttatttacaagaatgaagaatgggga

SEQ ID NO: 10074 - DNA, 506 bp, Gossypium hirsutum
  Clone ID: uC-gsflmaxxa040e11b1
ctttctctttggtcagtattgtagatcattaagatggagaagaaaggttttgttagattgatgctactttttctgggtttttcttatcttcttctttcctgtgctgctgttcccactactagaagcctcaaatcaaacaaggaactcccttcttctgtccaagatttacttgctcaggatgtaatggaattgagtgatggagaggaagtgataacggaaggtgacagattcaatggggaaaggatgttaatggaaagcactgattatccagggacaggtgcaaacaagaaccatgatcccaaaactccagggagagcttaaaaaacattaagacccataacctatttgttttatgtatagcttaagacatgacaggataaaaggcaagtctttgaatctgggtttcctccaatatttcgctagaatttcctctcttttaaggtttgttgcttggatagtgggaaaactatgatggaaggtttggactgtactttacagtttacaga

SEQ ID NO: 10075 - DNA, 540 bp, Gossypium hirsutum
  Clone ID: uC-gsflmaxxa040e12b1
tcgttctctctccactgaactcttgctaaacgggatcgttttagtcagtctttcatcaatggcgaaagaaccggttcgcgtcctcgttactggagctgcaggacaaatcgggtatgctcttgtacccatgattgctaggggagtcatgttgggtgctgaccagcccgtgatccttcacatgcttgatatcccacctgctgcggaggctttgaatggtgtcaaaatggagttggtggatgctgcttttcctcttctaaagggtgttgttgctacaactgatgttgttgaggcatgcactggagtcaatgttgctgtcatggctggtggtttcccaaggaaggaaggaatggagaggaaagatgttatgtcaaagaatgtgtctatttacaagtctcaggcttctgccttggaacagcatgcagctcctaactgcaaggttttggttgttgctaaccctgccaacaccaatgcattgatcctgaaggaatttgcacctttcatccctgcaaagaacattacctgtttgaccaggctggatca

SEQ ID NO: 10076 - DNA, 512 bp, Gossypium hirsutum
  Clone ID: uC-gsflmaxxa040f01b1
tttcactcgtccgcggacgcgtggggccacataagccggaaaaattctaaatggctacaggagaatctcacagatatggatacgaaagtcaaacaaatgatcaagctcattgaagaagatgctgattcctttgccaggcgagcagagatgtattacaagaaacggccagagttaatgaaattggttgaagagttttatcgagcataccgtgcattggctgaaagatatgatcatgcaactggggtgcttcgtcaggctcatcggaccatggctgaagtatttccgaaccaagttcccatggtgtttgcagatgactcgccgggaggttttgctccagaggttgatccctgtacacctgagatgacgccacttgtacgagcatatttggagcctgatgagctgcagaaggatgctgtggggatctcttcgcatgctatcaagaggaatgtagcattctcagaagaatctgaatctccaatgagcagaaagggtctgaaacatttcatgatgta

SEQ ID NO: 10077 - DNA, 428 bp, Gossypium hirsutum
  unsure (1)..(428): unsure at all n locations
  Clone ID: uC-gsflmaxxa040f02b1
cccacgcgtccgcccacgcgtccgaatggcgagtggtggaaaagtgtctttcaaagtcactcttacatccgatccaaagctccctttcaaagtgtttagcgttcctgaagcagccccatttacggctgttttgaaattcgcagccgaggaattcaaagtccgtccccaaaccagcgctatcatcaccaacgatggtgtgggaatcaatcctcagcaaagtgcaggaaatgtctttctcaaacacggttcggagcttcgcctgattccccgtgacagggtgggagccttttgaatgcttaaaaacttaacactagtttatcaccaccctttattatgggatctattttcttgacatgattgaaactttactggngtaaccatagctgattacatatatttgggagttaaaatgatataatgggtatggt

SEQ ID NO: 10078 - DNA, 508 bp, Gossypium hirsutum
  unsure (1)..(508): unsure at all n locations
  Clone ID: uC-gsflmaxxa040f03b1
ttgccatctgcaattacaagcagtccccttcttcctctgccattaaaataaaataaaaacctaaccctagaaatccaaaacaacaagagtcccaacaagtaaaggattaagaagatatcgtgggagtgggatactgaagccgtcgatgcttagttttggtggagtagaagaggatcagagagggggtgcttccaataaatgctctctctgtatctccccttcgaagttgcttcctttttcatgtcttcttcaatcacaccctctttattctttgctcattcagggtcttctcaatccctaggctttcatctttgctctatacctttccttaactctcaatcttctcctttgtataaaacatgactgattctaaggtattcgtttttgggtccttcactgaagatgaaaccaggtcattgctgtcaaagcagtcatctgggaattctgaatagcctgtagcaactaaggaacntgcatttggttctttcaattttgcagctggaggatc

SEQ ID NO: 10079 - DNA, 493 bp, Gossypium hirsutum
  Clone ID: uC-gsflmaxxa040f04b1
tggacgcgtgggcggacgcgtgggttttttttaaaaaggtaacttaattaggacacctaccccataataaaactaaaaacccaaaatgataaatgggctactttaaaataagcccttcacatttttgagtgacccgaaagtcccactacagggccctatagatatataatatgctagctatactaaaagtcaagctagttaaatactactttggatgcctggtatatttatatagtaattattaattaaaacttaaaaagcctaagataataatgtgttcctctagcggaattggcggccagtgaaggtctgcccaaaggaccacccagctggggcaacattgctggaaaccacagtacggccgtcgcttgttgtgaccttaaatgagaggctttgtccgttgaggtaggtgttgctctgccagttctggccccagttcctagacatgggctgccaaccagtcctggagcccttgatggccaccgcatgtaca

SEQ ID NO: 10080 - DNA, 477 bp, Gossypium hirsutum
  Clone ID: uC-gsflmaxxa040f07b1
atctgatctaacccttgaaatgctgctaaaatcacatcggttccgtagggaaatcttggtttccctgaaaactggtctgcctgattatcttcgggtagatgacagaattccatcttctaatttagctgagatctttctgaacctacgatgcagaaatctcatgtgccagacttctctgcctgcggaagattgtgagtgcaaggcttgctcaaagaagaatggtttttgtagtgcttgtatgtgtcttgtatgttcaaaatttgacatggcgtccaatacttgtagttgggttggatgtgatgtctgtcttcattggtgccatgtttgattgtggattaagggaatcttatatcaggaatgaacatactgcagctgaggtgcaatttcattgtgttgcttgtaatcattcatcccagatgtttggctttgtcaaggaggttttttagaactttgcaaaggaatggacgcttgaaactt

SEQ ID NO: 10081 - DNA, 423 bp, Gossypium hirsutum
  Clone ID: uC-gsflmaxxa040f08b1
ttgcgagaagtgagaaactattgtaaacctctcataatattctgagcttttttctctttttgtttcctataattttgatctgagccaaggttgataatcgagtttttataagcggttgatcctggcattccaaaatttgaattgtgtggctgaatgatctatggagactaagggagggaaaaagaagtctagtagtagtaagtcattattctacgaagctcctctcggttacagcattgaagacgttcgaccaaacggtggaatcaagaagttcagatctgctgcttactccaactgcgctcgcaaaccatcctgatattcgtaacgcaagtgcccccttctgaccactgttaaagtggtcaatttatttttatttgctttattacttagtattaatatctatcttcggccgggtttctcccc

SEQ ID NO: 10082 - DNA, 505 bp, Gossypium hirsutum
  Clone ID: uC-gsflmaxxa040f10b1
ttctttcacgcgtccgcccacgcgtccgctcactctctttaactttcgttcatctccattattgtttcagatcgtaaaatcaaaaccaaattttcgtttaatttatacatataaacacccaaaaacaaaaagggcataaaaaaaggagattcaatggggatcttctccttcaatgccatagctttggccttcttattagccattatctctggcgccgtcaatgcttgcccttcttccgaccgagaagcattgctagctttaagttcatcgttaaaggagccttatttaggcatcttcgattcatggaaaggcaccgattgttgttccaactggtacggtattagctgtgaccccaccactcaccgagtcaccgacgtttccctacgcggtgagtccgaagaccccattcttcaaaaaaccggccactcatcttctcgttacatgaccggtaccattaacccttctatttgtcagctcgaccgggtcactactttaatcattgctg

SEQ ID NO: 10083 - DNA, 531 bp, Gossypium hirsutum
  unsure (1)..(531): unsure at all n locations
  Clone ID: uC-gsflmaxxa040f11b1
ttttgttagcatcacaatatcaaaaggaagcggacaaatgcaatttgggtatggagacgtgtgaagaagtaagggagaaagctgaagaagcactgtcggctcaaatgaaattgacagcaatgtgggaaataagatctcgtcagaaagggtggagagataaggtcgccaaatctaatgcgcagacacaaggaaaaaccaactacactagattgcggtccaagaacaatttgcagaaggcacataatggctggctcctacctctacaaatgcatgtgggaggcattgcagcagcgaataagaatgatattgatcaacatgcagtcgacaccgtgctctgaattcgaattcaggtgtgagtttcagatattttatgtgcaaaaaagtattagagtgccatatgtttgtatgttagttaagcagattatagatagaacttgcagtaggatcaactaattagttgatcaaaaactacaccttgttttggtatagtatacttgcatattngcatatatttaataataatctcgggtc

SEQ ID NO: 10084 - DNA, 467 bp, Gossypium hirsutum
  Clone ID: uC-gsflmaxxa040g01b1
cttcttttcactcttaaactctaaaccccaactctccagatttcatattgcaaacgatggcgtcattggattcaaaagaatcacctgccaataacccaggccttcattttccccctgacgaagccaccaaaggctacatcatgcagcaaaccatgtttcgtattaaggatccaaaacgtactcttgaattttatagtcgtgttttgggcatgacgttgcttaacaaagtggatgttccatatatgaaaatgacattgtatatgatgggatatgaggatgtttcatcagcaccaaatgacccagttgagaaaaactatttggacatttggaagaccagctactatggaactaacacacttttggggtaccgaaaacgatcctgaattcaaaggataccacgatgggaattcagaacctattggctttgggcacattggcattaccgtggatgacatgtacaaggcatg

SEQ ID NO: 10085 - DNA, 483 bp, Gossypium hirsutum
  unsure (1)..(483): unsure at all n locations
  Clone ID: uC-gsflmaxxa040g02b1
ttcattcgtccggccacgcgtgcgatcaaagtgtagagcagtgggcaccatggtccgacgaccctgcggcgacactgatgcaagacctcatggtggccacccaggacgtggctatgatatttccctaccggaaaaccgagagaaaaaaatccatgttcttgtcgaacatagacaaagtgctgaatttcccggtggaaaccgtccattttttccggtcccacgaggattttccgccccatgttgcggctgagaagctgaaaaccgcattatcggagctgctagtgccgtatgatttcttagccggaaggttgaggtcgaacccggaaacaggtcggctggaaatcgactgtaactcggccggaatcggtttcgcggtggcttcaagtgattatgcgttggatgatgttggagactngatttatcctaattcagcatttggccaactgatttgtaaaagcgtcgatagcttggaacaagatgatc

SEQ ID NO: 10086 - DNA, 456 bp, Gossypium hirsutum
  unsure (1)..(456): unsure at all n locations
  Clone ID: uC-gsflmaxxa040g03b1
gtgagtagaagaattttgctcctttccttcaaacggtgattcatgcgggacttgtccgttgaaagaccctaaacccatatcaccattccggaaaggcaattaagcaaccctccttacctactctaagtaacctttttgtctaattaacctttttgtctttttcacttcatttccaaactcacggtgttgcagtagtggagcaatggaaggcgaaggatttgttgccgcaagcaaagtgaacatctatgaaggccgtgtcaccgccttcgtcatctgcacttgcctcattgctgccagtggtggtctgctcttcggctatgacctgngtatctcaggtggggtcacatcaatggagccttttctgaacaagttcttccctagtgttttggaacaacagagtaaggcatcccaaaccgagaaccagtacctgcaattcgatagccaactactcactct

SEQ ID NO: 10087 - DNA, 519 bp, Gossypium hirsutum
  Clone ID: uC-gsflmaxxa040g04b1
tggacgcgtgggtttttatggtttaatggagatgtggacaatccaaagaagaaaccaggttcttgataccatacttttgcttggaatagttctggttttgattaacataaatggtgttgaaagcagaaagtacagtgcttcattgatagactttggaggtgttggtgatggagtaacatcaaatacaaaggcttttcaagctgccatttttaacctcagccaatatgcatcagatggtgggtctttactctttgttccaccaggaaaatggctaactggtagttttaaccttactagccatttcactttgcatatccacaagaatgctactcttcttgcttcgcaggatgagagtgaatgggctgtcattgatcctttaccatcctacggtcgaggaagggatgccgatggtggacgatatatcagtcttattttcggaaccaacctcactgatgtcgtgataacaggtgataatggcactattgatggtcagggtgttacctggtggacaaattccat

SEQ ID NO: 10088 - DNA, 515 bp, Gossypium hirsutum
  unsure (1)..(515): unsure at all n locations
  Clone ID: uC-gsflmaxxa040g05b1
ctcttctttttcacaatttcctcttcccttgggcttcttcttcttcttcctatttccagaatttcagccccttattttcactatcaatagcatatgaacccttattagcctattccccctttcccctttttaccccctagttcttctagggcaaagatccctcgatttcccttcaatttcgatcctttatctctggaatttgattctttttttttttaattcaatcatggatggcaacaaagacgatgctttgaaatgcttgaaaatcggcaaagatgctttggacgccggagatcgagcccgtgccctcaaattcctcaccaaagctcgtcgtcttgacccatcgcttcctatcgagaatctcttatctgctgcggaaggtgggaaatctgacgatcggccggcttcggaacctgttgggtctgctaaagatccgtctgggtcttctccatctaaatcttctgatcaaccctcgattcgtcggaggaaatataccgatggatcngctgcgtctg

SEQ ID NO: 10089 - DNA, 520 bp, Gossypium hirsutum
  Clone ID: uC-gsflmaxxa040g06b1
ttcacgcgtccgcagagaccgatatggaaaccctggttcgatcaaacttcccccgtactaattcccgtgctttagacaatcccttatccttatccgccacgcctccaaatcttgccaataagacccattatccacgtctccatgttcgtcacgagttgcccaaatggtggcctcaacagctgcctcagcgtaacactgcttccatctttgattccgagtattaccagacgaaggccaatagattaatcaaagcaatcatcgacaatagattgggtggaaaagacttttccgaggaggatataattcaaggcatccggtgtgcgtgtctccattgacacaacaaacacacgggattcattatatcgtgcagcggttgagttggttttaaacgtttgctgcagagattatgcagggcatcaatcaactctacaaatgttcagattgatggtgaagatgctcgagaattccttgctgggctagctgaaaatattggacttgacaatatccgtgcttctagatg

SEQ ID NO: 10090 - DNA, 388 bp, Gossypium hirsutum
  Clone ID: uC-gsflmaxxa040g07b1
ttaaaacaaagtcttccctttcacacttttcaagtttcaatctaaaaaagaacatgggaagcagaatctagggtttgacaacaccaagtctaacaaggtctgtttttttcttttcttttgggggtattttcccttttgttttctcattgatcctttgcctgtttctgatcttcttcgtcttctagggaaaaagatttgtcccttaaagctaaatttggtttgaattctgtttgaaaaaggtccttgtttggtctttggattatctcaaatttgaattttgagtgatgggtctttttttgttttcctttaaagatctagttttttaatgaaacttcgttgctgtttttgtgtggttaattttgggtttggggcttgggttttggggggt

SEQ ID NO: 10091 - DNA, 415 bp, Gossypium hirsutum
  Clone ID: uC-gsflmaxxa040g08b1
ttgttttgtgttattttcttgtcaatggagtcattaacttcttctccagtgtgcaatctagggattttgatcagtctcgacaacgactccgtccaagaaatcctccaaagctacgacggtttctgcaccgccgctaattctctcctcaaaatctccggcgatctctccctcgaacatgacttcgtttctcatgttcacactctctgcaaacacggcctccatattctctctcgggactacttccttagattactagaggaagcgtttgagaaaaatggggcgtcgagattttggcgctattttgaggattatagcatagatctaagtgatacagtctttgttgctcttcatggatagttatttgatgggtacttttttctgaaggatttaaagctgctgttttcattttcatggc

SEQ ID NO: 10092 - DNA, 439 bp, Gossypium hirsutum
  Clone ID: uC-gsflmaxxa040g09b1
tcgttcacgcgtccgttttatttaattttcttttcgacggatcttagcagctcaaagttgaaaccctaattttcttgaattttttttctcattcgaaaagaaagatgggattatgggaagcttttctcaattggcttcgaagtctcttcttcaagcaagaaatggagctatcgttaataggcctccagaatgctggaaaaacgtccctagttaatgtcattgcaaccggtggatatagtgaagatatgataccaactgtaggatttaatatgaggaaggtaacaaaaggaaatgtcactataaagttatgggatcttgggggtcaaccaaggtttcgaagtatgtgggagagatactgccgcgctgtttcagctattgtatatgtcgtggacgctgctgataatgataacttatctgtctcgagaagagaactccatga

SEQ ID NO: 10093 - DNA, 497 bp, Gossypium hirsutum
  unsure (1)..(497): unsure at all n locations
  Clone ID: uC-gsflmaxxa040g10b1
ggagtcttctccaaaatcctcacatccacatagaaccttatctgcaccaattgatgccatctgtagtgacctgccttgtttctaaaaaattagggaacaggattgctgacaatcactgggaacttagagattttacagcaaagttagttgcttctatatgcaaaagatttggccatgtttataacactcttcagacgcgtcttacaaaaactttgctcaatgcacttctggacccaaaacgggcattgacccaacactatggtgcagttcaagggttggctgccttaggaccaaatgtggtccgtctccttattctaccaaatcttgagccataccttcgactccttgaaccagagttgttactagagaagcaaaagaatgagatgaagagatatgaagcttggcggatttatggtgtcttgctgcgtgcggcnggtcaaagcatatttgagcgcctcaagattttttcacctttaccattaaacttcagcccatgc

SEQ ID NO: 10094 - DNA, 544 bp, Gossypium hirsutum
  Clone ID: uC-gsflmaxxa040g12b1
tctttcacgcgtccgcttcatcttcatctccatctatttcttcttaattgtttctctgtatataattttttagattttcaattataatcggaaaaaaaaccaaaaaaaatcaaataaaaatgcagaggataattgctgcaagttctttttgcagcaaaattttgagaaaagaaaggcaacgggcttttttctcttcaacttccttactatttgatgaaactcaattacagttcaaagaaagtgttaggcaatttgcacaagaaaatattgcgcctcatgcttccaaaatcgaccaatctaattctttccccaaggaggttaatttatggaagctcatgggggattttaatcttcatgggataactgccccagaggaatatggaggacttggtcttggttacttgtatcactgcatagcaatggaagaaataagccgtgcttcggggtcggttggtctttcctatggtgctcattctaatctgtgcatcaatcagttggtgaggaatggaaaccctgcccagaagagaaatacttaccaagctca

SEQ ID NO: 10095 - DNA, 377 bp, Gossypium hirsutum
  Clone ID: uC-gsflmaxxa040h01b1
attcttttccattttccctttatttcctttgccgcccctagggtttaattacattccgcacatggcttctgcagatgtcgagtaccagtgctttgtcggaggtctcgcatggaccatcaacgaccgtgctctcgaagaagccttcagtgcttacggcgagatcgtcgattcgaagatcattaacgatcgtgagactggaagatccagaggctttggcttcgttactttccgtgatgagaaatcgatgagagatgctattgaaggaatgaacggtcggagtctcgatggaaggaatataaccgtcaacgaagcacaatctcgcccaaacggcggcggaggtggtggatactgaagtggacgccgtgatggtggtggat

SEQ ID NO: 10096 - DNA, 460 bp, Gossypium hirsutum
  Clone ID: uC-gsflmaxxa040h04b1
ctctttcgtccgaagaacaaaataattcaacggccgaccgtttgtgtcgttccggagacgtttcacatctcatttcaccagatctcaactcttccttcgccgggtttatttgttcttccttggtttttggctgttttcaataaatttcttctatttttgcatggctgctccacctgcatgagctcgagccgattacgactatctcataaagctccttttgatcggcgacagcggtgtgggtaagagttgccttcttttgcgtttttcggatggctcatttactacaagttttatcacaaccattggaatcgactttaagattaggactatagagcttgatggaaaaagaatcaaactgcaaatttgggatactgctgggcaagagcggtttcggactattacaactgcttacttccgtggagccatgggcattttgctcgcctatgatgtgactgatgag

SEQ ID NO: 10097 - DNA, 426 bp, Gossypium hirsutum
  Clone ID: uC-gsflmaxxa040h07b1
tcgtttacgcgtccgcccacgcgtccgcttattcttttttctcttagatgagtacaaccatggcgaatcacaaaccgttccctaatttcttatctcttattctcctctctctcgtcgccatcgcctctgctgaagttttcttcgaagaacgcttcgaagatggatgggaaagtcgttgggtaaaatctgactggaagaaagatgagaacatggctggggaatggaattacacttctggaaaatggaatggagatcctaatgacaaaggtattcaaactagtgaagactacaggttttatgctatttcagctgagttcccagaagttaacaacaagggcaagactctagtcttccaattttctgtgaagcacgagcagaagcttgactgtggtggtggctacatgcaggtgctcagtgataacattg

SEQ ID NO: 10098 - DNA, 432 bp, Gossypium hirsutum
  Clone ID: uC-gsflmaxxa040h10b1
ttctcgacgagttcttcaaaatccagatttttaaccaaaaacaagaatttcccaggtctaaaaacgttaaatccaatcaaatccaggaactggggtctaaacgtgagtgccccatttagagttgcatccgttgaagaagatgagggaaggaaagagagaaaccatggtattaatggatttgaggaacaagaacaagaggcagggttcgaccctggggcgcctccgccgtttaagctggctgatataagagcggccataccgaagcattgttgggtgaaggatccatggaaatctatgagctacgtggtgagggatgtcgctgtggtgttaggccttgcggctgctgcggtctatgttaacaactggattgtttggcctctttactgggctgcacaaggaaccatgttttgggctctctttgtcttgggcatg

SEQ ID NO: 10099 - DNA, 318 bp, Gossypium hirsutum
  unsure (1)..(318): unsure at all n locations
  Clone ID: uC-gsflmaxxa040h11b1
tcaaagctcacgttgcatggatgcatggattgctgtcattagtccaaaatgagagcataattggaatgatttgttgaaacattatatattagtaataaattactaaaaagtcaaaaaaccgataccaattccaaaatctaccctaaattaaagctacttttatttccattattaccttctttttttaattatttctcatccctatatattgtgaaaagaaaaaacctttttgttatcaattaggttaatatttgatatattgtaattgaaaattgaagattcaataccattaataaatattttctttatttcaattna

SEQ ID NO: 10100 - DNA, 550 bp, Gossypium hirsutum
  Clone ID: uC-gsflmaxxa040h12b1
tcgtttaggccaagatttgaattgccagaagctttggttatggaaattctaaatgcttccagttaaatcccttactcgcttcaactgtgtttgtaagtattggtgttcttcttttcaaactcctcatttcatttccaaaaattatcacaacaaccttgaaaacaacaaccttaatctacttcttagtcgctgtgatggtaacaccttccaaccttatttatcttcactttcaaatgaaaaagatcaaaactatatagtaaaacaaaacattcacttgcccttttttgaggatgatagcccctctgtttatggtgcatgtcatggattattgtgtttatttgattcttcaaaggataaggctgccatttggaacccatcaacaagagagtttaaaatccttccaccatcttcaatccaacgccctccatatttttccccattcgaagaaacctaccttactttagatgaacgttcttttaacgacgctgcttttggggtttgattctaaactgatgactacaaattcatacgattggtactcttacttttg

SEQ ID NO: 10101 - DNA, 188 bp, Gossypium hirsutum
  unsure (1)..(188): unsure at all n locations
  Clone ID: uC-gsflmaxxa041a02b1
gcctggtgttgttggattccagttatctgngatactaagtaatggtgtgacagctactgacttggttctgactgtgacacaaatgctgaggaaacatggtgttgttggcaaatttgttgtatttaatggggatgggatgggtgaactatcattggctgacagagctaccattgctaatatgtcttctg

SEQ ID NO: 10102 - DNA, 518 bp, Gossypium hirsutum
  Clone ID: uC-gsflmaxxa041a04b1
ctttcgcgtccgcattctcagattttctctcagggtttaatagtgaaacgatgtccactgtcggagaagctgcttgctcttacgctgctcttattctttatgatgatggcatccccatcaccgctgagaagatttctacactagttaaagctgcaaatgtctctgttgaatcctactggccaagcttgttcgctaagctttttgagaagtgcaacattgaggatctcataaccaatgttggagctggtggtggtggtgccccagtagctgcagctgcacctgttgctgctggcggaagaagccgtgctgctgctccacctcctgctgaggaaaagaaggaagaaccggaagaagagagtgatgacgatatgggattcagtttgtttgattaggtgtgttttggtccattacctagtatatcacatgaagggtagtaccgctttagaagtgattgctatggtatttgcatggtgatagaaatatacgttttggtggatggaagtgacactaatagctct

SEQ ID NO: 10103 - DNA, 487 bp, Gossypium hirsutum
  Clone ID: uC-gsflmaxxa041a05b1
attaatattaattattaataattattattatgggtaaaattgaatccaacttggtcaacacaccccatttcaatcccttaaaccctcaagagtttagaaaacaagctcatgaaatggtggatttcattgctgattattatcaaaatatcgagagctacccagttttaagtcaggtgcaaccaggctatctccgggctaacttgccgcaaaacgcaccgtctctgcctgaatcccttgaaacgatccttgaggacgttaaaaaccagataatcccagggatgacgcattggttaagccctaatttctttgctttttttccttcaactgttagcactgccggtttccttggtgaaatgctttgtacttgctttaactccgttggtttcaactggattgcttccccggcggcaactgagttggaaatgctggtcatcgattggctggctgacatgctgaagctgcccaagtcgttcatgtttcaaggtac

SEQ ID NO: 10104 - DNA, 410 bp, Gossypium hirsutum
  unsure (1)..(410): unsure at all n locations
  Clone ID: uC-gsflmaxxa041a06b1
gttccctatcgagccagcaccatggagatatgcaaatggaagtcgaggtactcagaaacaacctcttaaacatgtaaaggttccacccaagcctccgaattgttccccttcggtttatagtgagatcgagaaaagattgaaagatctcgaatttagacactcgggaaaggatctcagagctcttaaacagatacttgaagcaatgcaagcaaagggactacttgagactgggaaagaagaacaagctgcgaacttggtgtctcaaagagactatgaaccgaaatgcacgagccccggtcagcatctgagaggtcagcgaagccaacggggttcggattctattggaacatatgaatcacctattgtgatcatgaaccagcaaaactngttgagcaagttagtatgcatgc

SEQ ID NO: 10105 - DNA, 278 bp, Gossypium hirsutum
  Clone ID: uC-gsflmaxxa041a07b1
tgtttttcagtattgaaggaggcggctttgcttcagagatgaaagatcacctatcaaacctgtaagttattcatttgtttgtgtggaagaatacattattcatagaaccttcaaagttcccaaaagataaagggaagtgaaaggaaagaaaagaaaagggctgatttgtacttgacatgaacttgaatttgtaccattatagcatatgttacgacggtaatcatcctcagtttttatacgagagatgttttccaaattcagatcgtactttgttttcc

SEQ ID NO: 10106 - DNA, 423 bp, Gossypium hirsutum
  Clone ID: uC-gsflmaxxa041a10b1
tcgtggacgcgtgggttcattttcatcttcttcctctttctttctgttctttgttttcttcaaatactgccctttcattttccttagttcttgttaaaaagaaaatgtgtgggattttagctgttttgggctgttctgatgattctcaggcaaaaagggttcgggtgctggaactttcccgtaggctcaagcaccgtggtcctgactggagtggcctctaccaacatggagactgttatttggcccatcaacgccttgccatcattgatcctgcttccggtgaccaacctctctttaatgaagacaagtctattgttgtcactgtcaatggagagatttacaaccatgaagaactaaggaagaagttggcccaccacaagttcaggactggcagtgactgcgatgttatttcccatctgtatg

SEQ ID NO: 10107 - DNA, 340 bp, Gossypium hirsutum
  Clone ID: uC-gsflmaxxa041a11b1
ttggtgcgacgtttgaaggatttgattaagaagcattctgaatttattagctatccaatttcactttggattgagaagaccactgagaaggagatttctgatgatgaagatgaggaggataagaaggacgaagaagggaaagttgaggatgttgatgaggagaaagagaaggaagaaaagaaaaagaagaagattaaggaggtgtcgcacgagtggtctttggtgaacaaacagaagcccatctggatgaggaagcctgaggagattaccaaggaggaatatgctgctttctacaagagccttacaaatgactgggaagagcattttggccgtaaagcac

SEQ ID NO: 10108 - DNA, 373 bp, Gossypium hirsutum
  Clone ID: uC-gsflmaxxa041a12b1
ccttgtttcatcaaccttcaaaccaaatcaaacataagcaaaatcaacaaatttaagaaaaacccaacatagaacatatattcgtaatatattatacgtcatatatagattttcctgggatttggttttggaaaaatggatcgttatgagatactgaaagatattgggtctgggaactttggtgttgcaaagctggttagggaaaaatggagtggcgacctttatgctgtcaagtatattgaaagaggacccaagatagatgaacatgtgcagagggagattatgaaccataggtctttgaagcatccaaatataattaaattcaaagaggtgctgttaacaccaacccatcttgccatagtcatggaatatg

SEQ ID NO: 10109 - DNA, 492 bp, Gossypium hirsutum
  Clone ID: uC-gsflmaxxa041b01b1
gttgtctgcaccaggacctcgaggcgccttgaaaatagtctcttttaattttgcgaggagccgaaatccaaaccccaaagcaaaaagtgcttaacatggatgccgccggcaatcgaagttgtaagttactattatttttctttgctgccataatcccagccctgcaaggtcacatcggagaatatgatgagtattggaaacaacgtgaattggaagctaaagaaaacaccgagcaggcatataaccccaatcctgaggaagttacccagcatgtcaaccaccttgtttccaggtcgctgatgaggctaaatagcacaagacgacatttgagggcaagaaaaaaaggcggtccctgcgatccaaccagccccattgaccagtgctggcgctgtgatcgtaactgggagaaaaacaggcagagactggctgattgcgccagtggattcgcacgtggtactattggtggaaagtaccgtagaatttacgtagtga

SEQ ID NO: 10110 - DNA, 448 bp, Gossypium hirsutum
  Clone ID: uC-gsflmaxxa041b04b1
ctcattcgtccgcccacgcgtccgaatttgaccaagtcgacagggaaaagaactgggatgatcaaatattgttcaatggaatcctgtttttcttggctaacaaatacgtccccggggcttcacacttaccactatggagaacggatggtgtgattataaccatgttgctccatgtcggtcctgtggagttcctttactactggtttcatagagctctgcaccatcattatctttactctcgttaccattctcatcaccattcctccattgtcactgagcctatcacttctgtgatacatccatttgcagaaaacatagtatattttgcactgttcgcaataccaatgttgacagttgtgcttactggaactggatctatcatcgccattgctggctacatcacttacatcgacttgatgaacaacatggggcattgcaacttcgagct

SEQ ID NO: 10111 - DNA, 519 bp, Gossypium hirsutum
  Clone ID: uC-gsflmaxxa041b06b1
attactctttttattttcactcacttcacctgagattttgttttcttttgtttttcagtaatggggaagattaagatcggaattaacggatttggaaggatcgggcgtttggttgcgagagttgctctccaaagcgaagatgttgagcttgttgctgttaatgatcctttcatcaccactgattacatgacctatatgtttaagtacgacagtgttcacggtcaatggaagcaccatgagcttaaagtgaaggactcaaagactctcctctttggtgaaaagcctgtcactgtttttggcatcaaaaaccctgaggaaattccatggggtgaggctggtgctgaatatgttgttgagtctactggtgtcttcactgacaaggacaaagctgctgctcacttgaaaggtggtgcaaagaaggtgattattcctgctcccagtaaggacgcccccatgtttgttgttggtgtaaatgagaaagaatacaagcctgatcttgacattgtctccaatgctagc

SEQ ID NO: 10112 - DNA, 492 bp, Gossypium hirsutum
  Clone ID: uC-gsflmaxxa041b09b1
gtttcaggcttagaaaatttggggttttgattgtaatgtgggttttgtgttgagtgctttcctattgccatggattcctcttttgaaggagttgcgctcgatccatcaaaatgtagtaaattgagcatggatgaaaaacgagaacttgtatatgaattatcgaagaggacaagtagagcctctgaaatgctacaatcatggagccgccaagagattttacaagtcctatgtgccgagatggggaaggaaaggaaatataccggtttgactaagcttaaaattattgaaaacttgttgaaaattgtagccgaaaagaattcaggggatcatgaaggtgtgacggatcccgaatcacattcatccctatcaagtggctcgagattatccaaaaggcaaaggaaagctgattatccttctcgactgcctattccaggtaatgatcctgtaatccgtaatggcagcaatggcatgattaatgctattttttgcaaa

SEQ ID NO: 10113 - DNA, 517 bp, Gossypium hirsutum
  Clone ID: uC-gsflmaxxa041c01b1
cctcacgcgtccgcttttcttttccccgtgaaatctttgatttatagtataagtgctaacatggcagctgttatctcttgtaactcttactctcctttagctgcctctaaatggattaacccaacactccccactaaagcttcaacctttctagcaactcccaaatataatcctcacaagcatgttcagtgtaagcttcagaatgagcagaaagggaggccattttccctgaaggaatgtgcaatctccatcattttggcagctgagttaataactggaatcccatcacttgatgcatatgcagctaatcctccattgccagatttatctgttttaatctctgggcctccaattaaagaccctggagctttgttgagatatgcattgccaattaacaataaagctgttagagaagtgcaaaaaccacttgaagatataaccgagtctctcaagattgccggtgtcaaggcactcgattctgtcgagagaaatgtgaggcaagcgtcttgagctctta

SEQ ID NO: 10114 - DNA, 473 bp, Gossypium hirsutum
  Clone ID: uC-gsflmaxxa041c03b1
gttttccttgttctcttctacattcagcgaaggggtgctctgagatcacataccaaaatggtgaaggccgttgccgtccttggcagcaatgaaggtgttagcggaactgttttcttctcccaagaaggagatggtccaactaccgtgactgggaacctttctggtcttaagccgggactccatggcttccatgttcatgcccttggggacacaactaacgggtgcatgtcaactggaccccattttaatcctgctggcaaagagcatggtgctccagaagatgagaaccgccatgctggtgatctagggaatgtcactgttggtgatgatggctgtgcaagcttctccatcaccgacaaacagattcctctcacaggcccaaactccattatcggaagagctgtagttgtccatgcagatcccgatgaccttggcaagggcggccatgagctcagcaaagcacagaaatgctg

SEQ ID NO: 10115 - DNA, 537 bp, Gossypium hirsutum
  Clone ID: uC-gsflmaxxa041c05b1
ggaagagcttccttttttttttttctctccttttccaccgccgtcgatctcgatccttatcctcgttttcaaacaagctcgaaaaagatggccaacgctgcatcgggaatggctgtgcatgatgattgcaagttgaagttcttggagctcaaggcaaaaagaacccaccgcttcattgttttcaaaattgaggagaagcaaaagcaagttattgtggagaagcttggtgaaccaaccgaaagctatgaggattttactaaatgtctccccgctgatgaatgtcgatatgctgtgtacgattttgattttctaacggccgagaacgtaccgaagagcagaatctttttcatagcatggtctcccgacacgtcaaggatcaggagcaagatgatttacgccagctccaaagatagattcaagcgagaactggatggaattcaggtggaattgcaagcaacagatccaactgagatgggtctcgatgtgttcaaaagccgtgctaactgaatacggttcttttaggcatttgcaaccggg

SEQ ID NO: 10116 - DNA, 514 bp, Gossypium hirsutum
  Clone ID: uC-gsflmaxxa041c06b1
gttaccttctctacttcacttctccaataggaaaagaaaaaaccctagcggctacactcttccctcactttctaaactaacagaataaatcaatcacggaaatggagttttctcaagccgacttcgatcgccttttagtcgccgaacacactcgtaaaacgtctgaagtgaactacgctaaggaccctctcgatgctgagaatttaaccaaatggggaggggctttactcgaattagctcaatttcagactgtttcagatgcaaagcagatgataaatgatgcaatttcgaaattggatgaggcgttgatgataaatccatccaagcacgaaactttgtggtgcatgggaaacgctctttccactactgcatttatgactaccgattctgacgaggcaaaagtttcttttgataaggcagctcagtttttccaaagagctgttgatgcggatcctggcaatgagccttatcaaagtctttggaagtgcagctaaggctcagagtacatatggac

SEQ ID NO: 10117 - DNA, 489 bp, Gossypium hirsutum
  Clone ID: uC-gsflmaxxa041c07b1
tgcgaccagtaaatcgagtgaagaaattgtgttttgttagttaatttaagaagaatgagattcgagaagtgctggttttgttcctccactgtatacccggggcatggtattcaatttgttcgcaacgatgccaagattttccgtttctgtagatcgaaatgccacaagaacttcaagatgaagaggaatccccgtaaagtaaaatggaccaaggcctataggcgtttgcatggaaaggacatgacacaggattcaacatttgagtttgagagaaaacgtaataggccggagagatatgatagaaaccttgcagagaatactctgaaggccattaaaaagattgatgaaatcagatcagacagggcatctgaccacatcaaaaacaggcttaagacaggctaagtccacaggcagaaagaagcaaggaagcaattggagcacggcattcacttggtcaaagctccgctcgcacttgcacaagattcatct

SEQ ID NO: 10118 - DNA, 512 bp, Gossypium hirsutum
  Clone ID: uC-gsflmaxxa041c08b1
ctcacgcgtccggaaaactttagggttgactgataagagatgggcatgtgggatgttggttcatgcattgtttcctgagtcgagttggaaggagaagaaagggaaaggaccggagttttcgaggaatatcggagaaagagcggcggaggttgttgatagatggaaagggcaattggatggtgaaaaagaagggcttacgccgggggaagcggttatgtttttgcatatggtggttggttttgaattgaaagagaggtttgatgaagggtttttgaggaaattggttttggatttttcttcgaggagggatatggctaagcttgctgctgctttggggtttgaggataaaatgggagatattattgatgaactagtaaagaatggcaaagagatcgaggcagtgtactttgccagagcagctggccttacagagagatttcctcctgtttctctactcaagtcctatcagcagaattccaaaaagaatgccaccacaatattgaagaaatgga

SEQ ID NO: 10119 - DNA, 460 bp, Gossypium hirsutum
  Clone ID: uC-gsflmaxxa041c09b1
gaaaacagaaagctttctctccttccccttttctcccccagttctctctttgaccggcctttggctcgccggtggttcaccgtgcccacaccatgaccggtggtcggaaccgcgaggattcgggtaagtttcctcttctctttcttttttatttattaaaaagtagatttaaactatatatatattttttaaggaagaaaacataacacaaaaatgaaatagtggagaaaactctcgtcttcgtcgcttccccgaccctcgtcggaacccgagtgggttttgtgacgtttgggtcaccgcagattcacaaccacgaaggagcacgaaccacggtaagatttaattactatttatgctttatttcaaacaaaaatgaagaaaaataaaataaaagaggcacctttgagatcttggttcctgattttttccttttttattcaagagtctctgtaaaaataca

SEQ ID NO: 10120 - DNA, 482 bp, Gossypium hirsutum
  Clone ID: uC-gsflmaxxa041c10b1
cccacgcgtccgatctctttcaaaaaatttgcgaaaaacgaattctgatgggccgcctgacatccaccgtcgaaattccggaacggagacgccaatctgatcgagaaagcggccggtacgcatctgaatccgatggttcccccgattaccgccgccgtcgccgtagccctagctacgaagcctatgaacgcgaccaccagagccgcaaagattaccaacagcgtaacccttctggttcatctgaatacaggaaccctagaagacgaagccctgtcgaaagtcctgaaagaagacggcgttttgaccgcgaaaatggtcgctacgcatccgaatcggatgactctgttgattaccgccgtcgtcgccgcagtcccagttacgacgtctacgaccgcgaccaacctcgaaaccgccaccgttcggagtcgcctggagacgaaaatcctagaaggcggaaccctgcacatgacggaaccctaaac

SEQ ID NO: 10121 - DNA, 472 bp, Gossypium hirsutum
  Clone ID: uC-gsflmaxxa041c11b1
cttttgagtggggccagcaactgagtagttcttttgatggaaaaaagacatcacctgctggaaattcaaaagagacttcaattgctcacaagcgtgaaccagaggggatgaatgtgggtggtccaccagagaagaggcggaagatggaccgttgcatgactcagcagtgctctgccctacctcaccaaccaggattcaacatgaagggaggaaaatccaagtcagatactaagagtgccaagctatccgtgaaatccaaagctggaaagaaatcggggaaggctgccaaggatccaaacaagccaaagaggcctgctagtgccttctttgttttcatggaggagttccgtgagcaatacaagaaggatcaccctaaaaacaaatccgttgcggctgtcggcaaagctggtggagataaatggaagagcttgtctgaagctgaaaaggcaccttatgtagctaaggcagaaaa

SEQ ID NO: 10122 - DNA, 488 bp, Gossypium hirsutum
  Clone ID: uC-gsflmaxxa041d03b1
aagaaaagtccccccttaaaaatcgaccaaaacagaaaacccagatcataaaaagctccctaaaatgttgagtgaaacattgaagaacaagtaccaattatgtgaagagatcggaagagggcggtttggggttatctctcgagtgttttgcccttcaacccaatcctccttcgcctgtaaatccatcgacaaacgcctcctttccgaccccaccgatcgagaatgtctggagaacgaacccaaaatcatgacccttttgtctcctcactccaacatcgttcaaatctacgacatgtttgaatccgatgatacccttcaactcatcatcgatctctgccagccttttaccctctacgacaagattctggaacccgatatgtctgaacctaaagccgcggcttacatgcaacagcttatgttgggtttggctcattgtccaagtttgggatcgttcatagagatattaaacctgataacatttttttcga

SEQ ID NO: 10123 - DNA, 511 bp, Gossypium hirsutum
  Clone ID: uC-gsflmaxxa041d04b1
atctaaaaaaaaatgtcagtcaccttgaaatctccgccttcttcatttctttcatcttctttacctaaatcaagattgggatttgcaaatgggtcatcttcttcaactctactcttcaaattcaacagatcttttccagttcttcgtgcctcttctggttcctcttcttctgttgacactggtttgagtactgaattggatgctgtgtctactttcagtgagatagttcctgatactgtgatctttgatgattttgaaaagtttccaccaactgctgcaactgttagctcttcattgttgttgggcattttgagccttccagatactatttttagaaatgccgtggatatggctttggcggattcgacatgttctccgctggacaatcctgaactgaggttgtcttgttttgttaacaaggctttagtaaatgttggtggtgacttgcaaagctagttcctggtcgagtttcaactgaagtggatgcacgcttggcttacgatacacatgg

SEQ ID NO: 10124 - DNA, 495 bp, Gossypium hirsutum
  unsure (1)..(495): unsure at all n locations
  Clone ID: uC-gsflmaxxa041d06b1
tggacgcgtggggttcttgattgattgatcaagaatcatctaagggtcattaagatgaagtctttgctgtttcaattcatattggtaccatttgttatcttgaactttgtcaacaatgtgaatgccggtatcacgagtagattcattcgagaggagtggccatcggtcgatatccctcttgatcatgaagtatttgcagttcccaaaggatacaatgcacctcaacaagtgcatataacacaagggaactatgacggaaatgctgtaataatctcatggattacatttgatgaaccagggtccagcaaagtacaatatggtaaatctgatacgaactatgaattcagtgcagaagggaaaatgacaaactacaccttttataaatacaattctggctatattcatcatgttctcgttgatggccttgagtatgataccaagtactattacaagactggngatggtgattccgcacgagagttntggtttcaaaca

SEQ ID NO: 10125 - DNA, 510 bp, Gossypium hirsutum
  Clone ID: uC-gsflmaxxa041d07b1
tcctcacgcgtccgcgaaaatctctcccccattttccacagtttagtttttgcagccacaacacagccaaagaaagaagaaaatggcgtcgaacgcggcggttccattctggcgtgcagccggcatgacttatataacctactcgaacatatgcgccaacctcgttaggaactgcttaaaggaaccttacaagactgatgcccttagtcgtgagaaagttcatttctccatctccaagtggacggatggaaagcctgaaaagcctactctccgcacagactcacctgaagaatgagatgcaagtttggtcatggaagtttcgaactggaaggattttaattttttttttagtaatttctgttatgtctgaaacgtaagaacagatttcaagctgagatgatgttgcacatcctaataataatgtactttgtgacttgactgacgttgaccccttcaccggatgttcatgggttatcaagtattggtgtccagtattttaagctgaccttt

SEQ ID NO: 10126 - DNA, 472 bp, Gossypium hirsutum
  Clone ID: uC-gsflmaxxa041d08b1
tctcacgcgtccgcccacgcgtccgatagatttcgtttccatggctcatttcttaacttatcttttactctcgtttcttataatctacgactctcttggcctctcgcaatccaaccagttttgtgatgctggggttggatatcctgagtcaacgtgtgggttttcgtcatcatcgtcgtcaaagctgttgattaagggaggaactgtgttgaatgctcaccagcaggaggtagctgatgtttatgttgaagatggcattattgttgctgttaagcctaatataaaggttgatgaggatgtcaccttgcttgatgccactggaaaatatgtcatgccaggaggaattgatcctcacacacacctggctatggagttcatgggtactgagactattgatgacttctttagcggtcaggcagcagcattagcaggtggaacaacaatgcatattgactttgttatacctgttaat

SEQ ID NO: 10127 - DNA, 489 bp, Gossypium hirsutum
  Clone ID: uC-gsflmaxxa041d11b1
ttttaaaatttaaatataaatgttatatacattgttgaaattaattcgtacatggttatatattgtcgatattgaattgtttatgcatataggatgccgaattggatttgtatatgattatatattgccgaacatgattcatgaatggttataccttgctgaattgtttggtatatggatataagttgtcgaattgattcgtatatgttgtaccttgctgaaattaatttgtacatggttatatattgtcgatattgaattgtttatgaatataggatgtcgaattggatttgtatatgattatatattgccgaacttgattcgtgaattgttataccttgccgaattgtttggtatatggatataagttgtcgaattgattcgtatatgttgtaccttgctgaaattaatttgtacatggttatatattgtcgatattgaattgtttatgaatataagatgccgaattggatttgatatgattatata

SEQ ID NO: 10128 - DNA, 511 bp, Gossypium hirsutum
  Clone ID: uC-gsflmaxxa041d12b1
tttatgcgaccaagttactaggcagctcagaatggatggatggcctgccctgtcgatccatggtgataaaaaccaggctgaaagagattgggtcctggctgaatttaaaagtggcagaagtcctataatgactgccactgatgtggctgcacggggtcttggtaggatcactgtgttttaggagtcttagcatattcatgtaggtcttgaaatggtgaagataagcgagtctgccggctgctttccagtttcctgagacagtaatttgtggcttgggtgcgagttgccatgatgtacatttatatttttgactgataggcatgatcctccactttaggggagttactggacacaaggagcataatttgcttagacagctgaggtggtgatctataatttggatggttgtgcaatacaaagctcaggcaactctgttcctttgtttgagaagttttatatcccgattttaggttgagggaaaaagaaaattagaaaagctctgtatgtctag

SEQ ID NO: 10129 - DNA, 499 bp, Gossypium hirsutum
  Clone ID: uC-gsflmaxxa041e01b1
cggacgcgtgggcgggcaagcccttcgttgatgttttgaaggaaggtggtgtcctccctggcatcaaggtcgacaagggtaccgttgagcttaacggaaccaaccgcgagactttcacccagggtctggatggccttgcacagcgatgccagaagtactatgaagctggtgctcgctttgctaaatggcgtgctgtccttaagatcagtgctaatgagccaaccgagcttgcaatccaagaaaatgccaacgggctagctatgtatgctgccatctgccagcaatgtggccttgttccaatcgtcgaacctgaaattcttgttgacggatcacatgacattcaaaagtgtgctgcagtgacagagcgtgttcttgctacctgctacaaggctctaaatgaccaccatgtcatgcttgagggtactcttttgaagcctaacatggtgacccctggttcggactccccgaggttgccccagatgttattgctgagtatact

SEQ ID NO: 10130 - DNA, 498 bp, Gossypium hirsutum
  Clone ID: uC-gsflmaxxa041e03b1
cccacgcgtccgatctaaatgttttcagaaacttagatccaattaatattgttcccctaaaattttatccaaaaaaattccatattgaaacaaaaaatgggaattttatgcaaggtagttgatatgctgctgttggtggcgtttatggtgatgcttgtagccggacctttaatcgatgcgcagctggttttgccggagaccactttcccggaggtgctcgtccgtttgaagcagcaatatgcggcggagtaccaagattatttgatggtggagaagcctcatttcttcgtggccttggtctggttggagcttattttccagtggcctctggttttgcttaacatttatgggattttggcatccaagcattggttccataccacttgtctcatctatggtgcctctgttattactgccatgaccgctttattaggggagctgatgggatcccagaaggcatcagataaattgttgacagtgtactctccttcatgggac

SEQ ID NO: 10131 - DNA, 499 bp, Gossypium hirsutum
  Clone ID: uC-gsflmaxxa041e04b1
gtttgaccaaattggtgttgtttcagaacttgattcatgaactcataacaccgttgctgatggctttcgggctgtggttcacattgtttgagcttttactcaagttgtttcttatcttagcctttgtgaaaaagggcagtgcgggaattacaagtacttttactcgtacgaaatggcaatcttttgatatccctcttgaccataaagtacttgcaattcctaatggttacaatgctccgcaacaagtgcatattactcaaggtgactatgatggaaaagctgtaatgatatcatgggttactgctgataaacctgggtcttctagagtacagtatggcacatcagagaagaaatatgactttaaagctgatggcacagtggctaattacaccttttacaactataaatctggctatattcatcactgtcttgttgatggtctagagtatgagaccaagtactattacaagattggtgaaggtcattcatctcgagaatt

SEQ ID NO: 10132 - DNA, 510 bp, Gossypium hirsutum
  unsure (1)..(510): unsure at all n locations
  Clone ID: uC-gsflmaxxa041e07b1
ctcttctgcttattagctctagtctacgccaagaggttcaaagattttatggctgtttccaagtcttcctcgggcaagcaacaaaacgaccgtgatcaagaatatcacaagaaatcggagccgttgattccagggctacccgacgagatcgcagagctttgtcttcttcatcttccatatccataccaatcgttggcacgttcagtatgttgctcatggaacaggaccataaccgaccctggcttccttctctccaggagatccttatcgctttctctgccttatctgttcgttttcgcttttcataactcaacggccaggatacaatggcaagcttttgacccgcgatcaggccgttggtttatattacctcccatgccttgtcccaagtctgtgttcccaccagggtttgcttgtacttcgattccacgtcaaggccagctctacgttttaggtggtatgcgttcagacacacaaacttncatcaacacaacggtcgtctacactaca

SEQ ID NO: 10133 - DNA, 503 bp, Gossypium hirsutum
  Clone ID: uC-gsflmaxxa041e08b1
tcgcccacgcgtccgcccacgcgtccgcccacgcgtccgcccacgcgtccgggggaatctagtgagtcccaggaacggcaactgaaggcaagccattgccagcctcaatcatcacagctgcaacataatgtagatattgaacattcacacacgtcacttacagattctgccttgagggctatcagatgtgcacttagatattctgccagccctaaaactaacaaatctaaccaagaaaatcaagggccgttgggctgcaccaaatcccagcctgagcagagcccacagagacccgaacagcgacagttcacaaagaagaggaaaggaagaggtcctactcgctgcctcttcttaaatgatctggcagatggtgagcggatatttgtccacatcaacaagtttggacagcctgttggtccaaattcatccaagctaagcagcttcctgggcactgtagcacggaatggacacagggcaccacttaattttatagactggagggc

SEQ ID NO: 10134 - DNA, 411 bp, Gossypium hirsutum
  Clone ID: uC-gsflmaxxa041e10b1
ttcacccagagacgaggaagggcgtagtaagcgacgaaatgctggaggagggcttggcgggggtgccggtttaggaggtggagctggtggtggtgctggaggagggcttggtggtggtttaggaggaggagccggtgggggtgctggaggagggcttggcgggggtgccggtttaggaggtggagctggtggtggtgctggagcaggtggcggtcttggaggagggcttggtggtgggggtggtgcatgtggtggtagattgaggaacgaaaaacatattgacctcgttgggggatttgtgttgactcatgtaccggaagaatatagggggatgcacttggtacatatataaaggacccctttgttgctttagctggtcaaattttgaatggaacatcttttgggtctgtt

SEQ ID NO: 10135 - DNA, 216 bp, Gossypium hirsutum
  Clone ID: uC-gsflmaxxa041e11b1
tctcacgcgtccgcccacgcgtccgggaagaggaagcggagtacgaggattaggaaggaaaaactttatgccagttgggcaaattctaatctcaacttccagttgctgaaagaaatagtcattatgctgtgactgttgttgcatttatgtttctaagtgaacttttttcttgagcttttcatgctcaatacttagcaaagcatgcgcagtttatgt

SEQ ID NO: 10136 - DNA, 399 bp, Gossypium hirsutum
  Clone ID: uC-gsflmaxxa041e12b1
acgcgtgggcggacgcgtgggcggacgcgtgggcggacgcgtgggcggacgcgtggggttttagagaaaaataaataaatgaatggtacttttttaattttttcactaaaagtttgattattgtataattaggttttattgacggtattggttcctcgcataaacaagtaaagatggataaaacttgaagggggtatttgctagttttgaagaaaaaaggggaaatttttcggggggttcaaaggcctaattttcatgtaattttggttcatataagagcttggttttgtgggtaaacaagtttaaggaggttaaaaaggcttgttttttgtttgtatggaaagaggggtagccggaaagagtgtaccgccgaattcatttgataaatctaaagttttg

SEQ ID NO: 10137 - DNA, 492 bp, Gossypium hirsutum
  Clone ID: uC-gsflmaxxa041f02b1
atggtaaggtagtccccagatcagaatctagcaacaatgcaaccagtaaccggcatcttaatgctgcagagaagcatcgacagaagctgaagaagatgatggatgagctgaatgaggagggtgatggtcgctctgctcctattgtcaaactgggggatgcctcaatggcatcaccatttactgcaaagcatgcatcagttgccccaaccactgacataattcgtcaaggacgcagcacccttgtgactacccttcaaatgttcaagatcctcggccttaactgccttgctacagcctatgttttaagtgtgatgtacttagatggtgtcaagctgggtgatgttcaagcaactattagtggtgtatttacagctgcatttttcctgtttatcttacacgctcgcccactacccaccctttcaagtgcacgggcccacccgaatattttctgctcctatgacttcctttctctcatgggacagtttgctatgc

SEQ ID NO: 10138 - DNA, 498 bp, Gossypium hirsutum
  unsure (1)..(498): unsure at all n locations
  Clone ID: uC-gsflmaxxa041f06b1
cggtcgcgtggggaaaaataattctgattttgatctgtgcttgacttggttgattctcagatttggcagttctaagtcagtagcttggcagagagaaaaaagaatgttgaattctgggaataatttaagccgagggaatgcggggttgtcatcagatatgccaccattacctcagtgtttgcctttggaaccgatttcattaggcagtcagaaatatacacggtctggagagttaagccgggtgttgggcgttcctcttcgaaacagtacatcagaggatcattcttttggagtttcacaccctaagccttcccctccagtggcaacagaagagcttaagaactttaaggaaagtgttcaagatacctccagaaaggccagggatagagtaaaaaagttgcgagagtcaatttctaaacttgaaaggtatagagaagctttaagctcaaagaagcgacaacgaagtgatatttcaagtgagagaacangtggagtaag

SEQ ID NO: 10139 - DNA, 454 bp, Gossypium hirsutum
  Clone ID: uC-gsflmaxxa041f07b1
tcccacgcgtccgaattgcgtgagccgctatagttacgattccctccagcctagattctcataattgtgtttcccctctgcaaaggctttattcttcattcgcttcgttgaatttctatcttcttttgatctgaacggagtttggtaatccagttttcgtcttctgttgattcaggaaatcttagtttttgaattgcgtgactgaatgatctaatggagtctaaaggtgggaaaaagaagtccagtagtagtaagtctttattctacgaagctcctctcggttacagcattgaagacgttcgaccaaacggtggaatcaagaagttcagatctgctgcttactccaactgcgctcgcaagccatcctgatatactcacaagcgtgccgtctgaccactagtagtggttaataaaactgttatttgctctgttagttagttttagattatttccc

SEQ ID NO: 10140 - DNA, 502 bp, Gossypium hirsutum
  Clone ID: uC-gsflmaxxa041f08b1
ggaagactattcccatcagattgctgaaatgattggattgagaaatgaatctaacttcatacaagctggggtcagaaccatcttggatataggatgtggttatggaagctttggagcacatcttttttccaaacagctcttaaccatgtgcattgcaaattatgagtcatcaggcagtcaagtccaactcactctagaaaggggccttcctgcaatgatcggttctttcaatgcaaaacaattgccatatccatctctttcatttgatatgctgcattgtgcacgctgcggtattgactgggatgaaaaagatggtattttcttgattgaagttgatagagttctaaagcctggtggatactttgtatggacttcacctcttaccaatgttcagagttttcttcgtaacaaagagaagcagaaaaggtggaactttgttcgtgattttgcagaaaacctctgctgggaagtgatgtcacaacaagaggaaactgtgttgtgg

SEQ ID NO: 10141 - DNA, 448 bp, Gossypium hirsutum
  Clone ID: uC-gsflmaxxa041f09b1
ctcacgcgtccgaaaagaggttatagaatctttgttacttaaacggtgccctcatctttcagaaatccaaagtattgtacttactgaaatagaaagcactggttacttagtattggcaagtgtggatgcttatggtcatcttattgtctctaaactggatgccagtggtaaagatgctgacaagattacttattcagtgttacctcgggattttggtgttggagaaggtagttggtctgggatgtgcttcagtccaactcaatggtccatggcagctgtggcacgaagcttctgcaaaagtgttgatgtttatgaccaggatatccatcttcggactttgcgtacactttggtatccatcttcgctaagcttcatgcggaatttaagtcatgggaatgagagttctatattagccgtaactgaagggctgccagtgtctgtatgggac

SEQ ID NO: 10142 - DNA, 491 bp, Gossypium hirsutum
  Clone ID: uC-gsflmaxxa041f11b1
gtgtaataaatagccccgaagcccaaccccttcccccattgaatttgatattttcgaagataaaaaaggatggggctgtcttttgctaagctgtttagtcgactgtttgccaagaaagagatgcgaattcttatggtgggtcttgatgctgctggtaagactaccattttgtacaagctcaagctcggtgagattgtcactaccattcccaccattggctttaatgtggagaccgtagaatataagaacattagcttcactgtttgggatgttggtggtcaggacaagattcgacctttgtggaggcactatttccaaaacactcaggggctaatctttgttgttgatagcaatgaccgtgaccgtgtggttgaggccagggatgagcttcatcgtatgctaaatgaggacgagctgagggatgctgtgcttcttgtgtttgcaaacaagcaagatctgccgaatgctatgaatgctgctgagattactga

SEQ ID NO: 10143 - DNA, 488 bp, Gossypium hirsutum
  Clone ID: uC-gsflmaxxa041g03b1
gtgtttggtgaatggttaagaaatgcttttcgctggaaagcaagtgttggaccttgggaagaaagaccagggcactttggtgacgtttggatgtactggactgatgatggacttggttactttgagtttcttcaattagcagaggatcttggtgcattgccaatatgggtgttcaacaatggaattagtcataatgatcaagttgatacatccagtgttctgccttttgtgcaagaggcccttgatggcattgagtttgctagaggtgatgctagttctacatggggtgctgttcgagctgcaatgggacaccctgaccctttcgatttgaaatatgttgctattgggaatgaggattgtgggaagaagaattatcgaggaaattacctcaagttctatgatgctataaagcgggcctacccagatatcgaaatcattacaaactgtgatggatctttttgcccgcttgacacccaactgatctttat

SEQ ID NO: 10144 - DNA, 498 bp, Gossypium hirsutum
  Clone ID: uC-gsflmaxxa041g04b1
ttttatccctaacgtctctcactctccatctttgctttggggtcccgtctatggagatttcttcaatttccactactacaatacactacttctgtccctcaacagagtctttgctgttcaagagagttaagcttccttcacgggatcaacatctggtgtctatttctttgaattcaagaactgaacagcgtttattagctcggccatgttctcttgctcacaaggggaactcggtgaaggttaaatgtagtcaaaagagagaaattccggttttagaggccagttctatggatgaggtttttgatattttggctgaacgtattcttcctacatcatcagtagcatcaaatcctaatacaaagcatattgtcggtttagctgggcctcctggttctgggaaaagcactctagcttctgaagttacacagcgcataaacaagttttggttgcaaagtgcttgttcttctgatcctcaagttaagccttctgatgtggcta

SEQ ID NO: 10145 - DNA, 467 bp, Gossypium hirsutum
  unsure (1)..(467): unsure at all n locations
  Clone ID: uC-gsflmaxxa041g05b1
ccctcgtgtccgcccacgcgtccgcccacgcgtccgcggacgcgtgggcatcaaccaaccataaactgctttttgtctctctattcattcatctctatccccatctccaatttctctcttcttcttttttctttttccaattaaaactttccctaaacccacaataaaacaacaccatgagtcgcttctggactgtgctctccaatcttcatgctttagctgggcctgtggtgatgtcgctgtatcccctatatgcctcagtgatagctatagaaacaccagggaaagaagatgatgaaccacggcttgcttattggatcctatattctttgctaactttaacagagatggtgcttcaatcagcattagagtggataccaatttggtacacagcgaacctagtgtttatggcatggatgggattaccacagtttangggggcagcttttatatatgaaagtttgtga

SEQ ID NO: 10146 - DNA, 518 bp, Gossypium hirsutum
  unsure (1)..(518): unsure at all n locations
  Clone ID: uC-gsflmaxxa041g06b1
ttatgtcttagaagttggagctgatttttatgttagcaatttacataaatggttcttttgcccgccttctgtggcatttttatactgtaataaatcgactacatcgtctgatttgcatcaccctgttgtttctcacgagtatggaaatgggttgcctattgaaagctcctggactgggactagggattacagttctcagttagttgttcctgcagttttggagtttgttaacaggtttgaaggagggattgaggggataatgaagaggaaccatgatcaagtggtgaagatggggaagatgttggttgaatcatgggggacaaatttagggtctcccccggagatgtctgctgcaatgattatggctggtttgccgtcgaggttgtgccttaatagtgagaaagatgctttgaagttgaggtcacatctgcgggattgatatgaggttgaagttccaatctttcatcaggttccaaaggatggngaagagggtgttagaaataacgatggatttatta

SEQ ID NO: 10147 - DNA, 481 bp, Gossypium hirsutum
  Clone ID: uC-gsflmaxxa041g07b1
gttccctatcgagccagcaccatggagatatgcaaatggaagtcgaggtactcagaaacaacctcttaaacatgtaaaggttccacccaagcctccgaattgttccccttcggtttatagtgagatcgagaaaagattgaaagatctcgaatttagacactcgggaaaggatctcagagctcttaaacagatacttgaagcaatgcaagcaaagggactacttgagactgggaaagaagaacaagctgcgaacttggtgtctcaaagagactatgaaccgaaatgcacgagccccggtcagcatctgagaggtcagcgaagccaacggggttcggattctattggaacatatgaatcacctattgtgatcatgaaaccagcaaaacttgttgagcaagttagtatgcatgcttcaactgtagttcccatagttgacatctcaagtcttccgaagattcagaatggggcatctgtagataat

SEQ ID NO: 10148 - DNA, 503 bp, Gossypium hirsutum
  Clone ID: uC-gsflmaxxa041g10b1
tttacgcgtccggttctttagattttcttaccagttccttctattaagaaaatggcctcccacattgttggatatccccgtatgggaccaaagagagagcttaagtttgctttggaatccttctgggataagaagagcagtgccgaggatttgcaaaaggttgctgctgatctcaggtcatccatctggaaacagatgtctgatgctgggatcaagtacatccccagcaatgctttctcttactatgaccaggtgctcgatgccacatccatgctcggagctgttccacctagatacggctggagtggtggtgagatcggatttgacacttacttctccatggccagaggaaatgcctctgtccctgcaatggaaatgactaagtggtttgacaccaactaccacttcattgttcctgaattgggacctgatgttaacttctcttatgcatctcacaaggcagtggatgagtacaaggaagctaaggcgcttgagttaacaca

SEQ ID NO: 10149 - DNA, 517 bp, Gossypium hirsutum
  Clone ID: uC-gsflmaxxa041g11b1
ttcacgcgtccgattcattatttacgttaagttcaaagaaatggctaatcctgtgatcactcgcgtccacagtctccgtgagcgtttagatgagacccttcttgcccacaggaacgagattttggccttgctctcaaggatcgagggcaaaggaaaaggaattctgcaacaccatcaaattattctagagtttgaagctatccctgaagagaacagaaagaagctcgctgatggtgcattttttgaagtattgaaggctagtcaggaagcgatcgtgttgcctccatgggttgcacttgctgttcgtccaaggcctggtgtttgggagtacattagagtgaatgttcacgcccttgttgttgaggaacttactgttgctgagtatctccacttcaaggaagagcttgttgatggaagttcaaatggaaactttgttttggaattggattttgagcccttaactcatcattcccccgcccaactctttcaaatccgtggtaatggtgggagttcctaa

SEQ ID NO: 10150 - DNA, 522 bp, Gossypium hirsutum
  unsure (1)..(522): unsure at all n locations
  Clone ID: uC-gsflmaxxa041g12b1
tcgttttatcgccgtctcgagaggcatggccaccaagcagccaaatacaggcctttttgtaggactaaacaagggccatgttgtaaccaagaaggaattggctccacgtccatctaacagaaaaggaaaaactagcaaaagagtccattttgtgaggaacttgataagggaagttgctggttttgcaccgtatgagaagaggattacggagcttttgaaggttggtaaggacaagcgagctctcaaggtagctaaaagaaaattgggaactcacaagagagccaagaagaagcgtgaagagatgtcgagtgttctccgcaagatgagggctcatcatcctggaggtggagacaagaagaagtgaagcttttatttttgttgatttatggacaagcttgaaagtttgatttagtagctgttagagattttgtttagcactttgtttgagactgaaaatcatgcactcaaatttgctgctttacatgaattactgcangttttttttttttttaaaatttaaaa

SEQ ID NO: 10151 - DNA, 88 bp, Gossypium hirsutum
  Clone ID: uC-gsflmaxxa041h01b1
tttttgtatgtgtggacagctgcaagggggccattggtggttttgtgaactggcgatggcggaaggaaccggagccgggttactgtgc

SEQ ID NO: 10152 - DNA, 482 bp, Gossypium hirsutum
  Clone ID: uC-gsflmaxxa041h02b1
actttttgtagtaccagaggaatgtaaaaccgaaaccgatggctgcaccaacaaggaaaaggccttaccccttaagatcatagccattttctccatattgatcgctagtattatcggtgtatgttcgcctttattcacacgttcggtcccagctcttaatcccgaaagaagtttatttgtgatcgtcaagtgcttcgcatcagggattattctggctactggtttcatgcacgttttaccggactcttttgacatgttaacatctaagtgcttgaaagagaatccatggcacaagtttcccttcacagggttcgtcgccatgttatccgcaatcgtgactttaatagtggattccgtggctacatcgatatacagcaagaaaagcaacaatgaggttatcccaaaagttgcatcacctgctgggggtacacaacaggacatggctgtggtgaatgttggacactttcatggtcatcatcatg

SEQ ID NO: 10153 - DNA, 520 bp, Gossypium hirsutum
  unsure (1)..(520): unsure at all n locations
  Clone ID: uC-gsflmaxxa041h04b1
tcttttcgtccgcccacgcgtccgacccaattgaccaccatgtttaaattaatcaacatcctaaccatccttgtgctacttacatttagttcggaaattgcagatgccgcacctccntgccaggaggatatcgagtcgattaccccttgcttgagcttcataaaaggtcaacccgatccggcaccacgatgttgttcgggtgctaaagggctgnntaagcaagctaacaccaaactagataggcaaggaatatgcgagtgccttaaaggtgtattgccaaaaataggaccatatgaccctaaaagattccctcttattgcccagaaatgtggtatcaatactttaattcctccaatttctgccactactgattgcaccaaggcgtgaagagtgaagtggggggaatgtgaaaatgaagagcatgccaaatgaataaaaaaatgggccgaacttttcataaattgatcctgaatcaaccccttgattgcacttaagtatggattattaatataattacaat

SEQ ID NO: 10154 - DNA, 422 bp, Gossypium hirsutum
  Clone ID: uC-gsflmaxxa041h05b1
ttttctttcttttagaattagcgggggtcttctttgggacttgtaatggtgattttcataggctaagtgcccaactgttgggattcaaggaattgcttgggcttttggtggtatgatctttgctcttgtttactgcactgctggcatttcaggtggccatatcaacccggcagtgacttttggactgttcttggcgaggaagctgtcgttgacgagggcaattttctacatggtgatgcagtgtttgggcgccatatgcggggcgggtgtggtgaaaggtttcatggggaagactcattacggtatgttgggcggcggagctaactcggtggctcatggctacacaaaaggtgatggccttggtgctgaaattgtcggcacctttgttcttgtttacactggctttctcaaccactgacgcc

SEQ ID NO: 10155 - DNA, 488 bp, Gossypium hirsutum
  Clone ID: uC-gsflmaxxa041h06b1
gttagtaaaaagaaaaaaaaaaggttcagatttcttcgccggtaaaaaacccggaggcgtttctccggcgaggcgttagggtgtagcttccaagtagcatgaaaagtcatcgtcgtcatcgaaaagttgcgacggtgaagaatgattataagcaactagatcgatttgagtcaggtgaaggagataagatgaagaagcaaagatttaagaggaaattgttgaggtacgaagagttaccggattatttgaaagataacgagttcatcttgaattattaccgatgcgaatggccattgaaggacattttattaagcgttttctcattgcacaacgaaacgataaatatctggacgcatttggcagggcttttaatattcgttggattaacggtgttcagttccatggaggattttggagatggaagtttgatcaccagttttttcaagctcaagtatcaagacccgtgatgatgatgatgaatgatgtaa

SEQ ID NO: 10156 - DNA, 311 bp, Gossypium hirsutum
  Clone ID: uC-gsflmaxxa041h08b1
aagacccacgatcctatgaggttttgactaagaggttcataggagatgataatggaaatgtgaaaggacttgaggtggttcgtgtgcgttgggagaaggatgccagggggaggttccaattcaaggaagttgagggctcataggaaataatcgaggctgaccttgtgctgctagccatggggttccttggccctgagtagacactggcggaaaaattaagtgtggggcaagacaaatcgtcaacacttaaaggcagagtatggccgcttcacgaccaatgaggatggagtctttgccgctggagattgttg

SEQ ID NO: 10157 - DNA, 121 bp, Gossypium hirsutum
  Clone ID: uC-gsflmaxxa041h11b1
attctcatgagtccgcccacggatggggggagctaaaaccacgtctgggtaactcacgggtctcctgctgcaaatgtgcgaaatatgtgatccaaggcgacattgcagtgaatgcggcaaa

SEQ ID NO: 10158 - DNA, 497 bp, Gossypium hirsutum
  Clone ID: uC-gsflmaxxa042a01b1
atattatataaagtatggctattcaatttaattttgtttcatccatgttaatactagtacttctgtccatatcatccgttgaaggtcaaggaggaggaggtggtggtgttattgatgttgttgcaaagtttggtgcaaaggcagacgagaaaacagatttgagtaagccattattggatgcttggaaagaagcatgtgcctcgacatctccgtcaaaaattgtgattcctaaagggatatattttttaagtacagctaccttagatggtccttgcaaggctcctattgagcttcaagttcaaggcactgtgaaggctccggcagaccctggtgctttcaaggagcctaaatggattgctttcaatagaattgaaaatttcaaattgtctggcggaggagttttcgacggccagggaaccactgcttataaaagggaaggttgcaaaggtcatgattattgtggttcacttcctattaacctaagatttgatttttta

SEQ ID NO: 10159 - DNA, 480 bp, Gossypium hirsutum
  Clone ID: uC-gsflmaxxa042a02b1
ttattatttgggaaatgctttgaaagatgttggtcgtgttgatgaggcaatacaatgttataataaatgtctcactttgcaacctaatcatccgcaagcacttaccaacctcgggaacatatatatggaatggaacatggttgctgctgctgcttcttattataaggctacgttgtctgttacaactggcttgtctgctccattcaacaaccttgccgtaatctataagcaacagggaaattacgtggaagctatatcatgttacaatgaggtattgcggattgatcccttggcagctgatgggctcgtaaataggggtaacacttacaaggagattggtagagtgactgaagcaattcaagattatattcgtgctattaatatccgcccaaatatggctgaagctcatgcaaatctggcttctgcttataaggatagtggacatgtcgaggctgctatcaaaagctataagcaggcatt

SEQ ID NO: 10160 - DNA, 394 bp, Gossypium hirsutum
  Clone ID: uC-gsflmaxxa042a03b1
ctgtttattgcatcttccctcgaggcaccggctctctcttcattggcttgttgttctcgggattggcaagaaatatgcgtgtcggattgtttatggaagtcgcttcttaaagaaagatggcctcttttatgcggagctgataaagaccctaacttcaaggactggcgaggattttatgtaaagcagcacgaagagcagaagcgtcaagccgaatccgtcattaatttggtggaacaacgctcgctattcggttcactcaatgctgtagactatctgcatgcgatcagttgcctggaaaggattcagctcggtttcagagatgttcaaatgctgctgttgaaaccaaagctgaatgttctgcttaacttgatcggactacattactaccttaaca

SEQ ID NO: 10161 - DNA, 425 bp, Gossypium hirsutum
  Clone ID: uC-gsflmaxxa042a04b1
tcttttaaaaaaaaaaaaaaaaaaaaaaaaaaataaaaatgatttaaaaaaagctaaaaaaaagctaattatagaagttccattcctgccatggattcatatgaagcaacgaggatagtgttttctaggatccaaaatttagaccctgaaaatgcttctaaaatcataggttaccttcttcttcaagaccatggtgacaaagaaatgatacgtttagcttttggacctgaagctttaatccattctttgatctttaaagctaaaacccatctaggtctccccatttctaacccgccttcgccgtctcctcctccgccgttctcttacgccggtgtcgttaatgggtgtgccaaatctttgcatggtgtggccgccgacgacaatggtggattcgtggatgattttcagtttcaagaacatgtttc

SEQ ID NO: 10162 - DNA, 372 bp, Gossypium hirsutum
  Clone ID: uC-gsflmaxxa042a05b1
ttttctcgtgggggaagttatatctgagcttaaggcagctggtgcttcctggattcagtttgatgaaccgacccttgtcttggatcttgactctcacaaattgcaagcattcactgctgcttatgatgatttggaatccactctctctggcttgaatgtattgatcgagacctactttgctgatcttactgctgaggcatacaagacactcattgggttgaagggtgtcactgcttatggtttggatttggttcgtggagcccagactcttgatttggtcaagagcaatttccctaagggcaagtacctctttgctggaattgtggatggaaagaacatttgggcccatgatcttgctgcttctctcaacac

SEQ ID NO: 10163 - DNA, 390 bp, Gossypium hirsutum
  Clone ID: uC-gsflmaxxa042a06b1
tttttcacttggagcttcaaataatataaattcaaattaagcatttaaacccccccccccaaaaaaaaaaaaccccttccattcttcgacactgtgattacaaaagatcacattttttattttcggtggggtttaaggggtaaagataaagccattgcctttagtcctttacccccaccccatttatttattaaaaaaatagaaactttactgttaattcatagaaaaattggatgaccgtgggaaagtgaaagacacttggttggttggccccgttttaaaaaccctttttttttaaaattggggggggcaggggaaaagaacggtgaataagaaaaatggggggcccgaaaaagaaaatgaaaccgactggttgggggaaatgggaat

SEQ ID NO: 10164 - DNA, 494 bp, Gossypium hirsutum
  Clone ID: uC-gsflmaxxa042a07b1
aataaatagccccgaagcccaaccccttcccccattgaatttgatattttcgaagataaaaaaggatggggctgtcttttgctaagctgtttagtcgactgtttgccaagaaagagatgcgaattcttatggtgggtcttgatgctgctggtaagactaccattttgtacaagctcaagctcggtgagattgtcactaccattcccaccattggctttaatgtggagaccgtagaatataagaacattagcttcactgtttgggatgttggtggtcaggacaagattcgacctttgtggaggcactatttccaaaacactcaggggctaatctttgttgttgatagcaatgaccgtgaccgtgtggttgaggccagggatgagcttcatcgtatgctaaatgaggacgagctgagggatgctgtgcttcttgtgtttgcaaacaagcaagatctgccgaatgctatgaatgctgctgagattactgataagctt

SEQ ID NO: 10165 - DNA, 471 bp, Gossypium hirsutum
  Clone ID: uC-gsflmaxxa042a09b1
ttctttcacgcgtccgcgctgctcaaaaacactctctcctccccctctctcaccctctaatctgatcactgatttcttcgatttcaagttgaagtcaagctgcagctatactgtgatttggttaatatagaattgaaacaatgggggagctgttgggactgctaaaagtggtggttgtgcaaggtaaaaggttggttatccgggattttaagagcagcgatccttatgttatagccaagctcggtgatcaggtagcaaagactaaggttatcaacagttgcctcaatccagtatggaatgaagagctcactttctccctcactgaacctgttggagttctaaatttggaagtattcgacaaagatcgtttcaaggctgatgacaagatgggacatgcttatctgaaccttcaaccacttgtctcagctgctagattaagccatgctcttcgagtttcttctggtgagatga

SEQ ID NO: 10166 - DNA, 304 bp, Gossypium hirsutum
  Clone ID: uC-gsflmaxxa042a12b1
agctctcaatataatacaacacttcaaatgtgagcatttatacccccccccccacccaagaaagagcccgtgccatgatccgacaactgggattacgggggccagagctctctattccacggtggggtgaaaggtgtaaagataaagcccacggcctctaggaccttacccccaccccgaagatttcgtacaaacggtggaaacaaactgctaacccatagaaaaaatggaagccggtggaaacgagacagacactctgggggcagggcccgataaagaaaaaaagagctttgaaactaagggg

SEQ ID NO: 10167 - DNA, 491 bp, Gossypium hirsutum
  unsure (1)..(491): unsure at all n locations
  Clone ID: uC-gsflmaxxa042b01b1
tttttgtattaccattttgaagtttttattgtatttgtaatgtagttaccactgtttcatgtcattttctggtcgggttactcttcatatgaatagattcatgtattactagcagctgactgtagatgcagaaaactattttatttattcctagtaagtgatttctcatgcacattgtgctccaaaattgacacacctacaatagaatatttgagctgaggcccttcctgcaaaaggaatgtaggtagcaatggcttcgtcttccctactcctaattttctatctgggagtgtgaaagctctctttctgcaggtttgctcataaatttctactaagctactagttttaaacagtgaagttaacctgaagtaaaggtcattcagaattccgtaagttttactgccttttgcatgcttgattaatagcaaatggctgaaagagagaagtgaagttactatgatgattgnnggtatggagtccatggcaagaac

SEQ ID NO: 10168 - DNA, 473 bp, Gossypium hirsutum
  Clone ID: uC-gsflmaxxa042b02b1
ctgaataaaagtttgtacttaattatttttcccttttaatctcaaaatttgcccccaaatttcccagttctttttccttttcatttcacggcaccgaattcactcaccatagctactccttttctctcaatctgttagggtttctttaattttagattttcaagggaacgtacagtttccttttaattttgctggtgatttctatggcgacggaaaccctagatgacaagaaatcggaggaagaggaggtgaaagataaagaaaacgaagagggaagtaaggaggaagtcactgccaaattattggaatttttggaatcccctcatgctactacagatgttcttcttgctgacaaggaacagaagggtaaaaagcgtaaggctacaccaagcaaaaatattggttctgcggaggcattggatacatcagccaagaatgttaagacatttaaagatgtcaaaggctgtgatgat

SEQ ID NO: 10169 - DNA, 493 bp, Gossypium hirsutum
  Clone ID: uC-gsflmaxxa042b03b1
tttgttaaagggttgggcagtgaaggtgatgatgatgagtttggtggtggtggttggtgcgggtgatgagagtgggttagccaaagagtgcagcaaagatttacagagcgtgatgacttgtttgagctttgcgcaagggaagatggagaaaccttcaaaggagtgttgcagttcggtttcgagtataaaagaagaagaaccaaagtgtttgtgttatattcttcagcagacccaggcatccggggctcagaatcttaagagcttaggcgttcagcaagataagcttcttcaacttccttctgcttgccagttgaagaactctagcgtcactgactgcccaaagcttcttggattagcaccaaactcaccagacgcggctatatttacaaattcttcctcaacaccgacgacgccattcaccgggacaccgtcaagtgcttcagagaatgctgataataactccggtggtacaaagttagaaactgctcacttg

SEQ ID NO: 10170 - DNA, 450 bp, Gossypium hirsutum
  unsure (1)..(450): unsure at all n locations
  Clone ID: uC-gsflmaxxa042b06b1
ttttgtttcatgatgacacagatttggtcgtggagtgttggaaagatgaatagcagaggccggaattcttttcagtctaagaaagttccatggaagcatgaaaaagaggaggctgaaatgcaggggaacaagccaacaattgcaacaaagacaatgaagaatcgacgagcctcaagcaaagagagaaaaaaggctttacaacaagatgttgataaactgaagaagaagcttaggcaggaagagaacattcacagggctctggagagagcttttaaccgacctttgggagctttacctcgtcttcctccctatctccctcctcctacattggagcttttagcagaagtggcagtactggaagaggagattgttcggctggcagaacaagtggtgcacttcagacaggatttgtatcangaagctgtgtatacctctacataaaaaggaaca

SEQ ID NO: 10171 - DNA, 455 bp, Gossypium hirsutum
  Clone ID: uC-gsflmaxxa042b07b1
tttgttcacgcgtccgcttcacatctcttcccttaaaattcctctttgatttccaaccaaatcagagagcacaaagaaaacaacaaagggggaaaagagaagtagaagtagaagatagaagaacacatcagaagatctctttctctctctctctctagctggtgttttagcgatgtttcgttaagaatcatttggaggttgatgtatgaaatccagcactggggaataatgggtaaaacaatggaggttcagcgtatgaaggaattgctgttactttggtcgaggttccaaagtaatcgtgtggctctcgtgggtggaaatcacactgccgctcgattttgcactcgctaagttttgccttcttcattcctctctttctcgcctgttataatctcttccttgttttactttaatatgctatctctagattttcttttccggaaaaagtttctatt

SEQ ID NO: 10172 - DNA, 469 bp, Gossypium hirsutum
  Clone ID: uC-gsflmaxxa042b08b1
tctgttactgtttctgaacttattgaagcttctgagcaaggcttaggttttccttcagatatccctcagtccccaaagcctcaagatgataaatgtgatgcctctgatctcccatgcgaagcttggtggaagagaagagcagtttcattgtatgttcatgcaaaagagacaaatgcattttggtccgttttcattgctgcagctgtgatgggccttgtgattcttgggcagcgttggcaacaagagaggtggcaggcattgcaacttaagtggcagctcatcatcaacaacgagaagactggtagggtgctcgattccatatatcgtcttaaagaagtcatcgttggtggccactgtcgaggttcttttgtgaggggcaccttccctggtgacagctaaaagctgtgatgatgatgatgaaaaagcgtagtaagagagaaatgagatggagattgatttgggtgttaat

SEQ ID NO: 10173 - DNA, 446 bp, Gossypium hirsutum
  Clone ID: uC-gsflmaxxa042b09b1
tttacgcgtgggcggacgcgtgggcgagagcccatctctctgcttcaaagctcctgtccaggtagaattctcttcttcccttgcgttgtgttctttcctgttcaatcgccatggcttcaaagcggattttgaaagaactcaaggatttgcagaaagatccacccacttcttgcagtgctggtccagtagctgaagacatgtttcattggcaagcaacaatcatgggaccctcagatagcccttatgctggaggtgtgtttttagttactatccatttccctccagattatcctttcaagcctcctaaggttgcatttaggaccaaggtcttccatcccaacatcaacagcaatggaagcatttgtcttgatatcctcaaagaacaatggagccctgcactaaccatttccaaggttctgctctcaatctgctcactgctgaccgat

SEQ ID NO: 10174 - DNA, 469 bp, Gossypium hirsutum
  Clone ID: uC-gsflmaxxa042b10b1
ttctttaatccatctatcatctccgctttggatttgcctccttggcctctaaaccttactcgtcagcttggtacttgtggctgctctggcctgttacattgtggtccatggtgcttaccaggatttatcgtcgaacttttgttgttgaaaggaaccgcttccatcagctcagattacatacatgggccattcccaagtacggaatacagtaccgcttgaaatggcaaaaggaatccgtcaataacatgattgaggaagctgtattagaggctgaggaaaaaggtgctagtgtgttgagtctaggcctcatgaatcagggtgaagagctaaacaggtacggtgaggtgtatgtgaagaagcatcctcagttgaaagtgaagttagtggatgggagtagcttggcagttgcagttctttctaatagcataccaaagggaacaacccaagtactccctagaggcaacttgac

SEQ ID NO: 10175 - DNA, 490 bp, Gossypium hirsutum
  Clone ID: uC-gsflmaxxa042c01b1
ttttctcgtccgcgaaatggcagcgaaaaggaagactcccgtcaagaccagaaacccagatctgatccgtggtgtgggaaagtattccaggtctaagatgtaccacaagcgtggcctttgggcaatcaaggccaaaaatggcggtgctttcccccgccatgatcccaaacctaaggcccccgctgccgctgagaaacctcccaagttttacccggctgaggatgtcaagaagccgcttcttaacaagcgcaaacctaaacccaccaaactcagagcaagcattacaccagggactgtgttgattttgttggctggaaggtttatggggaagagagttgttttcttgaagcaacttacttctgggctccttttggtcaccggaccattcaagatcaacggtgttcctttaaggcgtgttaaccaatcctatgtcattgctacttccaccaaggttgacatctcaggggttaacgtagacaagtttgatgac

SEQ ID NO: 10176 - DNA, 490 bp, Gossypium hirsutum
  Clone ID: uC-gsflmaxxa042c02b1
ttttcgcgtccgcgctctctctctctctctctctttctctacctgtgctttctttctgctttctctctctttttaacctttgtttctggcggataaaccggggtctttgcagatccaggggaaaaaaatcccaacttctgtgcaactcagttagtaatgttaattaggacaaaatgatgggatgttcttggtttttcccgtctgatctatatttctgagcataagacctccttcggggaagcagggattagatgggggagaatattgatttcagacgctgggatgaattgataccggatgccttagggatgattttcaagaatcttccgctccaggaaatacttactgttgttccgagggtctgcaagtcgtggcggaaagcggttgctggaccgtactgctggcaggacattgacattgaacaatggagccaacaatgccggcctgaaacccttgatcgaatgcttcaaatgctgataactagaagctc

SEQ ID NO: 10177 - DNA, 513 bp, Gossypium hirsutum
  Clone ID: uC-gsflmaxxa042c05b1
tttactgttgaggattttcaaaatgctcttgagaaatatgactttgattctgagcttggaaccaaggttaaaggaacagttttctgcacagatggcaatggggcattggttgatattactgccaaatcttctgcatatctaccggtccaagaggccagcattcacaaaattaaacatgtagaagaagttggtatagttcctggtttaagggaggaatttatgattatcggtgaaaacgaggctgatgatagcttaattttgagcttaaggtccatccaatatgaacttgcctgggaaagatgcaggcaacttcaagctgaggatgttgtcgtgaagggcaaggttgttggtgcaaacaagggtggagtagtggcattggtgcagggtcttcgagggtttgttcctttctcacagatatcatcgaaatccactgcagaagagcttttagataaagagctccctttgaagtttgtagaggttgacgaggaacagtccaggcttgtcttcagtaac

SEQ ID NO: 10178 - DNA, 521 bp, Gossypium hirsutum
  unsure (1)..(521): unsure at all n locations
  Clone ID: uC-gsflmaxxa042c10b1
ttcacgcgtccgcccacgcgtccgcccacgcgtccgtatactatcccataccatgagatagattggaatcgagcacggaatgcatgtgcaaaggaagatttgtactaccctcacccattggtgcaggatattctttgggcatcccttcacaagattgttgaacctattctgatgtgttggcccggaaagaagttgagagaaaaggctctccaaactgcaatagagcacatacactatgaagacgaaaatactcgttatatctgcattgggcctgtaaacaaggtgttaaacatgctttgctgttgggtggaagacccaaattcagaggcgttcaagttgcatcttccaagactttatgattacctatgggttgctgaagatggcatgaaaatgcagggttacaatggaagtcaactatgggacactgcctttgcagttcatgcaattctttcaaccaaccttactgaagagtacagctcaaacttgaggaaagcaaacatgtacttacngaacacacaggt

SEQ ID NO: 10179 - DNA, 492 bp, Gossypium hirsutum
  Clone ID: uC-gsflmaxxa042d03b1
ccaatagaaaacatgaaagaaacgaacgaaatctctgttctgtttcagattcaaccaaaatttatcagcttgattactcttttttgaagttgttcgatttgcgggtggataactgctcattagaggaagacccatattgcaatatgttgggaaatgaggtttagatttaagaaatggggtgtgttttcggaagagaggtatcttctgggattgtttcagagtctagagcgagtaggaatgctagctttgaatctaataggaaagtagagcatgttacggttgcgaagactgatgctagtgctgtaggggttgaaaatgagggtacccaaaaggaggaaacatctgatggggaaaggaaacaaacgggggaaagaagaaggtcaaagccaaaccccaggttgagtaacctacccaagcattctcgtggagagcaggtggcagctggatggccttcgtggctgtcggatgcctgtggcgaggcacttaatgggt

SEQ ID NO: 10180 - DNA, 509 bp, Gossypium hirsutum
  unsure (1)..(509): unsure at all n locations
  Clone ID: uC-gsflmaxxa042d04b1
ttaatatctctctttttcttcttcatttttcaacatcaccttctcaagcgccgccgccgcctactcttccggcggcgggaaatatccattcccttttctttcccttccctctcctcccttttattaaaaaaagaagaaaaaaaagtcaccaaaacaaaacaaagtttggttctttaggaaaggtttttttcaaaagcacttgagattttaccatatcatttattatcacaattattttactcgttagggtttgtttgattaataacaagaggagagggaagaaagaagaaaaaaacccaaaaaaaagaaagagaaggaaagagaaaaaagagtttttttggctgggtttttagctgttgttttagggtttacaaagatggcgcatgttcaagttcagggacaacagtggggcgttaacaatggatctggtggagccaataaccagtttgtaacctcgctatatgttggggatctggatccaagtgtgaccgagactcagctntatgagt

SEQ ID NO: 10181 - DNA, 468 bp, Gossypium hirsutum
  Clone ID: uC-gsflmaxxa042d05b1
ttatttgaaggggtaaaagaacttcaatagtttgagtttagggtttttagatcgaagattatggggcgttttgctcttctccttttactagctttcgcttcatttcaagccctttgcttcgccgctgatgatgatacggtcttttatgactcatttgatgagccttttgacggacgatggatcgtgtccgataaagatgattacaaaggtgtatggaaacattcgaagagcgaaggacatgatgactacgggcttcttgtgagcgagaaggcacggaagtatgcgatagtgaaggagctcaatgagcctgtgagtctcaaggatggaagcactgtgcttcagtttgagactcgctttcagaatgggcttgaatgtggtggtgcatatttgaaataccttcgtcctcaagaggctggatggaaggctaaggaatttgacaatgaatccccttactctatcatgtttgga

SEQ ID NO: 10182 - DNA, 448 bp, Gossypium hirsutum
  Clone ID: uC-gsflmaxxa042d07b1
tttttgggatctaatcccttgaaatcaaaaggtgtgctttggtcggaggaaacttggcgcagtcggctcaaaacatgggttggtctggtattgtagtgaacggttgcattcgagatgtggatgagattaatgcatgcgatatcggcgtccgagcattgggatctaatcccttgaaatcaaataaaaaggcaattggtgaaaagcatgccccgatcagcattgccggaaccttaatccgtgatggcgaatggttgtatgccgatagtgacggcattcttatctcgaaaatggaactatctatctaaagcagtagtccttacctttccgagccaataaggggaccgattaagttctcagtaacaggatcgatatcatcccaattgtgagttctttagttggatattgattatgaacatgatgatatttcttgtttttaacatttttcaaa

SEQ ID NO: 10183 - DNA, 467 bp, Gossypium hirsutum
  Clone ID: uC-gsflmaxxa042d08b1
tcgtgacgcgtgggcggacgcgtgggcggacgcgtgggctgagtttgaagcttcaagtgctaaaatctagggatttgcgggtggagaagacgagagcccatctctctgcttcaaagctcctgtccaggtagaattctcttcttcccttgcgttgtgttctttgctgttcaatcgccatggcttcaaagcggattttgaaagaactcaaggatttgcagaaagatccacccacttcttgcagtgctggtccagtagctgaagacatgtttcattggcaagcaacaatcatgggaccctcagatagcccttatgctggaggtctgtttttagttactatccatttccctccagattatcctttcaagcctcctaaggtcgcgtttaggaccaaagtcttccatcccaacatcaacaagcatggaagcatttgtcttgatatcctcaaagaacaatggagccctgcacta

SEQ ID NO: 10184 - DNA, 385 bp, Gossypium hirsutum
  Clone ID: uC-gsflmaxxa042d10b1
ttgttcacgcgtccgattttttttaccctctaaattactcaaaaaaataagtaaccaatctaacacgaaatgtgtgaggaaaccatacaaatttgagcataatgaaaaggattgaaaatataactgcatcggtttcaaccgttccgttccaaccaacacaaaccatcccagtaataaatcgatgcaactctcccttttgcactagctaaagtttcgatctatatcaatcgcactagtttattctgctcaattccaattgcaccgaccaaaacattgtacattcattgatgtatgaatattttatatttgaatatgcatatattaaatattttttaaaaataccgataaatttggaacaatacattgaaataaactgatacaaaag

SEQ ID NO: 10185 - DNA, 504 bp, Gossypium hirsutum
  Clone ID: uC-gsflmaxxa042d11b1
tcgattaaaatccctccttcccttaaacctcccttcttcttcctcttctgtttcgagctgtgattttctatttttatttttgcaaaatagtagagagagatggcgccgaatgatcccaaacaaagcggtggtttctttgcgtccatcgctagcagtatatctaattttggtagcgccatgactaaatcagtcaacggtttaatgggatatgaagggcttgaagttgttaatccagaaggcgggactgaagatgccgaagaagaagcaaggagaggaagatggaaacaggaggacagggaaagttactggaaaatgatgcaaaagtatataggttctgatgttacgtcaatggtgacacttccagtacttatttttgagccaatgtcaatgctgcagaaaatggcggagttgatggagtactcatacctgctagatctggctgatgaatgcgaagatccttacatgcgattagtgtacaccacttcatgggctatatctgtctac

SEQ ID NO: 10186 - DNA, 509 bp, Gossypium hirsutum
  Clone ID: uC-gsflmaxxa042e01b1
ttcttcacttcacttctcttcctcctttctgaatttttcagcaattattttcccttagcttctcaaagtaaaagaaaacaccattaaacaaatagtaaggcaagccaaagcaaagcaaatcaatccgacttttctcatcaggtgaacaagtgataaaaccagaatttattttattcaaatatggaaggagagaacctagcaagtactgaaatcccagtgaaggaagctcttaaggatactgaaaacattgccgagcctgttaatgtcggaaaggaaggaaacaaagacgaagaagaaaccgccttggatggagaattcattaaagtagagaaggaagcactagatatgaaggacggttcaaatgtcgctaagccctcacccaaccagggcgatgagtcaactaccatcgaaagaagcttaagcaatccaggtagagaactacttgaagcccaagaaaagatgaaggaactcgagcttgaattggaaagagtgaccggagcattaaagga

SEQ ID NO: 10187 - DNA, 493 bp, Gossypium hirsutum
  Clone ID: uC-gsflmaxxa042e02b1
tgttctagatcgcgagccgccgcctgcgtctctctcttcatctctctgaacctaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctattgatgttgacattggtgccaatccttcagccgaagatgctgatgaggatgaaggtgttgatgaccaatctgtgaaggttgttgacattgttgacactttcaggcttcaggagcaaccccctttcgacaagaagcagtttgtcgtgttcatgaagaagttcatcaagaacttgacaccgaaactggatgcggaaaagcaagagtccttcaagaaaaacattgagggagcaaccaagtttttgctttcaaattgaaggaccttcaatttttcatcggagagagcatg

SEQ ID NO: 10188 - DNA, 499 bp, Gossypium hirsutum
  Clone ID: uC-gsflmaxxa042e03b1
tgtttagcagatctcaaaaccatttcattcatgtcttaacatcccaaataatatggatcgattgctgaaagctgcaagagctttcggttctctcaacttatccaatcgatctctcacagatgttccggaagagatctacagaagctaggatgctgttggggagggtgaaaaatggtgggaggctgtggagctacaaaagctaattttggcacataacaatatcgagtcattgcatgaagaagtgaggaacttacctttattgactgtgctgaatgctagtcacaatacgcttacagatcttccggctgcaatcggacagctttctatgctgaagttgctggatgtgtcttttaactctatagcgacaataccagaggagatcggcttggcaacttctttggtcacgtttgattgttcaagcaatcgtattaaggaacttccatgctcacttggaaaatgctcagatttatcagatctaaaggtatcgaataatctgata

SEQ ID NO: 10189 - DNA, 227 bp, Gossypium hirsutum
  Clone ID: uC-gsflmaxxa042e05b1
cgtcgtcatcgggagtctagctctagcatgtgatgcgttttagttagtataataataattatcatggtgataatgaggatgattaattagaggggtaggtggggatgcttatgaactcatggtttgcagcggccctttggtcattagtgttcgtctctttctgttcgataacgtttgtcgtgtaatgtgacaattatgggattaaattatattatgttttcactata

SEQ ID NO: 10190 - DNA, 346 bp, Gossypium hirsutum
  Clone ID: uC-gsflmaxxa042e07b1
tttcacgcgtccggtccaatttactgcaattttattagaatatgtggcaaattaactagagcttgaactttttttttgcatggactactttctcttacctttttttttttttggtggtggttgtatggtttagcaattctatgaaagtgtgtcgagcaaggcaagatcaaagccaagaagcccttctagatcctcatcaaatgaggaagaccctggtcagcgccttgaagcaaggctccaagctgccgagcagaaaaggttgaacattttggcaaagtctcaaatgcgcctaaccaagttagatgagttgcggcaagcggcaaaaactggtgtaaaaatgccgttt

SEQ ID NO: 10191 - DNA, 494 bp, Gossypium hirsutum
  Clone ID: uC-gsflmaxxa042e11b1
ttttctaatggctcttctacctctcctcttctcttctcttcttgttgtttctttggcagaaatgtcgggcaagattggagtaaactatggtcgagaaggggacaatttgccatcgccatatgaatcaattcagatcatgaaatccattaaagttggccaaataaagctcaatgattccaaccctgaaatattgacacttttgtcaggaaccaagatccatgtcgccgttacggttcctaacgatgatataatccaaattggttcgaacgattccatggccgaacaatgggtgcgaaacaacatcctgcctcactatccagataccatgatccggttcgtgttggtcggggatcgagtcgtcaactccaacatggatgtcaatgggacaatggagcagagccttgtgcctgcaatgcgtgggattaagagtgccctgactgctcatggtgttaaaaacgtcaaggtctctacgacgttaggaatggacgtggtgc

SEQ ID NO: 10192 - DNA, 509 bp, Gossypium hirsutum
  Clone ID: uC-gsflmaxxa042e12b1
cacgcgtccgctttgatcaatccttaatttcccaatttcttctgaaaccctaatcctaaattgataccccaacttcggtgttccaatggccactgaggaaccaactgtcgccgtggaatctgcgcctgagccggcggaagagaaccccgctgaggctacagccaatcccaaatctggcaaagcaaagaaagctaaactgccttgctccattggctaaggtcatccatgacaaatttggcattgttgagggtcttatgaccactgtccattcgattactgctactcaaaagactgttgatggtccatcaatgaaggactggagaggtggtatagctgcttcgttcaatatcattcctagcagcactggagctgccaaggctgttggcaaagtgttgccatcattgaatggcaagctgactggaatggcattccgtgttcccacagttgatgtctctgtggttgacctcacggttaggcttgagaagaaggcttcttatgaagatatcaag

SEQ ID NO: 10193 - DNA, 250 bp, Gossypium hirsutum
  Clone ID: uC-gsflmaxxa042f01b1
ttgtctcgtgggcggacgcgtggggtcttggttaaggaaaaagggtaggctacttgtcaagggctagccatggacaacggttctagtttgggcctggtcttgtcttggtataatatgtatctcatgtcaggtcatttgggcattggctaaagtctccaagtccatcttgtttcaatgggttgagggaaactatgtttgacaacttgcaagtcgcaactaaacttcaataatatcgaattccgctattgcc

SEQ ID NO: 10194 - DNA, 504 bp, Gossypium hirsutum
  Clone ID: uC-gsflmaxxa042f02b1
cgtctataaaaaagaagagagagggaagagagaaggaagagagaagggaggggggaaggaaaatcaggccaggggggccggtcaccggacggccaccggaggctcgccggcgccggcgccggccaccgcacgcggtggccggaaaagaggcatggggtgcagacggtgatgggcatgcgtggaggctggcgcggagcagaggcgtgcgaggttgagtggttgcgcacatggggcaacggcgcaagtgggcaagtgggggggggtttgctggtgtgggcccgggcagattttgggctttacactgagcattgattagtagcaaaaagaaatagtgtctttacgactaagacaagatgaaggattaaaaagtggggttgtctctgtcacgagtaatcaaaaaccattaccaataccaataccaataccaataccaataccgtttccttttcctttttctgttgtaactacatccactacttctcgagacaaaaatggaaaactaca

SEQ ID NO: 10195 - DNA, 349 bp, Gossypium hirsutum
  Clone ID: uC-gsflmaxxa042f03b1
tcttttcgtggagagactgtcacccttgcacagaagttggatgcagagatccagtctatgccagatgctcatccgttcgaagagacacggtactgcaacacaggaaactcacagtttgctggtcagcagtctgtagctagatttggagaggatcgtgaactatgcgaccatccacgccattatggacagaagggaaagacagggacgcttaagagctgagtacattgaactgactagggcgataagcgagcaaaggcttagacgagcgactagcgcctacattcgtagacaaagagtcaagggcctacgagatactatggctgccgtcatggaagctcgggcaggattt

SEQ ID NO: 10196 - DNA, 499 bp, Gossypium hirsutum
  Clone ID: uC-gsflmaxxa042f05b1
tttttctggtatcgacatggtaatggtgcctctcagatataaacagttcatggatgatttgacgtttctggttgaatctggggaagtactgatgtccaggatagatgatgccgttgaacgaatattgagagtgaaatttgtttccggtcttttcgaatatcccttctccgatagatctctgctggatatagttggcggcaagctacacagggaactagctcgtgaagcagttcgcaaatccttggttctattaaaaaacggaaagaaccctgaaaatccgtttcttccattagaccgaactgctaaaagaattcttgttgctggctcacacgctgacaatctcgggtaccagtgcggtggttggaccagtacctggtttggaggcagtggtagaataacaattggcaccaccatcttggatgccattagagaatctgcaggagacaaaacagaggtgatctatgatgaatgcccctcacaaacacctttagcaggcagt

SEQ ID NO: 10197 - DNA, 433 bp, Gossypium hirsutum
  Clone ID: uC-gsflmaxxa042f06b1
ttttctcgtccgcccacgcgtccgaaaaaagtaagatccatggtttccctgcaggtctttgtactagtttaggtgttggtgggcatataacgggaggtgcgtatggttctatgatgagaaaatatggtctcggtgttgataatgttatcgatgctcgaattgtcgatgttaatggacgtgtcctcgatcgagccgctatgggtgaagatcttttttgggcaatccgtggtggtgcaggtggaagctttggcattattcttcaatggaaaatacagctagtaccagtaccatctaccgtgacagtctttactatcaccaagtccttacaacataacagtaccaaaatcttccatcgatggatcgaggttgccgataacctcgacaacgacctttttattcgagtaaatcatccaacggcatgatcaacggcgag

SEQ ID NO: 10198 - DNA, 438 bp, Gossypium hirsutum
  Clone ID: uC-gsflmaxxa042f09b1
ttcatgtccctgcctatttgagttgctgttcgacacgctattgcttccgcggcaaaggctgatgccacatgatgatgaatctcagtacatgataaaagtgtgtttccgtcgctatccctggccactatacccgctgctgattgttgtgagtttacatcaaatgctgcatcgaagttaaccttcacaaactggacagtcttttcatgcactttcctattcctttctccccatattgcccaaagagcacaacaaaagatccgtcgccgattggtggaattctgttcaaaaacccaggacattctcggaatatatgatttgcagactctgctgcattaccacacccaacgcatgtcacattgtttaatagccttctgcagttcaagttgactcgagtcgggatataattccaagttattttccagactaaaatttttacct

SEQ ID NO: 10199 - DNA, 446 bp, Gossypium hirsutum
  Clone ID: uC-gsflmaxxa042f10b1
ttttgacgcgtgggcggacgcgtgggtttgtttctaaggatttaatctctaaaccttcttcccatttcttcattacattgttcaagaacaaacaaaaaaaaaaaaaagaagcaaaaaaacatggccaaagttctgttgttcattgctctatgtgtgcttccagctttggttagtgctacacgcattctgaataaccaattggtggttgaaggctatgtgtactgtgatacttgccgtgctggttttgaaacccctaagactagaaggctagctgatgccatggttaagctggtatgctccgacaggaagaccggcggagttgttttcgagaaggagggatataccgacaaaaccggaaaataccagattcgtgtatccgaggatcacttggatcagatctgtgatgcagttcttgtgaagagcccccagctgggatgtgccacaat

SEQ ID NO: 10200 - DNA, 481 bp, Gossypium hirsutum
  Clone ID: uC-gsflmaxxa042f12b1
tcttttcacgcgtccggtgaacttcagtgaccacgccacttcaacaacttccatcactcctaacccagctgcactcagtgagtgaaccatctcgagttcttgagctttcgatcaatggcaaccctgacaacctcacactttgtttcgacatgttcacatttcagcagccatggagcagacactaaggccaatcttgcacaggttggtgccaggaatcaagccatgactcacaatggtttgcggtctttgaacaaggtcgataggttgcagatgaggaccaccaacgcaaaggctgtcgttacgaaagccatgaaacaggcagatcacaggcctttgggaaaaattatttgcggaatagggatgaatatagtgtttgtgtcagctgagtgtggcccctggagcaaaactggtggacttggtgatgtcctcggtggacttcctcccgcaatggctgcccaaggacaccgtgttatgacagtgt

SEQ ID NO: 10201 - DNA, 502 bp, Gossypium hirsutum
  Clone ID: uC-gsflmaxxa042g01b1
ttctttgatacgagtactgatgttgctttcatgggctacctcaataggtggttcagcagtcgagtgcaccaccgtgagagaactaatctcgttctgtgccacctttatcagcaacggttcaccagatccttaccctggtacaccatgttgcgaggctgtcacgaacctctacatgatgactcattccactgacaataggagatcactttgtgggtgcttaatggggcttgttaccgctaacaattctaattccaccgctatcgctacgttgcctggcttttgtggtgtcccgctcggtttcaccatcggccctgataccgactgcaacttcgttccgtgacgatgagtacacaaagtggtggcaatgtggcgttgaaaggagaaggtttgctctaaccattcaacagtttcatatgaattttttgttcaagatttgaacatggaaaccgtccggaaacaccagtcccggctatcgaacagccattccttctttcatcactgt

SEQ ID NO: 10202 - DNA, 433 bp, Gossypium hirsutum
  Clone ID: uC-gsflmaxxa042g02b1
ctcctgtcaatatcagtcctggttcagtacagagagtatttggcagcttttgagagcaatgaagtggccaaacagagaatgccaaaggcattattgtcagcattcgataaccgatcttggattccagttacaactattcttttacgtctgtgcaagggttctgggtttggttcttcaaagcatggagaatcttcatcatcatcaattattttccagggactgttgcgtgaagcttgcatctccgatgaagagttgttctcagcttttctcaatcgtctatttaacactctcagctggacaatgactgaattctcagtttccattcgggaaatgcaagaaaaataccaggtattggagtttcaacagaggaaatgctgtgtcatattcgatctctcgtgtaatcttgcaaggttgttggagttttgtacccatg

SEQ ID NO: 10203 - DNA, 416 bp, Gossypium hirsutum
  Clone ID: uC-gsflmaxxa042g03b1
ttttctcgtccgccgagacttcacattgggacacagggattcgtggggtagggatccgttcgacgccgagagaacggttctgaacgcaccagtcttggatcatccttcgcagtatgtgattcgggatcaaatcaaaagtttccaagacctgtttggtgaatgggcaagtttcattgccggcttcaatccatctctcgatgttctcccgatcatatgtgatcccagtgcataatgtgacgggatctttcatcaaatcaagagaaataggacatcggaaatgcatcggaacgttgatttccgcatccaaatcttcacacaagcgattgttgttcttcattttgttgttatgggctctgcgatttctccaagataaaatcattgcggagtatttaaagaaacaaatgcaggcgaattcg

SEQ ID NO: 10204 - DNA, 470 bp, Gossypium hirsutum
  Clone ID: uC-gsflmaxxa042g04b1
ctctaagtggattttattgattttaggcttccactgtttgttttgcttatgattagttatcttttggagttttgaggtttccttgtcttcttttaaacagaggatgccaaactatttagtcatcttgactatcaattgctgagaacttattttttggattaaattgcagagaaatatttatttggtttgggtttttctttttttatattgaaaattattgattcattgagtttgttattttgtgggatttgatttgaccctttcgctcaaggattgaagttcaaaatggtatagcgtataactaggggaaggatacactgcaaatggtatatcgtaaatgtcatttagatattgacacagttcgtgttgtctcgtgttttcgatgaatccaaaactaggattcttattgtcagttgccttggacatgaagaagttattgcagcacattagagttgatatcttaaccgggc

SEQ ID NO: 10205 - DNA, 501 bp, Gossypium hirsutum
  unsure (1)..(501): unsure at all n locations
  Clone ID: uC-gsflmaxxa042g06b1
ttcttgcgtccggattttgattggagcgggaaacaaggtatcaacatggaaagcggggctgcggtggtggagctacaaagaaattcaacaaattttgcaaacatagtagaagagatagtgaagctggaaaagaagatattccccaagcacgaatcacttgctaggtccttcgatcaagagctgagaaagaacaacactggattgctttacatgatggatcttcatggagaggttgtcggctatgtcatgtattcttggccctcttcactttctgcttccataacaaagcttgcagtgaaggagagtcgtagaaggcaaggccatggggaagcattactaaaagcagcaattcataaatgcaggaccagaaacatccatcggatatctcttcatgttgatcctttgagaattcctgccatgggtctttacaagaagctnggttttcaagttgatagctcgatcaagtgttactactcangtgatagagatgccataggatgt

SEQ ID NO: 10206 - DNA, 429 bp, Gossypium hirsutum
  Clone ID: uC-gsflmaxxa042g07b1
ttttgttttcatggcttctttacttgtcaagattttttctatcttcttcatcatcatctgcatcttcacaccacaagcactttcagtagtaccagaggaatgtaaaaccgaaaccgatggctgcaccaacaaggaaaaggccttaccccttaagatcatagccattttctccatattgatcgctagtattatcggtgtatgttcgcctttattcacacgttcggtcccagctcttaatcccgaaagaagtttatttgtgatcgtcaagtgcttcgcatcagggattattctggctactggtttcatgcacgttttaccggactcttttgacatgttaacatctaagtgcttgaaagagaatccatggcacaagtttcccttcacagggttcgtcgccatgttatccgcaatcgtgactttaatagtgga

SEQ ID NO: 10207 - DNA, 454 bp, Gossypium hirsutum
  Clone ID: uC-gsflmaxxa042g08b1
tcttttacgcgtgggtgatgctggtattttccttcaatctcttcatctccaccacccaccaccacttctttccctttccctaaattttcaatctttacactttgcttcttcagtcctcaagccaaagccagccaagaaaattatatagaatagaaaagaaaagtgatgatagttgcttcctaccatccaaaatctttccttcaatccaactctacgtagacatcaaatctttacatcccattgttccattaagtccttccaaagaaacccatttttccataaagaaaaattgtttcttggctctaaatcgttgaccccaataaaggaaaaacattatgactgaagtactccaatcatccccatctcatttcccttcattttcaagctccaccttcacttcacacgcccttactaactctaacgtaagcactgtggaggatatataacccaagag

SEQ ID NO: 10208 - DNA, 475 bp, Gossypium hirsutum
  Clone ID: uC-gsflmaxxa042g09b1
tcgtctcacgcgtccgcccacgcgtccgcaaattcaagtcttcttcccttcacctccaagtttaaacaatggatgtagaagatgacacaagagagggcttggcttcctccattatccttcaatctttggaatccactcggcagggagataagctttctgatgaggatttggcttgggttaattcttgtctggttacagatactgaaattttggaaagaaattggtcttctttcaaagatgttttgctggagatcattggtgaccaacctgagccacttgactcttctgcaactggaagcaatggttttcttagtggaactgaaatcagtatagctccttccatcaaggaggcagaggctgccaattactcaaggagaactgatgaagatcttcttgtcattccagtggatggagaaaatggaatgaacaccaacaacatttctatcataaagaggactggtacccagcagcaatt

SEQ ID NO: 10209 - DNA, 413 bp, Gossypium hirsutum
  Clone ID: uC-gsflmaxxa042g10b1
acgcgtgggcttttttttcaaacccccccattattctctcttgttttcaacacccccctccttttccttcttatctcactttcctttcctccaaaaaaagcatctctgcaattccctaaaaaaaaagggtttcaagtgcctcacaaatgaagaagattgtgctgaagttggatttgcatgatgataaagccaagcacaaggctctaaaaacagtctcgactctttcaggaattgataccattgccatggatatgaaagcacagcaattgacagtgattggaacagttgaccctgtgaatgtggtgagcaaattgcgcaagaactggtcgaccactatagtatcggtagggccagcaaaaccgccggagaaggaggagccgaagaaggaagaacccaagaaagaggagcccaag

SEQ ID NO: 10210 - DNA, 99 bp, Gossypium hirsutum
  Clone ID: uC-gsflmaxxa042g12b1
tcccacgcgggggacagagaggcaagaggaggggactgtctgaaagcggagaccacagcaccccccggaccgaaaagggggggggaaaccacccaggcc

SEQ ID NO: 10211 - DNA, 493 bp, Gossypium hirsutum
  Clone ID: uC-gsflmaxxa042h05b1
aagagatggtggtaacatgtctccaccctaatctaaacccttgctttaaacccttaatttcattcccttctcaaaaccctaactctttcccttttaaatctctcattgcttcccctaaaacctttagtttcgctaaacccataatctctttacaagtcaaagcaaattctcctgctctttcagatgaactgccactggatgcttccccttctcaatcttcttctggtaaagagaagcttggagtggtggtgaagccattagagaagccacgggtagtattgaagttcatatggatggaaaacgatatagggatggctcttgatcaagtgataccaggccatggttcaatccctttgagtccatattacttttggcctagaaaagatgcttgggaagagctcaaggttttgcttgaaagcaagccatggacatctcacatgcaaaggattcaccttctcaaccaagctactgatatcatcaatttatggcagac

SEQ ID NO: 10212 - DNA, 296 bp, Gossypium hirsutum
  Clone ID: uC-gsflmaxxa042h08b1
tttttcatcttgatttacacatcacaccaacacaaatatccctacactctgaactgatccctattgtttcatttcttcaactattgttacctctgcttcaatgggtaacttgagcttcgtccttggcatcattggtaatgtaatttcaatactgctttttgcttctcccataaaaaccttttggggggtgataaagaagaaatcaacgggggattataaaggagagccctacataacaacccttttgagcaccagcttgtggactttatatggaatcatcaatccagatgggttac

SEQ ID NO: 10213 - DNA, 463 bp, Gossypium hirsutum
  Clone ID: uC-gsflmaxxa042h10b1
ttggtctagtacagtattgaagcatgctaaaggaacatccaagtcatttgatggaggcacaagatcgttagatgtgacaaaagtgcttttaaatggaacagactcaaatatttcactcaaccagccttctgagggaaaggctcaggcaccaagtgatgaaaaaccaaataatttcctggcagtggatgcagaggataatgtaccaggagtattgtatgatttgttgcaaaaagaggtcatagctttgaggaaagctggtcatgagaaagatctaagccttaaggataaggatgaggcaattgagatgcttgccaagaaggtggaaacattgacaaaggcaatggaagttgaggctaaaaagatgcgacgtgaagtagccgctatggagaaagaggttgctgccatgcgtgtcgagaaagaacatgagaatcgggccaagcggtttggtaactccaaggggtct

SEQ ID NO: 10214 - DNA, 428 bp, Gossypium hirsutum
  Clone ID: uC-gsflmaxxa042h11b1
tgttatttcaaaaccaaataaaaacatggcaccacaccttaatattgttccttccatgtttgtgcttttattattattcatttcagcctctaaagttcaatcaggcgctattgatgttgctgccaagtttggcgcaaaagctgacgggaaaacggatctgagtaagccatttttggatgcttggaaagaagcatgtgcctctgtaaccccatcaacagttgtgattcctaaagggacatatttattatcaaaagtaaacttagaaggtccatgcaaggctcctattgagattaatgttcagggcactataaaggcctccgctgatcctggtgctttcaaggaccctaattgggttagattctatagtattgaaaatttcaaaatgtccggcggaggcattttcgatggtcagggaagcattgcttatg

SEQ ID NO: 10215 - DNA, 419 bp, Gossypium hirsutum
  Clone ID: uC-gsflmaxxa042h12b1
tttgttgttctttggagcttaagaggaagaggcattctttcactcccaaaatgtcagatcttcaagcaccccttcgcccaaagaggaagaagggcttggtggactttttggtccagtttcgttgggtttttgttatattttttgtccttcctttttcggctctgtattactttctcatatatcttggagatgtcagatccgagatgaagtcctacaagcagcgtcagaaggaacatgatgaaaatgttaagaaagtagtgaagcgtctcaaacagaggaatccaaaaaaggatggtcttgtatgcacagcccgcaaaccatggattgcggtggggatgcggaatgtagactataagagagctcgccattatgaagttgatttgtctgctttccgtaacattcttgaaattgatagagag

SEQ ID NO: 10216 - DNA, 420 bp, Gossypium hirsutum
  unsure (1)..(420): unsure at all n locations
  Clone ID: uC-gsflmaxxa043a01b1
attatataagcattgggtcgaactctaaactggtgtcaaggtaatagctatggagagccatcgactcctcggaaagggtagaagaatgggacctataatgggacatacaatgcattacaggcgtatgatcattacgctgaaaccgggttattctattacacctattagaacgaattgaacttaaatcaaaatacttaatagcatggcgatacatttatacaaaacttctaccccgggcacacgcaatggagccgaatacagncaagtgaaatccaatccacgaaataatttgatctatggacagcatcgttgtggttaaggttgggatgccttatggatcattaccgcaaggcattcaaggggaggtcataagcgtttataccgttacagggattttcgacgaaatgaataagacctatt

SEQ ID NO: 10217 - DNA, 313 bp, Gossypium hirsutum
  Clone ID: uC-gsflmaxxa043a02b1
gtttgagctttgctgtttcccttctctttttttttttcctcatattttccaaacataagattttactaattaaagaaaataaaatactactggtatttttttatttgctccatttttttaaaaaaaataatataccatcttaattttattttattattattgatgttgttgctgtttccatgataattcatctcatctgttaaaatgcaaccgtttttaatccctattttctcctttgcagtttcaattttggaaattcctttatagggtatttattttataaaaataattggcgaacctttctttttttttt

SEQ ID NO: 10218 - DNA, 408 bp, Gossypium hirsutum
  Clone ID: uC-gsflmaxxa043a05b1
ttcacgcgtgcgtatacgcactcattagcctgtgcctcatggaatcccatcttgtgaaacaaaacggagatgtgcttcaaaaatctttcaatgagatgatttctactctccctaaaaagagttgatggggtcttcctgatgatcaatatcaatatcaaagtttttggttcatcccgtcttttctacaaggagcattgtcggctcaacaacaattccaagctcagtcaactgatatcatcctttgtagctttccaagaacaggcacaggctgtttaaaatgcctcactttcgccactattacaagaacttgatacaatgattgcaccacccctttactttccaagatgccgtatgatgttgtgccttactggagtttgatcatgcccagatttccattaatcgacatct

SEQ ID NO: 10219 - DNA, 354 bp, Gossypium hirsutum
  Clone ID: uC-gsflmaxxa043a06b1
tttacgcgtccgcccacgcgtccgattccttctgtcattttgggttttactcttcttcttttttttgtgaaatcaagatggatcttgatctttctccaaagctggcaaagaaagtgtacggtgacgatgctggaagctactacgcatggtgccccgatgaacttcctatgttgcgtcaaggcaacattggtgcagccaagttggcccttgagaagaatggctttgccctccctctttactctgattcttccaaggttgcttatgtccttcaaggggctggtgttgctgggattattctccctgaatcagaagagaaaggtgattgcaatcaaaaaggggtgatgcaattgctct

SEQ ID NO: 10220 - DNA, 356 bp, Gossypium hirsutum
  Clone ID: uC-gsflmaxxa043a07b1
ttctcttaaattgtgtgaagatgaataaactgcaggcggcgtaaaggttatactgggacgtgacgtactcgatacgcatccgctagctagattatctggaagcattgcacggtgttacgtttggccgtggttgtgtggtggaaacacgagaacttgagaacctatactgtaaagataattgcaacagagaggcctgcagtaaactccacagaacccagatcctgctgcataaaggatgaccatagacacacacggacttctccagaacatcgaaactacacgctcacaacaacctgcttaatagaaaacgatcgatgaggtcctacgataaacacatgcgctagggcgacttatcg

SEQ ID NO: 10221 - DNA, 267 bp, Gossypium hirsutum
  unsure (1)..(267): unsure at all n locations
  Clone ID: uC-gsflmaxxa043a08b1
tgtcttagatgtagtaggcaactcgttgacatgatccattgctacaaattgacatcaatacatcacatctgtgaacttggtaaaaaatatgaagatttatgcattcactttggcatatgcttccatgtagaaaatatgattcggtttcctacaaaaggaagagccatagccattcattctttttctaaataacatctctcatttgttagtgatggaattccaattttatatgaataaaatttaaaatgaaaaatgcttttcgcncat

SEQ ID NO: 10222 - DNA, 221 bp, Gossypium hirsutum
  Clone ID: uC-gsflmaxxa043a09b1
ttagaactaaaggacccacccgccattttcttagcatttgtacggccgtttaaccaatcattcacgatcacggaccgacagagcctgctggggacgtagatgctaaaatgaaccgtgggtggtcgatacgccctacacaaactcaacttgagggtacagcgcccatttattcaccaaaaacttgaagttataaacctggtgcagggcttaatatacagggc

SEQ ID NO: 10223 - DNA, 194 bp, Gossypium hirsutum
  Clone ID: uC-gsflmaxxa043a10b1
ctctctcgtacgcccacgcacacaatagcccgtggatcttttaaaaccatcgtgggaaacaccccatgcacacgcttcaaaaatctttcctcgagacgatatctacctcttcctaaccactcaacgtgctgaacttcctgcaagatcaaattccatttacaagaccattggttcagcccgccttttctacaaag

SEQ ID NO: 10224 - DNA, 409 bp, Gossypium hirsutum
  Clone ID: uC-gsflmaxxa043b01b1
tgcatggacaagggtttgatgactttgatgatgaggattatatcaatagttacaaggtagactctcagcaaaataatccaaggcagaaagcttcctcgaatgtttatgttgacaaggaggtgttttctgaaccagaaagaagtaggggctctaacttcgttcgtaaaaatatagctttatccggctccgaggatgacttatattttgattcacatgaagaactttcagctcatcctaactggaaatcgagtcatgtagctaattcgaagcatataggtagaattgcgtcaaaagacttgagttttgactcagaagaccatgatttggattccgatggtgatgatggttttggcaatttcaggtccaaacagtggaaagaggacaaacggagttatggtagaagcaaatc

SEQ ID NO: 10225 - DNA, 127 bp, Gossypium hirsutum
  Clone ID: uC-gsflmaxxa043b02b1
gttaattgcaaatccaacccaagtaccccagggtgaaaattaaaaaaatgacgggctctgtaacaaaaactcagtgcttcaaaatactcataaccaaacaatgaatctattttctccttcctgatgc

SEQ ID NO: 10226 - DNA, 465 bp, Gossypium hirsutum
  Clone ID: uC-gsflmaxxa043b03b1
ttatccttacattttcagcaatgcacttggaagcattttagagccgccattgactgacctcactgctgctcacatttcccccctatcagagaatattgctttccgttacctggtgaaagttgaagttggcatcaagcataacactaggccaaaattccaacatattgctgcctttgtattagacgtattaatctaataatggctgtctctttgtctcatgtttcatactcatccaccttcacctcttcagcatcaaaaaccagagtctccggaccttctctctcccctcattccatcaaagttcccaccttctcgtctttgactgtcaaacccctaaattctagcttcaccccacatggcgcacgtgcgatcaccattgcgccacatgccacctccaccccctcttccattccttctgacacctcaactacaacctttcatggcctttgttacgttgttggtgat

SEQ ID NO: 10227 - DNA, 385 bp, Gossypium hirsutum
  unsure (1)..(385): unsure at all n locations
  Clone ID: uC-gsflmaxxa043b04b1
tttgttacaatgcttggttctcgagagacttcattggcaaatccaccagatgatgatcaagatgccattagcatatgtaggcatgctaaaggagaagacaggaattgggaatctgatactggcacatcagttatttccggtgcaaatttggctatatggcttctttctgtccttgcttgtcatgatgaaaagagtaaaatcacaataatggaagctggagcagttgaagttgtcactcagagaatctcccaacgatcttcccaatatgctcagattgattttaaggaagataacagcatatggatttgtgcagtattgtagncgatcttattccaagatagagatatcattcgggcacatggaacaatgaaatctttaccagtac

SEQ ID NO: 10228 - DNA, 426 bp, Gossypium hirsutum
  Clone ID: uC-gsflmaxxa043b06b1
cttctctctctctcccaacccacatttgccaaaagctattcagtttcatcgctgtgtttttgtttttgtgtttttgtgtttttttttatcctttgctggcaacagtagattaggcgagaggaaaaaagagtgagttttttttagatggacacgtatacagttcatctagcgatggcggctctggtcggagcttcgttggtggcagtgtcggcgtattatatgcataggaaaaccttaaatcagttgctggagtttgccaagacggtggagagggaaagggaggacatttccgagggagaagagtcgccacagccgcagcactccaaaaaacggcgcggccaacacttccgctggaaggggaacggatactaccgccgcggttcggcgtctttgccggatgttactgtgatatccggcggatttgat

SEQ ID NO: 10229 - DNA, 397 bp, Gossypium hirsutum
  Clone ID: uC-gsflmaxxa043b07b1
ttttctactaaaaaaggatcaaaaaccacgtgtgaaattcagtttcctgcctgcctctcttacataaacttggttcttcaaaatactcaaaatcaaagaatgaatttggttctctctactgatgcaaagcctaggctaaagtggacacctgaacttcatcaaagatttgttgatgcagtcaatcaacttggagggccagacaaagcaacaccaaagagtgtgatgagggtcatggggattcctggactcactttgtatcatcttaaaagccatttacagaaatacaggctggggaaaagccttgggaataatacagattacaaagagatgcagagcagtaatgggaatttcattagggacacaagtgatggaattcacgggcatatgaatgaaagct

SEQ ID NO: 10230 - DNA, 201 bp, Gossypium hirsutum
  Clone ID: uC-gsflmaxxa043b08b1
tttcactccttcggcaacactgcccgcttaagtggttattttagcctctggcctgcacatcctcgcagcaccgttgccgccctataaaagaagtttagcttccggtacctcgtgccagcttgagtaggcatgaagcctaacaccactgctttgttgccacaaattagccgacttgttttacacccttataaataatagtgg

SEQ ID NO: 10231 - DNA, 460 bp, Gossypium hirsutum
  unsure (1)..(460): unsure at all n locations
  Clone ID: uC-gsflmaxxa043b09b1
tttaaggtctctcgccacctatttagatggagagaaagaagtggcatatgcagattactatgaacgggccctcacaaatggtgtactaggcatccaaaggggcacagaacctggagtgatgatttacatgctaccacaaggtcgtggagtctcaaaggctgtaagctaccacaagtggggaacaccatttaattcattttggtgctgctatggtacaggaattgaatcgttttccaagttaggagattctatatatttcgaagaggaagggagcatccctagtctttacattatccaatatgtatcaagtactctagattggaaatccggaaaaattgtgctcaactagaaagttattcctgttgtttcttcagatccataccttcgtgtgacgttgacttcctcttaaaagagggatcggagcaattatctactttgaatntgaggataccaatctgga

SEQ ID NO: 10232 - DNA, 167 bp, Gossypium hirsutum
  Clone ID: uC-gsflmaxxa043b10b1
ctggttacaatgcttggttctcgagagactttgtgtttttcaaaccagatgatgatcaaccactcccttaatcatcttccgcatgctaaaagacaacatacctattaataaatctgatactggcacatcagaatattcatctgctactgtgataggctatattcact

SEQ ID NO: 10233 - DNA, 336 bp, Gossypium hirsutum
  Clone ID: uC-gsflmaxxa043b12b1
tcacgcgtccgcccacgcatacgttccgacggcaactaaagccaatgcgtgagaacatgaaatccctggttcacgttgttatcgatccgttgagaacgacagaacattctgcattggcaaagaaatacagaatgaaaagaaatggacacaccaaactttaccactagcagacaagttaaggcacgccaacattcaaatgatggcaatgatctttcagtactgtcacattgacaccgtatagcccgaggatgcttaagaacacaaactccctcacaacaggggaacacattttgcatagacaagacaacacccaggctagctgcatcacacatcggg

SEQ ID NO: 10234 - DNA, 381 bp, Gossypium hirsutum
  Clone ID: uC-gsflmaxxa043c01b1
ttatcatgcagtcagatggataagcaacgggggggatgaagacacaaaggagagattggaggccatagatgatgagtttaagctgtatcgttgccatacagtattgaactgagctcgagcttggacacaggggctaaacccgagcaagccgaacactcacatgaagcattttgagcttactgctggtaggataaatctgcacatatataacgttcaaaccagtgaacttaaatgggccattatctgcgatgataacttgagcaatctgcaacgattcaataattggatcatatctcacaatcgtgcttagtgttgttgttcaagcgccgattttggttcagtcgatccttattgctatgtgctgtatatgattgaacatta

SEQ ID NO: 10235 - DNA, 470 bp, Gossypium hirsutum
  Clone ID: uC-gsflmaxxa043c02b1
ttctatggaaaatccaacccaagtgcaacatgctgaagatgaagatgaacatattttccgtagcaaatacccaccggtttcagtgccggataacttgacgttgccggaatttgttctccaggatgctgagttatatgctgacaaggtagcattcgttgaagcagtgtccgggaaatcatacacgtaccgtgatgtggttagggacacgaggaggtttgccaaggccttgaggtcgcttggccttaggaaaggccatgtagttctggtattactcccaaatattgctgagtatggcattgttgctcttggaatcatggctgccggcggtgttttctcaggtgcaaaccccgcatcgcacccatcggaaataaagaaacaagcttatgctgcaaatgctaagctgatagtaacaaatggcccaaactatgaaaaggtgaagaatctggagcaacccgtccgtgtgataggcg

SEQ ID NO: 10236 - DNA, 401 bp, Gossypium hirsutum
  Clone ID: uC-gsflmaxxa043c04b1
tgttaaaggaagctagaagagcaaagcgaaaatgaagactatactttcctccgagacaatggacatccccgatggggttagcattaaggtcaaggctaaggtgatcgaggttgaaggtccaaggggtaagcttacccgcaacttcaagcacctcaaccttgatttccatctcatcaaggacgaagagaccggcaagcgtaagctcaggatcgaggcttggtttggctccaggaagaccagcgccgccatccgtacagctcttagccacgttgagaacctcatcaccggtgtcactaaaggataccgttacaagatgagggttcgtctacgctcactttccgattaacgcctccatcactaatggcaacaaagtcatcgagatccgtaacttccttggcgag

SEQ ID NO: 10237 - DNA, 473 bp, Gossypium hirsutum
  Clone ID: uC-gsflmaxxa043c05b1
cctacgcgtccgcggacgcgtgggctgatttttcttggttagcatatgtctcaaaggcctaacgttccccactcttcttcaatagcttttggtctccattctcatctcctggtttccagtgagatgaaccctaattccaactggtcttaatagttccatctctttctttttcttctattgattttttgtttaaacttcttttatttcctttttgaaacaaagtaattgccttgttgatttgcaagcaaattttggtaaagttcttaagtatttgagtttagatcttctttgagagtgccgctatgggagtgaagagttttgttgaaggaggcatagcctcaatcgtggccgggtgttcgacccacccgcttgatttgatcaaagtccgaatgcagctccagggtgaaagccatgttcccaatccggctggtcaaacactccggcctgctttagcctttcagacaaccactact

SEQ ID NO: 10238 - DNA, 413 bp, Gossypium hirsutum
  unsure (1)..(413): unsure at all n locations
  Clone ID: uC-gsflmaxxa043c06b1
tttccgcgtccgcccacgcgtccgcccacgcgtccggaatttctaatccttatctgctaatggcttcttcacatcatttctgatttcttcttgcttgcttctttccttttagtattttctttcttgcctctttttttactctctctgacagtcatctgtatccccaaagcaaaaaaataaaataaaaatggaagcaattggtactggtgctgctgccaatgtctcttccgaggctgccaaaggtattttccaccaagttaaacgtcatattagatatgtagtcttctaccagaaaattgttgacaagttcgagcagaaacacgngacgttgattgcaaaaagaacaaagtgtgcaacaagatgttgatgttgcagaaaggaacggggagaagattaaagccgatgtcctggat

SEQ ID NO: 10239 - DNA, 413 bp, Gossypium hirsutum
  Clone ID: uC-gsflmaxxa043c08b1
tccacgcgtccgcccacgcgtccgcccacgcgtccggaatttctaatccttatctgctaatggcttcttcacatcatttctgatttcttcttgcttgcttctttccttttagtattttctttcttgcctctttttttactctctctgacagtcatctgtatccccaaagcaaaaaaataaaataaaaatggaagcaattggtactggtgctgctgccaatgtctcttccgaggctgccaaaggtattttccaccaagttaaacgtcatattagatatgtagtcttctaccagaaaattgttgacaagttcgagcagaaacacaggacgttgattgcaaaaagaacaagtgtgcaacaagatgttgatgttgcagaaaggaacggggagaagattaaagccgatgtcctggatt

SEQ ID NO: 10240 - DNA, 431 bp, Gossypium hirsutum
  Clone ID: uC-gsflmaxxa043c11b1
ttcacgcgtccgggtttccataaccttactgttttcagtatgtttatcggcgtcctatggtaagaggaccggaatctccaccatggctgacggagccgatgggtttcaaccaagcaacggttttccgcatgaagctgatcctgattcttcaacctctatcgatcctgatcctaccggattcggtgctggcataggtataggttatgaaagaagcccttactgtatcgactgcgacgatgtggatatcatgggcggcagcttttgcggcacctgcaattacggatgcccttaccgcaggttcaataatgggtgtggtgggtggtatcgcttatatggatgaactcaaacgaacgattaaggaccttaccatgaaacttgatgccaatgggtcttttagggaaaaagaaggccatgaatatacaagctatggc

SEQ ID NO: 10241 - DNA, 353 bp, Gossypium hirsutum
  Clone ID: uC-gsflmaxxa043c12b1
ttaattttccaaaaacaaaataactcctgggcctgggtggtttcattcgctatttcgtgtatttttattgtgctttatattatgaaagaatatggttttgttcctcctactaatttgaggggaacaagttcctggtatcccaataaataaaatgtattataaattaattaacttaaaaaaaaaaaaaaaaaaaaaaaaaaaaaaaaataaaaaaaaaaaaaaaaaaaaaaaaaaaaaaaaaaaaactaccaacgaaaataaaaaaaaaaggtggggggcgcccttttaaaaaaacccatattgatttgcccgggaatgcaaggctttttttttttttaagcgaaacaaaattc

SEQ ID NO: 10242 - DNA, 339 bp, Gossypium hirsutum
  Clone ID: uC-gsflmaxxa043d01b1
ggaccggccgaattccttgtctacccaccgtccgtcacgcgtccggcagggagctttagctttgtaaattttactccctttcgattgttcctcatcaaattccccattatccctttcttactttcttcttcttcaaccctttcatctttttaattccttttttcagttttttttttactccaatgttacctccaaaccctagcctttttcacgccaagccatctccgctactacctttactttaccggaccccattcacctgtcttaccgccgccggagacgccccttccggcccaacattccataagtggttccaatatcccaccacgacaacaactt

SEQ ID NO: 10243 - DNA, 414 bp, Gossypium hirsutum
  Clone ID: uC-gsflmaxxa043d04b1
tttcaaccctgtccttgtagccggtgatatgatgggagtaaaggttttaagcttttaactggtttacatggaatctttgtggtgtgggaagccatagcttctatttttgcattctcactctctgttgtactatgaaagccttcccttttcctccaatcaccaaaaggagatgctttttaatggtgtctttatcttagttggaagttgctgacaggcacataaccctaactctaaagccccgtatctccctttagttaaaaagctgatctacaagaacccaatgaaagaaagcataagccctcactttctttatatatcagctgcagctgcacccatctttgcttagccaaaccacgagtttcaagcaaacaagccaagggattttaattttgtttcattcatcagcagcaaatg

SEQ ID NO: 10244 - DNA, 471 bp, Gossypium hirsutum
  unsure (1)..(471): unsure at all n locations
  Clone ID: uC-gsflmaxxa043d06b1
ctcacgcgtccgcccacgcgtccgcccacgcgtccgctcgccgtctcgcgtgcgccctgtggctctcttcaaccctcgcatatctcttcaagatctgatctgatctgacanaaaaatgttcgggagagcaccaaagaaaagcgataatactaaatactatgagatattgggagtgcccaaaaccgcttcccaagatgatttgaagaaggcttatagaaaagctgcaattaagaatcatcctgataaaggcgngtgatcctgaaaagtttaaagagttggctcaagcttatgaggtgctgagtgacccagagaagcgtgagatatatgatcagtatggcgaggacgcccttaaagaaggaatgggtggggcnggtggtgcccatgatccatttgatatctttcaatccttctttggtggcaatcttttggtgggtggtggtagcagccgaggccgaagacaaagaagggaga

SEQ ID NO: 10245 - DNA, 470 bp, Gossypium hirsutum
  Clone ID: uC-gsflmaxxa043d07b1
tccacgcgtccggcagggcgctctgagctttgcaaaaatctccctccctttgtcattgttcttcatcaaattccccattatccctttcttactttcttcttcttcaaccctttcatctttttaattccttttttcagatctttttttactcgaatgttacctccaaaccctagccttttccacgccaagccatctgcgctcctccctctcctttcccggacctcattccgctgtttcgccgccgccggagacgccccttgcggcccaacattccataagtggttccaattcccgaccacgacaacaacttccgacaacgtttacagaggtggtgcgcgaatcgggcaagaaatcagctacgaagctccggctgggagtagcatcaaagtcaagaaatggtcgagggacacagagagttatttgactaacgacgatgaacctcttgcccttcccatgacttaccctgatac

SEQ ID NO: 10246 - DNA, 300 bp, Gossypium hirsutum
  Clone ID: uC-gsflmaxxa043d08b1
ttctacgcgtccggctctgagctggctttgcgtgcggtgtcaggatcggggactgcttggacacaagagtttaagacgtgtgtttgtggtaccatcaagagggaatattcgatagatattggaacgagggaagcaaaaacgaaacagccatcagccgttgctaatggcaaaacttgggcaaggaacgatattaactctgtcaagttaatcatggtcaacaggaaactcatgtccgataccccacattccttgacttctgagacaacattgactgggttccactttaagacaactgcctta

SEQ ID NO: 10247 - DNA, 467 bp, Gossypium hirsutum
  Clone ID: uC-gsflmaxxa043d09b1
tttgacgcgtgggtttaactagttggcgtgggttttttctcctatcaaggtcctgtctgcaaccaacctgttgtttgcaggatttgggctttgattacaccttttccaattttgctttataaaagaaaaaaaaaaaaaaaccacgatggctgctcatagttatagcttgtttcttttttccttgtcttttgttgtcttaatcccaacccttcaagctcacattgctgaatatgacgattattggaaggcacggaaattggaagccattgagaacctgaacaaggcttatcaccccaatcctgaggagatggtccaccattacaatgaccaatttgccaaaaccatgattaagcttaataacaccagaagggtgttgaagggaacgaaagaaaatggtccatgtgaaataaccaaccccgttgatagctgctggcggtgtgatcctaactgggaaaaaaacaggaaga

SEQ ID NO: 10248 - DNA, 377 bp, Gossypium hirsutum
  Clone ID: uC-gsflmaxxa043d10b1
tccacgcgtccgcccacgcgtccgaaaaagcacaggccacatagaacaatgcacaaagcttcaaaggttggcttgcacgcttagcactcacagcatttcacggtttacaccatttttctctttcagatttgctttaattttaccttcactttagacccataaaagaagaaaaggaaaacaggaaggagacatcgaaagaacccatcgttgttgctgcagaaatctcaaaagggcatggcctcaaccgagagttccagatcttcaactgctggctctcccgattcatacataggcagcttgataagcttgacgtccaagtctgaaatcagattgaaggtgttctgtttaatatcaacactgaagaatccagcatcggc

SEQ ID NO: 10249 - DNA, 469 bp, Gossypium hirsutum
  Clone ID: uC-gsflmaxxa043d11b1
tgtacgcgtgggtcttcttctccttctcagaaatcttagtatcatcactatggcctcaaatcccaaggtcttctttgacatgacgatcggtggtcagcccgctggtcggattgtgatggagcttttcgcagattgcactcctcgcactgcggagaacttccgtgccctctgtactggcgagaaaggcgtcggccgcagcggtaagcccctccactacaaaagctcttctttccatcgtgtgatccctaactttatgtgccaaggaggtgacttcaccgccggaaacggtaccggaggtgaatccatctacggatcaaagttcgctgacgagaacttcatcaagaagcacactggtcccggtattctctcaatggctaacgctggaccgggaactaacggatctcagttctttatttgcacggctaagactgagtggcttgacggaaagcacgttgtgtttgacaagttg

SEQ ID NO: 10250 - DNA, 474 bp, Gossypium hirsutum
  Clone ID: uC-gsflmaxxa043d12b1
tttcagtgtatcttctttccaggccctcctaaggatgtcaaaaattgacaataacaatgctccatggcaccgtctcaagcgtgcttccacaccaaggaaggcaacggtgcttgccatcggtaaggcctttccacggcaactaattcctcaagaatacttggtggagggctatatacgtgatacaaaatgccaagatgtctccatcaaagagaaactggaacgtttatgtaaaacaactactgtgaagactaggtacacagtgatgtgcaaggagattttagatcaatacccagaattggcaactgaagggttcatcaactatcagacaaaggcttgaaatagcaaacccggcagttgttgagatggcatttgaagcaagcttagcttgcataaaggaatgggggaggcctgcaactgatatcacccatatcatctatgtcttttccagtgaaatacgcttactggggggtgatc

SEQ ID NO: 10251 - DNA, 474 bp, Gossypium hirsutum
  Clone ID: uC-gsflmaxxa043e02b1
ttgtcgcgtgggcaaaatagttgtgaacacaagcactaaaagctcaaaggttaggagagtgcaactggaattttttatgaccacaatacatctgtgtttgaagttgaagttctattgaactactatcaatgatcaatcttgtttttccatatggtatgaaatgttaggctaacaagaagcaacatatacaagagacaagtatagcgaagttgcaaacgttaagatgggatgtgtggtaaggctaagaaagaagtggttagaaactagatattcacctccaagttgagatggctcttaaagaagataaggtgacaaagattagccacataagaagcagatcgattgcttaacatgttagaataatgaaaaatttggcattgcattggataaaatattgaaaaccaagaccaatatagacatggataagatttatagaacttgaagagaggcccggcataaatgtttctatgtctt

SEQ ID NO: 10252 - DNA, 472 bp, Gossypium hirsutum
  Clone ID: uC-gsflmaxxa043e03b1
ttggctcctggagaaactgactatctttcccggactaatggaaactgtgaggcggtatcactaccaagatgttggaaaggctcacccaacagagagcgatgagcatcctatgacctatacgatgaagctctgggccaccaatgaggcttgggcaaaatccaagtactggcacttcttgaggaagctgaagaaggttaagaagagcaatggtcaagcccttgccatcaatgagattttcgagaagaaccctaccaagattaagaattacggtatctggctccggtaccaaagccgaactggttaccacaacatgtacaaggagtaccgtgacactactttgaacggatctgttgaacagatgtgcaccgagatggcttctcgccacaaagtccggtacccttgcatccagattatcaaaactgcaacaatcccagccaagctatgctagagagagagcaccaagcagttccac

SEQ ID NO: 10253 - DNA, 471 bp, Gossypium hirsutum
  unsure (1)..(471): unsure at all n locations
  Clone ID: uC-gsflmaxxa043e04b1
tttacgcgtggggacgaagcagaagaaggaaacgaagagagaaacaaaaggaaaatggagattgtttggcaaactcctgctcatcctgctcagaaacaagattatgtttttcacaacgggaagcgccatgtacgaccttactactttgagttcgtctctcatgttaataaacgatgggaaggtaaaacaatagtggatttgttcgctcaagagttcagaggtcgatctagagattactatgttagtgctgtcaaatgtggacggatacaagtggatggagagaatatacctgtttcatacatagttaaacgatgccagaagattagccacttcttacataggttataggcatgaaccaccagtgatggcttgngatgtttgaagttcttcaaaatgaacctgatgtactgacagtttgcaaacctgcatcagtttnctgtacatcccatgtggtcaatatcgtaaaaacac

SEQ ID NO: 10254 - DNA, 460 bp, Gossypium hirsutum
  Clone ID: uC-gsflmaxxa043e05b1
tttggctcttctacctctcctcttctcttctgttcttgttgtttctttggcagaaatgtcgggcaagattggagtaaactatggtcgagaaggggacaatttgccatcgccatatgaatcaattcagatcatgaaatccattaaagttggccaaataaagctcaatgattccaaccctgaaatattgacactcttgtcaggaaccaagatccatgtctccgttacggttcctaacgatgatataatccgaattggttcgaacgattccatggccgaacaatgggtacgaaacaacatcctgcctcactatccggataccatgatccggttcgtgttggtcggcgatcgagtcgtcaactccaacatggatgtcaatgggacaatggagcagagccttgtgcctgcaatgcgtgggattaagagtgccctgactgctcatggtgttaaaaatgtcaaggtc

SEQ ID NO: 10255 - DNA, 468 bp, Gossypium hirsutum
  Clone ID: uC-gsflmaxxa043e06b1
ctcacgcgtccgcttttgacggacgatggatcgtgtccgataaagatgattacaaaggtgtatggaaacattcgaagagcgaaggacatgatgactacgggcttcttgtgagcgagaaggcacggaagtatgcgatagtgaaggagctcaatgagcctgtgagtctcaaggatggaagcactgtgcttcagtttgagactcgctttcagaatgggcttgaatgtggtggtgcatatttgaaataccttcgtcctcaagaggctggatggaaggctaaggaatttgacaatgaatccccttactctatcatgtttggacctgacaaatgtggagccacaaacaaggttcacttcatcttgaagcataagaatcttaaaagtggggaatatgtcgaacatcatcttaaatatccaccctctgtcccatctgacaagcttactcatgtgtacctggcgatcttgaagcctg

SEQ ID NO: 10256 - DNA, 467 bp, Gossypium hirsutum
  unsure (1)..(467): unsure at all n locations
  Clone ID: uC-gsflmaxxa043e08b1
tttgactccttcagatacttactatctttccctcaaaaatggttactttcaggtttcatcagtaccaagttgttggaagggctcacccaacagagagcgatgagcatcctaagatctataggatgaagctctgggccaccaatgaggttcgggcaaaatccaagttctggtacttcttgaggaagctgaagaaggttaagaagagcaatggtcaagtccttgccatcaatgagatttttgagaagaaccctaccaagattaagaattacggtatctggctccggtaccaaagccgaactggttaccacaacatgtacaaggagtaccgtgacactactttgaacggagctgttgaacagatgtacaccgagatggcttctcgccacagagtccgtttcccttgcatccagattatcaaaactgcaacaatcccagccaagctatgncagagagagagcaccaagcag

SEQ ID NO: 10257 - DNA, 470 bp, Gossypium hirsutum
  Clone ID: uC-gsflmaxxa043e09b1
ttggacgcgtgggtttccctttccgaatctcagatctttcgatggctctgaaccagagctacgatctgttcttcatcttcaacctctcactccttttcgctctcttacccttctctttctctcaaaccgtcgccgatgccccatcacccgccgccgatacttgcaatgggatcttcttatcttacgcttacacctccggaaccaagttaaaaccaacggatcccaagcaccagccgtacagattcgagtcagtcttaacggtgctgaataacggcgacgagaagcttaaatcgtggagggttttcgtggggtttaaaaacgacgagtatttagtttcagcgtcgaatgcggttttggctgatgggacgagcttgcctgccaatgttgggaacggtaccgtttttgctgggtaccccatgactgatctgaaaacagcgattgagactgccggagatttgaatcagattcaa

SEQ ID NO: 10258 - DNA, 461 bp, Gossypium hirsutum
  Clone ID: uC-gsflmaxxa043e11b1
gtggagagccttttttttgtgtagcgattctcagttagtcttttctttaagcttacagcttctctccagagttttataatgggtaaggagaaggttcacatcaaccttgttgtcattggccatgtcgactctggcaagtcgaccactactggtcatttgatctacaagctaggtggtattgacaagcgtgtgattgagaggttcgagaaggaggctgctgaaatgaacaaaaggtcattcaagtatgcttgggtgcttgacaagcttaaggctgagcgtgaccgtggtatcaccattgatattgccctgtggaagtttgagaccaccaaatactattgcaccgttattgatgcacctggacaccgtgactttatcaagaacatgattaccggtacctcacaggctgactgtgctgttctcattattgactcaaccactgggtggtttgaagctggtatctc

SEQ ID NO: 10259 - DNA, 203 bp, Gossypium hirsutum
  Clone ID: uC-gsflmaxxa043e12b1
tggacgcgtggaatgcccttcccgaatctggtgtatttatacggctctgagcgcggagctaccacctgcccttaatcttgaacctctcactccctttcggtctattacccgtctctatctctcaaaccgccaccaatgccccataacccgacggcaatactagaaatgaaatcttcttatctgacgctcacacctacggaacc

SEQ ID NO: 10260 - DNA, 472 bp, Gossypium hirsutum
  unsure (1)..(472): unsure at all n locations
  Clone ID: uC-gsflmaxxa043f02b1
ttctcgcgtncgcccacgcgtccgcccacgcgtgcgatagaatccccatcaatgtgggcaattttcccccttcaggatttgttagctcttaaggaagagtacatgactcgccctgctacagaggaaacgataaatgacccaacaaatccaaagcactattgcagataccgtgttcatgtaacaatggagtccttgataaaggataaagagttaaaaacgaccattaaagatcttatacaagggactggacgatcatatcctcacattggagaagctgaaaggcagttgagtcaagaaacagcagccttagctctggggaagcagtagcaccatgtgagtggtccagatataatttgtagtcgagtttcacagaaaggacatgttggtaatcctttacaaagcgaaggttgttcgtgtgtaagctcattactttggaattccagttcactaaataacaagcaagggaggtaat

SEQ ID NO: 10261 - DNA, 334 bp, Gossypium hirsutum
  Clone ID: uC-gsflmaxxa043f03b1
ttatctcgcaggtgtgctaagagctgctgagcgagagcataaatacactgtgccaccaatgggtgaaagcttaaatgctacatatgtcaatgccgaataccatcctataaaactatatctactgatcctttaaacgacccgagtcggataattgaggtggcagagaagaaacctcagggataagcggcttgtggtaggcaatccttcatatcgacgtgggtttgtgaatcatagaagacagctatttctataattgggaaccacaattcaccaagcattacttcggccacccaccaatatggaacgactgctgcgtgttgaccgtcactagaca

SEQ ID NO: 10262 - DNA, 464 bp, Gossypium hirsutum
  Clone ID: uC-gsflmaxxa043f04b1
ttcacgcgtccgaaagaaattcaagtttagaaattcaaaggattaaattaaaaataaaaagtcaaatgatactttgactttaaaaaaattatattctactttagcaggatttttatccgtctaacagggcaattaggagacgcagctttagggcattggataatgatatagaaatttctcaatttggggcaacagcaagcaaaaaaatccactcaattgaagaacaccagatcatataattgctaatcgatctctcagtactgattcagatttcctgaatcgaaagcaagtaattttcaaaggagcttgtgcaacacaggatatgctattgcatttgagctgagttatctactacggaatcagctttagaataaagtttcacttgcctgggttgttgttggcatggaatccgagttagtactgcacaatggcggttgccactgtagaaagtaagatggaaagtc

SEQ ID NO: 10263 - DNA, 469 bp, Gossypium hirsutum
  unsure (1)..(469): unsure at all n locations
  Clone ID: uC-gsflmaxxa043f05b1
ttcaaggttaccgagtttgtctgatgcatcgaggcaaccagttaaggaggagaagttacaattgaaaccttgattggtggttgagacttgacaccttgagaggtcacataatcaactctcccccagttgcagaatctgttcattttgagtagttcttacaataagtacattggttttctgttaataaaacttaaactaattaactcctatattgagtttgtggttggaggaaacggtgacacatttaataacaaaattattaggaaaattgcaccgacataccatagatttcgacttaggttgtagacatatcatctgggggccccagaaccgacagtattgggaccacaaacgtgcaaaatctattatagcgtctagggtaaattaattatgtttaaatttgaatctaatttttgaacagacctaactggctcccnctacgtttcttaaagaaaaacaaattagtttc

SEQ ID NO: 10264 - DNA, 482 bp, Gossypium hirsutum
  Clone ID: uC-gsflmaxxa043f07b1
ttaagatcatgaacccagaaaacgaacatgatccacaaaataactttaaattcaaactcaaagctttgaaccttttgtttctagcgtttttggccatgatcttagatcctttttgcacgttttcaattcacgatttggttcagataatccgccatgataacttaaaaacaatcacaatatcctcattttctctcattttcttagtaaccctttacttcagaaaccgtcgtagaaaagtttacctactgaatttcgcatgttataagcctaaaccagatcaaatatgcagcaaagaacgtataatgaaaatatttgcaggcactgggaaattcacagaagagagcttagcattccaaaagaaaatcatggagaaatcaggtgttggtgataagacatgtgttccgagagctatgatggcggcttcagtagaaaaaggaattgcagcggcgaaaaaggaaacagaagaggttatatttggagcc

SEQ ID NO: 10265 - DNA, 470 bp, Gossypium hirsutum
  Clone ID: uC-gsflmaxxa043f08b1
ttcacgcgtccgctactccaacgtttcggccttcacttacgattccaattccacttcttgcgttcaagccacttcctttttatcaagtcaaatatgggtctctgaaacttcattttttgcgttgtcaagttccagtctttggacgtatttagtatggacccttgtgataacttcagttttaagtgtacccatatgtttacttttgcttttattactcaaacactacacgaagcagatcgtttatgtcttgcttcctttctttataatcatgccggttttctttgatgtttattggttcgttgcttgtaccttgagctcttcttgtagtgatgctttccctttggtctatagaattttggtgcttgttttcattttgctaatagttggggttattatttggatcattgtggctaattggcatcggatcgagttgactgtgaagattatcggggttgcttccgatgcgcttt

SEQ ID NO: 10266 - DNA, 477 bp, Gossypium hirsutum
  Clone ID: uC-gsflmaxxa043f09b1
ttgccatcttcaataatttcttccgttgatcgttgttagagattagctttttaatttttcattatgggaaagatcaagatcggaatcaatggatttggaaggatcgggcgtttggttgcgagagttgctctccaaagcgatgatattgagctcgttgctgttaacgatcctttcatcaccactgaatacatgacgtacatgtttaagtacgacagtgttcacggtcaatggaagcatcatgagcttaaggtgaaggactcaaagacccttctctttggtgaaaagcctgtcacagttttcggtatcagaaaccctgaggaaatcccatgggctgaggctggagctgagtatgttgttgagtctactggtgtttttactgacaaggacaaggctgctgctcacttgaagggtggcgcgaagaaggttatcatttctgctcccagtaaggatgctcccatgtttgttgtgggtgtcaat

SEQ ID NO: 10267 - DNA, 469 bp, Gossypium hirsutum
  Clone ID: uC-gsflmaxxa043f12b1
tttagactctcgagatctataaaagttcacccagattcccatattcacttctcgaaacagttaattcatcgtttctgtctccgattgatctggtgctcctaccttttagatctctccctgaagcattaaatcttgagaatggatgataatggtgaaaaagaggaaaatatcccacgtgggaatgaatgggaagttgtgtccctaactgcatctgcatatgctgccgctcctggtccaaaagaagttgaaacaaaggatgataacaagggtgattcatatgaagtaggggaagcagaaacttctcatgctttattcatgtctggtcactttgtcttcccccctagcgagcatgagaatttgctgttggaacccgagaatagtagtgaaacgtgtaggcaaggacgtggtccatgaattaggtgttgtagatgaggtggtagatctaggacaaaggaagaagaagagattg

SEQ ID NO: 10268 - DNA, 402 bp, Gossypium hirsutum
  Clone ID: uC-gsflmaxxa043g01b1
ccttcaccaaaaaagtttgaggaaatgcctttggttatccagaagccatcgcaccatccgcatcatcttcaccatccccaccacaattcagagccaccatctctaccaggtaatcatactctagatttagaccctctccccttcgccatccctcttgtgctaggaaatgaaccggtctattcgcttcatggggggcataaacaatctcacactttttcaatccttgtctgacaattctaatgtcttggatataagccccgatggtcgatctatcatcaccactcgagttcgctttctttatcacagagagagaatccccttccaccaccacctttagaaaccgagaaccaaccccaggctgaatgcttgaaggcatgcaagggccttagctgcaaaaaccgg

SEQ ID NO: 10269 - DNA, 481 bp, Gossypium hirsutum
  Clone ID: uC-gsflmaxxa043g02b1
tctacgcgtccgcccacgcgtccgcagccgtacaaggagaaaacaatgcctcgcacgaccaccgtcgactgccctggctgtcctccacttcgagccttgactttcgatgcgcttggactcatcaaagtaatcgaagctccagagaaaggaggaggagttgccaaagtggtggagagatggggagatcctgatgcttccaaatgtgtgcttgccgcttccatgaatgaccgcaaaatcgaccccttattagctgttgcaagaaaaaatggtgtgattgagatacttaatccccttaatggtgaactttcccgtacggtttccgatgttagtaatgctggtgttaggccagaagatgatgctattgctgggctgcatttgttcagaagacagagagtggagttaaccccgaggtcatgcactttgctcacatgtaaaacaaaaggaaatgcaagcataaaaactggtgatctcgctgatactc

SEQ ID NO: 10270 - DNA, 446 bp, Gossypium hirsutum
  Clone ID: uC-gsflmaxxa043g03b1
ctgacgcgtgggtgaacgcgtggtgaaccctccaaagcaagctgtttctgtttttgctgatactcaaagcagtgaaattaaagataggatatttgatgaatttaacagtttatctgtcttataccagaagccatcttacatgtttacagacaaggagcacaggggtccacttgagtttgcagatgaacttggaaatctatctattggtgaagcagcaaataatgttgttcctactcagatggtggaggaaaacgacaaggatctgcttttaactacttcagagaaagaagaaactaaaggttcacgcaataatggttctgcttatagtgttccttatgatgtttcgtctacatccgtctttgcctcacaaacacagatagagtcgggagtttcaaatcccaccttggcaggccattctcctcaagcaagctttgcaattgacgatc

SEQ ID NO: 10271 - DNA, 470 bp, Gossypium hirsutum
  unsure (1)..(470): unsure at all n locations
  Clone ID: uC-gsflmaxxa043g05b1
atcnggtgcccttgttatgctcacaccccttggtgttgggatcttttttggcgtggaaactctctctggtgtcctcgctggatctcttgtctctggtgtccagattgctatctctgcatccaacacaggaggtgcttgggataatgccaagaagtatattgaggctggtgcttctgaacatgcaaaaactcttggtcccaaaggttcagatccacataaggctgccgttattggtgacaccattggtgaccctttaaaggatacatctgggccatcgctgaacatcctcatcaagctaatggctgttgaatctcttgtctttgctcccttctttgctacacatggtgggctgctttttaagatattttaagtgaagacaaacatcggctactagtctaccatttccgatacctgnctgntattctcttataattttcattttgaagtatatttaggtcgtagcacatttt

SEQ ID NO: 10272 - DNA, 377 bp, Gossypium hirsutum
  Clone ID: uC-gsflmaxxa043g06b1
gtattttcagtcgtcttctcttttagtcctctcgatcccaaagcaagctctcgattccgaatctctcccagaagatgcagatctttgtgaaaacccttactggtaaaaccatcacccttgaggtggaaagctccgatactattgataatgtcaaggccaaaatccaagacaaagaaggcattcctccagaccaacagaggcttatttttgccggaaaacaactcgaggatggccgaactcttgccgactacaacatccaaaaggagtccaccctccacctagtccttcgtctaaggggtggcatgcagatatttgtgaaaacccttacgggcaagaccatcaccctcgaggtggaaagttctgatacgattgataat

SEQ ID NO: 10273 - DNA, 394 bp, Gossypium hirsutum
  Clone ID: uC-gsflmaxxa043g07b1
ttctacttaaggtcatcaagacatgataacaggtatgagtttgagtcccgatggttcctaccttctcaccaatggtatggattgcaaactctgcatatgggatatgcgcccttatgcaccacagaatcgttgcgtaaagattttcgaaggccaccaacacaatttcgaaaagaacttgttgaaatgtggctggtcaccagatggaagcaaggtcacagccggtagttcagatagaatggtctacatatgggatacaacatctcgacgcatcttgtacaagcttcctggccacacaggatctgtgaatgaatctgtattccatcctaatgaaccgatcattggttcttgtagcagcgacaaacagatatatctgggggagatatgaactgtgctc

SEQ ID NO: 10274 - DNA, 478 bp, Gossypium hirsutum
  Clone ID: uC-gsflmaxxa043g09b1
tttccactcgctcgtgtcttccttccatcccacctccaattaaccccgacgccgccgtcatcatcgtgatcaaccatcgaatttttattataatccagatttttatcgaccacatgggcgaacaagcctcgggacagcctcaaccacaggctcaatctcagccttcaaacgactcttacgacgcgacccaatgccaaacccaaaggcaagcccaaactcaaactaaaactgaaaactcgaatgatgccttcgccgccgctgttcccaccgttactaccgccctcgttgtctctgcttcaacggaactcaccggtggttctccccttacatcctctcctccttctaaaatcccttctcgccctagaaaaatccggaaactctcccctgactcgaattccgaaccgaatgcctcccaacaagcgacgacttccacaacatcaacatccgtagcggtgccgctttaaaccgtccccagagc

SEQ ID NO: 10275 - DNA, 464 bp, Gossypium hirsutum
  Clone ID: uC-gsflmaxxa043g10b1
ttggcaccagcagggccaatgtaccaggctgggaccttgagtgggaacccattggcgatgacagccgggatacagacccttaagcggttgaaagagccaggaacatacgaatacttggataagatcaccggacaacttgttcaaggcattttagatgctggaaaaaagacaggacacgcaatctgtggggggtatatcaatgggatgtttggatttttcttcacagaaggacctgtttacaactttgacgatgcaaagaagagtgatacggcaaaatttgccaggttttataggggaatgctggaggaaggtgtatacttggcaccttcacagttcgaagctggatttacaagcttggcacatactcaggaagacatccaaaagaccattgcagcagctgagaaagttcttagcaagatttaaggtactttgtccaatcctgttctcactttcctattgaatga

SEQ ID NO: 10276 - DNA, 443 bp, Gossypium hirsutum
  Clone ID: uC-gsflmaxxa043g12b1
ttatttagtttgagaaacatagtagctttttgaccattgtttcatgcaagtatggtggtggcaacattgccttcttgccaaacctgtggctcacctgaaccatctcctccagcacctgaacccgaagcttttccacctgaaccggaagtacccgaaccttatccccctgaactggctccttatacagaacctgatcagtctccggaaccaagtgaggcaccaattgatgatgatggtgtttttgacgtcactaactatggagcggaggctgatggtcggaccgaatgtagctcggcattctctgcagcatggcatgcaacatgtgattatacgaggaactctaccatttacataccagaaggaacattcttgggcggtccgatctcatttcgtggcccctgctataacgatagatcgctaacgtagagatcaggggaacatta

SEQ ID NO: 10277 - DNA, 282 bp, Gossypium hirsutum
  Clone ID: uC-gsflmaxxa043h01b1
ctttgccattcatttgggaaatagtgtggccttatctccgtcactcaacgccgccccctatatatagtatctgaacatcccttcattgtttttccttccaaaatatctccagcccccttaaagcctatcttcttcttcttctactactactaaacttagagggtgaaatggccttcatacatcaaaccccatcactggaggtcttctcttctgccgcttatacaagaaagataacaccacccactccttcaacttctcggttctctttgccctttactttta

SEQ ID NO: 10278 - DNA, 180 bp, Gossypium hirsutum
  Clone ID: uC-gsflmaxxa043h02b1
aattgctcgagcagtcttgcattttgttttccgttttttttccccacacctttttttaaacccatttgctaaaaatgcactgggttcttccagtgttgcttgccgttatcggagttactgcactgcatcttgtaactccggtaagtgggtaaccgacattgaccgacttaaaacccaaca

SEQ ID NO: 10279 - DNA, 454 bp, Gossypium hirsutum
  Clone ID: uC-gsflmaxxa043h03b1
tttacgcgtgggctaggtgcaatcatgtatgagatgctcataggctatcctccattttgttctgatgatcctcggataacatgccgcaagattgtcaactggaggacttgcttgaaattccctgaggaaccaaaaatatcccccgaggctaaagatttaatatgtcacctgctctgtgatgtggaaacccccctgggcaccataggagtggaaagaattgaaggcacatccattggttcaaagggtgttccttgggaaaagctatatgagattgaagctgcatataagccgacagtcactggagacttggacacacaaaattttgagaagtttcctgaaattgatggcccttcttcctcaataccagaagtgggacctttgaggaagatgttgacgtcaaaagataacaatttcataggatttacatttaagaaatctgacgtcgttaagtcac

SEQ ID NO: 10280 - DNA, 422 bp, Gossypium hirsutum
  Clone ID: uC-gsflmaxxa043h05b1
ctcacgcgtccgcggacgcgtgggaagaaggccaagagaaattctgctttccaatacagttattgctcctttctttttatccttctcggttggtttaaggtttaagaatcatatataaagtggtgctatgtatggttcttcaccatagccagccgaaggaacatgtctctttaataataataataagaagaagaagaagaagaagaggaaattaacaaagatgagcaataaagtggttgttgcaggggtttccatcattcttgtggtgggagtcgctattggcgtggttactacaattaatcattctcgtgatgctaagggtaaattgtctcctgaaatgaaaggttgcgactagcatttgttcacctactcattatccagatgcttgtcataagactttcgcctttatgaacagcactggt

SEQ ID NO: 10281 - DNA, 392 bp, Gossypium hirsutum
  Clone ID: uC-gsflmaxxa043h06b1
tttgagaagcagggctcctttcgctccaactccgtgttcactgcatcgactcagccatggacacacaagatggaactcagcagtcacagcaactcatccttgctcacaacgtcttcctcctcaagcatccagacgtctctgacattgagaaggtccgtctcagggatgaggtcctcaactcggtccaatccaatgatatgacttcatattatgaaaccctcgttactgatgaagtgttggagctggatcagagccttttggaatcgatgcgtgccaagaatgaggaggagattaagaagcttgacgagaagattgctgatgctgaagaaaacttaggtgaaagtgaagttcgagaagcacatttagcaaaatccttatattacatttcgata

SEQ ID NO: 10282 - DNA, 501 bp, Gossypium hirsutum
  unsure (1)..(501): unsure at all n locations
  Clone ID: uC-gsflmaxxa043h08b1
ttttgcctccactgtttcctctcccaacaatggtggcatcaaacttctctcttgctttgacactcgctgccattatatctgtctgggtggccgctgatgcgcgccaccaccaccacacggcgtgggctacttccccttcctcttcctcttcctcccgggactgctccctcctcatcttgaacatggccgactgtttgtcccttcgtatccagccggaagtgaagtgttgaaaccctgaacggaatttgtttgntcttgctttgaaacctgtgcttgaaaaccgacgctgagtgcttgtgtgaggcttataagagcagtgcttctctgggtgtaactctgaatgtcaccaaggccatgactttgcctgctctatgcaaagtctctgctccttttaccactaactgcgcaatatctctcacacctgctggtgcaccaggtctgttctgataaatctaatccttatcttttctttgaagtatttcaatgtcatcaaatcttttg

SEQ ID NO: 10283 - DNA, 460 bp, Gossypium hirsutum
  Clone ID: uC-gsflmaxxa043h09b1
ttacgcgtccgctcgcctgtgattatttttgggtggttgcaacttgcgcataaaagctctggcctttcgctttgccttcggttatttacattctttggtggaccctggtaaagaaacagaaaaaagggaaaaaaaaaaatggatttaagaaagtgaaatcctcttgtttatggtttctaaggtgggtttcgcttcaaattttgatttgattaagaactaaattgaaaggcacatgaaatggagagagattttctgggtttgaactcaaaacaatcctttcctttggttaaagaagaagttgaagaaattggttttaccaaaagcttggggatttaatggccaattttaaacaaggtttcttcagctgttccaccacagcagatgagttttgattttgctcaaggagataacgctaaaagaatgggatatgattcaataggattctttactctcatgcata

SEQ ID NO: 10284 - DNA, 467 bp, Gossypium hirsutum
  Clone ID: uC-gsflmaxxa043h12b1
tttgttccttccttcgccgtctactgctcttgtgacctcgatttcaagtgaaacagaatgggtaaggaaaagactcacattaacattgtggtcattggccatgtcgattccggaaaatcgaccaccactggccacctgatctacaagcttggtggtattgacaagcgtgtgattgaaaggtttgagaaagaagctgctgagatgaacaagaggtcattcaagtatgcttgggtgcttgacaagctcaaggctgaacgtgagcgtggtatcaccattgatattgccttgtggaaatttgagaccaccaaatactactgcactgtgattgatgcgcctggacaccgtgactttatcaagaacatgattactggtacctcgcaggctgactgtgctgttttgattattgattccccactggtggttttgaggctggtatctccaaggatggtcagactcgtgagcatgct

SEQ ID NO: 10285 - DNA, 319 bp, Gossypium hirsutum
  Clone ID: uC-gsflmaxxa045a01b1
tgttttttcctctgctaaaaggctctttgatctctgtttcgtggatgggttaaaactctacaatggctaaaaccaaagattgcttggtacaataacatttcatagtttagtcgtgcacttggccatgctgatagctcggaccctaccagaataccttcgttttctaaccctactacgggatacaaggaatcatcaaccaggttttgaacctgttcaccgaccgcatgagctacttaataaggcgagtgaccgtttacagcctctgaatagtcagcaagaaccgattcagttactttcccggagctgctctcgctggtta

SEQ ID NO: 10286 - DNA, 410 bp, Gossypium hirsutum
  Clone ID: uC-gsflmaxxa045a03b1
tccttgcgtccgatttaaaaagaaaaaaagagagatggcgtctgtaataaaatctgcaatcttaattctgtcggtgtttttatctgtacgcttcagttcgggtgttaggttgctccaggaacagcccaatgatgaccccaaaaacatggacgctattcctcccattgatgcactcaaccctaccgagttgaatggacccggtgttggcattcacgaagatcatgttgtcccaaaaggtgctgaaactggtactcttggttttggttttgaaggaggtcctgataaatgttgttcttctggatgttccggtaattgtaatcctggtgggttcgatctaccatttactcaaattgcagaaatcccaagaattccagaaataccacaaatcccacagatcccacaaataccac

SEQ ID NO: 10287 - DNA, 238 bp, Gossypium hirsutum
  Clone ID: uC-gsflmaxxa045a04b1
ttggttcttgaacgcgcgcggtcgaactctttatttttttctaaacccaaagcgaacgctcataaatgggacggatagctgagaaaaagtctgctggaaggacaccagtgaaggagacgaaatctttaggttactaaggtccttcggagacgcagcctttggtttgttttatgctcccgctggatggcggccctgttgtcggagacccaatgtattagaggaccaagaatagtaccgt

SEQ ID NO: 10288 - DNA, 235 bp, Gossypium hirsutum
  Clone ID: uC-gsflmaxxa045a06b1
aggcgttcatatctctaaatcatctctttttctgcagtcaaacaaacaaaaactggctctttatctgggacaccaaccaagcagcacaccccccctgcataaatgatcagattttaatcaatcggcgaagggatattaatggaggctgacatttgtgacatcaatcacttggatgcggatgtcctcctgcctacccggaagcgcctgcttgcaggatttaagaaacaggcatcca

SEQ ID NO: 10289 - DNA, 302 bp, Gossypium hirsutum
  Clone ID: uC-gsflmaxxa045a09b1
ttcttcacgcgtccggttttattatcagctctcatttgtcagacgtaaaacccagaaaaagggcaagttgcttcttttttcttgtccaatagttcctttgtttgttcaaaaacatattcttttttaaggttgaaacaagtttaagcttaagggaaaatggcattcacgggaactttggacaaatgcaaggcttgtgataagactgtccatgtggttgatatgatgactcttgaaggagttccttaccataaaacttgtttcaaatgcagccattgcagggaaaccttgtgatgaacacctac

SEQ ID NO: 10290 - DNA, 374 bp, Gossypium hirsutum
  Clone ID: uC-gsflmaxxa045a10b1
tcgttcatagaaccgcgtcttctagcagcttatgacattccagcggtaatccagcagaagccaagttggagacaactggtagcttaattgattttgatgctgatcctgaacctgcagaagctcctatggttactcagacacaacaaactaccgcgactgaatccattgtgcatccaacttcttgtaccaacgagaactggacctctatcgatgtttacccccagacaaatgtctctcagacttcttctaatgtgaacactgtggactctgatctttctcaattgtcagttccggtatctgaacctggtcacttatcaggagtacctagtggtgtcggtggtcagaagcctgctcatgacgccaatatgaatatg

SEQ ID NO: 10291 - DNA, 262 bp, Gossypium hirsutum
  Clone ID: uC-gsflmaxxa045a11b1
tcgttcacgcgtacgggcacgcgtccgcccacgcgtccgcccacgcgtccgggcaattgggaaagtagggcagagcacaaatggcgagaacatcatccagcaaagaaaatgctcgagctttattccattctcttcgctgtggttatgctgccactccagtcaatctcaagatcattgatctgtatgtgggtttcgcaggcttcaccgatctgatccaggtggattacatggctagcgtgggatcatttccttgtaactcttt

SEQ ID NO: 10292 - DNA, 379 bp, Gossypium hirsutum
  Clone ID: uC-gsflmaxxa045a12b1
tcttatacattctaacaaaacgcctcttacagcacaacgaagcttctagtggaggaacctttacttgtaatgaagcccaaacacgctattgagtatcacaagaccataccaaatgagctgtatcctccagatctgtcttacacagagggcaagcaacatccacactcaactttcgtcgtgccagattaccaaaatggggcagcagatcgttaatcagtctccaacaatggatttttatttttttttggaatgattagtgcccataaggctttatagaaatctttgtaatcattattcatagaggaaatatatgtatgggcttgtaaatgaactgtagataggattcttgacccactcttaactggaatactccctgatc

SEQ ID NO: 10293 - DNA, 456 bp, Gossypium hirsutum
  Clone ID: uC-gsflmaxxa045b04b1
cacaaaccatttctcccctaaaacgattccttttattttttccccccaatttccccaaatcggcagccgtttgcagcccatacacactaattttgttctttcttcttcctgattttttattttcttggctgtggcggtggttttatttttgaacgatttcacgatctttcagttctaagaaaaaaatgagtgcggattcctctaatttgaaacgaagcttcaattcaaattcttcaaacaatcaaagtaatatcaacaagaagaggaaaagtaaacagaaaaccctaggcatggcttggggcagcaattctatatcttcctctcgctcctcgtttcgcgtgaaatgtcaatggggaaatgttaggtgatgctggaaaatgttatgaagactacgaaaataacaacatacggctgagaattcatttgatgatattagcaacaaagtggtcgtagatt

SEQ ID NO: 10294 - DNA, 423 bp, Gossypium hirsutum
  Clone ID: uC-gsflmaxxa045b06b1
tttattatggggtgctcatggtggtggggctttctgtggtaaagatcctaccaaggtggatagaagcggggcttacattgtgaggcaggctgcacagagcattgttgctaatggactagctaggaggtgcatcgtgcaagtctcctacaccattggtgtacctgaaccattgtctgtatttgtggacacttacggtactggaaagatcccagacaaggaaattctcaagattgtgaaggagacctttgacttcagaccaggaatgattgccatcaatcttgatcttaagagagggggcaatagcaggttcttgaagactgctgcgtatggtcattttggtcgggatgaccaagatttcacttgtgaggttggcaagccactcaagtgggacaaggggcaggcttaattggagcttcatcacac

SEQ ID NO: 10295 - DNA, 482 bp, Gossypium hirsutum
  Clone ID: uC-gsflmaxxa045b09b1
tcttttactcattcccgtgcaaagtaaaaaaaaaattccctttttcaatttttgcccttacctctccctatagaatgaagaagcactagaacgatcatcttctccctcggttcactgtcaaaaaaacttgcaaaatttgccatcggccaacaaaaggcaaagaaggcgctagctgtggcagcattacaaccactataaaggatataccattccttcaagaaaaacgaggcatctgaatcgggcgacaatgataaacatgtcgccaatgattttgctgagctggaaaagagcaatgtactgctaataggtcccactagttcaggcacagtcttatatgctgaataacttcttgctgcttctattgattattctctagctttttttttgttccgcttaaattcttaaaccttaattatgaggacaggacaaacattacttgtcgacactagcacgcattgtgaatgtaccatttgtcattgctg

SEQ ID NO: 10296 - DNA, 425 bp, Gossypium hirsutum
  Clone ID: uC-gsflmaxxa045b10b1
tcttcaatttcttcttcacttagaggtttgagcagatcgatcatttccagagaattcagtcaaggactgggaatcccttcaactcagtgctcttttttgatgatgaggataggaacatacaagctgtttctgaatgtgacaaccagaagaaacctgagaagagatttgtaactttggaggaaataggaaaaagaaataccagtgctggaaatactgtagatggtactcaactagatgcggagattgctggtccagagaacattaatgtaacaatatatagcttttatatattgaaacaatataagaaggttacttatgcaataccgaccaatgattctgctcagttcgttcacttgatatgtaacatgataactaaatgtcttatgttggctaggaaaaaagacggagcctacgggactgggaag

SEQ ID NO: 10297 - DNA, 412 bp, Gossypium hirsutum
  Clone ID: uC-gsflmaxxa045b11b1
tcttttcgctttgagattagatccaaaattcccctttcatcttatttccgattgcgcaatttttcctgaaaccctaatgctaatcccggattcctctcgtctacatcgtctagcaaatggcaaccgaggagccggcagtcgtggcagaccccgcaccggagacggaggaggacaagactgctgagaccaaagctacttcaaaatctggcagagcaaagaaaaccaaagaacccaaaaccaagaaagctgcagctcctcggaaaccacgggctgctcctactcatccaccttacgaagagatgatcaaagatgcgatcgttactttgaaagagaggacaggttcaagtcagtacgccattgctaagttcattgaagagaaacaaaagaatcttgctgggaatttcaagaagct

SEQ ID NO: 10298 - DNA, 258 bp, Gossypium hirsutum
  Clone ID: uC-gsflmaxxa045b12b1
ttcgttcacgcgtccgaaatatttatagaaaaatcgaatcatacaggcgaaaaacaaattgaaaaatttggccttgtcatttttggcagtcacactattgttgattatatttacaccggataacggatactggacaatagcgggcggtgaaacgccagtggcagatgtggagctcgacaaagcaatgcaagctctatggagattcgcagttgctgaacacaccaaaaatagaacaaatactgggaacatctccaacca

SEQ ID NO: 10299 - DNA, 325 bp, Gossypium hirsutum
  Clone ID: uC-gsflmaxxa045c02b1
tcgttggtgtctgagaaaaagggagatggcctccggtattaaagatgcactcgcaactctaacggagtccaaaccggcacgcttaacatccggcgtatggtcggttctagagcagatcaatgcctatcccacaaacatggacgctgtgggtcccatggaggcgctcaaccttacaaggtggaccagacccggcgtcgacattgacgaagatcgagctcttaccggaagagctgaaaaggatactcaaaacctctgccttgggggtagtaactgaaaacgatgatcacttgtgttataacggaacttgacatccaagagggttctg

SEQ ID NO: 10300 - DNA, 508 bp, Gossypium hirsutum
  Clone ID: uC-gsflmaxxa045c04b1
ttcacgcgtccgcccacgcgtccgtttaaaaagaaaaaaagagagatggcgtctgtaataaaatctgcaatcttaattctgtcggtgtttttatctgtacgcttcagttcgggtgttaggttgctccaggaacagcccaatgatgaccccaaaaacatggacgctattcctcccattgatgcactcaaccctaccgagttgaatggacccggtgttggcattcacgaagatcatgttgtcccaaaaggtgctgaaattggtactcttggttttggttttgaagggtggtcctgataaatgttgttcttctggatgttccggtaattgtaatctggtggtttcgttctaccatttcctcaaattccagaaatcccaagaattccagaaatcccacaaatcccacagatcccacaaatcccacaaattccactaatcccacagatcccacaagtcccacagatcccacaagtcccaaaaatcccactaatgccaagacaagtcggatgtg

SEQ ID NO: 10301 - DNA, 443 bp, Gossypium hirsutum
  Clone ID: uC-gsflmaxxa045c05b1
ttctcgcgtccgggcattcggtttttctccttctcagccttcaaataaaggatggagaggaacatatccctggtttccctgttatgcttcattcttttcaatgggtgtttggtgtttgaggcggatgctgtgaaaagccaacgcagcgaaaagctcaagctgattcacaggcattcacctgagctaggacacaatcctggaacgacccttggacccccaaaaaattcagaggaacgattaaaacagctggtgcagagcgacaaggctagacttcatgccattaaacggaggctaggcgtagtggggaaggcgaacgattgggtggagttcccattccgatcggcggcagatatggggatcgggcaatactttgtttccttgaggatggggacccctgccaagacctttactctgctggtggatacgggtagctgtcttacatg

SEQ ID NO: 10302 - DNA, 472 bp, Gossypium hirsutum
  Clone ID: uC-gsflmaxxa045c06b1
ttataatggagaaaactgatggaattgggaacgaaaatggaagcacagaagaaaagcaaagtttcaaagatggatcaatttgtgggtataattcgcttcaccacctcttgagcgcaaatctcaagcctcaactctaccaggaagtcagctggttgcttctggggctgaattgcggaaaagcacttgaaactattgttccacctgaatcagctaaagccctctcttcaaaacatgattttgatcttcaggctttcaaattttctgctgacaaagagttgttaagagaaccccgggtagtaaggggtcggtcttattcagaactgcattgctctcccaaccactgctcccatttcagaccagaaaaaaagctatctttgagaaattgggaccaataattgatgctgctggtgcttcaggagtcaacatactatgcttgcaggaagcatggatgatgccatttgccttctgtaca

SEQ ID NO: 10303 - DNA, 408 bp, Gossypium hirsutum
  Clone ID: uC-gsflmaxxa045c07b1
ttgttggtgtctatgggctgggcaggagagctgttatttgaaagaaacagtttgatctctaactcaaacgaaccgtacaagcttaacactcgacaaatagacagttctaacagttgatccatacctttcatactaagatgaataatgtggggcctagggagaggctgaaagtctgaacctggttaagatctgcactacacaattgtaaagcccgggctcttaaatgaaagcaggtgataaagaattctaggaacccaaccctctggattactaaaagcagcccatcatattgagttatataagcgaggatgacaaacaatagggttctgatatcggagccatgtgtaccagcagaacgatctgtgtctacttatgggctagcagcgaagagcttcatcatggacgcat

SEQ ID NO: 10304 - DNA, 321 bp, Gossypium hirsutum
  Clone ID: uC-gsflmaxxa045c08b1
ttgttctttcgtacaaaaactggatggaaacctgatatgttgttcggtgagcgtgggaagagtggattggctggcttaaatctggattatgctcacgttattgctttcgtgaaagagcgccttggcaaagaggtggaactcagtggatgcaagggacctgttccaactttcattgttgaacctttcatccctcacaatgaagagttctaccttaacattgcctttgaacgacttggttgcaacattagcttttcagagtgtggagggattgaaattgaagagaactgggcttaggtcaagaccatatttgccccaaccggg

SEQ ID NO: 10305 - DNA, 439 bp, Gossypium hirsutum
  Clone ID: uC-gsflmaxxa045c09b1
tcttttgggacctgaacacaagcgccttgtgcagactattgccctgagccaacaccagctcaggacgatactagatgattcagacctgcacaccatcactgatggctgtgtgtatcttgaaatgattgaatccaccctgcgtgcggcattgactgcttctattagtcaagtgatggcgatgagtaatggaaaagcgttccgattaggcaatgatacagattaatgatgactgagcgagaccttatatggagatagtgtatgactctaacaggtcttagctgatttcttattgctttcagataatcatacagcacatggaagtcaactagatgatgtagctaacttgaccactgatcaatacagactgtctgttcagcatgcacatatggaggtaacgatcacacatgcacgtggcggactacctgaaacaatgctgaac

SEQ ID NO: 10306 - DNA, 386 bp, Gossypium hirsutum
  Clone ID: uC-gsflmaxxa045c10b1
tcgttctttttaagaaaaaattgtttttggattcgtttcgttgctgctgagttttcgttgatctctgggctttgttgccctttcgccattgaaatccatgatcttcagcacctcatggactcatctccagtgcacaccacttcttcactccatgaacaagaagatgagtgggacactgatggatttgtgattccgagcttggaaattgaagaaccatatgaaactaaagctgatacttcagatgtagaaacatcaaaatcgtattcgcagcagaccaaaaaagaagagaacatctacttgggaccgcatggtgcgccgccatcacaatcaaggcagcaggagctgaatccgtccactcgtaagccacggatcacacagaatctaaa

SEQ ID NO: 10307 - DNA, 389 bp, Gossypium hirsutum
  Clone ID: uC-gsflmaxxa045c11b1
ttcttctcacctcggactactgggagcaaccttcaacacatgctcgtggacgacaaaaaagtaagcaaagaagaaactgaggaggtgtgatgaatatcaattgtggttaagaaatctgattgtaaagggtttagcttcaataaggattcttaattcttggtttgtttttctaattttagatatgatggtttttgctcgatgcaatctataatccgattccccttttttgtaacgttacttatagccatttttttaaaaaaagtctgcatccatagtgtttaaatttaaaaaaaaataagcaaaatggggaaagcgaaccattgggtggagttcccattccgatcggtggcagatatggggatcgggcaatactttgtttcctggggggg

SEQ ID NO: 10308 - DNA, 435 bp, Gossypium hirsutum
  Clone ID: uC-gsflmaxxa045c12b1
tctttgattttgtatttgtccattggagactccagcaaggttgttgtggacaactagcttctttcgccacaagcttatgatcttttaatttttatgtaaaagtaaaacacagaaattatctgtgtacaatctttgcttttcttcttttacagcaactttttgtgtctttttactcgccggaaagttttagacacaaaaatattacacacatacacgaagtttaagatatagaaagacaagtttgtataaagaaaatggagtctggccgtctttttttcaatccctccactacccaccgcaacatgttgcttctcgggaacactgaacccatctttcgaggggcaagaacaatggttagcatggaagaaaacccaaagaagcgactgttcttcagctcgccggaggatttgtacgacgaagagtactacgacgagc

SEQ ID NO: 10309 - DNA, 348 bp, Gossypium hirsutum
  Clone ID: uC-gsflmaxxa045d03b1
cgcgttcatttatactgtcttctggaagtggtaggactgttgtggatgataatgatagcagacctggctgcgcatatgaggcgtggcgagcgtgaggcagaacaaaggctctggagggaaatgttgggcagcgcctctactagtgaacagttgtggctactttagaggtgctgaaaggagtgcatggcatggcattgctggttgctatactggaagatgcactgtgaatatatatcacaccttaagacaggtgcacccacaacttggattatatgtcataggatcaggctttaacaggatttccgccaaagtgattgaccacccactggatagagctcacacaagaat

SEQ ID NO: 10310 - DNA, 516 bp, Gossypium hirsutum
  unsure (1)..(516): unsure at all n locations
  Clone ID: uC-gsflmaxxa045d04b1
ttcatgttttcggcaaaagggtgttcggtactaaggcacagttttgcgataccggtcggattcatgatcttgtgattgaatgcgacatgatcggggtaaatgatccgtgtcttgtgattcgtgtggacggcaagagtttgatgcaagtgaagcggctacgatggaagtttcgagggaattatactattttggttgatgggatggctgttgaagtttattgggatgttcataattggctcttcggatcatcggtcgggaatgctgtttttatgttcaaggcattgccttcatcggaggagaagttgtggattagccaatcgatcactaatccgagtacgttgcaatggtctttctacaacggtttcaagattcgaagacacgaaatctcggcttttcattggttttgtatgcttggaagaatgagtagaaaaacagactatagattcttcttcaactctctcaaaagtgctaacaaaaaanaacttttattgagtggtgatgtttatatacacttat

SEQ ID NO: 10311 - DNA, 439 bp, Gossypium hirsutum
  unsure (1)..(439): unsure at all n locations
  Clone ID: uC-gsflmaxxa045d10b1
ttcacgcgtccggatttcctcgcaagccaaacagatttcacctcttatctccgaattatctcatctatggctcgtaccaagcaaacagctaggaaatcaaccggaggaaaagctccgaggaagcagctagcaacaaaggccgcgcgtaagtccgctccggcgaccggtggagtgaagaagcctcaccgtttcaggccaggaactgttgctttgagagagatccgtaagtatcagaagagcactgagctgttgatcaggaagcttcctttccagaggttggtgagggaaatcgcgcaagatttcaagaccgatctgaggttccaaagcagcgccgtcgctgctcttcaagaagcggcggaggcttatctcgtcggactgtttgaagacactaatttgtgtgcaatacatgccangaggagtaccatcatgcctaaggata

SEQ ID NO: 10312 - DNA, 236 bp, Gossypium hirsutum
  Clone ID: uC-gsflmaxxa045e01b1
tttcttaatccataaacggaaccaaatatggccgggaaagcaatcgagtcggttcattgctaaagccggaaaaagacggcgggagccgtaacgcactgcatgaggggccgtggtttgatcaagagcaatgggtgttccattgagcttgtcgagcccaagatccttcgttataaggccgtatatccaatccttgtcctagtgcgttagaggttctcctaccctgacatgtggatccg

SEQ ID NO: 10313 - DNA, 368 bp, Gossypium hirsutum
  Clone ID: uC-gsflmaxxa045e04b1
ttgcttttcattatagataaagagggaattatccagcactccaccatcaacaatcttgctattggacggagcgttgatgaaacaatgaggactctccaggccttgcagtatgtgcaggaaaatccagatgaagtatgcccagctgggtggaaacccggagagaaatccatgaaacctgaccctaagctcagcaaggattactttgcagcaatttgaggtatagcctagaaagcagaaggtatgtgttgcgtccattaggattgactaaatgagtttttgtttttcaatgtatcttttttgttttaaagaattgcttagccttggatggtaaataaaagtatggggaaataatcaaaattaatgtttgg

SEQ ID NO: 10314 - DNA, 402 bp, Gossypium hirsutum
  Clone ID: uC-gsflmaxxa045e07b1
cttcgttcatttgtcagaccaaaaacccatgagccgggcaaggtgcttcttgttcacttgtgccatagttactgcgaccgtcactaaccatattctgtcttcagggtgcctcctgtttaggcttaagggagaatggcatcacaaccactccggaccgatgcaaggctcgtgatacgtctagacctgaggtggatcacaggactcttgaaggagctccttaccatcaaacttgtttccaatgccgacatcgaaagggaaaccttgtgatgaacacctactccatcatggatggagaactgcattgcaagcgtcattttgagcaactatttaatgaatgtggcaatttcagcatgaattttcaaacagtgatgaccgagaagctaaatgacgcgtagaggactc

SEQ ID NO: 10315 - DNA, 293 bp, Gossypium hirsutum
  Clone ID: uC-gsflmaxxa045e08b1
gccttccttgcgtcctaggcacacccacgcacgcgcctgggctggggaccaatgtccacgctgcctcattcatggctaccgccactgacatcgttcgggctccagctggggaactttgtgccacattctcggaaaccggtgccaaggcaacccctaccgttcaatagtcccgattggccatggaaggtacaatgatcactggtatggtgagtcacctacacatgaacaacgccggccacgccaccgacaacatcgtaggacagcctgccaaccctatctctggatgccggttt

SEQ ID NO: 10316 - DNA, 317 bp, Gossypium hirsutum
  Clone ID: uC-gsflmaxxa045e10b1
tctttttgggggtattgcaaagataatatttttattggggaaaaaaagaatggggagaggtagggttgagttgaagagaattgagaacaagattaacaggcaagtaacttttgctaagagaaggaatgggcttttgaagaaagcctatgagctttccgttctttgtgatgcagaggttgctctcatcatcttctccaataggggaaaactgtacgagttttgcagtagttcaagcatgatgaaaacattggagaggtaccagaagtgcagccatggagcaccagagacaaatgtttcaactagggaggctctggagc

SEQ ID NO: 10317 - DNA, 454 bp, Gossypium hirsutum
  Clone ID: uC-gsflmaxxa045e12b1
tctttaaacaccagattgtttcctaaacgatccggttcggttaaatcggatccgcccgtcattgaaccttcttcgcctaaagtttcttgcatgggaagagtcagatcgaaacgagaccgtaatcgccgaattaaaaagaaccgccaaaaatcagctggaatcgaaacagttaaaaagaaaacaacgagggcagggagcggtttcttctcgagtttccgtgctattttccggtgcaatggtaaagcacgtgagtcacacgctctgccattaacactgtcgccgccgcgatacagtgacattaggtctcgtttgccgccggatgatggtgatgacgtattgaatgtagctcctgaaatagctgagagtggaccggttgcagagccggtcagtctaggtggaatgaagcggttctcgtcgggtaggagatcggagacgttaatctgaccgtgtggag

SEQ ID NO: 10318 - DNA, 360 bp, Gossypium hirsutum
  Clone ID: uC-gsflmaxxa045f01b1
ttctctttcgtccggctttgtttgcgagctagccgacgcaccgtcccttcctcctccgcagtttgcttctaaagaacctgaggttgattaagatcgcagatcgcagctcttaaacaaataaattacaccatttcttgccattcttcattagctgtaggtattagtaaaataaagctcttttacaactgtggagctcctcattatttttcgaaatactagtctttaattgggaggaaaaataaacaaatgaaagagactttttgcatttcagttcatcaattccaatctggacttttaggtaaaaactttgtggctgacgtggataaagggaaggtgctgcatggggtgttcaagattatg

SEQ ID NO: 10319 - DNA, 415 bp, Gossypium hirsutum
  Clone ID: uC-gsflmaxxa045f02b1
ttctgctcgaaatcttcttcattctcattctctctccactgaactcttgctaaacggtatcgttttagtcagtctttcatcaatggcgaaagaaccagttcgcgtcctcgttactggagctgcaggacaaatcgggtatgctcttgtacccatgattgctaggggagtcatgttgggtgctgaccagcccgtgatccttcacatgcttgatatcccacctgctgcggaggctttgaatggtgtcaaaatggagttggtggatgctgcatttcctattctaaagggcggtgatgctacaactgatgctgttgaagcatgcactggagtcaatgttgctgtcatggctgcgtggtttcccaaggcaggaatgaatggagaggaaagatgctatgtcaagaatgtgtctattacaagt

SEQ ID NO: 10320 - DNA, 359 bp, Gossypium hirsutum
  unsure (1)..(359): unsure at all n locations
  Clone ID: uC-gsflmaxxa045f03b1
atctacaagtactcaatcaatcaatccccaatgactaccagctcttgtgattggcttccctcccaaatgtctacttcaacattaaccttactcttcgtcctccttggaactctctgttcctttatctacttcttcagctgaccaaaccgctacacaaatggccggaaacttccacccgatcctgcccctctacccatcataggtcacacccacatgctacggaacctgacacaccatattattaactatcttggcgaaaaatatggacccactatgtctacaatgctcagtaccgntactaccattcaggattcacaaccctaaagcgttaaactgactctcacggtccattacgtcac

SEQ ID NO: 10321 - DNA, 510 bp, Gossypium hirsutum
  unsure (1)..(510): unsure at all n locations
  Clone ID: uC-gsflmaxxa045f04b1
tttctcttaacgatatcctctgtttgcagttaagaaaagcaaatcatggctgctaccacagtcccagccgccgcaaggcagctatctcctaaagaagccgatatccagatgatgttggctgccgaggtccatctcggtaccaagaactgtgatttccaaatggatcgttacgtcttcaagcgtcgcaatgacggaatttacatcatcaaccttggcaagacctgggagaagcttcagcttgcagctcgtgtaattgtcgctatagagaaccctcaagatatcattgtccaatctgcaagaccctatggatcagagggctgtcttgaaatttgctcagtacactggttgtcatgccattgctggaaggcacactcctggtacattcactaaccaactccagacatgtttcagtgagcctcgccttcttatcctcacagatcctaggaccgaccaccagcctatcaaggaagcagctcttggaaatattcctaccattgctntttgtgacac

SEQ ID NO: 10322 - DNA, 428 bp, Gossypium hirsutum
  Clone ID: uC-gsflmaxxa045f06b1
tttttgtcttggaccgcaacagcctcctcataagatgtgctggcctgtttttcatgctgttgagcctctttctaaccttttgaactcatcacacttgggatttggagtagttgaagtttaagtatttagatttcagggttagttgtgtccaaagattaaagaatagaatgtggaagcatttacttgtaagatttcaacccccaatggtatccataaacatgacccctttagacagtggtgtcaactccacatatgcgccaaccggctggtgtgaaaaactccaattcctaacacacgcacacacatatatattgttcatttataatatggtaatgggtctccatctttcttatgtcaagttgcaaaggtttaaatcatgcatgtgaatcaatatggtagcaaactcctttgtaatagctatataaagt

SEQ ID NO: 10323 - DNA, 237 bp, Gossypium hirsutum
  Clone ID: uC-gsflmaxxa045f07b1
tttcttctcgaaatcctcttcattctcattctctctccactgaactcttgctaaacgggatcggcttaatcagactctcatcaagggcaaaagagcccattcgggcactcgcacctggagctgcagggcacatggggtatagctcatgtacccaagatagctaggaaagtcatgaccggtgcagaccagcccttgatccttgacctgcgagacatgccacctgctccggaggctacg

SEQ ID NO: 10324 - DNA, 428 bp, Gossypium hirsutum
  Clone ID: uC-gsflmaxxa045f09b1
tcttaatcttatcaatgaacttatgattaattctcattctgttgccagaaaggataagaaaaaagtgagactgactgagagaaacaaaaagaacaaaattatggaaacaataaagaaaaatggggagtcctggattgggaactggaaacagtgggcaaaggttaggcatcacggaacctatttcgttgggaggaccgactgaatatgatgtgatcaaagcccgacagcttgagaagtatttgcaaaatgtgggattgtaccaaagtcaaaaagaggctgttagtcgagaggaagtattggggaggcttgatcagattgtgaagaattgggttaaggcaattagccgtgctaaaagattgaatgagcaattggttcaagaagcaaatgctaagatattcacttttggctcttatcggctaagggtacat

SEQ ID NO: 10325 - DNA, 498 bp, Gossypium hirsutum
  Clone ID: uC-gsflmaxxa045f10b1
tttttacgcgtccgagaagaagcatatacatggagtgagggtcgcgcaatctttgccagtggaagcccatttgacccctttgaatacgatggcaaagtctttgttcccggccaggcaaacaatgcttacattttccctgatatgcacccatctgggttcattgaacaacaagccccagagccaaaacgaccaagcggtcctattatccaagaattagattctgatgatgaaaaagagatgaaagaaaatcccagaaaacatggtaggtctaaggatgaacctcatgtcgaggtaccagatgatgaaactgaacaatctgagagaaggaatgggcatttgcagtatatgaatggctataatggttcatatcaacgacaacagcaaccacctcaaactcgtagctttacatttcaaagctccaccgttacgtatggtggtgctaatggggcttactatacttcatccaaaacaaggaagagtggaagtgactggattacc

SEQ ID NO: 10326 - DNA, 231 bp, Gossypium hirsutum
  Clone ID: uC-gsflmaxxa045f12b1
tcgtttgtaaagccaccttttttgatccaataattcaaatcccttcacccacctcacttcctataataactcccccatttgaatcagattccatttcctaaaaaatatgattcaccaagagatggatattgatcatgaatgggttttcctccctgataatagattcctggatatcaatcaagaccatggaggaaaacgagtttctgattcaaaccttgttttcttcacaga

SEQ ID NO: 10327 - DNA, 349 bp, Gossypium hirsutum
  Clone ID: uC-gsflmaxxa045g03b1
aaaccgttagatctcgtaaacaagccggagcagacgccgacgcgggtgacgcgctccgtcaccgacagcatgtgtgttaaagtagtacaacagcagtttatatattgtctttgaatcctattagcgattgctgcggattatgctctcagccatatatatataaacatttcgagggttgtctttctatataaacaagaacagatagaaggctatgaactcagacacatggggatagagggtcaccgtcacaggtgacctaatgagaaaggctgctagacatggtgatgtggacaaccccagggagaaggctagggtagactcagacttcactgatcctatggcatgctca

SEQ ID NO: 10328 - DNA, 512 bp, Gossypium hirsutum
  Clone ID: uC-gsflmaxxa045g04b1
ttgctacaccaacttgattcagtctcgatctttccgccgttaatcagctaccctgtccctcccacgttctatatttgatctctttactctaaacaaataacgccctcaacttttggtttaacttaattcccccttcccaattttttaccggttttgggggaatggctgatggttggaccggattcctttggtttcattccttattcaacttggagaattgaagggaaaccggaagagataccttctttctggggggacaaaatcctataaatatgactggttatatcgttggtgcgctggttcctatggttttttacccttctccttcggagttcaaagaaggtaaagaagcgaggggtgccagtcgatgttggtggggaaccggggtatacaatccgaaacagtcgattcccttcccctgttgaaacatcatgggaaggtatatctactcttgcagaacttttgagcaggcatgtaagcaacacgcagataaaccattgcttggaactagg

SEQ ID NO: 10329 - DNA, 512 bp, Gossypium hirsutum
  Clone ID: uC-gsflmaxxa045g05b1
tcctcattcccctattttgaggtgccagaaccaaatattgttgaggtgaacactgtgaagaaccacgaaaaaacaggcgatgttcccatggggactgatattgagcctcgccatcgccacagcctatggacaggcctacgaaaatgtaaagccacttgctatggtggaaaaggtgacccgactccacttttactaccacgatattcccgttggaaatattgctactacaacctagatagctcacgcttacaccaccgataatttcttttccccgtccccatttggaagcttgtctgcaatgaatgatcccctcactgtatggccacatctaacatccacggtcattggcaacgcccaagggacgtacatagcattaagtcacgaccctgccaagatcactgcagtggtacatgctgattttggatttaccactggcaggttcaatgggagctccttcaggttgttctcacgatatccgcccacagattatgttcctagccccgacaccattc

SEQ ID NO: 10330 - DNA, 435 bp, Gossypium hirsutum
  Clone ID: uC-gsflmaxxa045g08b1
aaccgatggcgcttgtaaacaagccggcgcagacgccgacgccggtgacgcgctccgtaagctacaggtagggtgttaaggtgctccaggcacagtccattgatgaccacagcaacatggtagctattcctgccattgatgcactcaaccctaccgagttcaatggaccgggggttggcattcacgaagatcatggaggcccagaaggctccgaaattggtactcttgggtttggttctgaacgtggccctgaaacaaggagcactgctggatgatccggtgatgtggactactagaggtttgcatctaccgttgcctaagaattcagaaatcctaaggattgcacatatcctccaaatcccacatatcccacaaattccactaagtggacaggtcccacatgagccacaaataccactaatgccgggacactct

SEQ ID NO: 10331 - DNA, 440 bp, Gossypium hirsutum
  Clone ID: uC-gsflmaxxa045g10b1
ttgttcgtgccatttagtggtttaagggattttttcatttgtttcttcttacgctcgattacctcacgaaaagagaaaatgaccaagtgttacccaactgtgagcgaggaataccagaagtcagttgaaaaggctaagaggaagctcagaggtctcatcgctgagaagaactgtgctccactcatgctccgtctagcgtggcactcagctggaacttttgatgttaagaccaagacaggaggtccattcggaaccatgaagcatcctgctgagctcgcacatgctgctaacaacggccttgatatcgccgtcagacttctcgagccgatcaaggagcagttccctaacctcacctacgctgacttctatcagctcgctggtgtcgtcgccgttgagattactggtggacctgaaattcccttccattccggagagaggac

SEQ ID NO: 10332 - DNA, 474 bp, Gossypium hirsutum
  unsure (1)..(474): unsure at all n locations
  Clone ID: uC-gsflmaxxa045g12b1
ttttatataatgcaagcagtgtggaatctttgaacctcgaaatggaagaagtgagtcaaaccacaacgaagaagaaaacaaagatgacaaccgtcaggagcctcacttccccatctattgttaaagctgcaaccccaaaccgatttacaagtcccatcgccaaggccccaacatctcttggatctgttaaaaccatctctagatcttttggcttgaaatgttcctcaaatcaccgaacatcgatggcaatgtacaagattaagcttgtagggccgaagggtgaagtgaatgagttcgaagtccccgataaccagtacatcttagaggcagccgaggcagcaggagtagagctgccttattgttgcagagctggagcttgctctatatgtaccgcgaaggtcgantcgggtacggtacattaaccagaagccatctacctcgaggacgatcaaattaaggatgggtatatgttga

SEQ ID NO: 10333 - DNA, 420 bp, Gossypium hirsutum
  Clone ID: uC-gsflmaxxa045h01b1
ttgcctcggtcgtggttgtatttatgctagtactagtaccatgggcttctcaccgagcaccagcacgggacagtcgtggaccatgcgtgtaaagagcatcaacgactgcaggggaggcctaccagcgcatgacatcagcatggataggctgaaaaccacgctgaaagagacgagcatgattgacgagacagagccccaacctatagggctaactagcatgctgaactggattattgtgagtcaacacacattgggtagaatcactggggaggctattcatgaccatggtctctcacaatctagagaatcatgcggactgaccgctgctaggttagccatctcaccaggacgcagggatgctgagctggcttatctagcgactattgtaggactctatatcagcgatgtgcctccagctgc

SEQ ID NO: 10334 - DNA, 422 bp, Gossypium hirsutum
  Clone ID: uC-gsflmaxxa045h04b1
ttctctcgtccgtgctgatcctacagtattgtcggtgttggtcttcttggcactttcacatatcgtcacaaatataagataaatcaagtcagcttctccagttctactccttcttcttactattgtcgtgcaacactatcaacaacgatggaggaagtgaagccaacatttgattcagacaaagctgctgtactagttaacgagctcaggaaaacctttaattccggcaagacaaagagctatgaatggagaatatcacaattggaaagcatatcaaagatgattgatgaaaaggagaaggaaattgtagaagcactacagaaggacctctcaaaacctgaacttgaagcgttcttatcagaaattttgatggcaagatcctcatgtaagttggctctgaaagaacttaaacaatggatgat

SEQ ID NO: 10335 - DNA, 508 bp, Gossypium hirsutum
  unsure (1)..(508): unsure at all n locations
  Clone ID: uC-gsflmaxxa045h06b1
ttttcccaacattctagtgtgattcctatctcttttgttgaccactcaaaacatttgtaaatttggcatattccaaattaattccaagaattggattaatattagcccatgattctctcccttgattttgctttgaattttggctaggttgctacctaaattgtgtctttccaaaaaaaaatattctctctctccccccttagccagatactgtttactgtagtagcctttcgcggctgagccctaaacgtcaaatcccaacctatttccatttcctgcatcccatgttgtaatctcaccggacaaaaattgttaccatggcctaagcagccacataagaaacaaaacaaagttattttttcatatttgaactttgcataagtaaaatttgaatcggagatcataattttctttcttcttttcagaggctttcgaacatcaacctagactncgacgcatagataatttctgtagccgtggataattgcttcatatcatattcaagata

SEQ ID NO: 10336 - DNA, 371 bp, Gossypium hirsutum
  Clone ID: uC-gsflmaxxa045h08b1
tttttgacacgacagtgccactgaatcatggaccgattgggctaaggacaagatcagcgttattggtggcatgttcgcttcttcaccaacagcggaaccagcaggggaaccagcaccaacaccagcaagctcatcagcggaaacacccgaagtcaaggttagagctgaacctgtagccacaagcttggtttaagatgggatatcaaagcctgggtctcatcctataatatagagaacgatgggaaaagcactatgcctatgactatgagtactatgtattttttatttgtgcgatcaaaccttttatgtggtttgaacccattgctaatagaatgtgataacaataacatcaatgcccatgttgttatctt

SEQ ID NO: 10337 - DNA, 336 bp, Gossypium hirsutum
  Clone ID: uC-gsflmaxxa045h09b1
gtttccacacgtgcgaccacgcgtacgaccacgcgtccgggaaagagggacaaagaatgaaaagcgagctgaatcctgaagggactgaaagcgctctaaactcagtttacaactgacctttcttacccactgtaggtaactctgatctttttttgtgagtgagtgctgggatggcgccaaaaaggaaaacacccagaaagaaagctcgggggggatctttgggtcttgagcacatgatcaacggccattgaaatttaaaaaatgggctgcgacagctcgaaacacggggagtcggagacgcctgcgttagaccattccagcgctttacgtgacaat

SEQ ID NO: 10338 - DNA, 486 bp, Gossypium hirsutum
  Clone ID: uC-gsflmaxxa045h11b1
ttttcacgcgtccggggctatggacctaatgaagtgcttattgcaattattggaagtcaatttatgtacagaggcttgtggttggagcatgcacttattttacaggctttattgccgctctttgccgacttttcttctgataatgattctatttcccaccctaaaatcattgttttaagcagtgattcagcaagcaactacagcatggctgttgagaaaattgctcttaacttaagatatcccagtggggtggtgaagcatgtagctgttcatggagatgttgatggtgttctgagcatgactgaccttgtgatatatggctcgtttcttgaggagccttcatttccagaaattttgataaaagccatgagccatgggaaaccaatcatagcaccagatctctccaatataaggaaatatgtagataacagggtaaacggttatcttttccctaaggagaatattagtgttctgacacagatcata

SEQ ID NO: 10339 - DNA, 451 bp, Gossypium hirsutum
  Clone ID: uC-gsflmaxxa046a04b1
tttctctttccgtcctctcctgggttgatggatgctttctgtatccatcactccgatctctcctagaaagctaacatctcattttaaaatgaaaccatcagtacgtgcacctcatgttacatattgatgggctttcttttttagttttttgcacaccaattttgttcaacaacagccattcacttgctcccatctacccgaggggaaaaaaaaatcagaaactgtgtttctcagttgagttcttcttttctgttttgactgattggcgctcatgtattgcagtaactaaatagttctgaaatcatgaagcataaagatggaaaataccattcacaacctgaaaaacctttcaagattgtccctgcaacattgcttgttatcgttctatgtgggttatgtttctatcttggcggcatcttctgttctgagaaaagtctactagagggaaaga

SEQ ID NO: 10340 - DNA, 443 bp, Gossypium hirsutum
  Clone ID: uC-gsflmaxxa046a06b1
gtccttcttgactcaaagcatcaaggatgggtaaaagtcctggtgtcttcgtgttcgggggtttttggaaatgaaaatgctgacgcttggagtgattttcttggtcttttgaaattcagaggtgtgactgtggatagaactctaaccagggactccgctaatcaaagttggtgcccttcaaattcttcatctatggctaagatttcatccgagcttgtagcggtcaaccctgcaatggttgctgcattagcatgaatactcagatctttgggtgaagatccattaaggaaggagctggtggaaactcctagccattctgtgaggtggatgataaactctgataatacgaagttggagatgaagctgaatggctgtactcgtggcatatccgatcttctcaaacctaatggggaaatcagatcctgcaacaacgaacagatgca

SEQ ID NO: 10341 - DNA, 315 bp, Gossypium hirsutum
  Clone ID: uC-gsflmaxxa046a08b1
gtggctagcatgaattaacaatggcggctggtctagttacaagagaacgctggtcttttaaacacggggtcatatcggctgaaaatactagcctgataggtctaaactatggcataattgggtacatctggctcatgccatattgcaccattgagacgcggaaagcgatcaatgccgacacgtataaccagtaacatctctaccttgaaatatagagactttgatgccgaaccaaccacaagagctctggcagggcacagagcaaggacgtacatcaaactgctggaagccgagctgttgtcgagcaaaggatac

SEQ ID NO: 10342 - DNA, 451 bp, Gossypium hirsutum
  Clone ID: uC-gsflmaxxa046a09b1
gcttataataattcacatgcttacagaaagctgcctgtttttgcggagcttctttttcttcttctatttttgttttatttctaccgtttgtttgaaccgtatcagcttttcttcttcttcttcactgctttgtatctctcagctcagtttaactgagtccgctgacatatgaagatgccagtaagtggcattgctgttgctgctggcattgtgcaatgcaatcaaaattcatggagaagaaagcaatgggctgtgtgatgttaatctaacattgcgctcaagaccacatagtgtatccatattggaatttggtgctgttggagattgcaaaaccttgaataccattgccttccaaaatgccattttctatcttaagtcttttgctgacaaaggtggtgcacaactttatgtgcctccgggagaaggcttactcgaagtttaatcttacaag

SEQ ID NO: 10343 - DNA, 378 bp, Gossypium hirsutum
  Clone ID: uC-gsflmaxxa046a10b1
cattgtctcaatcttcaactgcaatttcttcacatgtttgaggtcgacggtgacggcggcatcaacggtgacgatgaggatggggatatatcatgatcgttgaatagtagctgttcaatcagttgggcaacttaagactcttttggcagttcatcaagaatggggatcattgtggctcaatccaagcgtataaatgaccggataatagttaagttattttcagcatttgcctgtactatttagtatttatgcctgaacttgagctttcagaaatgaaagtgaaaacattagtggttgaaactaatattattagagctctttttgcaccttaattctgccggaaaaaaaaaaaaaaaaaaaaaaccacaaatcccccag

SEQ ID NO: 10344 - DNA, 446 bp, Gossypium hirsutum
  Clone ID: uC-gsflmaxxa046a11b1
gatttaatctccaaaccttcttcccatttcttcattacattgttcaagaaaaaagaagcaaaaaaacatggccaaagttctgttgttcattgcactatgtgtgcttccagctttggttagtgctacacgcattctgaataatcaattggtggtagaaggctatgtgtactgtgatacttgccgtgctggttttgaaacccctaagactagaagcctagctgatgccatggttaggttggtatgctccgacaggaagagcggccaagttgtcttcaaaaaggagggatacaccgacaaaaccggaaaataccagattcgtgtatccgaggatcacttggatcagatctgtgatgcagttcttgtgaagagctcccagcttggttgtgccacaatgtctcccggtcgtgaacgtgcccgtgttatcttgaccaacttcaatggcattt

SEQ ID NO: 10345 - DNA, 492 bp, Gossypium hirsutum
  unsure (1)..(492): unsure at all n locations
  Clone ID: uC-gsflmaxxa046a12b1
atcccctctccctgctttgctctgaaaagtccaagtttttctccaatggcgaccgtctctccaactcctctgttgaaagatgagctcgacatcgtgattcccacgattaggaacttggactttttggagatgtggagaccctttttccagccttaccatctcatcattgttcaagatggtgatcctaccaagactatcaaggtccctgaaggcttcgattatgagctttacaataggaacgacatcaacaggattttgggtcctaaggcttcttgtatctctttcaaggattctgcttgtaggtgctttgggtacatggtttccaagaagaaatacatctataccattgatgatgactgctttgttgctaaagatccatctggcaaagacatcaatgcattggagcagcacatacagaacctgctgagtccatccactccnattttcttcaacactctttatgacccataccgatcccgtgctgacttcgtc

SEQ ID NO: 10346 - DNA, 478 bp, Gossypium hirsutum
  Clone ID: uC-gsflmaxxa046b02b1
ggacaatcctactaaatcttgcaaagctaggggttccttcacgccgtgtaccgtgttggcgatcttgatcgtaccatcaagttctacactgagtgttttgggatgaaattgttgaggaaaagagatattcctgaagagaaatactccaatgcctttcttgggtttggcccagaggagtctcatttcgttgttgagttaacttacaattatggagtatcatcgtatgatattggaactggttttgggcattttgcaattgcaacacctgatgtctacaaaatggttgacgagtacaggcgaccactttattattcaagtgcctagtctagtcaagtcttccttaattatgtgatatgaatacgatgatgatgcagcaactccttctgggttttaattttaatttgatgttgaggtgttgctactcttgaactgatcttgatgtactttgtgatattataaaatggaatggatctttggt

SEQ ID NO: 10347 - DNA, 463 bp, Gossypium hirsutum
  Clone ID: uC-gsflmaxxa046b03b1
gccgcctcctaagaatccgatccgaatcatttgggtttacccaatatttggcccgtcgtccgaccatttctacttagcggcgacgttctgtcgccaaaaccgacccttaatcccaaccccaatcttccattctcttaaaagacttaaaccccaatgactgataaattcactttttgtcaaaaagttgctaactcatctcaaaacaatggtcaaaccatccacaataagtctgcagaagaccaaagacgggaaacccattctttaaacatgggtttcgatcaaaagagaggtgtaaagcgagggaaaaatgggaaaaatgagcggaagaaaggtcctggagagacgggaaatgtaaagggctcattttggactgcatgttcctactgctattacaagttcgagtatgagaagaagtatgaagagtgccgcttgcgttgtcggaacttgagaaaaggatttcatg

SEQ ID NO: 10348 - DNA, 473 bp, Gossypium hirsutum
  Clone ID: uC-gsflmaxxa046b04b1
ctcaacaaagcctgcaatccgtaccatttatatatcgttcacgcttttcccagctttaacctatcactcttttaacaatgcctcgccgaagctctggaggaaggtcagccccaaggcctgctgctcgtgcaccatcgagcaacgttccttcgaaacccgctagttctgcccctcctccagcacctgtgcaaagtggaaatggactcggtgctgccattgtagatggtattggatggggtgccggaactgctatggctcacagggctgttgatgccgtcattggccctcgcgtcatcaaacacgagactgttgcttcatcagaaccagctgcggctgcttctgctcccgcaccaaacacaaatagcatgaacatggatgcatgtggtgttcaatccaaagcactaagtgattgtctgagcaacttcggaagtgatatcagcaaatgccaattctatatggatatgctgcaagat

SEQ ID NO: 10349 - DNA, 411 bp, Gossypium hirsutum
  Clone ID: uC-gsflmaxxa046b05b1
cttataccatcatgcagatattaggagacactttgaagcttttgcttgggcttatatttctcaacaatgcagaccaagagatgtttgggaaggaattctgctgaaattgatcaccccatcaaaggaggagaaggaagaaattttgagaatgagggatgaggaattagcaaagaagctttacaaagttcagcaagagaagaaatgtttgattgtgattgatgatatttggaccagtgaggcgtgggagactttattccctgctttccctgatgaaacaactgttggtagcaaaatattgctcacaacccgcaataggaaagtagctttggatgctgatcagaatggattccttcatgaaccagagtgtttaaatgaagaacagaagttggagctattccaattgaaagcatt

SEQ ID NO: 10350 - DNA, 515 bp, Gossypium hirsutum
  unsure (1)..(515): unsure at all n locations
  Clone ID: uC-gsflmaxxa046b06b1
cttttcgttttctctttattttgggatttgttagatttagaaggaaaattcagtattgcaggagagttattgaaatcaagagatgttagaacagttgctgatatttactaggggaggattaatcctctggacatgtaaagaacttgggaatgctcttaaaggatcaccaattgacaccttaatccggtcttgtcttttggaggaacgctctggtgcagcatcatataactatgatgccccaggtgcttcttataccctcaagtggaccttccataatgagcttggccttgtatttgttgctgtttatcagcgtattctccatcttctgtatgtggatgatcttcttgcactggtcaggcgtgagttctctgagatttatgatccgaaaatgactgtttataatgattttgacgaaacttttaggcagcttangatggaagcagaagctagggctgaggagcttaagaaatcaaaacagatggntaagcctgtcaataacaagtagaaagcagggc

SEQ ID NO: 10351 - DNA, 484 bp, Gossypium hirsutum
  Clone ID: uC-gsflmaxxa046b08b1
gcgaataatgtgttccgagcgaggtgggagattgtttgcaaccgatgacaggtactgcatcgacaatggagcgatgatagcatatacaggtctccttgcctttgctcatgggtactcaacaccactcgaggagtcaacattcacccaacggtttcgtactgatgaggtgcacgcaatctggagagagaaacaagagtcgggtgacttgagtggtcttccggatggaggaatctaaatgcaagttgctattaaggtttcaatgattgtgttgggatcaggatcttgaagattcagaaatgatattatgtatcaattatattgttttgtagtagactttactaggaaaaaaagttaagaacaaactttaactctgtattatgaatatgtctgaatatgtaaatcatgttctgaatgtgtttatttggaactggaagcttgaaacttcactttttttttcttcttttataattaactcaaaattata

SEQ ID NO: 10352 - DNA, 431 bp, Gossypium hirsutum
  unsure (1)..(431): unsure at all n locations
  Clone ID: uC-gsflmaxxa046b09b1
agaacattcactcttttccttctcaagtgccgggaatttcaacgccggctgctaactccggctcggggatgggaattccggtcaggcaaagatggcgtcggagcaaagatggattccatggatttagagagagagaaagggattactatccaatctgctgccacgtattgcacctggaaggattaccagattaatattatcgatacgcctggtcatgttgattttacgattgaagtggagagggcgctgcgtgttcttgacggtgccattttagttttgtgtagtgttggtnggtgtacaaagtcagtcaattactggttgatcgacaaatgagaagatatgaggttccgagactcgcctttattaacaagcttgatagaagggatctgatccatgaaagttctcaaccggcgaggtctaagcttcgacat

SEQ ID NO: 10353 - DNA, 464 bp, Gossypium hirsutum
  unsure (1)..(464): unsure at all n locations
  Clone ID: uC-gsflmaxxa046b10b1
caacaacccaaaagataaaaggaatcgtttacttgttcgtagcaatttatcgtcatttcaagctcaattctctgaaaatttttgtgctgaacttcttttttctctttgtaccaccatgtgtggaggtgctattatctccgatttcataccgccgtcgcggtcgcgacgattgacggccgatttcttgtggcccgatctgaaaaaatccgggttgaagaaggggtcgggtaagagatactcgaagcccgtgatcgacttgggcgatgatttcgagactgactttcaggagttcaaagatgaagaatctgatatagatgattatgatgttgatgatgctttggctgatgtaaagccctttgcttttaacgctacaaagaaacctgcttctgctgtatctcatggntcgaactctgaaaaatccatgccattcaatggtcaagctgagaaatgtgcgaaaagaaaga

SEQ ID NO: 10354 - DNA, 486 bp, Gossypium hirsutum
  Clone ID: uC-gsflmaxxa046b11b1
cccacgcgtccgcccacgcgtccgatatatctctgtctctctattttcgcatctggacagttcccggtttaacataaagccggtttgacgtgcgccgcctgagatgtcgccggcggtttctagtgtgataagaatctcacggtatagggaagctcagtggtgatagaagataatcaaatcggacggctccggtatttatctggtggggcccaaggagaaaaaaatctaaaaaagggtaggggaaaaatggagagccaaaagagtcaggggaagctaacgcgaacacagtcgtcgttgctccgttcatcgcctaccgtccggtcgtcaatccacagtatgtcatccatcaccgaaagtgactttagcaaagaccaagaagaaaaccagcagcgcgagtcgttactgaaagatgagaaaaaaacgaaaccgccaccaaagagaacaggttcgatgtcaccgaggattataccggtccggttcaccccg

SEQ ID NO: 10355 - DNA, 482 bp, Gossypium hirsutum
  Clone ID: uC-gsflmaxxa046c01b1
ggacatccctactaaatcttgcaaagctaggggttccttcacgccgtgtaccgtgttggcgatcttgatcgtaccatcaagttctacactgagtgttttgggatgaaattgttgaggaaaagagatattcctgaagagaaatactccaatgcctttcttgggtttggcccagaggagtctcatttcgttgttgagttaacttacaattatggagtatcatcgtatgatattggaactggttttgggcattttgcaattgcaacacctgatgtctacaaaatggttgacgagtacaggcgaccactttattattcaagtgcctagtctagtcaagtcttccttaattatgtgatatgaatacgatgatgatgcagcaactccttctgggttttaattctaatttgatgttgaggtgttgctactcttgaactgatcttgatgtactttgtgatattataaattgtaatggatctttggtcttc

SEQ ID NO: 10356 - DNA, 506 bp, Gossypium hirsutum
  Clone ID: uC-gsflmaxxa046c02b1
cggattcgtgggcggacgcgtgggcggacgcgtgggcggacgcgtgggcggacgcgtggggagagatattttgtgagtaaaaaaaaaaaaaaaggactaaagttggatggttgtagggttttgcacgtaaaagttcgtgtttaatcatcataatgactagcattatgggcacggaggatgataagtatagcacgattaacttcgaagagacggagttgcgtttagggttgcccggcgccaatggaaacgaaggtgaaactaccaaaaacaacggaaaacgagggttctcggagaccgttaatttgaagcttaacctttcatcaaaggagactgtagccgaggattccgataagatgaaggagaagagctcaactgacactgcaaagccacctgccaaggcacaagtggtgggatggccaccagtcaggtcattccggaagaacataatggccgttcaaaaagccagttcctaggaggaaggtggcagcaagaaggccggaaacagt

SEQ ID NO: 10357 - DNA, 503 bp, Gossypium hirsutum
  Clone ID: uC-gsflmaxxa046c03b1
aaaggttctagttcaagtggttcattggaatctgaaaaagttgtgcagttgaacaaccatactgtatctcgaatggaaccgagctcttgtccgaatccagctttgaatatgtgcgctggcacacattatgctgaagccaaacaaagtttcaccaatactgaagttagtgaatgtgcaaacagtgttgaaaagtctggtgaaagcggtgaagtgagtaattccttcgatttaggtgagagtaggaagacaagcctctatagagagagcactggtagtgatgttagcgatgaaagcagctcgagttttctaagcagtacagtgtataagccccataaagcaaatgatataagatgggaagcaattcaagccgttcgatctcagaagggagatttggacttcaagcacttcagggtgctgaagagactcggatgtggggatattggcagtgtttatttatcggaattgaccggcacaaagacttatttcgccatgaggttatggat

SEQ ID NO: 10358 - DNA, 475 bp, Gossypium hirsutum
  Clone ID: uC-gsflmaxxa046c04b1
cccacgcgtccgcccacgcgtccggttcctttgaagggaataaaagagaagaggagggaaagtacgtgaaatttgtgaatttgttttacatcttcgttaatctgagttgagcatttcacacagcctttgtagaggatatatggagaaacaaagaaagaaagagaaaccggcctcttccagacaaatattctgcctttcaggtcctttacacctcacttcagttgactgggataactttcatgaccgaagatcagttgctgcaagcttggttcagggagtgtacatcctagaacgtgatcgccaagagaaccgcaaagaccctctggctcatgcaccagcttggtgggagttcttcaatttccagttgttccatattcttgtagatgatgttgataactccatttttggtgccatttttcaatccaagccttggtatttcacctacaaccattcatctcaaagttcttcacattat

SEQ ID NO: 10359 - DNA, 446 bp, Gossypium hirsutum
  Clone ID: uC-gsflmaxxa046c06b1
ggcgtcgtttcggttcttaatagctatctccctcgtttctctcatcctcatttcaacgctcactccttcaatctccaagaccgccaaaaacgacgacgtcgagctagacgacgacgaggatctccgttttctcgaagaaacggagggaaaaaaagacgccgctccttctcattcccactacaaagaagaagacggcggcgacgacgagtaccccgacctggacgacgaggacttcgggaactatcacgatttcgatgactccgattcggatccgtacaaggaacccgaagtcgacgacaaggacgtcgtcgttttgaaggaagggaacttcagtgatttcattgagaaaaacaagttcgtgatggttgagttctacgcgccgtggtgtggccattgccaggcgttggctccggagtacgctgccgcggcgacggaattgaagggag

SEQ ID NO: 10360 - DNA, 529 bp, Gossypium hirsutum
  Clone ID: uC-gsflmaxxa046c07b1
cgatctagcagctaagttctccaaagagaaaggcagtttcaccgtggttttgtctggcggctccctcatcaagtctctcaggaaactagtggaacccccatatgttgatgcgattgattggtcaacatggcatgttttctgggtggatgaaagggttgttcctaaggatcacgatgacagtaactataagctagcttttgatgggttcctatcaaaggtacagattctccctggtaatgtatacgccatcaatgatgcactgtctgctgaaggtgcagccgatgattatgagacttgtctcaagcacttggtgaagagcaacgtgcttagtgtctcaacagctactgggtttcctaagtttgatctcatgcttctcggaatgggaccggatggacacgtggcttccctctatcctggccatcctctggtgaaggagaacgaaaagtgggttacctttattaaggactcacctaaacccgcccccgagagaatcacctttactttcccagttatcaactcatctgctcac

SEQ ID NO: 10361 - DNA, 524 bp, Gossypium hirsutum
  Clone ID: uC-gsflmaxxa046c08b1
gcgattcctcgattaaatcccattgctccgaaatgagcacgggcgaccttcttaccatcgatcctttagagctcaagtttccttttgagctgaggaaacagatctcatgttctcttcaattgtcgaataaaactgataatcatgtagctttcaaggtgaaaacaacaaatccaaaaaagtactgtgttcgtcccaatacggggatcgtcttgcctcgatctacatgcgaagttatagttaccatgcaagcacaaaaggaggcccctgctgatatgcaatgcaaggacaaattcctccttcaaagtgtaaaagcccctgatggtgttaccgcaaaggatataactgcagaaatgttcaacagagaagctgggaatgtggctgaggaatgcaagttgagagtggtttatgttttttcgcatcaacaaacttcaccttcacaagaagggtctgaattagtgcctagaggctctatttcagacaattctgagtttggtatggctgcaagaacatttatggatcagctt

SEQ ID NO: 10362 - DNA, 346 bp, Gossypium hirsutum
  unsure (1)..(346): unsure at all n locations
  Clone ID: uC-gsflmaxxa046c10b1
cccacgcgtccggaagaatcgaaagttaaactaagcaacattagcttcaagaacatccgtggcacatctgcgcttccagaagctgtcaagtttatttgcagcggttcttcgccatgtcaaaatgtggaacttgcagacattgatattaagcacaccggacctgaacccgcaacatcccaatgtttgaatgtcaagcctaaaactagtggcaaattaaacccgactccatgttccagccctgtcccaaaaaccctaagtgccaccgcttaaaccataccaacagattcaatgcaattgtaattaatatatttattcatattacataaaaacagttctttntcatttt

SEQ ID NO: 10363 - DNA, 525 bp, Gossypium hirsutum
  Clone ID: uC-gsflmaxxa046c12b1
cccacgcgtccgggtgtccaagacactacccagatccacacccacatgtgctactccaacttcaatgatatcatccactcgatcattgacatggatgccgatgtcataaccattgagaactcacgttcagatgagaagctcctgtcagtcttccgtgaaggagtgaagtacggtgctggaattggacccggtgtctatgacatccactctcccagaataccatcaaccgaagagattgctgacagaattaacaagatgcttgccgtgctcgagaccaacatcttgtgggttaaccctgactgtgggctcaagactcgcaagtacgctgaggtgaaaccagccctgagcaacatggttgctgctgccaagctgctccgcacccaactcgccagcgccaagtgataggctcccgagatattggaaatccgaatcccataccattccagagagattaaaaagaaaaatggcaaagaagttcttctatcttatcatttgaatactcttgtgtgatgaaaatttgtacat

SEQ ID NO: 10364 - DNA, 531 bp, Gossypium hirsutum
  Clone ID: uC-gsflmaxxa046d02b1
cccactcgtccgaactacaataaaatacaggtttaggaagaaatgggttctctagtggggcatgttctcccaggtttagccttctttttacttggtttttggcatctctttaatcacatcaagctccattctctccatccgaatccctacacatctcccacatggttccccacaccaaaatcaaggcacttagagctgttcctcatcatggtagcttcctccatctccatctccatggagctctttatcagccctgcaaggcaccaacctttggatcctgatggaaccatcccatcaactcatctccacaactttgagcactcttccatatctatgactttctttacttatgcagctttcgctattatccttgataaaattagccccaaagctaagcatagcctaacacagtttattgcagccgtagcttttgcccagcagctcctcctcttccactttcattcagctgatcacatgggagtggagggtcagtatcacttgcttctacagaccctcatctttgttctttac

SEQ ID NO: 10365 - DNA, 499 bp, Gossypium hirsutum
  Clone ID: uC-gsflmaxxa046d04b1
agcaaatctaataaacatcaacaataaatcggaattccccagcagcaatggctactcctgtagagtatttgcctcctccattggatgctactgcacagcaacccgctatctttgatggaacaatcaggttgtatctggcttatccttgcccttacgcacagcgcgtgtggatcgccaggaattgtaagggtttgcaagacaagattaagttggttcctttgaaccttcaaaatagacctgcttggtacaaggaaaaagtttaccctgaaaacaaggtgccgtccttggaacataatggcaaagtcattggggagagtcttgatttgattaaatatgttgatagcaacttcgaagggccgtctcttctacctgatgatgctgacaaaaaggagtactttgagacgacgttatcacacatggacgaatttctagggctggtgtatgctacatttaaaggagactcaacaaggatgctgatgctgctcttgatcacttggaa

SEQ ID NO: 10366 - DNA, 465 bp, Gossypium hirsutum
  Clone ID: uC-gsflmaxxa046d06b1
gaaaggtttcagttcagagtcataagcaacatcaatggctccttcaactctgacggctcttgcggaagagaaaaccttgcaggcaagcttcgttcgtgatgaagatgagcgtcctaaggttgcttacaaccaattcagtaatgatatccctgtcatctctcttgctggtatcgatgatgttgatggcaagaggggtgagatatgcaagaagattgttgaggcttgtgaggattggggtgtcttccaggttgtggatcatggtgttgatactaaactcgtgtccgaaatgacccgtcttgcgagagagttttttgctttgcctgctgaagagaagcttcggttcgatatgtctggtggcaagaaaggtggtttcatcgtctccagccaccttcagggagaagcagtgcaagattggcgagagattgtgacatacttttcatacccattgaggagcagggactattc

SEQ ID NO: 10367 - DNA, 483 bp, Gossypium hirsutum
  Clone ID: uC-gsflmaxxa046d07b1
ccctgacaaagatataatgatgaagcctccaagacgaagtgacgactcactaatcactgcttggatcttgttccgctacctggtgattgggctctatgtggggatagccactgtcggggtcttcatcatatggtacacccaccatagcttcctgggcattgatctgagtggagatgggcatagtcttgttacctactcccgacttgctaactgggctaaatgcgattcttgggaaggtttttctgtgtctccattcacagcaggttcccaagtgttcagattcgattccgacccatgcgactactttcagtcagggaaaatcaaagcctcgactctttccctctctgtcttggtagccattgaaatgttcaactcccttaatgccctatctgaagatggaagcttgttaacgatgcctccttgggtgaacccatggctccttttagccatgtcagtctcatttggactgcactttttgattct

SEQ ID NO: 10368 - DNA, 378 bp, Gossypium hirsutum
  Clone ID: uC-gsflmaxxa046d09b1
cccatgcgtacggagagctgcctgagcaggatagacgtgtgtcacagattcttagccatcatgcaggcatcaggactactaggggcagtgggggaggccgtctaagaccacgagaggactcttcgaataccctaatagacatggaagctgtgacctgtgctaaggcgcatcaacatattgatgactggagcagaggttatggggacatgaaacactaggtgtatgatgaggcggacactatactcgaccgagcttgtgaggctgacactcacacgcaaactgagacagttggacatcgggctataaaacccaatggccgaagattgcgaactattttcgtgacagctgcactgacagaggctgcacctaaactgattg

SEQ ID NO: 10369 - DNA, 463 bp, Gossypium hirsutum
  Clone ID: uC-gsflmaxxa046d10b1
aagttgggaagctcttggcaaggaagagaggagaaagaaagagaagctcttgatgcaaattggttcatttcattgaaacacacgctgtggaatttcaagaacagctccattttgcacttgctttcaccataactattgccatattagtggtcaccatccttgttaaaggcaacaagagacaaaagaggaggcccccagagccagatggggcattaccttttattggtcatcttcatctttttggaaaaaaccagctgctacacaggatatttgcagacatggctgacaagcatggaccggccttcttgatccgtctcggggttcgtcgagcacttgtggtgaataactgggaagttgcaaaagaatgtttcacgaccaacgataaggtcttctccacacgtccaaagtccatagctgtaaagtatatgggatatgactataagatgttaggttcgctccttac

SEQ ID NO: 10370 - DNA, 496 bp, Gossypium hirsutum
  Clone ID: uC-gsflmaxxa046e01b1
gagaaatacacaagaaaaaaaaacaagtgatctgataaattgaagactttatttctgttaacatccattatgagtactgctggtcaagtcatccgttgcaaagctgcggtagcatgggagtcggggaagccactgtcaatagaggaagtggaagtggcaccaccgcagaaggatgaagtccgtattaagatactcttcacttctttatgtcacaccgatgtctacttctgggatgctaagggacaaaaccctctgtttcctcgcatactaggtcatgaagctggagggattgtggagagtgtaggtaggggggtgactgatctaaagccaggtgatcatgttctccccatcttcacgggggaatgcaaggagtgtccccattgcttgtcagaagaaagtaacatgtgtgatctcctcagaatcaacactgataggggtgaaatgattaatgacggaaaatccaggtttttcattaatgggaagcctatctaccact

SEQ ID NO: 10371 - DNA, 438 bp, Gossypium hirsutum
  Clone ID: uC-gsflmaxxa046e02b1
cggacgcgtgggcggacgcgtgggttagcctatctttgatacgcaggtgtctggattggttaaagaatggccatgacgccacaaatggcttaataaataaatcccacacccagttggccaaagctttacaccgaagaagcaaagcagcatcggcatggcagtttattgcaattccgctcccttttcttgcaaagcctcgagaaacagagaccccacacccttatccgcactcttacccacccgtctcttctcacttcttcaacccccaatcagcttccatccagatagattaaagctctcaacttgcaggtgggataaggtggcttctgctgttgtttctgaagaaagtgcagttgggtcaagctcttctgggactgatgtattcaacctcacttacctagaggggaatagtctgcttggggatataagtggggtgag

SEQ ID NO: 10372 - DNA, 479 bp, Gossypium hirsutum
  Clone ID: uC-gsflmaxxa046e04b1
cccacgcgtccgctctccctctcttcttaggtctgctgtatcttagttcttgattaattagccaatcacagcagccatgtctctcctcaatgatctcatcaacctcaacctcagcgacaccactgaaaagatcatagccgaatacatatggatcggtggatctggtatggatctgagaagcaaagcaaggactttgcctggaccagtgacggacccttcaaaactcccgaagtggaactacgatggttccagtaccaatcaagcacctggagatgacagtgaggtcattctttatcctcaagctatattcaaggatccatttagaaaaggaaacaacatcttggtgatgtgcgatgcttacacaccagccggcgaacccattcctaccaacaagagatttaatgcggccaagatctttagccaccctgatgttgttgctgaggagcctcggtatggtattgagcacgagtacactcttc

SEQ ID NO: 10373 - DNA, 548 bp, Gossypium hirsutum
  Clone ID: uC-gsflmaxxa046e05b1
gggattttcgagaggcattggggtatcttcaattacgatggaagtatcaaatatccgttggatttgggaaaaggcaaagcactcacccaagccaaaggcgtcaagtacttggccaggcaatggtgcgtgttatcgccttcagcgggcgtttcggaccccaacgcgttggctcaaagcattagccaagcttgccagtacgccgattgcacaagcattggccccggatcctcgtgttctaatctagacccccaacgcaacgcttcatatgcgttcaatatgtattatcaaaccatggatcaaaggaaagatgcatgttcgtttaataacttatcaacggttacaaccgtggatccatctcagccaccttgtcgtttcgagatcatgatcgacatcgggaaacacgaactctctgtgtctaacaaagttccagcagccggatttggaagcctgctacttgtatctctgatgctggtattgggtttggctaatggtgtccactgattggagtccatcctttgcctttgatgcagagtcaagcaggcaaatga

SEQ ID NO: 10374 - DNA, 484 bp, Gossypium hirsutum
  Clone ID: uC-gsflmaxxa046e06b1
gcttgtaaggctcttgatgatcttttaacacaatttatatcgacccaacgccacaaatccaccaaatcagtggcatcctcaggctcaaatgaagagcatgatttcaatttcttgaactgttacctgacaggacatgagataacaggcccaacaccgaaagaaagtcttataagagacaaccttatacattttctgtttgccagtgatggtacttacagtttaactcttacttggttcttctatctcatctccaaggcacccgtggttgaaaacaagatcagagaagaaataaagagacacttatcaatgaaacaagtggagggaagcttgcaaataccatccaactacgacgagttgagtaagctaacatatcttcatgcagcgttgtgcgaaaccctaaagctatatccaccgattccgttcgatttcagaacatgtacaaagcaagaatatcttccgagcggtcattgagtcgatcaaaaca

SEQ ID NO: 10375 - DNA, 416 bp, Gossypium hirsutum
  Clone ID: uC-gsflmaxxa046e07b1
cccacgcgtccgggaaaaagagaaacaaagaagagaaagaatggcttggatatggttggaagcagcacttcccctcggaatcatagctggaatgctctgcgttatgggcaatgctcagtatttcatccacaaagcttatcacggccggcccaagcacatcgggaacgatatgtgggacgtcgccatggaaagaagggataagaagctcttcgagaacctctcttcctccgattgatccctttttagttttcttctggaaacttggtcgatgttgtgagagaagaaataaaaagtgctctatgatattctgtaatgctgaagaagactaaagagcagatgaactcgagtattttctttttcatggtaatgttaagcatgaacttctgaaatgttgcacttttgacacactttctaat

SEQ ID NO: 10376 - DNA, 475 bp, Gossypium hirsutum
  Clone ID: uC-gsflmaxxa046e08b1
caagacctagaatttgaatctgaagaacatgatagaaatgatgaggaagatgaagaagatgatgatggtggttatgggagtgagaacggggaagagggaagtcctaaaaatttggattcggaggttgtcgccgaaaataccgaggttaagaatgtgaagttacccaatctaacggttaaggaaaagaaagagctggcttcttacgctcatggtttagggaagaccttgcagtgtcaactggtgggcaaatctggtgttactgataatgtcattttctcttttcttgagactcttgaagccaatgagcttctgaagatcaaaattcaccggacctgtcctggagagctagaggatgtggtcagcatgagaaagaaagcagttggctttgaacaaaaggacctaacacaacctgatataaccagtacatggagagccatggaggcactttacgactcccgaaaggctagagctattg

SEQ ID NO: 10377 - DNA, 455 bp, Gossypium hirsutum
  Clone ID: uC-gsflmaxxa046e09b1
cgcaaacagaacttaaagacggtggagatgaatttcccactttccgataaaaacatttgtcactcacgttgtcgttcactgtaactatcataacctgggaaatcgacagttctttcatacttttcaatcttgtcctacgcctagaaatttccccagcccacctttgatctctcatgtctttattaccttcgggattcctttttctttgcttaatactcaagcttctgtaaaatcacagggtggtgttgtttgagcttttgaaattgtaatggtttcttgtacaattccttcatggaccttaattggtcttgtaagatcttttcttgaacttacactagcttatttccttttatgtggatcaaccttgggtttttttgcttggaaattttttcatgtttttggtattcatctgccatgtccttgatctggggtttttggttacccaaataccaacc

SEQ ID NO: 10378 - DNA, 489 bp, Gossypium hirsutum
  Clone ID: uC-gsflmaxxa046e10b1
cggtcgcgtgggcaaagagagaggaagcagcccccttgattgaagctgcttttcaacggcgattggtagaagagaaggtgcttcatgaacgtgagcaacagctggaagttgagttgagcagacagcgccatgatggggacttgaaagagaagaataggctggcacgtatgttagaaaacaagatgattttccaggagagtgtaataagtcgtcggcaagctgagtttgaccaacggagagtggagagagaggagaggatcaaacaaataattcaggctcggaagcaggaaagagatattaagagaaagaaaatattttatgtgaggtctgaggaggagagaataaagaagatgcgcaaagaggaggaggcttgtaaacgtgaagaggctgagagactaaggaaagaagaagctgaacacaaagctaaaatggatgagattgctgaacagcaaaggcaaagagagcgagaattgcaagagaaagagaggc

SEQ ID NO: 10379 - DNA, 510 bp, Gossypium hirsutum
  unsure (1)..(510): unsure at all n locations
  Clone ID: uC-gsflmaxxa046e11b1
gatgaatgcagccttggccctgccaaaggtttggatgagtctgaggtgatgaaactagtatcagctggtgaattatcattaagtagtttacaatcaccttccttgaacgattccatcttcatgagaaccatggaactgtctggtatattgagcaaagcagataataatcggacaatgctccaaaaagagggtgctctgctataggttttgatatgaaactaatctaagagttttgttatggaagtggataaaaatggatccaccctccaattttgatattggaagatctcaatttccccatttttatacatcattatcattattagctgggttattcataagcaggcttctgggtgttttttttaattgaatcctgcaaatgctacaatgattgctatngatgtgtcctgtattttctgtttcaatgtgtacatgataataaattatatgtattaaatgtaatcatattgaattgacgtgttcgatagtttaatccgcggggttgaggcc

SEQ ID NO: 10380 - DNA, 520 bp, Gossypium hirsutum
  Clone ID: uC-gsflmaxxa046e12b1
aaaaaaaaaggaaaaaaaagtttctcttctttgctttctttcaagtaaaaatcaaacgaaaaacaacttaaataatattaaaagatattgattttgatcatcaaattttctgtttctgatccaccaatccaatcagagtgttgaagtattgaagctgtctgtgttctgtttgttttttgaaatctgatgtctccgccgcttcttggcgtggaggaagggggtcagaacaatgtgactttactgggttcttctggctctatggatagtgtgtgccagaataatgctgaattgaaggaacgcaattacatgggcttgtctgattgttcttctattgatagctctgttgtcacccctggttctgacgatggcaacgtaagtacgaatctgaaggcaacagagctcaggcttgggctttctggatcacagtctcctgaaagaaatcctgagctttgcttgttaagctctgctcaacttgatgagaaaccccttttccctttgcatccttcaagtgatggtcact

SEQ ID NO: 10381 - DNA, 387 bp, Gossypium hirsutum
  Clone ID: uC-gsflmaxxa046f03b1
atttgttgcaaaggatgcttgtttttgacccatctaagagaattaccgtcacagaagctctcctacacccatacatgtcagggctatatgatccgaggtgcaatccacctgcccaagtcccgattgatctcgacatagacgagaacatgagagaagagatgattagggagatgatgtgggctgagatgcttcattaccacccagaggctgcatctgcaaatgcttagatgacattgttttaagctatgctgggttctgttactttgttataatgtttgtttcgcaaccagtattattatttaacctagaagaacaccattgaaacttctgcatgccatggaactttgcattgagatttttagttttgattggctcgtgttaacctgt

SEQ ID NO: 10382 - DNA, 509 bp, Gossypium hirsutum
  Clone ID: uC-gsflmaxxa046f04b1
tgatgttcattgttgattgcaaattgtatttctctaactggttcatgttcattgcttcatttagcccagagggtaactcaacttttcatctgaagcattgcggttttctttaatcagaaatttatcagctctgtcaagactttgtataaggcgtgtgttcattaaattggttttttgacaggctggatactattgctcagtttgcgagtgtgttgtgaaagattctgcaaactacttggatcacatcaatgggaagaaacatcaaagagctttaggcatgtccatgcgagtagaacgggcatcccttaaacaggttcaagagcgatttgagcaattaaaaaagcgaaagcctcctggaagcttcacagagcaagatcttgatgaacggatcatcaaacagcaggaagaagaggaagagcgaaagcgccaacgacgagaaagaaagaaagagaaaaagaaagagaaggccgcagaagaggaacctgaaattgatcctgatgtggcagcta

SEQ ID NO: 10383 - DNA, 514 bp, Gossypium hirsutum
  Clone ID: uC-gsflmaxxa046f06b1
cccacgtgtccgcagagttttgtttctctttagtttacgttttttttgtccttttggattttttgatactaaaaaagggaagcaaagaagaagggaaatggagggcaaagaagaggatgttagattgggagccaacaagttcacagagaggcaaccaattgggaccgcggctcagactcaagatgacgggaaagactattctgaaccaccaccggctccatttttcgagcctggcgagttaacctcatggtccttttatagggctgggattgccgagtttgtggcgactttccttttcttgtatatcactattttgactgttatgggagttgttaaggaaaaaactaagtgcccaactgttgggattcaaggaattgcttgggcttttggtggtatgatctttgctcttgtttactgcactgctggcatttcaagtggccatatcaacccggcagtgacttttggactgttctaggcgaggaagcttgtcgtgacgagggcaattttctacatg

SEQ ID NO: 10384 - DNA, 453 bp, Gossypium hirsutum
  unsure (1)..(453): unsure at all n locations
  Clone ID: uC-gsflmaxxa046f07b1
ctcagtcctgaggttactgatgcaatgctgtttgcgtgcttttctgtctatcctagttgttcggatgcgagggtaatgtgggatcagaaaactgggcgttcaagaggatttgggtttgtttcatttcgcaaccagcaggatgcacaaagtgcaattaacgacttaactggaaaatggcttggcagtcgacaaattcgttgtaactgggcgacaaagggtgtcagtagcagtgatgacaagcagagctctgatgccaaaagcgtggtagaactaaccaatggctcatcagaggacggtaaagagacgaccaataatgaggctcctgagagtaatcctcaatatactacggtttatgtcggcagtcttgctccagaggtcactcaagtagaactccactatcacttccatgctcttggnngctgggtgattgaggaggtccgtgttcagcgtgat

SEQ ID NO: 10385 - DNA, 492 bp, Gossypium hirsutum
  unsure (1)..(492): unsure at all n locations
  Clone ID: uC-gsflmaxxa046f09b1
aaatgaggaaaaatcctctgaacgagagcctggggtgagttctcggagtgccatcgtgcctccgtccaatgggctgcacgcgcttacgcgccactgtcaatgccgtcacatatggcggccggaagccaaaaaacctcatcgtttaccccgcatcaaaaggtattccattttttatctatttttaatatttttatatgtataaaatgcaaatattttgaaaaagaaaaataaaaaacaaatcacctttgctttctttgtgaaatctttctgatgtcttattgcaaaaaaatatttggtgtacaatcatccttttctgtgtgtgtgtatctctttatagatcaaagaaaaaggctttataacctcagtctattacatattttggaaagaaatccttgatttctttccatatttgtttaatctgtatattgggttctttctttccatatttgntctttgactggcgcgatttctttcctttgtttgaaggtgagc

SEQ ID NO: 10386 - DNA, 539 bp, Gossypium hirsutum
  Clone ID: uC-gsflmaxxa046f10b1
gcgatgttgaatctatggcgtcctccaagttacaggctctgtggaaccaccctgccggacccaaaaccattcacttttgggcaccaacttttaaatggggcattagcatagcgaatgtggctgactttgctaaaccaccggaaaaactttcctaccctcagcaaatagcggttactgcaactggaattatctggtcacgctacagcactgtaatcactccgaaaaattggaatctcttcagtgtaaacattgctatggctggaacaggcatataccaactaacacgaaaaataaaacatgattacttttcggaggcagagccagccgttgcatctgaatgatgacgaaatcttctgaaatcctttgtttttaatggaacaaattatcagttatcttgccttgtttttctgttaattaaaagttacactttggccctatggctttgaattattcaagcatgttgtgctgtggaaaacatggaacttgatgatgatgatggtagagccatcaactgatacttgactgagcaacagaatccc

SEQ ID NO: 10387 - DNA, 272 bp, Gossypium hirsutum
  Clone ID: uC-gsflmaxxa046g01b1
cttaattttggtgttttgttgaatgaaactgtgatggctggctggactattgttggatgcaaaaggaaattggaaggtaaagttgctggaatgacataggagaagagctatggagctcggttaccagccggagcttggtttttcttatcatatgtaaaaccggattctaattccagtatgttgatttttaattcttgtaggtaacgaaatatcatttcgtatcgtaactgttttcagcttctgttgtggttggggtagtacccttccaagtc

SEQ ID NO: 10388 - DNA, 419 bp, Gossypium hirsutum
  Clone ID: uC-gsflmaxxa046g03b1
gagtgtgagaatggggttgaccggtgacagctcaatgggacactacgctgattggggaagcaacaaatacaaaggaagccagaatgggtatgcagtggcttacaccgaaagtgaatgttataaccaaatccacaagcccacccatgggatgatcaaaccccagaaagcttatgggatggctgaaacctgggatgaggagcatgctcaatcttacgccacctacaagtcccaaactggacctccaatgttcaaaactcaagttcatggtccttcttggaatggcttcggcttccactccaatactgcaactgcccacatgcaatcctatggctttagtagccccggaagaaacgaaggtcgtgtttatggctatgagggccccaccccagccgctagacaccggaaaagtaatggcggaa

SEQ ID NO: 10389 - DNA, 532 bp, Gossypium hirsutum
  Clone ID: uC-gsflmaxxa046g04b1
gcttgtaaggctcttgatgatcttttaacacaatttatatcgacccaacgccacaaatccaccaaatcagtggcatcctcaggctcaaatgaagagcatgatttcaatttcttgaactgttacctgacaggacatgagataacaggcccaacaccgaaagaaagtcttataagagacaaccttatacattttctgtttgccagtgatggtacttacagtttaactcttacttggttcttctatctcatctccaaggcacccgtggttgaaaacaagatcagagaagaaataaagagacacttatcaatgaaacaagtggagggaagcttgcaaataccatccaactacgacgagttgagtaagctaacatatcttcatgcagcgttgtgcgaaaccctaaggctatatccaccgattccgttcgatttcagaacatgtacaaagcaggaatatcttccgagcggtcatcgagtcgatcaaaacacccgaatcataattggaatacatgcaatgggacggatggaagcttatg

SEQ ID NO: 10390 - DNA, 547 bp, Gossypium hirsutum
  Clone ID: uC-gsflmaxxa046g05b1
cggacgcgtgggctaataaatccccaaatcacagcaaaaataagatagaaaaattcatttgtagttctattccacttccaattcatttaattttcatctaaagaaaatgcctttttgttcgcttttctccttcatttacttcgtcgatcattgtttcagaattcgttttctctttgaaaagcgaaagttttaattatttaaaattcgtatcacgtttatttcactttgtatgatttgtatacagaaaaaaaatggaatcaagcttgcttcaatgggaatccgaccccttattctcagccgccgaagtcgttcaagattcagctgacaggatggaatcgttttttcgacttcttttgcacgaaaaaactcttcttcaaagtgatcttcctgacccaaagctgcttacttcaattggatatcatacgcgtgatctcgcaaccgtactcgagacagcgaaatggcagttggaagattttgaaagagcagttaactcatcggctaggatggaccagtctcactctagggagcatgtatttctagacataag

SEQ ID NO: 10391 - DNA, 513 bp, Gossypium hirsutum
  Clone ID: uC-gsflmaxxa046g06b1
cttaacaataaaaaatcaaaatcagattactaaaaggggaaaaaaagaaattttctcatcagccaaacagagcccagaaagtaaaaacaaaaaaaaaaccataaaaactcaacctttgagtgttaattagctttttttgtttttgaatcggttcatgtgaacatcgttggtactttcacaatgagtttctccagaatcggccgctctctctcccgctcttctcgctctaatttccgaacaaatgttatatcgaggaaactgttacgaaatgaatcgaatgtaccaagtcctgtaacaaatacgtgcatttcacgcattaataaagggttagggcttgtaaagggttatttcgcaccggctggagttgggaagcagcttagtactaatacaccgttgtcgaatttggattctattcttgcaaaccctaggatcaggcggttcttttgcagtgaagggcctaagaaaagaaattatgaaaattactttcccaaagtacattggttgaacaagaaa

SEQ ID NO: 10392 - DNA, 378 bp, Gossypium hirsutum
  Clone ID: uC-gsflmaxxa046g07b1
cccacgcgtccgcccacgcgtccgcccacgcgtacgtccacgcgtccgaagtctcactctttttttcttaaaactttgaatctttcatatattttaccttatatagcttcaagcaacaaaaatggctgatgaagcgctagtgaagaacaagcaagtggttctcaagaactatgtgaatgccgggttgcccaaggaatcagatatgggaattaaagaaaaaagcatccaattgaaagttccagaagggactaaagatgcaattttagtgaaaaatctctacttatcttgcgatccttacatgagaaatcgtatgaagaagctcgaagattcgtatgtgccgacttttgagcccggatcgtctatatccggctatggagt

SEQ ID NO: 10393 - DNA, 517 bp, Gossypium hirsutum
  unsure (1)..(517): unsure at all n locations
  Clone ID: uC-gsflmaxxa046g08b1
gcgaaacgggttcaggaaagcatgtaccgagagctgtctttgttgatctggaacccactgttatcgatgaagtgcggactggcccttatcgccaacttttccaccctgagcagcttatttctggcaaggaagatgctgctaataactttgccagaggccactatacaattggaaaggaaattgttgatctctgccttgatcgagttaggaagttagctgataactgcactggtctgcaaggctttatggtgtttaatgctgtcggcggtggaactggttctggtttgggatctttgttgttggagcgcttgtcggtagattatggaaagaagtcaaagcttgggttcaccatctatccttcgcctcaggtctcaactgcagttgtggagccttacaatagcgttctgtccactcattcgcttcttggacacacagatgtggctgtgctcttggacaatgaagcaatttatgacatatgtcngagatccctcgatatcgagagacaacttacaccaat

SEQ ID NO: 10394 - DNA, 394 bp, Gossypium hirsutum
  Clone ID: uC-gsflmaxxa046g10b1
gtttattgtaacaatgaattttgtgctgctgcacatgacggtaaactcaaagattgtgagcctgatcttcaatgtgaatactatgttacttacggtgacgggacctcaaatggtggatactttgtaaaagataccatagaacttcagcaagtgactggtaaccttcaaacttcacccacaaacgggagtatagtattcgggtgcgggtctaaacgagctggtcagacaactacatcaagtgaatcagttgatggaatcattggatttggacaagcaaattcatccatgatttcacaactagctcaaaacggagtagtgaaaaataaattcgcacattttttggataatgtggacggaggtggaatctttgcaattggtgaagtggtaggacctc

SEQ ID NO: 10395 - DNA, 462 bp, Gossypium hirsutum
  Clone ID: uC-gsflmaxxa046g12b1
atccttgctaattattgaagaagattaagaaattctgtcttcgtttgatctattggagtaatcaatttggtaaatcccccaagctttaagggagttgttttgggggcaataaatattgaatttgaaaaaaatcgagtgaaaacagcttagattaagctcttttgggggcatttggtattgttgaagagatagagagtagcttttgttttcttggcttgagatggatcgtgtaattggtggtaagttcaagcttggaagaaagattgggagtggatcttttggagagctttatttaggggtaaatgtgcaaactggagaggaagttgctgtcaaactggaatctgtgaagaccaagcatccacagcttcattatgagtcaaaattgtatatgcttcttcaaggaggaactggtattcctcaccttaagtggtttggagttgaggcggattacaacgtcatggt

SEQ ID NO: 10396 - DNA, 517 bp, Gossypium hirsutum
  Clone ID: uC-gsflmaxxa046h04b1
cccacgcgtccgaaaagaggttatagaatctttgttacttaaacggtgccctcatctttcagaaatccaaagtattgtacttactgaaatagaaagcactggttacttagtattggcaagtgtggatgcttatggtcatcttattgtctctaaactggatgccagtggtaaagatgctgacaagattacttattcagtgttacctcgggattttggtgttggagaaggtagttggtctgggatgtgcttcagtccaactcaatggtccatggcagctgtggcacgaagcttctgcaaaagtgttgatgtttatgaccaggatatccatcttcggactttgcgtacactttggtatccatcttcgctaagcttcatgcggaatttaggtcatgggaatgagagttctatattagccgtaactgaaggctgccagttgtctgtatgggacttgagaataaaagaaaatggtggatgtctaaatcgtatttgtggttctgctggagatatctattatgct

SEQ ID NO: 10397 - DNA, 504 bp, Gossypium hirsutum
  Clone ID: uC-gsflmaxxa046h05b1
cccattcgtccgaaagtcccctaaaggtcccatcactttgcctccccttgtgaaacctccaatcaagttgccaccggttgttcctccaatagttaagccacccattgacctccctccggttacagtccctccaattaacctccctccagggacggttcctccagtaactaagccaccaagtgggaaaccctgcccaacaccaccaaccaaggacacttgccccattgacacactgaaattgggtgcttgtgtggatctgctgggagggttggtgcacattggactaggtgacccggttttgaatcaatgttgtccggttctttcaggacttgccgagctcgaagctgcggtctgcttgtgcaccaccctcaaacttaaggttctcaaccttaaaatttatgtgccactggctcttcaactccttgtcacatgtgggaaaacaccccctcctggttacacttgctctctctaaaccaaggttgctaggctgatggaatggacatg

SEQ ID NO: 10398 - DNA, 467 bp, Gossypium hirsutum
  Clone ID: uC-gsflmaxxa046h06b1
gttccaacaatcttcgtctctttctctcgcttgccgtttttctctcttaggttttgattcttctttgtagttcgaggtgttttaaagacaagtcaagatggtgaagtttacagctgaggagcttcgtgccattatggacaggaagcacaacatccgtaatatgtctgttattgctcatgtggaccacgggaaatcaactcttaccgattctcttgtggctgctgctggaattattgcacaagaagttgctggtgatgttcgtatgacagatacccgtgctgatgaggctgagcgtggtatcacaatcaagtctactggtatctctctttattatgaaatgtctgatgactctttgaagagctacaaaggagagagaacagggaatgagtacctcatcaatcttatcgattcccctgggcacgttgacttttcatccgaggtcacagctgctctacgtattactgatg

SEQ ID NO: 10399 - DNA, 460 bp, Gossypium hirsutum
  Clone ID: uC-gsflmaxxa046h08b1
aaaactttcctgggtttggctcttgatccaacccataagtctctaggtttcaaagatatggctggaaaggagttcactgttaatctgaacaaaccccttgtcttccaggttggtcaccttggagaaagcttaccaggaatgggttcatacgcctattgtgacagatgaaagtcctcgctttttcaagagtgatttcatggagatcctgactcggacagtgtggtgggtagtaccattgatatgggtgccggttgcaatgtggttcatctcactctcttacacaatgggtcatacacttccccaagttgttttaatgtctgttgttggaagtttcatttggacattcttggaatactgtttccaccgtttccttttccacattgaaacagagagttactgggcaaacacttttcactatctaatccatggctgccaccataagcaccctatggatgggcta

SEQ ID NO: 10400 - DNA, 335 bp, Gossypium hirsutum
  Clone ID: uC-gsflmaxxa046h09b1
cccactcgtccgcccacgcgtccgtgagagacaagttagggaactcacttcaatctgctttgtcactacttcctaagaatgaaagcaatggataaagaaaagcctgctttgagcggcttttaagggaaaaatcatggagatttgcggagtcattgtggaaactagcaaaagaccatgaaaagtaatggatatttgtaattttggataatgtacacaaaattttaggggggtcgtcgacccaaagtacctgagaggacaagttttcgtatacttgtaatcgtcatggattggacgaaggatctaatttatgtgatttattgaatccttttttttat

SEQ ID NO: 10401 - DNA, 508 bp, Gossypium hirsutum
  Clone ID: uC-gsflmaxxa046h10b1
cgaggcctgaagaaaagtcctggatgtagttggattgaggtggggaacgggattcatactttcatggcaagagacaagtgtcatccagagtgtcatcatataaccaagaaattggatcaaatcacggaaaagctggagaaggaaggaggttatatagctcaaacaaagtttgttttgcacaatgtggaggaaaatgagaaagttaagatgctatatgggcacagtgaaagattagccattgcatatggtctgctcaagactgctgagcaaacccccattcgggttacaaagaatctacgtgtctgtggtgattgccatactttctgtaagttagtctctaaactctttggacgggaactacttgtgagggatgccaatagatttcaccattttgaggatggggcttgttcttgtggggatttctggtgaatgttacatccaattatttgaattggacttttcgacattcttcttgctgaaggtattggaatcattcttcagtgatcag

SEQ ID NO: 10402 - DNA, 422 bp, Gossypium hirsutum
  Clone ID: uC-gsflmaxxa046h11b1
cggtttcgtgggtaaaattaccattgtacaaattatgactcaactgtgactaacgcgagtgaatatctacttctcgatcttattttggggatcgcttgcgaggtggcttggaggcacacattcaagtgtagcataatgaaacgaatgcctgattagcatagctttggaggcatatattcaagttttccggacgcataaggatgcctatttctttgtgtggatttccagactagaatgctcttcattatctgaactttggaaactaattgctactaatggaggaagaagcagtttttatgggaaccttaacagaggagattatggagaatgtcaatagttcaaagcctgaattgaagcgtgctataattaggtactagcattcttgatagagccagagtgaagtcatgaaacgtaagggaact

SEQ ID NO: 10403 - DNA, 585 bp, Gossypium hirsutum
  Clone ID: uC-gsflmaxxa047a01b1
gtagtaatgtcaaccctttgtacatttcttttctcagttctactctttgcctcacagccccttatcctccccactgctgccgacggccggtggcagctgctacaaaaaagcattggcatctcatccatgcacatgcaactccttaaaaatgaccgtgttgttatgtatgataggactgatttcggcccatccactctgccattggcaagtgggaaatgccacaatgacccaaccaacaccgctgtccaagtagattgtacggcgcattcagttgagtacgatgttttgagcaacaagttcagggctcttactgtccgaagctgttacgacgaggggaaacgtacagccgaaaccctgacaatggactatcacagaggagctggagttgaggttaggattgcccggattttcaatacttacggacctcgtatgtgcatcgatgacggtcgtgttgttagcaactttgttgcttaggcattaaggaaagagcctttgactgtgtatggtgatgggaaacagaccaggaagttccaaatatgttctgatctgggtgaggggctaatgcgattgatggaaggagacatg

SEQ ID NO: 10404 - DNA, 490 bp, Gossypium hirsutum
  Clone ID: uC-gsflmaxxa047a02b1
gttgtgtttttactctcaccttctcccactcctcgtgaaaccctagttctcagacgccactaaaaccttagtcctctcactcgtctttcatcatcctcatcaatggagttctggggtattgaagttaaagctggacagcctattaaaacggaccctggtgccagtcatgtcatccatctttcccaggcaacacttggtgagtcaaagaacaaagcagagtcggttcctctctatgtgaatgttaatgggaagaaactcgttctcggaacactttcccaccagaattgcccgcaattgtgttttgatttagtatttgagcaaggctttgagctctctcacaactggaaaaatgggagcgtctatttccttggttacagaacttttgtcccagaggaaggctctgatgatgaatttgatagtgaggaagaaagtagcgaggatgaggaactttctgtggctgctgaaaacggaaagcttagacagatgcaaa

SEQ ID NO: 10405 - DNA, 389 bp, Gossypium hirsutum
  Clone ID: uC-gsflmaxxa047a05b1
gcgcccatttgttcgtccacacgtccgcccacgcgtgcgtgtgatgcttttagtcataacatggcaatgtgatactgaagagttgtaggtgattccatcgctcggcacttacggtacatactcgggaaatgtataaaggtaaaccttaaggcatactaattggtgagttacttaacattgtgcgcgctttacttgtattctataaagactgcaacaatgcacactgaattgctcttctcttctcaactcatgagttcttttttagtttgcatttgagatgaacccttttggtacctacaaagaactgagaatggctgaatttagtgaacaacatgagtattcgcaattactcataaaataaaagtcatgaatattgataagcttatttt

SEQ ID NO: 10406 - DNA, 484 bp, Gossypium hirsutum
  Clone ID: uC-gsflmaxxa047a06b1
ggagtgccttttttgtgtagcgattctcagttagtcttttctttaagcttacagcttctctccagagttttataatgggtaaggagaaggttcacatcaaccttgttgtcattggccatgtcgactctggcaagtcgaccactaccggtcatttgatctacaagcttggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgctattgatgcacctggacaccgtgactttatcaagaacatgattaccggtacctcacaggctgactgagctgttctcattattgactcgaccactggtggttatgaagctggtatctctaaagatggtcagactcgtgagcatgc

SEQ ID NO: 10407 - DNA, 465 bp, Gossypium hirsutum
  Clone ID: uC-gsflmaxxa047a07b1
aagttctggctccggttccacctcccgtggctactaaaatggcttcacacattgttggatatccccgcatgggacctaagagagagcttaagtttgctctggaatctttctgggataagaagagcagtgccgaggatttgcagaaggttgcagctggtctcaggtcatccatctggaaacagatggctgatgctgggatcaagtacattcccagcaatactttctcttattatgatcaagtgctcgataccacagcaatgctcggcgctgtaccacctagatatggctggaatggtggtgagatcggatttgacacttacttctgcatggccagaggaaacgccttcttgcctggcatggaaatgaccaagtggtttgacaccaactaccacttcattgtttccgaattgggacctgatgttagattcttttatgcatctcacaaggcaggtggatgagtacaag

SEQ ID NO: 10408 - DNA, 364 bp, Gossypium hirsutum
  Clone ID: uC-gsflmaxxa047a08b1
cttgttttttattgtatcgaattgttttctttttgatggtggttttctttcttttgggtgggattagattctagagtctttaatcctttcacaaaatagaaacataacatgttgaaaataaaagttgcctaagcatagattgaagtttgtacattatattgagtaggttgaaggttttgctgcaggagtgcagtgcccgtggcaaagaccagtttttcttagttgtctcccctccaaacagcagtgttaattccttttaccttataattttgtaggtatgttcattcttctcattgtcttcctttttctaaaagaacaattcttgagagctacatatctttaatggatgcattttctatttgat

SEQ ID NO: 10409 - DNA, 422 bp, Gossypium hirsutum
  Clone ID: uC-gsflmaxxa047a09b1
ctaacaagccgctgtcgctgccggtgccgctgcctgtgcctctgcctccacaccttccagcgtcttacgtcatatatctattcaatccatagctccccatttcttcgccgattctctctcactctcactctcggactcttttcaaaattttcctgtcattcttttttagctttgggtaaccacaggccaaaaaacacacacgctataataggaagagagttttcgtgagagagaaaccctaagtttttctgccgtttctggtttttgtgatttttgaaatccgttgcttcatcggagactcatttcagataggacttccagaggactggaataagcactttagtcgctgtgggagaccgagatattaatgcaacttggttctgcaacaggtgtctataaaagccttgtaaagttcttggttt

SEQ ID NO: 10410 - DNA, 301 bp, Gossypium hirsutum
  Clone ID: uC-gsflmaxxa047a11b1
caaaacttggtccagagttcaacaatagttgctcctgggtatgttcctagtgaacttgacgagagaattttgttagaactcccttcatccatggttcggccactgagggttatacgaggaacctttcaagtaacctcaaagaaaataaattttgtagttgataaaactgaatgcaacatatcgatggatggttcagaagacaactctgaagcaaaaaatgatgaaaaagaccgtagttggttgatgacttctcttcaataaatgtatagccgaagatatctcctaagaagaagtgcttttg

SEQ ID NO: 10411 - DNA, 457 bp, Gossypium hirsutum
  Clone ID: uC-gsflmaxxa047a12b1
tttacgcgtccgatcggaacatttccaattaggtgagctctctcttccattctttaagcaatccgcggctaaactatgtgctaggatattagcagatctggatggtttcccaaaagcaaggcctgaaagtaagcatatccttccgctataaatggcgaagcgatctccttgtgcagtgtctgttttgaagccaaaatctcacttggagagttacgaacaaccactccagatctagatctcaccaaattttgattacaagcggcatcaaaattaactttaacatcagaacctaatgggggacaccattcctcattaacaatagatctggacaagatttctatttgtccagattcctcatatggcacaataaaataatttgtactggtcattggaactcattcgaaaaacccagggctttgctgctccaccacacttgtgacacaggacatctcttcta

SEQ ID NO: 10412 - DNA, 534 bp, Gossypium hirsutum
  Clone ID: uC-gsflmaxxa047b01b1
gtttataaacagcttccttctcattgtaaaagacgatgcagatgtgagaggaaaacccaagtgctttgaaaccagtcatggagattcagagaaccttctccagtacaaagcaaactatgacagtctttgattcgtctgcatccagctcctccaatccctttccacaaaccgcattactgaagccggaactccatcaaccccaaacccagatctttggcttctttgcccttccgctgccatggtatgggctgcatcatttatagaacgaagaataaaaagctttttgataactgtcaaagaatccccttctacgaccaggcaccagaaacccatcattcgcgtgaacagtaacgacttttcacatgcccgtgcttcagcaatgaatgcatcgaacgcatcagcaacatcctctatcagataagtttcggctcctctaatttcacctctagaatctctcgctaaaactgctattatagaagttctagaatcttttttgaaggagccgtaaaatttaatcttgatgaaacccaaaac

SEQ ID NO: 10413 - DNA, 472 bp, Gossypium hirsutum
  Clone ID: uC-gsflmaxxa047b02b1
ttgtaaacctaaagattctctctcccaaaccaaaccttcaaatttcagcaagagagagagagagaacttacatagctcagacttcgatcatcaatttagggtttcttaattcgattccccgattacccgataccccaattttacagatcaggtctgagtgttctagttgttcggctgtttctatccgctaagtttcatgtctgatcttgacatccagattcctactgcctttgatccgtttgctgatgcaaatgctgaagacgctggtgctggtgccaaggaatacgttcacattcgtattcagcagcggaacggtaggaaaagcctgaccactgttcagggattgaagaaagaatttagctataacaaaattctcaaggacctgaagaaagaattttgttgcaatggcaccgttgtccaggacccagaattaggaaaggttattcaactttaaggagatcagaggaagaac

SEQ ID NO: 10414 - DNA, 579 bp, Gossypium hirsutum
  unsure (1)..(579): unsure at all n locations
  Clone ID: uC-gsflmaxxa047b03b1
ttgagttttgttttctatctcaagaaccttttgagttagagaacaaaactcagtgttgtctttaattgaaaccatttattatttgtaataattgtaagaaaaatggcatccaatgggacaacagagaaaaaggctggcaaatatgcatccttcttctccggcacacaagacaaatgtggagtttgcaagaaaactgcatacccattagagaaggtgacaatggaaggagaaatctaccataaaaactgctttaggtgttcacatggtggttttgtgcttacaacatcttcatttgctgcattagatggtatcctctattgtaagattcactttgctcaattgttcaaagagaaaggtagctatgcacatgttaccaaggcaactgccatgaagaaaacctcatcagaagccaagacagaagatgatccaacaccagaggctgaagctgaagctgaataagatgattcttacaatagggatttngaataggttgtttctttttactgggtaagctacattccatacttttttttttttattatcaccattcattagtatgactaattgaagtaatgaagg

SEQ ID NO: 10415 - DNA, 540 bp, Gossypium hirsutum
  unsure (1)..(540): unsure at all n locations
  Clone ID: uC-gsflmaxxa047b04b1
atcttcttccattcctctcccaatccaaaccatgagagagatccttcacgttcaaggtggccaatgcgggaaccaaatcggttccaagttttgggaagtgatttgcgacgagcacggcgtcgatcccaccggaagttacactggagatgaatcttcgtcctctgatctacaattggaacggatcaatgtgtattacaatgaggcttctggtggaaggtacgttcctcgtgctgttctcatggaccttgaacctggtactatggatagtatcagatccggtccctatggacagatctttaggcccgataatttcgtgtttggacaatccggtgcgggtaacaactgggctaaaggtcattataccgaaagagctgagttgattgattctgttcttgatgttgttccgaaagaggctgagaattgtgattgcttgcaaggctttcaggtatgccattcacttggaggaggtacaggctcaggcatgggaactcttctaatatcgaaaattcgagaggaatatncagataggatgatgatgac

SEQ ID NO: 10416 - DNA, 606 bp, Gossypium hirsutum
  unsure (1)..(606): unsure at all n locations
  Clone ID: uC-gsflmaxxa047b05b1
gtgtttttgttaattactctctcaaggtgaagcctgctttagcacaacaactacagctgcggtaaaattgatgtcaaactggaacatattctgctcctggtatacgtgagcatcgatttgtggatgccatgaaggacagttatatggtatggatgatattttcaatggttactcttggtctatataagaatagctttttattgattcataccaacaaccagtttgaacttgttgacccttggcttcattgcagctaaatatgcagagatgtgtttcctccccatgacaaaaatctttgctatagtggatatttgtacagcctttaatgaagttgaatattatcctgctaacaggacttgtaataattagctgatgagcttgcaagatgtgagcatgatattgtcaattttagagtttagctagagttctttcctagtgctatatataatctgaatatttattagtaatgaaagtgctttttatatataatgagtttgtatttttgtgcaatgcactacctgagtgtgttttattgaattnnnttattaaaaatangttaaaaattacaacttacatcatatactattataaattattataaattaa

SEQ ID NO: 10417 - DNA, 163 bp, Gossypium hirsutum
  Clone ID: uC-gsflmaxxa047b06b1
ggtggttactatggtcgtggccgagcaggacatggcaggggtggagaaccttttccagtggggtttttagttcctatgcgatgatgagctttgaagctctttataactgtgatagaattaggaactctttaggaaatataaggaagcataattactcgtaatg

SEQ ID NO: 10418 - DNA, 451 bp, Gossypium hirsutum
  Clone ID: uC-gsflmaxxa047b08b1
ggattgttcttaacagcctcggcaatgtttcgaggcaaaatgagcaccaaggaagttgatgaacaaatgatcaatgtccaaaacaagaactcttcgtactttgtggagtggattccgaacaatgttaaatcaagtgtttgcgacatcccaccaactgggttgacgatgtcatcgacgtttatggggaactcgacatcgatacaagagatgtttcgacgtgtttcggaacagttcacagtgatgtttaggaggaaagcatttttgcattggtatacaggggaagggatggatgaaatggagtttactgaggctgaaagtaatatgaatgatttggtttctgaatatcaacaatatcaagatgctttggttgatgaagatggtgaagggtatgaagattaaactgaggaaaattgaccgaattctttttaactttttatagtaatggcctagg

SEQ ID NO: 10419 - DNA, 498 bp, Gossypium hirsutum
  Clone ID: uC-gsflmaxxa047b10b1
gtttaagtggtaaaaaagcaggttcatcaacacggggaatacttggagaaactgaagggcagaggctttgtgaatcgttcagggaaaatcagtatcctgatcgagccacgaaagagagattaggtaaagatctcgatatgactttccggcaggtcagcaaatggtttgaaaatgctcgttggagcttcaatcatccaacatctaatcaggaaaccacagctaaaagagttgcagaaaatgccataacctctgttgttccgaagaaaaactgaatgatcggcatcgtagagagggagaaagagagaaatcaaaattggtgaaatggagaggtattgaggcagttgatttatatagctttaaatttaatgaacattattggataggaatagaaggaactttgttgctcgaggaaaatttgcagtgaaatgaagttgtgacccttatccaaatagatatttaaatgctttattttttaaaaaaatttattcattcagtttc

SEQ ID NO: 10420 - DNA, 565 bp, Gossypium hirsutum
  unsure (1)..(565): unsure at all n locations
  Clone ID: uC-gsflmaxxa047b11b1
gtagagagagaaaagaaagaccaacgccatggctggcactattgacttccgccgcctggatgaaggcttcggcggcaaaacgtacaaacgaaagcgccaagaatctcagatcgttgccaatgacgacgaggctgcccccgccgccgcttccatggacgtggatgattcttgccccccacccgcaaagcgttcagccgtgtcttcctcggacgaccccaataaacccaccttcggtcaacccacctacgacggcgtgattgcgggtaaggtgtctggtcggaactggaagcagccaagaaagcagcgtgcgtcagcgaagcacgtgagcataaggaggacgagcttggaggagagggagaggcaaaaggagatcaagagagcttatagagagaggattaatgagttgaaggaagagatccggcaaaataaggtggagaagagaaagaagagagaggagagagagaagaagaagaaagagaacatattgaggtctggaactaagtttcagaagaatactaatcctaatactttgaagaagatntgctagttcaagcacaagaagttg

SEQ ID NO: 10421 - DNA, 502 bp, Gossypium hirsutum
  Clone ID: uC-gsflmaxxa047b12b1
caaaaatgttccgcttgttgagcatcttcttcgtgagtgtaaccttttggggaaaatgcttgaagctgaaaagaattgcacattaacttctgatccgaatatgccaacaattagtgctgaaggtagaccgcctccaaagataggaaatcttggacacttgacacgcatatctaacaaacttgttcagcttggaaatagcaatgctgaaattcaggcacatctgcaggaaaacagtgaatgggttgattggcacactaatgtcttattaaagcgtaatgctacagaaaatatctatcagtgggcttgtgggaggccaacagctctacacgaccgaaccagagacagtgatgatgatgattaccatgatagggattatgatgttgcagccttggcaaataacttaagccaggcatttcgatatggcatttacagtaatgatgatatggatcaggtacatggctcactcgaaagagatgatgaggatgtttactttgatgatgaa

SEQ ID NO: 10422 - DNA, 505 bp, Gossypium hirsutum
  Clone ID: uC-gsflmaxxa047c01b1
gtttttctacaatcagacccctttcttaatgaacttgcgagcatgtttgagcgaagcactgagacaggctctgtttgggttactcttaaacgatcatctttaaaatcgaaggctcaaaggaacaaaatgaagactgctgaacaacccattgaatatcgatgccttgttcgtgcaactaatggaaaaaagacaatttctacttcggtgggagcaaaggatcaccagcgtttccaagcttcatatgccaccattcttaaggcccacatgactgccttgaagaaaagggagagaaaggacaggaaaaaggctgcagaggataagaaagaaggtggttcaaagaagccgaaaagggcttgaagggctttactctttccattgccttcaagctgtcatcatcacctagaaaatgcttaggttctttgttttttctttaaaaaccaaaatgaaatttctttcaatttaagctcattacagtgattacacttggaattttgcttgaattccc

SEQ ID NO: 10423 - DNA, 441 bp, Gossypium hirsutum
  Clone ID: uC-gsflmaxxa047c02b1
ttactcgtccgcggacgcgtgggcggacgcgtgggctcgtcttcaatatttcaaccgaatccaattctcaaagaaaaaaaatcgccagttaagaaagaaaaaaaagttgaaatcttttttgagcaatggaaggatcagtttttactccatcattggaaggaatgaagcatatcaaatctccggaaggggaaatgcttaccaagccttttttggatgtctgcaagttgattttgccagtcctagataagttcggatctgctatgagccttgtgaagagtgatgttggtggtaacatatcgaggttggaaaagaaatacgaaactgatcccgctaaatacaatcacttgtacagtatggtgaaagaagaggttgattgtaaaacagcaacagattcatctagttgtaccaatggtcttctctggttgacacgagccatggatt

SEQ ID NO: 10424 - DNA, 383 bp, Gossypium hirsutum
  Clone ID: uC-gsflmaxxa047c04b1
cggttgcgtgggcctttttaccattcatagcataggggggtagtccaactccacacccaccaccgttggctgtttttgatcatccgaaaaagaatggtgaccgtggaagaagttcgtaaggctcaacgtgcccaaggccctgccaccgtgttggccatcggcacatcaaccccacctaattgtgttgatcagagcacataccctgactactatttccatatcacaaatagtgagcacaagaccgagttgaaagagaaattcaagcgcatgtgtgaaaaatcgatgatcaagaagcgatacatgtaccttacagaagagattttgaaagagaatcccaatgtatgtgaatacatggctccttcactggatgctaggcaagatat

SEQ ID NO: 10425 - DNA, 390 bp, Gossypium hirsutum
  Clone ID: uC-gsflmaxxa047c05b1
aaatcgacttctccatcccgcctaccctaattatatggtgctttatttatttactccaaaaacaactgatctgcaaaaattatatttactttttcccctttattatgtttagtctgcgtgcttgaagggaaggctgaagctaaggttatccgtttcccttcgtgccagtccacttctcttcctttttcttaatccaagattatcgccggatgtatatatatttaattattctctgttaaaagggaaatttgattggtaaattcggagcaaaaagtcatttgaggttttaggtgaatgacgagtgcttcggagttgttctacactcgaaggtcgagagtaggtcgacccaatcccgatccagggatcgactctttaattgatcggaattac

SEQ ID NO: 10426 - DNA, 498 bp, Gossypium hirsutum
  Clone ID: uC-gsflmaxxa047c08b1
cccatgtgtccgcggacgcgtgggtctctctctagaggtgttctaattagatttccattggtctctccctcttttgggaaatctccggcttccaaatatacccccataatctcaaaactccggcgatttaaaattctcgtttcgatcttgagatcttattatcattgccggtttctttctggaaaaacggggattaaagacgaagaggagggatagaatcggaaaaagaaaggaaatcgcatgagctggttgggaaatctgggttttacttgcttctcttcggtgaattgttccaaccattttataacgtgtcttttaatttttattcttcattactcccatcaattacctccttcgttatttaaatttgaaaaaaaatcaactgagcctttattattattggttaattctaattccaaacatattcctcccttacatcttaaatctaaatcctaatcccgatcttaatccatggagtcgtcggacaagagtaatcac

SEQ ID NO: 10427 - DNA, 492 bp, Gossypium hirsutum
  Clone ID: uC-gsflmaxxa047c09b1
aacgagtgatgccgaagtgaaagttttgggcacatgggcgagtccattcgtgatgagggtaaggattgccatgaacatcaagtctgtggcctatgaatttcatcaagagaggttatgggaaggcaaaagcgagcttctcctcaaatcaaacccagttcacagaaaggtccctgtcctcattcatggtgatgacaccatctgtgagtctctcattattgtccaatacatcgatgaggtttggccttctgctcccattcttccttctgatccccatgaacgtgccaccgcccgtttttgggctgcttatcttgacgacaagtggttcccttccttgagagctattggtatggctgaaggagaggatgcaaggaaagcagccatagggcaagtggaggaagggctgatgcttgtagaggaggcatttgacaagtgcagccaagggcaggcattctttgggaaggaacaaattggatatctcgacataacatttgg

SEQ ID NO: 10428 - DNA, 466 bp, Gossypium hirsutum
  Clone ID: uC-gsflmaxxa047c10b1
ataacattgcggggatacctttcggttatcgtggattctcagacaaaggcttggctgaaatgccgctatcgcggaaagtagtccaaaatattcacctttcaggtggaagcttgttaggagtttcacgtggaggaccctctgtcagtgatattgtctctagtatggaggaaagaggaatcaacatgctttttgtgctaggtggaaatggtactcatgctggggctaatgctattcacgatgagtgccgcaaaagaaagttgaaagtggctgtagttggtgtgccaaaaactattgacaatgacattctgttgatggacaaaacctttggttttgatactgctgttgaagaagcacaacgagcgatcaactctgcatacattgaggcacatagtgcttaccatggaatcggtgtcgtgaaattgatgggtcgtagtagtggtttcatagccatgcagtcattcttagc

SEQ ID NO: 10429 - DNA, 521 bp, Gossypium hirsutum
  Clone ID: uC-gsflmaxxa047c12b1
gacatgtaagtcatggttaagcataacaacgttggggaaatgggcacttcaaaaagcgctggcagaactatgtgaaaacctggttcaatcagccagcaagaaaggctaggagaaggattgcaaggcaaaagaaggcggtaaggatctttccaagaccaacttctggacctcttcgcccaatcgtccatggccaaactttgaagtacaacatgaagttgagagctggcaagggtttcactcttgaagagcttaaggtatgacgttctattttctcaatttctttcatacactttttggggcttattttttagatgtctttttcttgtaccaaaattgatctatcacgacttcaggttttctatttttattcttatataaacacatagatttgtggattagactcttaatgaatttggttttaattggtatatcgattgaatgctttggtactctgcctgtgattgataaccaagttttgatattagttagcgacaatcaagtttaaaattaggatcaaaatg

SEQ ID NO: 10430 - DNA, 436 bp, Gossypium hirsutum
  Clone ID: uC-gsflmaxxa047d03b1
ataaaagagagatggcgtctgtaataaaatctgcaatcttaattctgtcggtgtttttatctgtacgcttcagttcgggtgttaggttgctccaggaacagcccaatgatgaccccaaaaacatggacgctattcctcccattgatgcactcaaccctaccgagttgaatggacccggtgttggcattcacgaagatcatgttgtcccaaaaggtgctgaaattggtactcttggttttggttttgaaggtggtcctgataaatgttgttcttctggatgttccggtaattgtaatcctggtggattcgttctaccatttcctcaaattccagaaatcccaagaattccagaaatcccacaaattccacagatcccaccaatcccacagatttcacttctcccacagatgccaccggttccacagatcccacaagt

SEQ ID NO: 10431 - DNA, 435 bp, Gossypium hirsutum
  Clone ID: uC-gsflmaxxa047d04b1
gtataaaggagggataattggagtggagaaaagaaggagaaaaggttaaaagctttgggggacttttttttcttttcatttatttgattttgatttgtgatatgaattatggatttctgagtttttttttcaaaaagatctgtttttagctgttgggttttgtttttgagtgtttaaaagaaaggggaatggccggaagtaatgaagtcaacctcaatgagtgcaagatggtggttcccctaaatacatgggtcctaatctccagttttaagttggcttacaatcttctccgtcgaccggacggcactttcaatcgtcacttggcggagtttctcgatcgtaaagtccctgctaatttgaacccagttgatggagttttctcttttgatgtcctcattgatcgtgctacaggcctcctttgtcggatttacagac

SEQ ID NO: 10432 - DNA, 100 bp, Gossypium hirsutum
  Clone ID: uC-gsflmaxxa047d05b1
tttttgcgtagcctatgtcactgaaaactcgagggggaaatttaacatatcggcgcggattgtctaacctcagagaaacacactctgactcattttaaca

SEQ ID NO: 10433 - DNA, 142 bp, Gossypium hirsutum
  unsure (1)..(142): unsure at all n locations
  Clone ID: uC-gsflmaxxa047d08b1
cccatgcgtccgctttgacgctatatcaagtgattcttcaacagctactaaattcagagaaagaatttatgacatgggcaaagttatggagtcgagtatacacaataacatacgttgcaacaaatatagaagatcattggnt

SEQ ID NO: 10434 - DNA, 355 bp, Gossypium hirsutum
  Clone ID: uC-gsflmaxxa047d10b1
cggttgcgtgggcggacgcgtgggtgaccatgcaccagggtccaatgacttttaatcaagttattctcaggacagtctaattcgcttaatttgatcttttaatccattgcttactgtaataaaatggcacttcttgttgttctttcctcttttagctttggttttggttttgttttgttattgtttgtaaagttattgtcgccaatcgttgctattgtggaaatggatgaggtggtttttttattatttccaaaaaaaaaaaaacaaaaaaaaaagagacaatctagaaacataatggtaaatacaatagaaaaaagccctcgatagaaaaaaaataaaaaaaagcggggggggc

SEQ ID NO: 10435 - DNA, 422 bp, Gossypium hirsutum
  Clone ID: uC-gsflmaxxa047d11b1
cccacgcgtccgcgacttctctgcattttccctcttctctcccttcacattggaggaactgaaccaaaagccaagaagcagtaggattgaacaaaggaatagaaaatatgcactctttcgggcacagattaaatggtctcttaaccttttccgtgacgatactggcaataatgtgtgctatcgcgtctctctcggacaaccttaatactccttctcccacggcagaaatcaagattatgaacataaactggttccagaagcagccgcagggtaatgacgaggtcagcctgacaatgaatatatcggctgatttgcagtcattgttcacatggaacacaaaacagcttttcatatttgtagcagctgagtacgaaaccccaaagaattctttgaatcaggtctcactttgggatgctataata

SEQ ID NO: 10436 - DNA, 514 bp, Gossypium hirsutum
  Clone ID: uC-gsflmaxxa047d12b1
ttgttgcgtgggcggacgcgtgggttttaagagccggccttagaattttcgagctggaatcttgatttttccttttctttttacgaacacagatttttggccacacaaattaaagtccactttattttaccttttaaatttctacttgtagcagtcagagagaaaattagtgaacgcagagagaaaacgagagctttgaaactttttttttttgttatcatcgaatcaagatggaccttattggatttgcaattatgttctagttatcggagattcagtttctgccactagaaaatcatgtggagttttgcgtccaattgtgtagccggaactgttgggcggaaaaatgtttttctaaatcaaactcatgctgcgttagaatgttcagatgatgaaggcccttccgtaattagcagggatgagtgtttagaatgcccgatatgctgtgaatctttcaacatcgtagaaaatgtgccctatgttttatggtgtggtcataccctttgtaaaaact

SEQ ID NO: 10437 - DNA, 437 bp, Gossypium hirsutum
  Clone ID: uC-gsflmaxxa047e01b1
ctcatgcgtccgaaaaatggagtccaacaccaaaatgtcagctcttcttttgctttgcatgcttttcatttcttcagtgacaccaattcttgggtgtggttcatgtgggaaagcaccacacaagcatcgaaagcctaagggaaagtcccctaaaggtcccatcactttgcctccccttgtgaaacctccaatcaagttgccaccggttgttcctccaatagttaagccacccattgacctccctccggttacagtccctccaattaacctccctccagggacggttcctccagtaactaagccaccaagtgggaaaccctgcccaacaccaccaaccaaggacacttgccccattgacacactgaaattgggtgcttgtgtggatctgctgggagggttggtgcacattggactaagtgacccggttttgaatcaat

SEQ ID NO: 10438 - DNA, 480 bp, Gossypium hirsutum
  Clone ID: uC-gsflmaxxa047e03b1
ccaatatccatcattttttcttgctgggtatatctcatatctctcttagtaatttgcgttggagggccaggcagcagcaatggagctgttctacttcgtcgtgttcggggcattgggagcggtggtggccgcattagagctaagcaagaccagcaaggaccgaaccaacacgtcccctgctttcaattccttcaagaacaattaccttcttgtctactctctcatgatggctggagactggcttcagggtccatatgtttactatctgtacagtacatatggatttggaaaaggggagatcggacagctttttattgctggttttggctcttccatgttgtttgggacaattgttggatctctagctgacaaacagggcaggaggagggcatgcgttacatactgcataacttacatacttagctgcatcaccaagcattctcctgaatacaaagttttgatgataggtcgtgttttgga

SEQ ID NO: 10439 - DNA, 454 bp, Gossypium hirsutum
  Clone ID: uC-gsflmaxxa047e04b1
ttttaaaaccatttatttttcttcagctctaagcgacaagaacaatggctgacttcaagaaagccactgctttgattctcacagtggctttgcttgtgaatctcgctttaatggttgatgctgatggtgatgatgataagaagattcgagtcaggaaacataagggtgagaaggagtgtatacaagggtgggaatgttcctactggtcgaaatattgttgcaaccaaacgatttcagatgtcttccaggtttatcaatttgaggacctgtttgctaaaaggaattcgccggtggctcatgctgttggattttgggattactcattctttattttggctgcttccatttatgagcctttgggttttgggactactggtggtaaagcatatgcaaatgaaggaagtcgcggcttttcttgctcatgtcggcgccaagacatcttgtggagatggtg

SEQ ID NO: 10440 - DNA, 403 bp, Gossypium hirsutum
  Clone ID: uC-gsflmaxxa047e05b1
gaagcgtcacgtcatcacgactcaaacggagcacaaatgcgttttagattcttgccggcatcttcaacaggaaggttttgaggtaacttatttgcctgtcgggtctgatgggcttattgatttggatagattaaggaaagaaatccggcccgataccgggttaatttctgttatggcggttaataatgaaattggtgtggttcaaccggttgaagaaatcggtaagatttgtaaagaatttaatgtcccttttcatactgatgctgcacaagctttagggaagattaaggttgatgtagagaagtggaacgtaagtttaatgagtttaagtgggcataagatttatggtcctaaaggagttggggctttgtatatgagaaggcgacctcggattagagttgag

SEQ ID NO: 10441 - DNA, 443 bp, Gossypium hirsutum
  Clone ID: uC-gsflmaxxa047e06b1
tgcttctcccttctccctttctctctcggtgacccctttctcttctgttttacttggggtcgcctaaaatcaccaaaaaaatttaaaaaaattgaaaaaacctcaaaattcctattgtatttctaaattattaatcaaatttaatccctacaaatagtttttttttttataaaacttttgaatatatttttcaaccatgtcggagatggcgaacacggatcccgaagggattgacgccgtgcggatgacgtggaacgtttggccacgcaccaaagtcgaagctagcaagtgcgtgatcccgttggcggctaccatcgctccgatccgtcctcacccggacatcccgacgctcccttacgcgcctctacggtgcaggatgtgttcagctgcgctcaacgcctttgcgcgtgttgacttcggtgccaaaactggatctggccttt

SEQ ID NO: 10442 - DNA, 477 bp, Gossypium hirsutum
  Clone ID: uC-gsflmaxxa047e07b1
cctctcttggccttttttttaaaagagaatgcagagaatcatagcagtggtgttgtttttattttgcgccacttctcaattggcctcttctctcaatgatggctatgttgagtacatcaaatcaggtcaaaaacaaggtgacatgttgctaatagtacctgaaggaggctttgcagttaggttaggcaatgaggcattgatcaagcagaagattaaggtgattaaaggtatgttttactctctaaccttcagcgcggctcggacatgtgcacaagaggaaaagttgaatgtttcggtttctctgaactacgagaaaaacgactctggtttgttcccaattcagacgatgtatagtagcaatggatgggattcgtatgcgtgggcattccaggcttctgagtctgtaattgagatctcgatacataatccgggtgtggaggaagatgctgcttgtggccctcttattgattccatcgc

SEQ ID NO: 10443 - DNA, 496 bp, Gossypium hirsutum
  Clone ID: uC-gsflmaxxa047e08b1
cccttttgtccgcccacgcgtccgcttttaacgttatgggcttattccgtgaatcggaggcggggcacggcccctctttttggacccaaggccggcttcggccggccgatccgggcggaagacattgttaggtggggagtttgtttggtgcggcacatttgttaaaagataactcatgtgtcctttgatgagttcaacgtgaacagaaatcttgatgagaacaagtcattgatcttaaagattgttgagagccagaattttgggaaattgagtgaatgtgcggagaaccaaacaaggcttgaaggaaaccttatgtacctggctgccattgcggattcttaaccccaaccactcaccatgcatgcacagtttccatttgggggtatcatgcagtcaggagcttgggcactacatgcagcaccaacatgcttaacagatgacacagcagtcgcttatggctgctcgggcctcaatgttgtattcttagcaaccattt

SEQ ID NO: 10444 - DNA, 555 bp, Gossypium hirsutum
  unsure (1)..(555): unsure at all n locations
  Clone ID: uC-gsflmaxxa047e09b1
cccatgtgtccgcccacgcgtccgcccacgcgtccgggttcgagtgccaaaactatgcccagtattcgccttcttgtactcttcttcttcctcttcttctcagttcattcccaagaagacactcccatagctcgattccttcgttaccttcaattcaacaccgctcatcccaatccaagctacgctgaccccatctctttcctcatatcccaagccaacgccattggactccatgcccgaacccttgaattcaccccttctaaaccacttctccttctaacatggcctggctccaacccttctcttccctcagttctcttcaattcgcacctcgattccgttccggctgaaccttccaaatggatctaccctcctttctccgccactctcgcccctgacggtaaaatctacgcgcgcggtgctcaagatgacaagtgcatcgctatgcaatacttggaagccattcgcaacctcaaggctaactgctttactccttcacgaacagntcatatttcttatgtccctgatgaagaaattggagggtttgatgggagt

SEQ ID NO: 10445 - DNA, 303 bp, Gossypium hirsutum
  Clone ID: uC-gsflmaxxa047e10b1
ccctctcttcttaggtctggggggttttttttaatgattaatcggcctcttccaccagccatgtctttcctcaatgatctttttaacctcaatcttagcgatattgattcaaagatcatagccgaatacatatggatcggtgcatctgaatggatttgagaagcaaagttaggactttgtctggacctaagccggaccctttaaaacttctgaagtggaactacgaaggttccagttccaatcaggatcctggtgatgacagcgaggtccatcattattctcaagctatattcaaggttccat

SEQ ID NO: 10446 - DNA, 496 bp, Gossypium hirsutum
  Clone ID: uC-gsflmaxxa047e11b1
gtacgatcagctaacaaggccaaagctaaactcatcgttgtcttaacccgtggtggaacgacagccaaattggtcgccaagtacagaccagctgttcctatcctatccgtggttgtcccagtcttgacaaccgattcatttgattggacctgcagtgacgaaggtccagccagacacagtctgatatataggggcttggttcccatcctggcagaagggtcagccaaggcaactgatgccgaatccaccgaggtcatcttagaagcagcaatgaagtcagctacggagaaggggttgtgcaagcctggtgatgccatcgttgcactgcaccgtatcggggctgcttcggttattaagatctgcatagtgaagtgatgatcaaaactggctttttagatattgcatttaattatccctatattggtcttaaaaatctaagctggttccaactttgaatatttagctgaaacacttgtttgtctcagcttctgatgac

SEQ ID NO: 10447 - DNA, 427 bp, Gossypium hirsutum
  Clone ID: uC-gsflmaxxa047e12b1
ggaaaatccaacccaagtgcaacattttgaagatgaagaagaacatattttccgtagcaaatacccaccggtttcagtgccggataacttgacgttgccggaatttgttctccaggatgctgagttatatgctgacaaggtagcattcgttgaagcagtgtccgggaaatcatatacgtaccgtgatgtggttagggacacgaggaggtttgccaaggccttgaggtcgcttggccttaggaaaggccatgtagttctggtattactcccaaatattgctgagtatggcattgttgctcttggaatcatggctgccggcggtgttttctcaagtgcaaaccccgcatcgcacccatcggaaataaagaaacaagctgatgctgcaaatgctaagttgatagtaacaaatggcccaaactatgaaaag

SEQ ID NO: 10448 - DNA, 436 bp, Gossypium hirsutum
  Clone ID: uC-gsflmaxxa047f01b1
ctgacgcgtgggttttatttattcacttcttcaatcgtcattttgatcttccattaatatattaggatatgtataagatggatgatgtctaatgtaaattccaacttgtattttaatatgtagttaaattatttggttccactttcatataaatttgattataccatcttaaaattaggatgcaaagggaaactagcaatggtgtagcagcagcagcggcagccgcatcgcgagtccatccggcatgcgctgcatgcaagcatcaacgtaaaaaatgcgacgagaattgcattttggcgccttatttcccggccgataagtgccgagaattccaagccgtgcacaaggttttcggtgttagcaacgcgaccaagatagtccgtaatgccaacagtgacgaagacctgaaaaaggtggcggattcgctgatatggga

SEQ ID NO: 10449 - DNA, 579 bp, Gossypium hirsutum
  unsure (1)..(579): unsure at all n locations
  Clone ID: uC-gsflmaxxa047f02b1
cccatgcgtccggtcaaacatctggtctcaatcaatctgcttggcaatgtacatgcgatcaagcatgccgcacgagccatgctgagatgcaatacaaaaggttccatcatatgtacatcaagttctgcaggcatcatgggagggctagcgtctcacccttactctttgtcgaaagctggtatcgtcggactgatgagaaccgcagcatgcgagttaggtgtgcacgggattcgtgtgaactgcatttctcctcatggtgtacctacagatatgctcattagtggttatagaatgttccgggggaacgaaacaacacccgaagaagtgaagaaactggtcggtgatcaagggagtctattacgtgggaaagctgcaactgttgaagatgtggcccaagctgcagtgttccttgcctcagatgacaccggattcataacagcacataacctcattatcgatggtggatatacttctgctattagttcactgagtttcatctacaaatagtnaagaattgggagaagaaaaaatanaacaagacaactttaccaatgtgatttgagctttattgtaaaacac

SEQ ID NO: 10450 - DNA, 464 bp, Gossypium hirsutum
  Clone ID: uC-gsflmaxxa047f03b1
attaaaaagaaaaaagggaaaaaaaaaaagggatttaagaaagtgaaatcctcttgtttatggtttctaaggtgggtttcgcttcaaattttgatttgattaagaataaattgaaaggaaaagaaatggagagagattttctgggtttgaactcaaaacaatccttccctttggttaaagaagaagttgaagaaattggttttaccaaaagcttggggattcaatggccaatttcaaacaaggtttcttcagctgttccaccacaccagatgagttttgattttgctcaaggagataacgcttaaagaatgggatatgattcaatagtatcctctactttcatgcatatctcaccaccagatgctgctgaacttcagaaatccttcaatcacaacaggcaacgagtaggcaatcatttcccattcacagcttgcttttctgttcagcatgatgtacatcatgtt

SEQ ID NO: 10451 - DNA, 552 bp, Gossypium hirsutum
  Clone ID: uC-gsflmaxxa047f04b1
gtctcaacactaagcaggttttgatcaatatcaggtgcatataaaatatcagtaatgaacttagtacctgaacaacttataatggctatatttcttttgactgcagtatagtcaccgttcccaattctgaccttcttgaactcggtactctttaggtttttgaacaactttttgtcatgtgtcatatgattagtgaaaccattatcaatgagccagcttttacttgtttcgtaactagtgaaataagttacaacaaaaagctaatcttcttcttcttgatctgccacttgcacttcatctccttattgctgatttttgtacttacaaataacaacttcatgtctcatttggttacacttgttgcactttgcatctagtcttctctaacacttaaatggagggtgacatttcttgccgcaatgttgacatagaggataatccttatttactcctaatcttctatttccagttttacttttgttcccaaatgcagaactatctcgattcgagtgtgaatctttttattccttggactcttattcttctatgatc

SEQ ID NO: 10452 - DNA, 445 bp, Gossypium hirsutum
  Clone ID: uC-gsflmaxxa047f05b1
tgctcgttgtgattattggaatttgagtgatgcagcaatgagacatgagaatgagacttgtttgctatatgccgatcaattgaaacaaagatgtgtggagcagtttatagaagggagtttgaggattgaacagcttgctgatgttgatgggttatttgatttggtttcgaaagtgattggtgcagctgagcctgctaggatatacaatgtcaatctctcgattttcacttcgatcccggatttttggagtattggtcaggtttttcctatagtcccaattcaccgattggatgaaaagcccgaagtgaggggagtattgtctgatttaacttgtgatagtgatgggaagattgataagttcatcggtggtgaaactagcttgcttttgcatgagcttgaaagtaatgatggtggtgcaaatgggcggtattattttgggatgttc

SEQ ID NO: 10453 - DNA, 467 bp, Gossypium hirsutum
  Clone ID: uC-gsflmaxxa047f06b1
ttcacgcgtccgcccacgcgtccgggaaattaaaaagggaaagaaagcagggaaatgcttaatctatggaatcttctcttcctctcctttgttcatttctcatcattcagtgttactttgggtggggtgtcgggaaacccatttactccaaaatcctccttcattcgctattggaacaaagagctccacaaggaaatccccaacacccattttttactctctaaagtttcaccattaactgccgtcgactccgccagtttctcgaaactcgccgcccacaacaacctcgcttctcgtcttccttccttttgttcctccgctaaactcttttgcttccccgacttatcgcccagtctcgagaaacattccaaagacgttaacttcgccgtctacctcgacaggaacttcactaattacgactccgatcgactcgctggactcgactccttcaagaactactctgaaaa

SEQ ID NO: 10454 - DNA, 471 bp, Gossypium hirsutum
  Clone ID: uC-gsflmaxxa047f07b1
cccatttttccggaagaggaagaatcaagcttgattgggtctcatgatgtcagaggtaccattcagacctagggaaaagcttatcgagtatcagaaatattttcaaggcatccataaacacacttacttgaaaggtccttacgataagatcacatctgtcgccattcccgccgctctagcagcaagttccctgtttttaatcggacgagggatctataacatgtctcatgggattggaaaaaaggaatgagagctctcactcatggttagaagacatgtttttcttttttgggtttcattatagcatgaaattgcttgtttgtttgctctaataattggttggtttttatgccaaatggagatcttaaaagataccctttggggttatgttttttaagttgggtttggattctcttgaaagctaaatgatatgaagctcaaggattcaacatgatattttatgattattat

SEQ ID NO: 10455 - DNA, 427 bp, Gossypium hirsutum
  Clone ID: uC-gsflmaxxa047f08b1
gggcggacgcgtgggcggacgcgtgggcgctgctttatagatctggtctgctcaacactcttccttctctctaaatctaatactcagatccgcgagtaatttttgtcacagctcattagaatggagacctttctattcacatctgaatcaccgaatgagggtcacccggacaagctctgcgaccagatctctgatgctgtgctggatgcttgccttgcccaggaccccgacagcaaggttgcctgtgaaacatgcaccaagaccaacatggtcatggtctttggagagattaccaccaaagccaatgtagactatgagaagattgttcgtgacacatgccgctctatcggatttgtttctgatgatgtgggtcttgatgctgacaactgcaaggtcctggtcaatattgagcaacagagccctgata

SEQ ID NO: 10456 - DNA, 411 bp, Gossypium hirsutum
  Clone ID: uC-gsflmaxxa047f09b1
attagcttctctttttgcccccttgccttctctgtttatgtacggatatagcattcaggttatgatagcttttagtgaccggaaacctgagagccgccgcaccgctcccgctctcggtttccctcgcgttaggttcttccgtttccggcgcttgacgtaatcgtcgactccgctccacccgtattcccaacaagaaaaaaaaaacggagaagagaagttcatttattacttttttttttattttcttctttatatttctcgtttgaattattgtataatatgacacttggaatatgccgaattccaaaaataatcgtaaggagcaggagaagaaccggaagggtaagttatctgaaaaggcgtcgtcgtttcacgggaaattcccgacggtggctccgtctgatctgaggc

SEQ ID NO: 10457 - DNA, 367 bp, Gossypium hirsutum
  Clone ID: uC-gsflmaxxa047f11b1
cccatgcgtccgattgtgctcagtgggggttcaaccatgttccctggtattgcagaccgcatgagcaaggagatcactgcacttgctccaagcagcatgaagattaaggtcgttgcgccaccagagagaaagtacagtgtctggattggaggatctatcttggcatcactcagcaccttccagcagatgtggatttccaagggtgagtatgatgaatccggtccatccattgtccacaggaagtgcttctaagttttgtaattgcttttgatggtgatctacattttgcatttagttggctttttttgtgtgcggtgtcaagtgaactccaaagtctggtttatgtggggggagggtggggatcatt

SEQ ID NO: 10458 - DNA, 413 bp, Gossypium hirsutum
  Clone ID: uC-gsflmaxxa047f12b1
caattatcagttgattgttgataatttgaaactgagacgaagacttcaatggcgtttccagtagtcgataccgagtatctcaaggagatcgataaagctcgtcgagaccttcgcgctttcatcgccttgaagaactgcgctcctatcatgcttcgcttagcgtggcacgatgccgggacgtatgatgtgagtactaaaaccggaggtccaaatggctctataaggaatgaagaagagttcactcatggcgccaatagcggcttgaaaatcgctattgatttttgtgaggaagtgaaggctaaacatcctaaaattacgtatgctgacctataccagcttgctggtgttgttgctgttgaagtcactggaggtcctaccattgactttgtacctggaagaaaggattcaaacat

SEQ ID NO: 10459 - DNA, 323 bp, Gossypium hirsutum
  Clone ID: uC-gsflmaxxa047g03b1
gtcttatggagggtccttagctttctcttttaaatggaaaaataaaatcacacataaaaatatttaaaaaaaattaaactttgaacaaatttcaaagattttggttttcttctgcaatttctcatccaccaattgaatcaggttgtgaagtattgagggtgtttattatttgttgtttttttataattactgatgtctccgccgctgcttggcgtggaggaggaagggattcaaagcaatgttactttacttgggtcttcaagctcaatggaaagtgtgtgccaaaatagtgcttacttgaaagaacggaactacatgggctt

SEQ ID NO: 10460 - DNA, 526 bp, Gossypium hirsutum
  Clone ID: uC-gsflmaxxa047g04b1
gtttcttcttctgctaatagctctctctgctttgaacctttgtaagtgaaaaaaaaaataaaaaataaagttaaatgaagcttcaaaaatggcgttaatggcaacgatacgagcccaattatctaggttcttaagccggacactaacacgatcgggatttatagccttcaacggctcgattcggcagccagaagcaccaccggttcaccgcaacttctcctcctccgccgcagccgcagcggtgttgcctcaaagagagccgatgggagttaaagaatacgaggattatagacgatctctttacggagatatcacacataaagctctccttgttgatgctgctggaaccctcttagctccatctcagcctatggcacagatttatagagagattggtgagaaatatggagttcagtactctgaagctgagatattgaatagatatcgaagggcttatgctcaaccatggggtaaatctcgtctcagatatgtgaatgacgggagacccttctggcattacattgga

SEQ ID NO: 10461 - DNA, 419 bp, Gossypium hirsutum
  Clone ID: uC-gsflmaxxa047g07b1
ggcattttggaaatttgcttgcctgttaatctctggggaggaagatggtttccgtttagatccagcacaaatacagatttcttaagccttctttgatcctatattcctagccaatacaatttgcagatttcagaaatactagtgatttagaaaaaaaatggcttcaacggggggtctggtgcccataacaagggcgtttctcgcttcttattacgaaaagtacccattcgatccactcacagacgacgagtctcgtctttgctctcagattcggcctttcatccaggatttgatccaaggcttttctccaactcaaggtgaaagcttattaatacaagaagcagatagggagcctccacataaaatggatgagaacatgtggaaaaatctagaacatattgaacaaattgtgattttac

SEQ ID NO: 10462 - DNA, 532 bp, Gossypium hirsutum
  Clone ID: uC-gsflmaxxa047g09b1
ataatctataataagcaaccttctggtctggtcttcagcagcaatcaatccttgtttttgacttctctttttctgttcttctccaaccaaacaaatttttttttctcttacagggtaaagggggggggtgttagagatcaccaatcaccacacccatcaatggagaattcatcaaggttagtacaagacaacaagaacttgaacttcccatcatcctcatcttcatcatctcctttaaactccccacatagcaatggaaccaaccacaacaacagcaatgggggtgtccaaattcccaccccacctttaactccaatccccatctccagatctgagaccaacccttacccaacaacctttgtccaagctgacacaactacttttaaacaggttgtccaaatgcttactggttcatccgaaactgctaaacaagccttctctaagccttcaacacaacatcatcatcatcatcatcatcaacaagatccagcactcccatcaaaatcatcttttcctatacctccatgaaaac

SEQ ID NO: 10463 - DNA, 542 bp, Gossypium hirsutum
  Clone ID: uC-gsflmaxxa047g10b1
ggctttttcagccaacccagattagttttggactcgggtaagataacccatcaagggtttttcacttcttttcttcttcttcttcttcttcttcttcttcttcttttatttggttttggtgtgacccattattggatcttttagctgattttgcaatcttaaagactataatttggggattttctcttccttttcttttatatatagttcatattcatggatctttgcttattcgatgtttctactttttggatttacccaatttgggttacttggaaactatcattcaaatctatgtactccttgaacttttaactttttatgctctttttttccttaaatagatcgcctgcatatgtaattcaatttttcttttcttttttcttctttttccttttttaatttcagttctgcagaaatttccggttgagagttcttgggaagtgtttaattgttgtaaatatctgaaaccaaccacttcagaggaatcttggcatatttgcaagtcatttagattgatatttttgatagatttggggata

SEQ ID NO: 10464 - DNA, 484 bp, Gossypium hirsutum
  unsure (1)..(484): unsure at all n locations
  Clone ID: uC-gsflmaxxa047g12b1
ccctttcgtccggaaattttgatacaagtaaagtaggggaatcttaaagaaaaaaaagtgctaaaaaagctaacttttttttttctttctattgatccttctttactctgggttcgtttttcaaagcataaaaacctaatttctaacagagcagctgcaactatcatcacccatggcggcaccgatctgggtatgggctttttacgtagccctaactctatttccttccgttttgggaaactcagaaggcgatgctctttatactttgagaagaagcctatcggatcctgataacgtgctccagagctgggatcccacccttgttaacccttgtacttggttccaaatcacttgcaatcaagataatcgagtcactagagtagatttaggtaattcaaacctatctggacatttggtaccagagctcgggaagcttgagcatttgcagnatctgnatgttctgcttcttttctcttgaactttt

SEQ ID NO: 10465 - DNA, 479 bp, Gossypium hirsutum
  Clone ID: uC-gsflmaxxa047h06b1
atttactagatccggcacacaaagaagcccttgaaagaatattgaaagaacggtcaggtgggacttttgaggctttaagtaaggtgatgggagcgcacctcgggattgcgtcgtcagtgactagcttttttggtgaaggtgggctgctaggcaagaaagaaattacggaatcaccaactgaaccagttgaagctctgcaatctgcagcatcaccagcagcggtagaggataccagattcatgcgaatcatgagggtcactgacatgcttagaggcaaaggaaagaacccagaagaaactcaccagaaccagtgaaatcaagtgagactgttgtttcctaataccctatatggaatgaatatatctaatttttcatgttcatatgcgaatacgagaatgctatgttagtaaatgctgataattctttttccttgtaatcattgcttaaagcagtcacaatcgcagaggattattgttttc

SEQ ID NO: 10466 - DNA, 422 bp, Gossypium hirsutum
  Clone ID: uC-gsflmaxxa047h08b1
tttatttacggtagcaaagagtaggggaaagaaagatggtggccgatcatttcagcggcggcggttgtggttggcgagatataaagacattcgggttgaaactgattctgggacggtggttcatggtgtttgcttcactgcttatcatgtcggtatctggcgcaacatatatcttcggtctatactccaatgttattaaaacatctttgggatatgatcaaacaaccctcaatcttttaagctttttcaaagacttgggtggcaacgttgggatcctatcggggctcatcaatgaggttacgccgccgtgggtgattctcttgatcggggccgtcatgaatttcttcggatatttcatgatatggctcgccgtcaccggccgcaccgctaagccccatgtgtggcaaatgtgccgttatttc

SEQ ID NO: 10467 - DNA, 478 bp, Gossypium hirsutum
  unsure (1)..(478): unsure at all n locations
  Clone ID: uC-gsflmaxxa047h10b1
ggattttaagaggaagaggcattctttcactcccaaaatgtcagatcttcaagcaccccttcgcccaaagaggaagaagggcttggtggactttttggtccagtttcgttgggtttttgatatattttttgtccttcctttttcggctctgtattactttctcatatatcttggagatgtcagatccgagatgaagtcctacaagcagcgtcagaaggaacatgatgaaaatgttaagaaagtagtgaagcgtctcaaacagaggaatccaaaaaaggatggtcttgtatgcacagcccgcaaaccatggattgcggtggggatgcggaatgtagactataagagagctcgccattatgaagttgatttgtctgctttccgtaacattcttgaaattgatagagagagaatgattgcaagggttgagccacttgtaaacatggngcagattacacgtgtcacagttcccatgaatctt

SEQ ID NO: 10468 - DNA, 505 bp, Gossypium hirsutum
  Clone ID: uC-gsflmaxxa047h12b1
gatatattgaagactttatttctgttaacatccattatgagtactgctggtcaagtcatccgttgcaaagctgcggtagcatgggagtcggggaagccactgtcaatagaggaagtggaagtggcaccaccgcagaaggatgaagtccgtattaagatactcttcacttctttatgtcacaccgatgtctacttctgggatgctaagggacaaaaccctctgtttcctcgcatactaggtcatgaagctggagggattgtggagagtgtaggtgagggggtgactgatctaaagccaggtgatcatgttctccccatcttcacgggggaatgcaaggagtgtccccattgcttgtcagaagaaagtaacatgtgtgatctcctcagaatcaacactgataggggtgaaatgattaatgacggaaaatccaggttttccattaatgggaagcctatctaccacttcctaggcacctctactttcagtgaatacaactgtgtccatg

SEQ ID NO: 10469 - DNA, 522 bp, Gossypium hirsutum
  Clone ID: uC-gsflmaxxa048a01b1
tttattcgtccggcagcacagaacatagcttgaaactcgccatctataactactcaagaaactaagagtcgaaaacagatggcgtatgctgcaatgaaaccgaccaagcctggtttggaggagtcccaagagcagattcacaaaatcaggatcactctgtcctccaagaatgtgaaaaacctcgagaaagtttgtgctgacttggttcgtggtgccaaggataagagactgagggttaagggaccagtgagaatgcccaccaaggttcttcacatgaccacaaggaagtctccctgtggtgaaggaactaacacatgggatcggtttgaactccatgttcacaagcgagttattgaccttttcagctctcccgacgtggtcaaacaaattacttccatcaccatcgaacccggagttgaggtcgaggtcaccattgcagattcttaaatgtgtgcctcacttttgcctttttcagaccttactagttttagttgattcaaagggctttcgtgtcacaactgc

SEQ ID NO: 10470 - DNA, 517 bp, Gossypium hirsutum
  Clone ID: uC-gsflmaxxa048a02b1
ctctctcgtccgcccacgcgtccgagagattcagagagggattggaaagatgggtgattaccagtttcttatgctaaaggacgccattacttgcattaaccagaaagttaacctatttgccgtcattcttgacttcactctgccccagcgaaccaaaggcaccgattatttttgtaagctaaaagtaattgacgagtcacattccgagttctgggttcctgtgcatgtatttgctcaagaaatcgacggtcttcctcttgttgcatctgttggagatattattcaactttcacgtgtcacgatgacagttcatgaaggagatgtatatgctatattcaacaacaagttttcttcatttgctttatatgatgggaaagatggtgataatttccatccttataaagtttctttaagatttcatgagagagaacatgatgaaaagataatagcaagcatgagaaaatggttagcaagttcagaggtcattgacgtgccaaatttctcattgttgagggag

SEQ ID NO: 10471 - DNA, 471 bp, Gossypium hirsutum
  Clone ID: uC-gsflmaxxa048a05b1
tttatgcttaggttcctctataggtttttacttgctaatccttttacataatttaggcaacaacttttttcttacattgcacatataattttatgaggccaatgactattagtggaacaacagcgacatgcatggtttgtcataagaaaggagctgtgattgattaattaacaggtgatggcatttctcatcataagactggcttgaaatgaactcattgccaggttgtgttggtgatgggaaactattgctcaacggatagggttctgtcttgcaagccatactatgatcaaccgttgctggcctcgtggacttaccaaattaggaatgccaaaccctcctctgaaaattgaaaaggaacagaaaaggctgctagcgatgaagaacaaggctcctgtggttcacacgacaaacggggtgcctgtaagataactgctaccccatataggggtgactcttgaaggagaaaac

SEQ ID NO: 10472 - DNA, 533 bp, Gossypium hirsutum
  Clone ID: uC-gsflmaxxa048a06b1
ctcctacagacaaggggagaaagaaacaggcaatcaatcatgctgagatattcgacgatgaaagtctaaacagaagattaacttgtaagaaagaagaggattatcgagttaaatactagggtgaatagtttttttttcttaaaaagaaaaagaaaggaaagatgatgacgggtgtagtgccagagcagaatcttgagaagcaaatagggaaacaaatgggatgcatggctggtttccttcagatctttgatcgtcaccagcttctttctggcaaacgcctttactcccctaagcgcctccctcccgtggaaacgccggcgagtgaaaagaaaacggagcaagtgaagaccgttgagacaccagcaatgtcgagagaattagggaagcagccacaaggtcgagcagcagcgtcaccggaccgttcgaagcaatctccagttacatcggagctccgatctccggcatcggaacttttcacgcctactggtaatcagagcaagtcacctctccccctttccgtttttgagtacaaa

SEQ ID NO: 10473 - DNA, 499 bp, Gossypium hirsutum
  Clone ID: uC-gsflmaxxa048a09b1
ttcacgcgtccggggactccctgatagcggagcctacatggagaaaaggttcgctgggcctcgttctatcaccatccttggtttgaacactggaacactggacatatcacataatggttggggccaccaggttggaattgatggagaaaagaagaaattgtttactgaggaaggctcaaagtctgttcagtggacaaagcctgaccaaggaggaccattaacatggtacaagggatattttgatgcaccagaaggggacaacccagttgccattgttatgactggtatggggaagggtatggtttgggtcaatggtagaagcattggccgatattggaacaattaccttagtcctcttaagaagccaacacaatccgagtaccacatcccacgggcatacttgaagccaaagaacctgattgtcctccttgaggaagaaggaggcaatcctaaagatgtccatatagtaacagtcaacagggatacaatctgcagtgct

SEQ ID NO: 10474 - DNA, 519 bp, Gossypium hirsutum
  Clone ID: uC-gsflmaxxa048a12b1
ttcttattaggaaatgttgttggggaacgccatagccggtgctcgtataatcatggcgtcgtcatccaaccacatcgtcttcgaacctgatgacatccctttcggctcttttgagtggttcgtctttgcgggagtttcctgcttgcttgtgctcttcgccggcataatgtccggccttaccttgggcttgatgtctctgggcctcgttgacctcgaaattctttagagaagcggcactatcaccgagatgaagcaagctgctgttatcttaccagttcttaaaaagcagcatcagcttctcgtaactctgcttctctgtaacgcttgtgccatggaggctcttcctataacccttgataaaatttttcacccctttgttgcagtgtcgctgtctgttacttttgttctggcttttggagagattattccacaagcgatattgttaagatatggactctctgttggtggcaaatttgtgtggctcgtgcgtattcagattattatttgttatcccatcgc

SEQ ID NO: 10475 - DNA, 503 bp, Gossypium hirsutum
  Clone ID: uC-gsflmaxxa048b01b1
ttttgcctatccccccaacttcatcctcttcatggctcaaattacatttcttgctgctgtttgtgctcttcttctatcacattcctttatatcaggagtgcaaggaacaagctttaccatagtaaacaaatgcaattacgtggtatggcctggagttctctcaaacgcgggcgtttccacaatttccaccacaggtttcactctccgaagaggtgaatccaaaaccattaacgccccggcatcatggggaggtcgtttttggggaaggacccattgctccctagattccgccggtaaattctcatgtttgacgggcgattgtgcttccgggaagctagaatgttcagggaacggcgctgctccgcctgccactttggctgaatctaccttggacggtgccgggggtcttgattttttcgatgtgagtctggttgacggttacaacgtccctatgctggtggttccccagggcggcacaggccaatactgtacctacactggct

SEQ ID NO: 10476 - DNA, 515 bp, Gossypium hirsutum
  unsure (1)..(515): unsure at all n locations
  Clone ID: uC-gsflmaxxa048b02b1
ttcagaaaaaaattgagtgtcagtttgaaagtgttcttcagatatggctatgaaacaagttgctaattctgctatcaaagcaattgccaattctgggtcatcctctcttcttaccagacaactgcatgcttctccagggaaaaaaagattgtgggggtgttttacaaggccaatgagtactttacgaagaatcccaactttgttggttgtgtggagggagccttggggttgcgccaatggctcgaatcacaggggcatcagtatatcgttaccgacgacaaagaaggaccggactgcgaacttgaaaagcatatccctgatctccatgtgctcatatcgaccccattccacccggcttacgttacggctgagaggatcaagaaagccaaaaacttgcaactgcttctcacagcagggattggctccgatcatgttgatcttaaggcagctgcagaagctggtttgactgttgctgaagttactgngagcaatgccgtctcggttgctgaggatga

SEQ ID NO: 10477 - DNA, 332 bp, Gossypium hirsutum
  Clone ID: uC-gsflmaxxa048b04b1
gtcgttgatactgaagggcacgagtctgattccgataccaaatcagacgatgaggacaaggaagatgcacatgatgagctctaagcactgcaatgtctcgctgacaaatcggtttggagataaaaacgcctaaattttttcctaccctttatttaaaaaagagttctagttttaggagtttcctgttagaggaaaaaggaattgaatgcttcaggcaaaagaactttcactgatgctttcttaatatgattttaactgtcagaacaaaggcatgctctttttcttttttatgatgactagatatttttactattcaagttccccggtttatc

SEQ ID NO: 10478 - DNA, 542 bp, Gossypium hirsutum
  unsure (1)..(542): unsure at all n locations
  Clone ID: uC-gsflmaxxa048b05b1
ctatctacctctctcgtccggtatccagaaccagatgtttacgaggaaaatagaaagtattccccaagagatcatgtcagcaagagggatcttggctatttcaactctgacatccgatataatcgttacaaggaccaacagagaccaaattcccagagtttcaaataccaaccaggtgatagtagaggcagagcttatcgtagggcatcgagaagtcctgaggctgacactaaccctcactatggaaggtctattgatagcagaaagcatagagaaagaagaggtgcatcacccttggaaagaagctggaaaagggaaagatctccatcaaaatcaacgtctcagagatattgccatgaggattctagtttcggaaggtcggggagtttcagataccagtcgggtgatgatactggcagaaactatcatacagtgtaccaaagacccactgatgtcgatatcccccacgatagtaggtttattgatagcagaaaacatagagaaaggagtggttcatcgcatatggaaagaaanctgaaaat

SEQ ID NO: 10479 - DNA, 516 bp, Gossypium hirsutum
  Clone ID: uC-gsflmaxxa048b08b1
aggcaacggaaggagaggatgttgacgagatcaaggccaagatagatgccgcgaataaagccgtctcaaagattggggagcacatgtctggtggttctggtggtgcccaaggaggttcttctggaggtgctcaaggtggtgaccaggctcaagaagccgaatacgaggaggtgaaaaagtgagtgatgaggcagtaattctgttcacagcttgtatttttttttcaagtggaaacaaacgccactggagagatgatcgttttgtttgttgatgatgcatagggtgtttactgtttagcagttttatatctaaatgaaggttgaatgtaataatagcctgttaggaattggagtccacagacctttcaacatgagataaatttttcctgaagaaatggagaaataaggagattcctttattagtagaaatttaggctggatggtatataaaaacgtgatgctgtcaatgctttatgtgattaatggttctgcctgcgctggtatatcagcgtttctt

SEQ ID NO: 10480 - DNA, 522 bp, Gossypium hirsutum
  Clone ID: uC-gsflmaxxa048b09b1
ttttccattaaaccaacaacaacaacaaaaaaccaaacacccagagttaaccaaaagagaaaatggtcaccaaagtctacattgtatactattccatgtacggacatgttgagaaactggcccaagagatgaagaaaggagctgaatctgttgagggagtagaagtcaaactttggcaggtagcagaaacactaccagaagaagttcttgggaaaatgggagcaccaccaaagacagatgcccctatcataacaccagatgagctgacggaggcagatggtgtgctatttgggtttccaactagatttgggatgatggctgcacagtttaaagcattcatggatgcaactggtggtctatggagaacacaagcccttgctggtaaacctgctggcattttctacagcactggctcccaaggtggtggacaagaaactactcccttaactgcaatcactcaactggttcaccatggaatgctatttgtgcccatcgggtacacctttggtgctggtatgtttg

SEQ ID NO: 10481 - DNA, 529 bp, Gossypium hirsutum
  unsure (1)..(529): unsure at all n locations
  Clone ID: uC-gsflmaxxa048b11b1
cccacgcgtccgcccacgcgtccgcggacgcgtgggttgaaatcaaagcgttcaatatggcgactgagaactatcactgattttttctgggcaattatcaatttcattggagtgttcttctcgaccatgttctcgatggaaaagtccgatgcctacagaaaaggctttggttcaagcaagaaatgggatgatggtccaggaggacctggaagtggaccatatggggaggtggtggcccacgacgaccaccacggggaatggacaatgttcggggaattgaccatagttcccttcctgcctgtggctcctgctgcggtggctaaatgctgcaagcatacatcttgtgcatgtacactgttatatagctaaagtcctcttattataagtaaggatgttccacatgtttttaatgtcaatagattgcctgtgaaacaggcaactntgaacctctataaaaccagagatgcttttatgtactttcaaactntngctaaatggtgggctgatactgctctgtttctacaacatg

SEQ ID NO: 10482 - DNA, 526 bp, Gossypium hirsutum
  Clone ID: uC-gsflmaxxa048c01b1
ttttcgcgtccgcccacgcgtccgggagaagagaatcagagccgcagctgccgccatcgccatggtgaagtttcttaaaccgaacaaggcagttatcgtcctccagggtcgatacgccggccgcaaagccgtcattgtcagatctttcgacgatggcacacgtgaccgcgcctatggccattgtttggttgcagggataaagaagtatccgagcaaggttatccgcatggactccgcgaagaaaaccgccaagaagtcacgcgtcaagtgcttcatcaagctcgtcaattaccagcacctgatgcccacgcgctacaccctcgacgtggacttgaaagacgtggttaccgtcgatgctctccagaccaaggacaagaaagtggccgcttgtaaggcaactaaggagaggtttgaagagaggttcaagactgggaaaaacaggtggttctttactaagctcaggttttaagtgttttattggaacatgttttatgcttaagtagttttatcgaacaattttgaattt

SEQ ID NO: 10483 - DNA, 521 bp, Gossypium hirsutum
  Clone ID: uC-gsflmaxxa048c02b1
cattttcaagtttcaacccgagtacagcgatcagctctcgattccttactttaaacttactgattagctgaaattctacaagtttcgatcttatcttgattgaggctgcgaatagcaagatggtgtatgaaataactgagcaacaaaaggttggcttgggtcttattggcttcggtatctccttcacatttctaggtgtatctctcttctttgacaggggtctgcttgctttaggaaatattttgtggttagcaggggtcgtaatattgatcggttggtattctactttgcagcttttcagaaaaaactacaagggtactgcttgttttattctggggctctttttcttattcgtgcgttggccaatagttggtataatcttggaaatatatggttgctttgtggttttcagtggcttttggccttcggtcagtgggttcctctgtcacattccggttgttggatgggttatacagtatccggtcatgtaccttgatcggttgagaaggggttaggatcat

SEQ ID NO: 10484 - DNA, 524 bp, Gossypium hirsutum
  Clone ID: uC-gsflmaxxa048c03b1
gaattttatttttccctctgttttgaatcagaatacaacggatcaaggagaagcaatgcaagaaatcaatcatccatatggattcaacgatggtgcgaatattgggaattcggtatcacagctgatattgtcaggaggctcaaataccttagattcaatcttctctcgttgcgagccatcaatagcggccgtcggcaccaactctgtttatgagccattaggctcttcagtttatcttcggcagagagatctccttctaaaattctgtcaaggaaacgcttcattttcacgcaactccgtagcggatcagcttcgaaagagccaaaacaccgcatcgacgagcaactgcgtcagtcctcaaaagacgaagctgtacaggggcgtgaggcagagacagtggggtaaatgggtggccgaaattcggctcccacaaaacagagtgcgggtctggttaggcacttacgaaacgcccgagacggcagcttatgcatacgatcgtgcggcgtataagctcagaggggaac

SEQ ID NO: 10485 - DNA, 522 bp, Gossypium hirsutum
  Clone ID: uC-gsflmaxxa048c04b1
aaattaacaaaaatttcatggctcggaaattctttgtcggtggcaactggaaatgcaatgggacaactgaggaggttaaaaagatcattacaacattgaatgaagctgaagttccttctgaggatgttgtggaggttgttgtgagccctccatttgttttccttacctttgtgaaaagtctgttgcggtctgatttccatgttgctgctcagaactgttgggttcgcaaaggtggtgcttttaccggagaaattagtgctgagatgcttgttaatctgagcattccatgggttatcatcggtcactctgaaagaagggctctcttgaatgagtccaatgagtttgttggagacaaagtagcgtatgcactttctcaaggcttgaaggttattgcctgcattggggagactcttgaagagcgagaatctggctctaccatggctgttgttgctgcacaaaccaaagcaattgctggaaaagtaacaaattgggacaatgtttgtttggcttatgaacctgttt

SEQ ID NO: 10486 - DNA, 543 bp, Gossypium hirsutum
  Clone ID: uC-gsflmaxxa048c06b1
caatttctcacgacgaaaaactcatccgaattgttaagcttgttcaatggagataatgggtttttcgttgctcttcaagttccttctcttgctctctggctttggggtttcaatggcgttacaagaaaccccattggtggctaaaaacttgggtcaaatcagttctaactcggtgcttgtggccttgttagactcgcattatacggagcttgctgaattagtggagaaagctttgttgttacaaagcttagaagagtctgtgggaaagcataatattaccatttttgctcctaagaatgaagctcttgaaaggaatctagaccctgaattcaagcggtttttgttggaacctggtaatcttaaatccttacaaactctattgctttatcacattgtgccgactaggattgagccacattcatggcctaattcaacatcgggatcgatcattcaccgtacgttatcaaatcacaatgttgagctctcgagtgaagattcaatgggggctaaattcattggtagcgctaaggttattaacccaat

SEQ ID NO: 10487 - DNA, 520 bp, Gossypium hirsutum
  Clone ID: uC-gsflmaxxa048c07b1
tcactttcttcctcttcctctcatctcatctgtcggtgctgccattgcggtttatactttataatttttctttacttttgtctattcctcttttaatcaagatgagcatgtatgggagagatccctggggagggccgctggagataaacgcggctgattccgccactgatgatgacaggagtaggaatctgcaagacctggacagggctgcgctctctcgccctttggacgagacgcagcagagctggctgcttggccccagcgagcagaagaagaagaagaagtacgttgatctcgggtgcatcattgtcagccgcaagatctttgtctggacggttgggaccttggtcgtctcagccgtccttgccggattaatcaccttaatcgtcaagaccgttccacgtcatcaccacggcaagcctcctcctgataactacactctcgcacttcacaaagccctcatgttcttcaatgctcagcgttccgggaagttacccaagcataataacgtgtcctggag

SEQ ID NO: 10488 - DNA, 319 bp, Gossypium hirsutum
  Clone ID: uC-gsflmaxxa048c10b1
gttcctctgctaatcttgggattggccttcggtatccgctcctataccaaaacaccagcttcatcttaagcattgagactcccaagagataatttgagcaatcttcacaataagattatgctagtttaaatttctttggaattttcacatactgcaggttggtaaatggttggatatttttattcaaacatttgctccaatgcagttgaaaaaactcagattcgcctccgattgtgataatttgataattgtctttcccagttttcaccatgtgtttgttcaatgctccctttcatttgataaaaaaacttgttcattt

SEQ ID NO: 10489 - DNA, 118 bp, Gossypium hirsutum
  Clone ID: uC-gsflmaxxa048c12b1
attttggaggtcttgtcatatgaacttcagtatagactacatgatatatatatatgtgtgtgtgtgtgtgtgcgcgtgcgcttataatgtttgaaagaaagaaagaaacttcttgtgt

SEQ ID NO: 10490 - DNA, 525 bp, Gossypium hirsutum
  Clone ID: uC-gsflmaxxa048d02b1
tttttctctcattcgtttaatctttttcagtatagtttctctaaaattatcaaattttttactttgagaaatttctcttctcgatctatccatttcgagtttgggaaaggagagacaagatagagagaaacagagagtgagaaatttggaatggcacatagagtagatcacgagtacgattaccttttcaagattgtgctgatcggcgattctggagttggaaaatcgaatattctctctagattcaccagaaacgagttttgtttggaatctaaatccactatcggcgtcgagttcgctaccagaactctccaggtggagggaaagactgtgaaggcacagatttgggacacggcaggtcaggagagatatcgagctataactagcgcttactacagaggagctgttggtgcacttcttgtctacgacataacaaagaggcaaacctttgataacgtccaaaggtggctgcgtgaattgagggaacacgccgattctaacattgtcgtcatgatggctggaaat

SEQ ID NO: 10491 - DNA, 528 bp, Gossypium hirsutum
  Clone ID: uC-gsflmaxxa048d03b1
tttacctgttggcgagccgaagcccagagcctccaaaaaagacttcaaccctctagccatgacattcaagcgtcggaatggtggccggaacaaacatggccggggccatgtcaagatcatccggtgctctaactgggggtaatgtgtgccctaaggataagtcaatcaagaggtatgttgcgaggaacatcgtgtagcacgctgctgccagggatgagcaggaagcctggacctatgacacgtacactctgcccaagctgtatgtgaagatgcaatactgtgtttcatgtgcgatccattcacacgacgtgagggtccgaacccacactgacaggaggaaacgtgacccggctcaggacttcattagacacaaggatgatatgccaacgcctggtcagactgttcaggctcctcgctctggcgatgtggcaactgctcacgcataaggcttatgaagtgtacgatgaatctgtatatcaagctgtgctttgagacatggctgcttgaatctagagaacttggagcatg

SEQ ID NO: 10492 - DNA, 463 bp, Gossypium hirsutum
  Clone ID: uC-gsflmaxxa048d05b1
cggacgcgtgggctgcacaaaaaaaatttctctctcgtctttagggagggaaaagaaagtcaatattttttactaaatccctgtaaattcgccaaaaagacttaaaaatccataattcgttgtcttcccgtaatggattttagtcagcctcctgttgaaaattatgccaaccccaagacttgtttctttcatgttctcttcaaggctgcagcattggctttttacatcctttcagctctctttttcaacagctttgtgatcatatttgtggtgactgttcttctttccgcccttgatttttgggtggttaagaatgttagtgggcgcatattagtcggtttgaggtggtggaatgaaattaacgatctcggcgagagtgtatggagatttgaatgtcttgaccaagagtcgttggctcggatgaacaagaaagattcatggctattttggtggaccctttacc

SEQ ID NO: 10493 - DNA, 535 bp, Gossypium hirsutum
  unsure (1)..(535): unsure at all n locations
  Clone ID: uC-gsflmaxxa048d06b1
atttatcgtcatttcaagctcaattctctgaaaatttttgtgctgaacttcttttttctctttgtaccaccatgtgtggaggtgctattatctccgatttcataccgccgtcgcggtcgcgacgattgacggccgatttcttgtggcccgatctgaaaaaatccgggttgaagaaggggtcgggtaagagatactcgaagcccgtgatcgacttgggcgatgatttcgagactgactttcaggagttcaaagatgaagaatctgatatagatgattatgatgttgatgatgttttggctgatgtaaagccctttgcttttaacgctacaaagaaacctgcttctgctgtatctcatggttcgaactctgaaaaatccatgcaattcaatggtcaagctgagaaatgtgcgaaaagaaagaggaagaaccagtatcgtggaatccggcagcgcccatggggtaaatgggctgctgagatccgtgacccaaggaaaggggttagggtctggttaggaactntcatactgctgaagag

SEQ ID NO: 10494 - DNA, 473 bp, Gossypium hirsutum
  Clone ID: uC-gsflmaxxa048d07b1
ttttcacgcgtccggcttgcgattgggaaggtgttcgtccagatgttgtgatactaggaaaagctttgggtggtggcgtaatacctgttagtgcagtgcttgctgacaaagatgtaatgctttgtattcgacctggagaacatggaagcacttttggagggaatcctttggccagtgtggtggccattgcctcactagatgtaatccaggaggagaaacttgctgagagatctgcccatttaggagaagaacttttgtgtcagcttgttaagattaaggaggaatttccaaactacgttaaggaagttcggtgaagaggtttattcactgctttagagttcaatagcaagagtttattttcctgtttcagcatatgatatctgtctaaagatgaaagaaaggggagtttttgccaaacccacacatgacaccattgtacggttgacttctccactttgcatgagtcgggatga

SEQ ID NO: 10495 - DNA, 523 bp, Gossypium hirsutum
  Clone ID: uC-gsflmaxxa048d08b1
cccacgcgtccgactctctgtatcttcactcacttcacctgagattttgttttcttttgtttttcggtaatggggaagattaagatcggaattaacggatttggaaggatcgggcgtttggttgcgagagttgctctccaaagcgaagatgttgagcttgttgctgttaatgatcctttcatcaccactgattacatgacctatatgttcaagtacgacagtgttcacggtcaatggaagcaccacgagcttaaagtgaaggactcaaagactcttctctttggtgaaaagcctgtcactgtttttggcatcaaaaaccctgaggaaattccatggggtgaggctggtgctgaatatgttgttgagtctaccggtgtcttcactgacaaggacaaagctgctgctcacttgaagggtggtgcaaagaaagtgattatttctgctcccagtaaggacgcccccatgtttggtgttggtgtaaatgagaaggaatacaagcctgatcttgacattgtctccaatg

SEQ ID NO: 10496 - DNA, 532 bp, Gossypium hirsutum
  Clone ID: uC-gsflmaxxa048d10b1
cccacgcgtccggtcggatcttcttcaagtaatttcaagctctacgatcaattcgaattgctggaatatgaagataggttagtgttcaaatcccccgaatctcccgatcaaggcttttcgatttgccgtcgtcaaggaaacatcgaacccctatctgatgaatcttcttctggaaaaccatccaaaacctctaccatttatggcgtggctggaacaattagattgcttgcaggaacatatgtacttgtaataacttcaagaaaggaagttgggagttttctaggtttccctgtctaccgagttgaatctatgaaattcctggcttgcaatgaggctttgaggttttccaattctcaagaaaaaagagacgaggcttacttcatgtccttgttgaaaacagttgaagcaactcctggattatactactcgtacgaaacagatataacagtgaacttgcagagaagatgcaaattaatggaagcgtggacgagcaaaccattatggaaacaggctgatccctcgtttgtttgga

SEQ ID NO: 10497 - DNA, 521 bp, Gossypium hirsutum
  Clone ID: uC-gsflmaxxa048d11b1
ggtgttttgatgaagttgattgatttttgaaaaatcggtttctgggtttgcttagatctattatgaattctggtctaaacttatcattccgagttttgattttattttctttaataatatcctcttctgggttttgattttcattgattttgctaatgaatggatctatctagctgataaacgaataaagaaaataaatacaggtttttagtctcatatatttttttctttttgtttgaaacccttcccctcatctcaaaaaatgaaaattaaaaagaaaaccctgtttaagtttagtagttgcttcaagactattttcatggaaaattttattattttattatttattttggtctttcttagctttacttctctaacaagtagagcttggttttgcccttgaatcaaatggatgttttgtttagcctaaagttcctctttttagaggtcatcaccaaatattaatgatttttgttccatttctaagatttgtatggtaattggaacttatttatttctct

SEQ ID NO: 10498 - DNA, 495 bp, Gossypium hirsutum
  Clone ID: uC-gsflmaxxa048d12b1
tgtctctctctttctctctccataaagggcaaaccctaaagagtcgtttacaccccctctaacttcatggatgacgatgcgttgaacatgcgtaattggggttactatgagccatcctttaaaggacatcttggtctgcagcttatgtcaagcatggctgagcgggacacaaagtcttttattccaatgcgcaatccgaatctcatggttactcccaatgctgcctttcacccacgcgactgcattgtttcggaggctcctaaccccatgaattatgttagggatagttggattagccagagagaaaagttttttaacatgttaccgggcatttttcctaactacggtattctgcctgaaacttcagctgctcattcactgccaattttgcagtcatcacccaattctttaacaagagatgagagggtggttggcagagttgtagagccaccagctaccaaggaaagtgtggagttgaagaaaaggcagagcgag

SEQ ID NO: 10499 - DNA, 523 bp, Gossypium hirsutum
  unsure (1)..(523): unsure at all n locations
  Clone ID: uC-gsflmaxxa048e01b1
ttgtcgcgtgggtgcctctgcattggcaattgaacttaaccagggattgaaacttctgcgggatattgcatctggaagaaatctgaaggagttccttatggttatagctgcattctgggttctgtcaattgtgggaagttggtgcaacttcttgaccttgttctatatatgtttcgtattgctgcacacggtacctgtattatacgagaagtacgaggataaggtagatccatttgcagagaaggctgcaatcgaggttaaaaaacaatatgcagtttttgacgccaaggttcttagtaaaattccaatgggccctttgaaggccaagaaggtttaacaaggaaaggggggttcagtctccacctctccggcaacatttggctagttctgggatgtggttttatgtgctgaattcacattagctagaggcatttcgtcctcaaatcaaattgttcacanatgttttggtttgcaattcacaatatcatatatgagtaagaggcaatatcagttgttagggata

SEQ ID NO: 10500 - DNA, 530 bp, Gossypium hirsutum
  Clone ID: uC-gsflmaxxa048e02b1
tttttctctcattcgtttaatctttttcagtatagtttctctaaaattatcaaattttttactttgagaaatttctcttctcgatctatccatttcgagtttgggaaaggagagacaagatagagagaaacagagagtgagaaatttggaatggcacatagagtagatcacgagtacgattaccttttcaagattgtgctgatcggcgattctggagttggaaaatcgaatattctctctagattcaccagaaacgagttttgtttggaatctaaatccactatcggcgtcgagttcgctaccagaactctccaggtggagggaaagactgtgaaggcacagatttgggacacggcaggtcaggagagatatcgagctataactagcgcttactacagaggagctgttggtgcacttcttgtctacgacataacaaagaggcaaacctttgataacgtccaaaggtggctgcgtgaattgagggaacacgccgattctaacattgtcgtcatgatggcttgaaataaatc

SEQ ID NO: 10501 - DNA, 530 bp, Gossypium hirsutum
  Clone ID: uC-gsflmaxxa048e03b1
gatatctaatagttatattatgacagatcaccagcagaggattcatcctgtggtggaagtcgaagcaccagcccccacgacgcctttggtgcctcatggctcggctacatcggagaaaggcagcccgattcaacagcgtccaccacaacgaaccattccggtgaggccaccaccaccaccaaggaagcgaagctgttgttgcaagtgcatatgttggacagttagtctcattgtcgtcctcctcataatcctgggtgccactatcggcattctctaccttgtcttccgcccccaactccccaaatactccattgatagcctgagaataagtaatttgaggctcaacttcgatatgaccttgtatgcgaaattcgacgttaagatcacggccaataaccccaacaagaaaatcgggatatactacgagaaaggagggcgattaagcgtgtggtatacaaactcaaagctttgtgaagggtcattgccaaagttctaccaaggtcaccaaaacataacaaagctggaagtgg

SEQ ID NO: 10502 - DNA, 374 bp, Gossypium hirsutum
  Clone ID: uC-gsflmaxxa048e07b1
ttttcaaggacacgtatgactcgaaaggcaaaggaggattcaagcaagcgagacttcgatttaaagctgactcgacacgaaccaggataatgttctatagcacgttttacaccatgaaaaatgacaactcgggttctctctgtggaccagtggtggatgatgtgaagttggttagtattcaaaaattgcatcatttgtaaaattcatgttttaaatttgttttgcattgattatgctacaaattaatgtgtttcatccatttaggggtttactttaggattatttaatctatcaaattaatgagttcaccaccaatgttgacatttatgtatctactttcttcgttaaattaatggtgtgaaccaagttctttt

SEQ ID NO: 10503 - DNA, 520 bp, Gossypium hirsutum
  Clone ID: uC-gsflmaxxa048e08b1
cggacgcgtgggtttttggacaccgtgagaatcggagaccgagaatccgtctttttagggtttggttcggattttaatttttgtagcaatggcggatgattcggagagtaagcagtcggcggtggagtcgatgatggagaagatcagcgagaagattcacggcaatgattcatcgtcatcttcggattcggatcatgagaaaccggcttccccttcctccgttaaggctaagatttatcggttgtttggaagagagagaccagttcatcatgtgcttggtggtggaaaacctgctgatgtgttcttgtggaggaacaagaagatttcagctggtgtccttggtggagcaactgcaatttgggtcctttctgagttgattgaataccacctacttactttaatatgtcacatttcgatactctgtcttgcactattgcttttgtggtccaatgctcataccttcatccacaagtctccacctcgcatccccgaaattcatttgccagaggagccattcctc

SEQ ID NO: 10504 - DNA, 525 bp, Gossypium hirsutum
  Clone ID: uC-gsflmaxxa048e09b1
ctcatttgattcaatccaagttctgggtttagtttctttaacttcaaaatccattacccatattggatttattagggtcttttgttttgtttttataaaacaaatcaaatatcttgatgctcaacctttttgtgttaatgtttgagattcatgtttccaattctcagtgaaatcttcttttctgggtttatgataaattccacattcatacgcaggacccatcttgttcaatctttctctgttgttttcctctactggttatattacgtttcataaagaaataatcatctttttttaacttatttatctttactactaaggttttttttttttaattttatttgggtcctgctattatatattataaacaaaactcctataatggctacatcctcgggttcatcagcaacacaaatcaactcaggctcagaagaagcattaatggacgaaaggaaaaggaaacgaatgatatcgaacagggaatcagcaaggagatcaaggatgaggaaacaaaagcatttagat

SEQ ID NO: 10505 - DNA, 439 bp, Gossypium hirsutum
  Clone ID: uC-gsflmaxxa048e10b1
cccacgcgtccgcaaagaagaaaaacttaatcatggctcggttgacgttggtgtcctccatcatccttctgctatgctccgtcgccgccggatcaactttcgaggactccaaccccatccagatggtatccgatggcctcagcggcttcgaatcctccgttcttcgtgtcatcggtcacactcgtcatgctctctccttcgcccgttttgcatacaagcatgggaagaggtatgaaaacgtggaggagatgaagctacggtttcagattttcaaaggcaacttggatttaatcagatccactaacaagaagggactgccttacactctggctgacagtcagttaggtgagcgcagctgggcagagttccagaaacacagattgggggctgctcaaaactgctgtgctaccacaatgggcagacaccaccacactgatgt

SEQ ID NO: 10506 - DNA, 489 bp, Gossypium hirsutum
  Clone ID: uC-gsflmaxxa048e11b1
tggtcatcattttccgatccgataatgaacctttcaagaaacacatgaaaaggtttgtgaccttgattgttgacaaactgaagcaagagaagttgtttgctccacaaggaggacctattattttagcacagatagagaatgaatacaacactattcaaagagcattcagggaaaaaggggatagttatgttcaatgggccggtaaactggcccttagcttgaatgccaatgtcccatggatcatgtgcaagcagagggatgccccagatcccattatcaatacatgcaatggaaggcactgtggagatactttctatggtccaaataagcgcaacaagccggcattgtggactgagaactggactgcacagtatagagtattcggtgatccaccatcccaaaggtcagctgaagatttggcatactcagttgctcgattcttctacaaaaatggaagcatggacaactactatatgtactatggtggca

SEQ ID NO: 10507 - DNA, 315 bp, Gossypium hirsutum
  Clone ID: uC-gsflmaxxa048e12b1
gaagttgtgaagcccctcaaatgggaaaagcctcaatcttgaagtccccccgtccgtactgccccgtgcttttctcatccgcggtgctgaataatcccgatgtttcgtagctcctaccggaaatatctaatctcatacttataatgccctttttcattttcattttctatttcttcttttatcgatgcttgttttgatttatgtgtctttttatcagcgtcggtgttgcaaaactgagtgagaattttgcttatattgatggcattggaattaacaagctgcaacattattaagttatttgcatggatttaaatt

SEQ ID NO: 10508 - DNA, 516 bp, Gossypium hirsutum
  Clone ID: uC-gsflmaxxa048f01b1
ttaaaaatgcagttttgattaatcgttgatttaggcgaaaattgactcaagtacagttcctttctttgctttgctttggtgtgcttgagataatgtaattgaagtaattttggtcctggtctacctagcttatttctttttcttttggaagcaagttttcatggtaataccatacaaaggatatgagcggagaaggataatggaattgtagttcgtttgcagaagggaaacatatattgggtgaccaaagaacaaggagtggtgaatatatttttcgagttttagattcttcagcaagttaaaattgtgacaagcacactcctgttggaccattgaataagatttgcctgctacgattccatgggatggagaggtgtcttctattcttcactttttcttctcactctagtcgaatcttcaagtagatcagagaaaatattgttctcaagcttgggtgcccaaaaagctgtagaattcagctggccagtcttcagtgctagcatatttgtctttgtc

SEQ ID NO: 10509 - DNA, 511 bp, Gossypium hirsutum
  Clone ID: uC-gsflmaxxa048f02b1
gtgcgttccttagagagatggcagccgccatgaaagttgtatgcatgatgtttcttgttgccatatttcataaacaccatgcccatggcgcaatatcagcagatacacaaaaacttatcgatgaagccaacatgaatggaccttacttaggcttgctcattccaaaccttttcgaaatgaaccctcttcttcaacatccaaactatacttccaccaacttcaccattgatattgctggaaggagatttcggttcgggaaaattgttgagaaaaatgttatattagtcatgacgggactgagcatgataaatgcaggaataacgagtcagctattgttaactctattcaaaatcgaaggagttgtccattatggaatagctggaaatgccaacccctccttacacattggctttgtcactattcctcaatattggtcacactctgccctttggagttggcagagatatggatatggaccctctgacgagctcccccttgacccaatggagac

SEQ ID NO: 10510 - DNA, 531 bp, Gossypium hirsutum
  Clone ID: uC-gsflmaxxa048f04b1
tttttattgaataatatccttagttcccttgatttctacgaaaattttcttttatttttattttcattgaatcaccaaaatgggcggaggagctatgagagcggcggcgaaagttgccggagcgggaattgttaacactggccttcgtggcggtgttcaggtggctccgtcgtctgcggaatactccgtcatgtgcgtcgccgcttctcgttcggcttcttccggaatttctgtttctggcggtggggtgtcttccgtcgctgacatgacggcgtcgcccaatcagatgatgtcatgggagatggtggacgattgggagtttgctggtggtgttgaagaggaggtgcccaccgccatttccggcggaggagagccgatgcctaggctgttgtttggagttgctgcaaccctggaggatgctaaagcagccgctagtgatttgaaagatgcattggataaggcttatctatcatctctggattcgacggatgatacccggtcatcttgctcctcattgctttcagaggagac

SEQ ID NO: 10511 - DNA, 530 bp, Gossypium hirsutum
  Clone ID: uC-gsflmaxxa048f06b1
tggtaacgctaggtaagcttcgccacccaaacatcgttaagatcctagggttttgctcttcgggtctcgatcggattttgatttatgagttcattgagagagggagtctcgaccaattgatttacggtgaagatcaagaaaacccggacggcaggtttctatgttggtatacgaggaagaagatagttcttgggatagctaatggtctagcttatttgcatggactggatacacccatcatccatagagatattaaggccagcaatgtgttgttagatcgggatttcgaagcccatatttctgattttggtctggctcggcaaatcgaggagtcccaaacacacgtatccacacaggtggccgggacaatgggctacatgccgccggagtaccgtgaagggaacacagcggcgacggttgtggcagatgtttatagcttcggagtattgatgatcgagatagccacccaaaaccgccccaattggccggtgaggtttgaggggaaagttataggactagtagagtgggct

SEQ ID NO: 10512 - DNA, 530 bp, Gossypium hirsutum
  Clone ID: uC-gsflmaxxa048f07b1
ttgcgtgttataggaacaccttcctgatgtggctttacctcttcgtcatgttcttcatcatcgccgccctcatcggcttcataatctttgcttatgcggtgactgataaaggctccgggcggccggtgttgaacaaaggttacttggagtattacttgcaggactactcagggtggctcaaagaccgcgtggtggatgagagctattgggctaagattagttcttgcatcagggattccaaagtttgtagcaagacgggcagaacctttaatggcgtccctgaaacttatgacatgttttctatgaggaagctttcccctattgagtctggttgctgcaagccacctacagaatgtggctacgtttatgtcaacgagacactatggaactccggtagtgggctagctgcgaccaacctcgactgctcgcggtggagcaatgaccaacagatgctgtgctaccaatgtgactcctgcaaggccggtgtgcttggcagcctcaagatgagctggaggacagtctcggtaatc

SEQ ID NO: 10513 - DNA, 524 bp, Gossypium hirsutum
  unsure (1)..(524): unsure at all n locations
  Clone ID: uC-gsflmaxxa048f09b1
cccacgcgtccggtgtgttttgtttcatttcattccaattgaatgctaacgtttcgcccatcccatcttctccgctatacttgttgtattactcgtcctctcacccctctccttcctcccttttcctcccatatccttccttccaactcgcctttctttcgccccaaacccctctctctttcttccttaaaccctcactccaacatgtccactcgcccctccgccttcgatgccttaatgtctaatgctcgccgtttagccggtaagaagagctcttcctcttcttcgcccaccaagaaacgcaaatcccccgattcgtcgcccacccaaaaccctaatccccccaaaaccgtcggctccactgaagtcaagcacgacgcagaggtttctagtgatggaatcggaaagcccattaacgattccccaaaacccgatttagatgaggcgaagaaacccccggattcgaagaaggtgaaggtggngagcgcctccgagagacacgcggagatgaaagggaaaattgt

SEQ ID NO: 10514 - DNA, 530 bp, Gossypium hirsutum
  unsure (1)..(530): unsure at all n locations
  Clone ID: uC-gsflmaxxa048f10b1
tccacgcgtccgcaacttccatcactcctaacccagctgcactcagtgagtgaaccatctcgagttcttgagctttcgatcaatggcaaccctgacaacctcacactttgtttcgacatgttcacatttcagcagccatggagcagacactaaggccaatcttgcacaggttggtgccaggaatcaagccatgactcacaatggtttgcggtctttgaacaaggtcgataggttgcagatgaggaccaccaacgcaaaggctgtcgttacgaaagccatgaaacaggcagatcacaggcctttgggaaaaattatttgcggaatagggatgaatatagtgtttgtgtcagctgagtgtggcccctggagcaaaactggtggaccttgtgatgtcctcggtggacttcctcccgcaatggctgccaaaggacaccgtgttatgacagtgtgtcctcgctatgatcagtacaaggatgcatgggatacaagtgtgttagttgatctaaaagtcngagacaaagttgtaactg

SEQ ID NO: 10515 - DNA, 529 bp, Gossypium hirsutum
  unsure (1)..(529): unsure at all n locations
  Clone ID: uC-gsflmaxxa048g01b1
atctaatcaatttggtaccaattttggggcgcaatgagggtgctcacccttcctcatgcgtaaccgactcccgaacccatttgtttttgattttgcgtgaatcgaaattgatttaaatagaacaaaatgttttagtaggtgacccaatcacacctaaacaaaagattggtggcgactccacactcagttttaaaagtcgatccctgcttttttcctaactcgaaaaaatggtttcgacaattttgatatgttttgagtttagaattttgttggttttggtcatgggatggttatgttttatgtgtaccttattgggtaagcttcggcttgattttaacttgtttaatgagtctttttggaagcacacagcttgagacacgggttgttacatggtcctgtgctacacacggtcacctcacacagccgtgtgtattctgttagttctagggcaggttttatacgggttgagacacgancgtgtgtctcaagtactgagttacactggctagcgcacagcctgcgacacggt

SEQ ID NO: 10516 - DNA, 526 bp, Gossypium hirsutum
  Clone ID: uC-gsflmaxxa048g02b1
gtgcgttccttagagagatggcagccgccatgaaagttgtatgcatgatgtttcttgttgccatatttcataaacaccatgcccatggcgcaatatcagcagatacacaaaaacttatcgatgaagccaacatgaatggaccttacttaggcttgctcattccaaaccttttcgaaatgaaccctcttcttcaacatccaaactatacttccaccaacttcaccattgatattgctggaaggagatttcggttcgggaaaattgttgagaaaaatgttatattagtcatgacgggactgagcatgataaatgcaggaataacgagtcagctattgttaactctattcaaaatcgaaggagttgtccattatggaatagctggaaatgccaacccctccttacacattggctttgtcactattcctcaatattggtcacactctgccctttggagttggcagagatatggatatggaccctctgacgagctcccccttgaaccaaatggagactatacaagaaacat

SEQ ID NO: 10517 - DNA, 521 bp, Gossypium hirsutum
  Clone ID: uC-gsflmaxxa048g04b1
ctcttgttgtaagctaaaaaaagaggctccattttcgattcctttttctcttaattttctttagagaaagagagagatggcttcctttgatgcgtacggaatggaaggagaagaggttcatgcaggtgcagcacctaataaccatcctttcgatgtagacgacgacgagagctattccaattacggctcttactctaacttcaccgacaatcagcaattcccggccgacggtggtgatgtggcggtggatcacttggcttcttctcctgagatcttcggcttcggatcttccgatccgtcccctgcttactcgcaatctcctttcggtactacgattcctgtggaaaacggaaacggaacgaatggatttagcggtggaaacgacgatgttttcagttctgatggtcctgtgcttcctcctcctactgagatggcgccagaggaaggcttccttcttcgcgagtggcggcgtcaaaatgccattcagcttgaagagaaggagaagaaggaaaaggaattga

SEQ ID NO: 10518 - DNA, 509 bp, Gossypium hirsutum
  Clone ID: uC-gsflmaxxa048g05b1
tccacgcgtccgcttcgttttggtttttttgctttgctctgaaactccaagctctcatcaatggcggatccagcgactatctcaccagccacgctgttgaaagatgagcttgacatcgtgattcccaccattaggaacttggatttcttggagatgtggagaccctttttccaaccttaccatctcatcatagttcaagatggcgatccttcaaaggccatcaaagttcctgaaggctttgattacgagctttacaacaggaacgatatcaataggattttgggtcctaaagcttcttgcatctctttcaaggactctgcttgtcggtgctttggatacatggtttccaagaagaagtacatctataccattgacgacgattgtttcgtaagctcaatattcatctctcatgttgctaaagatccatctggaaaagacattaatgcattggagcagcacataaagaaccttctgagttcctctacttcgttttttttcacaccctttac

SEQ ID NO: 10519 - DNA, 528 bp, Gossypium hirsutum
  Clone ID: uC-gsflmaxxa048g06b1
cggacgcgtgggttaatattagggtttcatcatactttaagaaagacagagagaagccggcacttctgaagagcagcggaagaagcaatggcgagaatcaaggtccatgagttgagacagaaatcaaaaactgagcttttggctcagttgaaagatctcaaagctgagctcgctcttcttcgtgttgccaaagttaccggtggtgcacctaacaagctttccaagataaaggtggtgaggttgtcaattgctcaggtgttgacagtgatctcacagaagcagaaggctgcactgagggaggcatataagaagaagaagttcttgccccttgatctccgtccaaagaagaccagagccatcaggagaaggcttaccaagcatcaggcatcgctgaagacagaacgtgaaaagaagaaggaaatgtacttccccatgaggaagtatgccattaaggtgtaggataagatatttgagattctattttgaaatccgtttgtgtttacttatttgtgaaaacccgagctgtga

SEQ ID NO: 10520 - DNA, 518 bp, Gossypium hirsutum
  Clone ID: uC-gsflmaxxa048g08b1
gcggggtactttacctgtagtaggcgaatgcctggttcacttggttatgaagagcaggatgctaaaacctttgcttcttggggtattgattatttgaagtatgataactgcaataatgatggctcgaagccaacacaaagataccctgtcatgactcgagctttgatgaaggctggccgccccatcttcttttctctgtgtgaatggggagatatgcaccctgctgaatggggtgctcctttaggaaatagctggaggacaactaacgacatatccgataattgggaaagtgatctctagagctgaccagaatgaaatttatgctgaatatgcaaggcccggtggttggaatgatccggacatgctcgaggtggggaatggagggatgacaaaagatgaatacatagtacatttcagcttgtgggctatttcaaaggcacctcttcttcttggttgtgatataaggaatatgacaagagacacgatggatatcatcacgaatagggagtcattgctgt

SEQ ID NO: 10521 - DNA, 532 bp, Gossypium hirsutum
  Clone ID: uC-gsflmaxxa048g09b1
aacaatttcacggaaactctttcttccttttcacaatttcctcttccctttggcttcttcttcctatttccagaaattcagcccccctattttcactatcaatagcatatgaacccttattagtctatttccctttttccctttttaccccctagttcttctagggcaaagattccccaatttcccttcttcaatttcgatcctttatctcttgaatttgattttttttttaaattcaatcatggatggcaacaaagacgatgctttgaaatgcttgaaaatcggaaaagatgctttggacgccggagatcgagcccgtgccctcaaattcctcaccaaagctcgtcgtcttgacccatctcttcctatcgagaatctcttatctgcggcggaaggagggaaatctgacgatcggccggcttcggaacctgttgggtctgctaaagatccgtctgggtcttctccatctaaaccttctgatcaaccctcgattcgtcggaggaatataccgaatggatcggctgcgtctgct

SEQ ID NO: 10522 - DNA, 530 bp, Gossypium hirsutum
  Clone ID: uC-gsflmaxxa048g11b1
tttgtcttcttgaccagcgtccttcagaaagtagatcaagcgaactttggttttcttgcatccggtaagagattattccactttctaagacttcttttgctaactgatgggcatgcatgtttttattttctgggaatatacttgaactttattgtttgataatgggcacacttatcttgaatatctcgaatgattgctccaatgactgacttatcaacttctgttgtttggcatttcctgattactgtctttgaatcccctttgatttgtgaatctctaaagcccattaagattcctaacttaattgcttccaatcctgcatatgcttctgccgcgaacggagatggaacataattgtggaggactgtcttcgttgccagtttttcattcctacaaccccaaaccaccaccccagaggcagatctgaaatttctcttgtcgtacgcttcgtcgaagtgtatctttactattgctttctttctgagatgaatatccgttcgtgaactagctggtttcttgagtaccatatt

SEQ ID NO: 10523 - DNA, 510 bp, Gossypium hirsutum
  Clone ID: uC-gsflmaxxa048g12b1
ttaacattgagaaagaaagaaatgtgttgttcggcggtgctcgcccacgagaactggttctgaaggagagagggattgatgacagcatccatgagccggaccaacatcctgatagggtcgtcaagcataatgttccgaggagtgaaaaagtagcagagcaagcagctcctcgtcccagtgaaagagttgggaatcctcctgttgatcagagagctggaagaaaatctgagagaaaccatggtgtttacaatgaaagagttgatacgcagaggaggaaccggcctaatgaaaactggcggaatgacaaggaaattgagaggcagcagcggcaggagaggcagccatcacctgagacctggcgtaagcctgcggagcagcctaaaccagtctctcctgaagctgctggtgttcgctatggaaaagcagcatcagctttggagcttgctcaagccttttccaaatcattctcagatcagaaaacagatgatcgatatgcggtgcaaaggggtc

SEQ ID NO: 10524 - DNA, 449 bp, Gossypium hirsutum
  Clone ID: uC-gsflmaxxa048h02b1
tgttttaatgtgcaacctactgaagaacccaatcccatgccttgctgctatcctgcaggtgcaagaagctatgtacgagcaacaacaattcctactgctatgccttcacatttctttaccggtttaacatcattgactacgatacaccttgacaactacctttacgaaccatgggagatcctagggagcttcatggtaggatcttctttgataactttgtcaaccaacactgctaatatcaaaggcaaattcccaggtctattagaccctgaaactgtcccatcctttactgcactttattcggctctaaacaaacttgaaggagaattgcctgctgagttctctggttcaatgattcagtctatatgggtaaatgggcaaagtttgaatggcacaattgaagggatacaaaacatgacttctttgacagatgtattgtcacatgagaa

SEQ ID NO: 10525 - DNA, 531 bp, Gossypium hirsutum
  Clone ID: uC-gsflmaxxa048h03b1
cttgcttctcggtgaagaggaaagcaaagataattctttaatggcagtcgacggtgactctcctccgcattacaatgacgactgttcaacgtctcctttcaggaaatctccatggtcgtctcacgaatccactcatttatatgcttcggctgttgaagacaccaacaacgtcactcctaacgtgctcatgggttcgttggtacgtgaagaagggcatatatattccttggctgcctctggggatttgttatacacgggttcccatagcaagaacattagagtttggaggaaccagaaggagttttctgggtttaaatccaacagtggattggttaaaaccatagtcattgctggagagaagatctttacgggtcatcaagatgggaagattcgggtttggaagattgctaacaaaaactcaggtgttcataaacgagttggtacattaccagcttttaaagattatttaataagctccatgaagccaagtagttatgttgaagtgaacagcaatcgtaaggccgtatggct

SEQ ID NO: 10526 - DNA, 520 bp, Gossypium hirsutum
  Clone ID: uC-gsflmaxxa048h05b1
ttttatattttctatatttaaatacataaaacagtattgtcgagtctattctcacaatataataaaaggggtaatatttaccataatcctctcttttatttgtaaattaaatctaaaatttcactgctaaccctcccttttctgcgaatctcggtcgctcctttggctgttctgtccatggcgattgcagcggcagctgttatcgtcccattgggccttcttttcttcatctccggcctcgctgtgaatctcattcaggcagtatgctttgttcttattcgaccactgtccaagaacacatatagaaagatcaatagggtattggcagagttgttgtggctgcaactagtttggctggttgattggtgggcaggcgttaagattgaagtgttcgcagatcatgaaagcttcaatttaatgggtaaggaacatgcccttgtcatatgcaatcacagaagtgatattgattggttagctggatgggttctagcacagatgtcaggttgtcttgcagtacatt

SEQ ID NO: 10527 - DNA, 56 bp, Gossypium hirsutum
  Clone ID: uC-gsflmaxxa048h06b1
cccacgcgtccggcatgctaatatatatgattttctttgttatataaatttctgct

SEQ ID NO: 10528 - DNA, 539 bp, Gossypium hirsutum
  Clone ID: uC-gsflmaxxa048h07b1
tattaaaatgtcgaatcccggagaacccttacgtatgtcgtcggactatcccggcaccggaggagcctctgaacggcaacaagagccggacggcgatgccgatctacgtgttccactccaaaatctctcgacggtgaaaagaaggatggactctctacaagatttcctctctcaatcggtcaacaccaacactttgatctccaaagatcaaatggaccacgtttcctccgaaatcgtcaacgccgtccaccaaactatcatcaacggtgccgctcttctctcttgtgcccaaatccattaccgtaatctggctccggttctaaacctgacaccagaaacaaaacccgagttcgaagattacgatggaggagagtccgaggtaatcgaattagacgccgtcgaattgctttcggaacatttacatttctgcgaaatttgcgggaaaggtttcaaacgtgatgcgaatctacggatgcatatgagggctcacggagatcagtacaaaactccagaagcgttggcgaagaaaccggaagtaa

SEQ ID NO: 10529 - DNA, 488 bp, Gossypium hirsutum
  Clone ID: uC-gsflmaxxa048h08b1
ttgtgcaaaggggggctctgagattttgcttgcttgttcgattttttttcccaatttttcctgcttaagttaagcttgatcttgatgactatcaattcattttctcttatgatgattgactaaagctaaaaggaaaaaaaagatcacataccaaaatggtgaaagccgttgccgtccttagcagcaatgaaggtgttagcggaactgttttcttctcccaagaaggagatggtccaactaccgtgactgggaacctttctggtcttaaggccggactccatggcttccatgttcatgcccttggtgacataactaacaggtgcatgtcaactggaccccactgtaatactgattgaaaatataatggtacattgccaaattataactggcacactggtgatctatgaaatgtcacttttggtgactgatgctgtgctacatgatacatgcttacaagcactttccactcacatgccccaactccatta

SEQ ID NO: 10530 - DNA, 520 bp, Gossypium hirsutum
  Clone ID: uC-gsflmaxxa048h10b1
cccacgcgtccgtttcatctttatttcagaatttgcttcctttccttcttccattattttctctcgtcaaagttctcaacttttaactctttttcaggatgggcagtactgatggaaccagctatggtgcttacacctatgatgctctggagagggagccttactggccatctcagaaactccggatttccatcactggtgccggtgggttcattgcttcccacattgctcgacgtctgaagagtgaaggccattacatcattgcttctgactggaagaagaacgagcacatgacagaagatatgttttgtaatgaattccacctcgttgatcttcgagtcatggagaattgcttgaaagtttccaaaggagtggaccatgtcttcaacctcgctgccgatatgggtgggattgggtttcattcagtcaaaccactctgtcattatgtacaacaacactatgatcagtttcaacatgcttgaggctgctaggattagtggagttaagaggttcttctatg

SEQ ID NO: 10531 - DNA, 505 bp, Gossypium hirsutum
  Clone ID: uC-gsflmaxxa048h11b1
ttgacgcgtgggctcgtcttaatttctctctctacaatatctccgtgaagctaaattctgggttttgttcggttgattgatcgtggaaagatctgttcgtttccaaattttgaatcagagagaaaaaaatcatttttgtataaaataaaggaaaaaaaagatgtttgagaatggaaagctatttattggtgggatatcttgggacaccaatgaagggcatctcaaggagtatttcaatacttttggtgaagtaatagaggcagtgatcatgaaggatcggaccactgggcgtgctcgtggtttcggtttcgttgttttcgctgaccccatcgttgccgagagagtaatcaaggagaaacacagcattgatggcaggatggttgaagcaaaaaaggcggttcctagggatgaccagaacgttatgagtagaagcactagtagcatccatggttcacctggtccaagcaacacaagacagattttcgtaggaggtttagcatctaca

SEQ ID NO: 10532 - DNA, 341 bp, Gossypium hirsutum
  Clone ID: uC-gsflmaxxa049a02b1
cccacgcgtccgatacccaactattgaactccccatttattccttttttccccctccgccattgtttctgattttgcagtcgagtcgaatcgcgcagtgtcaacgaacatctgcaacattttacgctatggcacccataaagggcatcctttccttgcaaagggcagcaatgttcagagccagcagtgagaggtggaaactaggcattagatcatttagtactcaaggagcaacaactgctggtgctccacaggcatcccctccaccaccacccgaaaaaacccattttggtggtttaaaagatgaagatcgtattttcaccaacttatatgggttgcatg

SEQ ID NO: 10533 - DNA, 339 bp, Gossypium hirsutum
  Clone ID: uC-gsflmaxxa049a07b1
tcgttagggaggctcagacgggagccttgaacttcacatttctctttcaagttttagggtttctatccttgttttctctctaaatttcagctgtcctcaagaatacgcttattttgctgcagatcgtctaattttctaggacatggactcgtttgagcaggatggaaatggggcggcacctgactctctgcctccacccccacctgtgcctcctgatgtggtgcctatcaaagcacaacctgaacctgcaaagaagaaggttgtgcgagtcccaatggccaggcgtggtcttggatctaaagggcagaagataactcttctcaccaatcacttcaaagt

SEQ ID NO: 10534 - DNA, 334 bp, Gossypium hirsutum
  Clone ID: uC-gsflmaxxa049a09b1
tcttttacgcgtccgcccacgcgttcggaggaatccaggaacaagcttttgcaagaaaatcagcagcttaatgaaaatatatctagcatgcagttacattattcaaaacctcgagaggaacagttcctccaattcccaatcagaagacgttgaaaagcaagcttctggcaatgaggacctgaaatttcatattgaagcagcaaatgtgtttgctcgacaaactgttgatggataacgctgagcttgttgagaaggcgaatgtgttgtatgccatgcttgaacaacaaagtaagggcgcagaacattccaaggttattgaaacgactaattctgt

SEQ ID NO: 10535 - DNA, 343 bp, Gossypium hirsutum
  Clone ID: uC-gsflmaxxa049a10b1
tccacgcgtccgcccacgcgtccggaggaatccaggaacaagcttttgcaagaaaatcagcagcttaatgaaaatatatctagcatgcagttacatattcaaaaccttgagaggaacagtacctccaattcccaatcagaagacgttgaaaagcaagcttctggcaatgaggacctgaaatctcagattgaagcagcaaatgtgtttgtcgacaaactgatgatggagaacgctgagcttgttgagaaggtgaatgtgttgtatgccatgcttgagcaacaaagtaaggcagcagaacattccaaggtcattgaaacgactaattctgtgcctcgatcccttg

SEQ ID NO: 10536 - DNA, 343 bp, Gossypium hirsutum
  Clone ID: uC-gsflmaxxa049a11b1
tttcccatttctcccctaaatcgaacgttgtttttactttcctaaaagaagatggggatcaaacgttctatcctcctcatctccatcttctccctcgcagctatctcagcttgtgctagacctccttcagacattactgatacgcccgagtcacccgattccacacccgaatcacctgattccacacccgaatcacctgattccacacccgaatcacctgatgatgactattcacctaatgcaccagatgaagcagcagacggttatgcacctccacctgaagcaccaaccccatctgcaacctttacaatattgccaggcggtagttaccctgagctcgatc

SEQ ID NO: 10537 - DNA, 337 bp, Gossypium hirsutum
  Clone ID: uC-gsflmaxxa049b01b1
ttctcgcgtccgcgatttttctttcaaaacttcttctgaatcgtttcactttctttagttttgaagctttcttccttcctttcctcatctcttggcatttcttagtctggttcgtgcaaccgatcatatcttctttgatctttggcatactcagggacctccatttctaggttaacctcctcttttctaaaatttgggagtttaaacctaaaaatcttgcattaaaaatgcttaaattaaattatcaatttttaaaagggttaaaattatatatatatttcatttaaccaaaggtgaaaaattactaaattgattttttttttttaaatttgtggag

SEQ ID NO: 10538 - DNA, 337 bp, Gossypium hirsutum
  Clone ID: uC-gsflmaxxa049b03b1
gtcagagctcactgctcactctctttaactttcgttcatctccattattgtttcagatcgtaaaatcaaaaccaaattttcgtttaatttatacatataaacacccaaaaacaaaaagggcataaaaaaaggagattcaatggggatcttctccttcaatgccatagctttggccttcttattagccattatctctggcgccgtcaatgcttgcccttcttccgaccgagaagcattgctagctttaagttcatcgttaaaggagccttatttaggcatcttcgattcatggaaaggcaccgattgttgttccaactggtacggtattagctgtgac

SEQ ID NO: 10539 - DNA, 340 bp, Gossypium hirsutum
  Clone ID: uC-gsflmaxxa049b05b1
ttttagtcctcaaaatcatcccctttcttctcctctcttcttcctactccccacccccaccgagatttcgccctcgctgattctctacaccgcaaatccgaatcatttcaacttttaccgtacgccccgaagcttttgaatgttgcttctgtgacaaaatattctaatataaggactgatactgtgaatgggattgacaatggagttgaataacctgaaggatgcatttgatcgtgtagcaaagaagcaaaagctgtcctgctctaaagtgcaggaagttatggatcagattgtacaagaaatcgagaaggcaatagaaatgatgcagtcaaccaccctt

SEQ ID NO: 10540 - DNA, 343 bp, Gossypium hirsutum
  Clone ID: uC-gsflmaxxa049b06b1
ccttttcgtccggtttcttctggttggatgagaccctttattctctgatccttctatctgttgctgtgtccctattttttctgcttgcacgagactcctggtttacgtgatcctcctcctttttatctgttgctccgtgaatcgttttcttggatcacccaaaggattttcctttaaatagattgagctagtgaggttggtagagtaatttaaccaaaacccattatggacaaaggagagttgtttcatattgcgagctctgtttttggtagtataagcttttggaggatttttgcagagatctgacatgtgtggggagaaccaattgttgttgagattggac

SEQ ID NO: 10541 - DNA, 296 bp, Gossypium hirsutum
  Clone ID: uC-gsflmaxxa049b07b1
ttctccacgcctccggggccacgtctgcatggagcacagttgcaagtcttgtgactgcgctgaggttaatccacgccaagagcagactcagttccagcatcatggtgcgcaatccccgacagctatggtatacctatctttatatatcgtgtcccgactcctacctactgagagcgttgtgcaacacaacatattattggccgtctctgggatatcgacctccgaacttgcggttccaactgtagctatgcagcttactaatcagtccctttctataactgtacactggatcttcc

SEQ ID NO: 10542 - DNA, 272 bp, Gossypium hirsutum
  Clone ID: uC-gsflmaxxa049b08b1
tttttgctaccactagagctcttgttgttctgagaaaggttattgtcattccctatggcctaaaatcccatggtgttctatgacctgacgattggcggttatccctgtgctccgattgggtttgatgtattaggaaatcgcgctcctcgcactgcggatacctttctcgccctctttactgcttagaaaggtttctggcgcagcggttagctcctccactacaaatgctgcggtattacattgtgggatccctaactttatgtgccctggtg

SEQ ID NO: 10543 - DNA, 340 bp, Gossypium hirsutum
  Clone ID: uC-gsflmaxxa049b09b1
tcgttggaagtctcgctcgaaaactccggattctggaacatctgccccaccctttccgtatatataattaaaccctgacgaaacttcaagacccgactgacgattcaactctacgacgcacttttgcctgagccagagtaaggttttttcttttttgttattgaatggcaataatctccgagttccaagaagacgaggctaaaaagccctcgccttcttcgtcgccggcttctaaaccgctgctgtttagcgccactttggatccgtcgaaccctgttgtgtttttggagaaagttttcgatttcattgggaaagagagtgattttctagtgaaagagaa

SEQ ID NO: 10544 - DNA, 342 bp, Gossypium hirsutum
  Clone ID: uC-gsflmaxxa049b12b1
tcgtcttcttcaaaacctaacataaaaccctaattcttaatctttaacattctctttcaatagcgttatctttcctttggctactgacccctctttcgtatttacgctcctatcctgtctaagctctgccatacgcaacgaaattggaaattccacttccaaacggtgtcatgttggacagttccgtgggctttgcactgcaagctatggttgtcgtgaccgacattgttgaaacaaattcagtcccttggttgctgatgatgatgggaactatgcctaatggaattgatgccctcattaaagagcctgtagcatatgcagggtttcttgtttgctcttttt

SEQ ID NO: 10545 - DNA, 339 bp, Gossypium hirsutum
  Clone ID: uC-gsflmaxxa049c01b1
gtctcattcatacaaagtaatttgaccaaacaatgcaacagaacattgacagttaagaagcgaatgaagaagcctatctatgtctactaccaactggacaatttctaccagaatcatcggaggtatgtgaagagccgaagtgactcacagttgaaagaaaatagcagttgggatgatgttagttcttgtaagcctgaagatatgtctaatgaccagccaattgttccctgtggtcttatagcttggagtttatttaatgatacctataatttctccctcaacaatcagcaattggcggtgaacaagaagggcatctcctggaaaagtgatagggacagt

SEQ ID NO: 10546 - DNA, 339 bp, Gossypium hirsutum
  Clone ID: uC-gsflmaxxa049c03b1
gttcgacatcttcctgctggtagcccagcaacattttattgcattcacagtcttgttgataaagctaataacctcctcagtgatgcgaatgctttaaaggccgatgactggaaaaactggcaaggggggccagagccttgtaaaaaaatcctcgagctgctttcacgtcttatttctctagttgatatacaggtattaccgactctaatgaagttgctagcacagttaattatccaactgccaaaaacaggccagaccatggttcttaatgagttatatgcccaggtcgctgaatcagatgatgtcactcggaaaccaactttagtttcatggttgcag

SEQ ID NO: 10547 - DNA, 337 bp, Gossypium hirsutum
  Clone ID: uC-gsflmaxxa049c04b1
ttctttagtagctgggaattgtggaagaggaagtggttatgattatgggaggtttgcatccaggtcaaatttatatcttgggaaagattttttggcttgagacttgtgtaataataattcattttgaagaagagcaaatgggtgtttgtcaaaagctttaaaaggtttctagaatggaaacgggaggaggttctgggttattgcgagagttaagaaagggaagaagcatgattacccttggccggataatattgacctggatatcaaagacgggcacttgacttacttgtgtcatttcaagcctttggctgagaaaccgaaaccggtgaccttacca

SEQ ID NO: 10548 - DNA, 341 bp, Gossypium hirsutum
  Clone ID: uC-gsflmaxxa049c05b1
atcttcgtcaccctttggtaatgcggggatggtgcctcctcctatgcctggaaaccctgcattctcacaagctcaactcagcgctggttttcaagctcagtatcagctatcccaagctcaggcccttgctcaggctcagtcgaaagctcaagctcaagctcaagctcaagctcatgcccaactccaagcacacttacaagcccaaggtttgtcccttaaccaggctcagaatgctggctttgggacattaggttcgtcttcaccctccatgtctactcctggcagtgcaagtgcaaagaggatccttcaaaggccccccatgcgccctcctggtgttccta

SEQ ID NO: 10549 - DNA, 340 bp, Gossypium hirsutum
  Clone ID: uC-gsflmaxxa049c06b1
ttccacgcgtccgtttcaggcttatgttcttcttttccatcggtgaagcctaataacagaatcggcggtgaactcagtccggttcgcaaagactcactcgcagtgtcgactcgttctaactcgagctttaaacactctgttgctcgtgaagtatctgctgatttgtcgaaaacgaatgatgtcgcgggtttgaagcaggctaagcaaggtggactcgagaaagatcctaaagcgctttggaggagatacgttgattggttgtaccagcataaggagctcgggttgtacctcgatgtgagtaggatcgggttctcggatgagttcgtttccgaaatggagc

SEQ ID NO: 10550 - DNA, 338 bp, Gossypium hirsutum
  Clone ID: uC-gsflmaxxa049c07b1
tctttgacgcgtgggtgagtgagagacactgcaagcctttactttaccaaacaccatggatgctgctgtgagctggtcgagaaccaaatgggtcttccattttatgcttatattcgcacatttctctcttctatcactagctgaagatggtctggtggccaatggggatttcgagacgccaccgtccggcggcttcccaagcgaggcaatatccgatggagcccccgagatccccagctggagcacgaacggtacggtgaagcttgtgtccgccggtgaaaaagtgagcggcgggatgctactcatcgtaccccgaggcaggcacgccgtcagattgg

SEQ ID NO: 10551 - DNA, 275 bp, Gossypium hirsutum
  Clone ID: uC-gsflmaxxa049c08b1
tttttgcgctgacttgaatgaagacaacatcaacggttcgtattacgtgggtgtctcttcactctggggttctacatagccaacatgtttggatgtcaccgacaacagcctatttaactcaatttgaactcttaatcctcttctatgatagtgccttcatccccagtaatttgtgaagatggaagaacaaaagttactttagtgcacatgaagcttgtacgttcttctgatatgaagaagctccaagatttcattggtatagccctgaacaccgg

SEQ ID NO: 10552 - DNA, 341 bp, Gossypium hirsutum
  Clone ID: uC-gsflmaxxa049c09b1
tctcttttccttcttcatcccgggacaaatcggcttcaggtcattccttgactgtccgagaaacaattacagttactcgggccgaaatcgaaggtgccaccgtatacgaagtcacagctgcaggaaatcatagatcaaaaatgggaatttgtttagcacttcattggcagatatggccaaccagtacattgctgttgacaaaatgttaaaggaatagacgaaacaagcaacatctatggcttaaactttggtgattttgttatagaggagaatgcttgattcttattaggaagatcagatctttatgtatcagattggcccatctactggttttagattta

SEQ ID NO: 10553 - DNA, 336 bp, Gossypium hirsutum
  Clone ID: uC-gsflmaxxa049c10b1
cggacgcgtgggcaaaagccaagtgttctttattgcttctacaatggataatacacccttaagtgcaatcaaactcacgtccttctagctattgcaatagcaatggtgccaactaagctaaggctcaatccattgatttagtttgtttttgaaaatgttgagattatattcccactgaatctggacagtactttctttattgaaagaaagagaaactggaactgtagtttcttgattgttcaagggaggaggggagggtgagcatctctgactttctttcagttagtgatcttttctactttgcacatctgtttgactttgtcctttctcagtatc

SEQ ID NO: 10554 - DNA, 340 bp, Gossypium hirsutum
  Clone ID: uC-gsflmaxxa049c11b1
tcttggacgcgtgggttttcattttcttgttccttccttcgccgtctattgctttttgttacctcgatttcaagtgaatcagaatgggtaaggaaaagactcacattaacattgtggttatcggccacgtcgattctgggaaatcaaccaccactggccacctgatttacaagcttggtggtattgacaagcgtgtgattgaaaggttcgagaaagaagctgctgagatgaacaagaggtcattcaagtatgcttgggtgcttgacaagctcaaggctgagcgtgagcgtggtatcaccattgatattgccttgtggaaatttgagaccacgaaatacta

SEQ ID NO: 10555 - DNA, 335 bp, Gossypium hirsutum
  Clone ID: uC-gsflmaxxa049d04b1
tttggggatagtaaaataaagtacaaaaaagaaaaattgtgttttccgttggcttttaggttgtgaattgtggatcgacgccgtcaacgatgggattaggtttcatggtcggcgttttgggggttctattcctcttccacgcagcttattccacaattcagtatagggggctattgaagattatggaggaggagttttctggtccgcccatgaacgtggttttagagttgcttctagggtttgttttctgtatttcagctgctctaaccgtgcccgggaattttctctccatacatcctgattctgaggagaataggattgtttctttatcagca

SEQ ID NO: 10556 - DNA, 319 bp, Gossypium hirsutum
  Clone ID: uC-gsflmaxxa049d06b1
aaaaaacataaaatatggtaaatgttcctttcgttgtgttctcatttgctttggtgctctcaatccaattcgtagtgggacatgatgagaaggctttagatgaggcagcatcccctgaagccgaagatgcacttttgagttcaggggtagctcaacttgttgaaaactttaaaagctctgctggagataattcccaaagtgtggatgggccaacttctggcttagctgatgagattgcagctactccagaatcggatgtagaagttgctactgaatatgccgatgggccaacttctggcttagctgatgagattgcagt

SEQ ID NO: 10557 - DNA, 340 bp, Gossypium hirsutum
  Clone ID: uC-gsflmaxxa049d07b1
tcgattccttctgtcattttgggttttactcttcttctttttttttgtgaaatcaagatggatcttgatctttctccaaagctggcaaagaaagtgtacggtgacgatgctggaagctactacgcatggtgccccgatgaacttcctatgttgcgtcaaggcaacattggtgcagccaagttggcccttgagaagaatggctttgccctccctctttactctgattcttccaaggttgcttatgtccttcaaggggctggtgttgctgggattattctccctgaatcagaggagaaagtgattgcaatcaagaagggtgatgcaattgctcttccatttg

SEQ ID NO: 10558 - DNA, 339 bp, Gossypium hirsutum
  Clone ID: uC-gsflmaxxa049d08b1
ttaagcaaccctatccattgatctgtggccatgtttaaattgacagaaagggcatctccttcaacttcgatcactacaaaccccagatccatgcccaactgtatactttgaacgcatgcaagagcctccgccgctaacaccaaggtttattttcacaaatgggttcttcggtggccgccacttttccagctctattttttaacaggtaaaccagtccataaactccatgtataatactgaatctggccaaatccaattcaattgatgccatatttcttttgtcatcggacaatcacgcgaatcatgttctcaggattccacctttcctgcgcatcttgg

SEQ ID NO: 10559 - DNA, 338 bp, Gossypium hirsutum
  Clone ID: uC-gsflmaxxa049d09b1
gacttcatcaccacttcagttcttcccctggatgtcaccctctcctggtataggatcccctttcccatggctatgggagctcaaacctgaggagaggggtttatggttgattcgtcttcttgttgcatgtgcaaaccatgtagctgctggtagtcttgagaatgccaatattggcttagagcaaatatcccaccttgcttctcccgatggagataccatgcaaagaattgctgcttacttcactgaggcacttgctaatagaatgcttaaagcatggcctggccttcacaaagccctcaattccacgaaaatatcatcggtacccgacgaaattcttg

SEQ ID NO: 10560 - DNA, 335 bp, Gossypium hirsutum
  Clone ID: uC-gsflmaxxa049d10b1
cccacgcgtccgcacactttccagcgtcttacctccgatcaggttagcttccttcccatcattcgaaacttaaatcctcaaatatatctatccaatccattgtttctcaattcttcggcgattctctctcaccctaggtctcttttcaatgttttcctgtgattctattttagccttgggtatccacaggccaaaaaaacacacgctatagtaggaagagagttttcgtgagagagaaaccctatgttttctctggcgtttctggtttttgtgatttttgaaattcgctgcttaaacggagactcatttcaggatgtttgggagtatgattcggt

SEQ ID NO: 10561 - DNA, 83 bp, Gossypium hirsutum
  Clone ID: uC-gsflmaxxa049d11b1
tctttcacgcgtccgggtatatgtcagaagctgtggttcctgtccggttcttggtggacgaaaccgcgccgtcggtgagaatt

SEQ ID NO: 10562 - DNA, 294 bp, Gossypium hirsutum
  Clone ID: uC-gsflmaxxa049e02b1
aaggccgaagaggggaaaggttccatgtgaacggttcttgcacatgggttagtctgttcctaagagacgggggaagcccgtccgacagcgcgttcagcgcgagctttgaaagggaatcgggttaaaattcctgaaccgggacgcggcggctgacggcaacgtttgggagtccggagacgtcggtgggggcctcgggaagagttatcttttctgtttaacggcctgcccaccctggaaacggctcagccggaggtagggtccagcggccggaagagcaccgtacgttgcgtggtg

SEQ ID NO: 10563 - DNA, 344 bp, Gossypium hirsutum
  Clone ID: uC-gsflmaxxa049e03b1
tttttgcgtccggatcattgtagcttttcaaacttcaattgtccatggcgttgtcaaattccctttcctttccttcttctaacgccgtcgacctccgacgttccacggttcccgattccggcttcgtcccttttttcacttcttttgactgttctagattccgttgcaacttttctcagtgcggcattaggcccaatttctctgcaagaaaacgcattgtttttgctgctaacaatggtttcaacacggttaattcaacttcattggggactggccaagataaagatgattatattccaatgccaattgtttcgattgatcaagattcatattcagaagcaaca

SEQ ID NO: 10564 - DNA, 241 bp, Gossypium hirsutum
  Clone ID: uC-gsflmaxxa049e04b1
tccttgcgtacgcccacgcgtccgaccacgcgtccgctttcgcgtgggctgacggtgaaaagcaagatgctataaacttatttttgggctactttcaaccacaggaaggaaaacctgcttctttgggagttggattctgattactatcttcatgattttggcgcaggagatgacctattccctgattaagtgcgcggaggacaatgttaagcctttgggagatcgtgggaaagtatccttg

SEQ ID NO: 10565 - DNA, 104 bp, Gossypium hirsutum
  Clone ID: uC-gsflmaxxa049e05b1
accccccccgccgtctttaaagttcagagaaacgcaaacaggaacgtcgatttctcttttacctcgccaattaaaacttgctaaaagaaagggcttacaaaaac

SEQ ID NO: 10566 - DNA, 336 bp, Gossypium hirsutum
  Clone ID: uC-gsflmaxxa049e06b1
ttttatacggggccagtgggttacccttaattttggtcaacaaatgttgcaacagcaggagaggacaatgctggctggctgctctatacccccccaatgaagtgatctgaaactgaagcaagcggttgttcaagttcaactcagacacaccttccacttgctgcaataacttacgtccacgtttattctactctgcgtgcactcaaaccttttgagataattgctcaccatattagttgtgcacaaccccatttttctttttcttattccttttatccaaatcttattctcagcttattaatcattcattcgatttgcacatgagaaatcggatta

SEQ ID NO: 10567 - DNA, 335 bp, Gossypium hirsutum
  Clone ID: uC-gsflmaxxa049e07b1
tctttaagaaacaacaatgtttacagtcgagagtttcagtcgatgttagaaggattcgatgaataaggttgttttgaagaattaacagtcggccttggcgggggtgccaagaagagacgattaagtgtggatcaagtgaaggcattggagaagaattttgaagttgaaaacaaactcgaacccgacagaaaatcgaaactagctcaagaacttgggttgcagtcacgacaagttgctgtctggtttcaaaaccgacgtgctagatggaaaacaaagcaattggaaagagattatggagttcttaagaccagttatgaatcttttaagctcaatta

SEQ ID NO: 10568 - DNA, 344 bp, Gossypium hirsutum
  Clone ID: uC-gsflmaxxa049e08b1
tcttccacgcgtccggttgctgttattttctttgttactattctcttagtattatcaactctctgatgtaggagccaatgattaacacatatgccagatttagagatgatgttcttccccgtattaaaagacttgggtacaatgctattcagatcatggctattcaagagcactcatattatgctagcttcgagtattacctccatcgtaatattagctcaaatctatttgtttctgtgtatgtttgtaagtttgtaaacttgtactaactgctatgtggcagatataagtagacacatttttctacttaaaacaagttgcatttaatattttacaggtaccat

SEQ ID NO: 10569 - DNA, 333 bp, Gossypium hirsutum
  Clone ID: uC-gsflmaxxa049e10b1
tttgaaaacaggtatagctcgtataatagtgcagccatcgacgaagcgcatccatcacgattccctctacgaggatgttggttgtcacatatcagatgacttatcagaatgtggtcttattttgggtatcaagcaaccaaagttagacatgattcttcctaatagagcttatgccttcttctcacatactcacaaagctcagaaggagaatatgccattattggataagatcctcgcggagagggtatcgttgtatgactatgagcttattgttggggacaatggtaaaaggttacttgcatttggcaaatatgctggcagagcaggaatgat

SEQ ID NO: 10570 - DNA, 262 bp, Gossypium hirsutum
  Clone ID: uC-gsflmaxxa049e11b1
tctttaaagttttgtgaaacgcaaaaaggaaagttgatttcttttttattttgttttttaaaacttgctaaaagaaagggtttaaaaaaaagagtaatttttggcttggtttttctcttttctttttctttgtatttatgtttatgttggctgccttttttgggcatgcttttgaatggaggggagtgggatcaaagggaaggatttgattgaggagatttttgggcggtaatggtggtagcttgagagctagggttttttg

SEQ ID NO: 10571 - DNA, 343 bp, Gossypium hirsutum
  Clone ID: uC-gsflmaxxa049f01b1
ctcttctcttatagaagccactacatttttatatcacccagaaggacaaaagaaaaaaaatggtacaggcagccaaatctatggtttttcttgcatttgttctacttttcttcccttcatctggggtagctgatccattgacttataacgttcttaactatggagccaaacccgatgacaattttgactcaacccaagccttggttgctgcatggactttggcctgtggctccatcaatcccgcaactatttacgtcccgcctgggaggtttttggtgcgcaatgttgtttttcgtggacagtgcaagaacaatggtattgtttttcgtatcgatggcacgct

SEQ ID NO: 10572 - DNA, 344 bp, Gossypium hirsutum
  Clone ID: uC-gsflmaxxa049f02b1
gtatgcgccaaacatcccattggaaaagggaggtcagtgaaaggccatcaactaccaaaaaacaaagttcatataaatataaatattttgcgattcaaatctaaaagctcaggcaccaaattggcaatggcatctactgaacaagaagtcccatctggaattgcagctcctacggctgatgttgtgggtaatgcctttgttcatcaatactaccttatattacaccaatcccctgcactggttcaccgattttaccatgataacagcaaactcggtcgccctgaagaagatggcggcatgagtatcacaacaaccatgcaagccatcaatgagaagatactctt

SEQ ID NO: 10573 - DNA, 325 bp, Gossypium hirsutum
  Clone ID: uC-gsflmaxxa049f03b1
tttttcgcgtgggcggacgcgtgggggctttgcgagtgcattctataattaaaggagctgttgtggcgttctctgcataccgggattttaatgccttccccaggagactcacggagggctgtcagagaactggagtcaaactcatagatgtcccaaatggaaggaaggatgctgccgacaaggctattttggttgacatgttcttattcgccctggataaccccccacctttatttatcatgctgatttcgggggacgttgattgtgctccggctcttcacattcttggccaacgtggctatacaatcattcttgctattcctgc

SEQ ID NO: 10574 - DNA, 335 bp, Gossypium hirsutum
  Clone ID: uC-gsflmaxxa049f05b1
tccacgcgtccgcccacgcgtccgcttctccttgcttgaagggctgacagaggtcaatgtagtggtctggaacagcaatactttatctagtgatgacttaataggctatggaagaattcaattgcagaaggctatttctcaaggttatgatgatagttcttgggccattcaaaccaaaactggcagatttgcaggagaagtgcagctgatactgcattatcccaacgccaaacaccaagcctcaggaggatatagtcaaccgtcggcaccaccagcatatgcaccgccacctcatcaaccacctccatacggcggaccacctgttccagctcctt

SEQ ID NO: 10575 - DNA, 130 bp, Gossypium hirsutum
  Clone ID: uC-gsflmaxxa049f06b1
tccacgcgtccgaatatttgttacatgcccttggcgtccctttgatttccttatttttgggtgttcttttctctaagtatcatgtactttcttgggaatatcacatatatgctgtcttcagtttcttagt

SEQ ID NO: 10576 - DNA, 324 bp, Gossypium hirsutum
  Clone ID: uC-gsflmaxxa049f08b1
ttctttccagcggtcggatgagcaccggcgtgtcgtggtgtggcctgcgcccccggcagtcctcgaatatccggaggtccgagtgccgcgcgtgcccggtagtagttatggccccatcatgtctctgaggtgatacagactatggagaatgatacaatgtaggcatggctagtggtgatattggagccgatgccttaggtaatggattgtatcttagggctgagcacgggggtgcaatgtctgaacctgtatgctgtgggagcactgatctagctggtccctgggtgagagcgggtctgagtatgacgaccggtggacagactg

SEQ ID NO: 10577 - DNA, 345 bp, Gossypium hirsutum
  Clone ID: uC-gsflmaxxa049f09b1
tcgtctcactctctttaactttcgttcatctccattattgtttcagatcgtaaaatcaaaaccaaattttcgtttaatttatacatataaacacccaaaaacaaaaagggcataaaaaaaggagattcaatggggatcttctccttcaatgccatagctttggccttcttattagccattatctctggcgccgtcaatgcttgcccttcttccgaccgagaagcattgctagctttaagttcatcgttaaaggagccttatttaggcatcttcgattcatggaaaggcaccgattgttgttccaactggtacggtattagctgtgaccccaccactcaccgagtc

SEQ ID NO: 10578 - DNA, 334 bp, Gossypium hirsutum
  Clone ID: uC-gsflmaxxa049f10b1
tcgctttacgccacactctcattgtttctctgtggtaatggaaggctcagtcgaagatatggcgaaagcagtttccgatttagcattggattcgtctgctgccggtgaagctcagagcaaaaatgctcgtaagaaggaacttaaaaataagcagagggaagaggagcgtcaccgcaaggcggaggagaaagcagccaaacaggctgcagtcatggctggcacacacagtcagaaacatgcatccgctgaagacgaagatatggatcccacgcaattccacgagaacaggctgaaatttctcgcatcccaaaaggcagaggggaaaaatccatat

SEQ ID NO: 10579 - DNA, 353 bp, Gossypium hirsutum
  Clone ID: uC-gsflmaxxa049f11b1
tgggaccacgcggcctttttttcgtccgcccacgcgtccgctgctcttggcttgaagggctgacagaggtcaatgtatgggtctgggtctaaatttcttgatctagtgaggacctattacagctatggatgaattcaattgctgagggctattttttaaggttatgatgatagctcttgggccattcaaaccaaaactggcagatttgtaggagaagtgcagctgatactgctttatgccaacgccttacaccaagcctcaggaggatatagtcaaccgtcggcaccaccagcattatgcaccgacaccttattaaccaccttcatacgggggaccacctgtttcagctgctt

SEQ ID NO: 10580 - DNA, 345 bp, Gossypium hirsutum
  Clone ID: uC-gsflmaxxa049g03b1
tttttataaaaaatgtgcagcattctttgagagcaagccaaaaaaaaaggttcatggttgattgagttttggttcttcttcaacaaaacaaaaaacacaatccaaccccaatggctgtttctccttgtttgagtgttaatgatcaaaagaaacactggtggcttagcaaccgaaaggttgtggataagtacattaaagatgcgaggagtctgattgcaacccatgaacaaagcgagattgtttcggctttgaatctactcgatgcagcattggctatttcgcctcgtattgaggttgcccttgagctcaaagctagatctttgctgtacttgagacgatttaagg

SEQ ID NO: 10581 - DNA, 205 bp, Gossypium hirsutum
  Clone ID: uC-gsflmaxxa049g06b1
attctaattagtgaatcatatggacagcactgtggccctaaagctcgcttgtggagtggtcttgtgcttggatgtgggtgcacccttggctgtgggggccatcagatgtggacaactgatattaggcttgacaccctgcatcccttacgtgagaaacatcggtgctggtggcgtgcctgtatcttgctgcaatgggatcagatct

SEQ ID NO: 10582 - DNA, 347 bp, Gossypium hirsutum
  Clone ID: uC-gsflmaxxa049g07b1
tctttgaatttggagattttaagcttaccatatggggaatgctcggaacttatggctttgaaagaagaattctggatactgcaaaatctttgattgaggatgacacattttacacaatggagcttactgaagaatgggagccttctcattggattatgcaccatcgaagttcattatgttgtatatgcaacagccttcttaccaagacctcttctagctttcgtgttcgggttttcagttgtggtcacgcaactcatattcaatgtgagcttctggaaaacgagtcatcaactagaggcttgtcatctggatgccctgtttgtttgcccaagaaaaacactcacaga

SEQ ID NO: 10583 - DNA, 344 bp, Gossypium hirsutum
  Clone ID: uC-gsflmaxxa049g08b1
tcttatggaatttggagattttaagcttaccatattgggaatgctcggaacttatggctttgaaagaagaattctggatactgcaaaatctttgattgaggatgacacattttacacaatgagcttactgaagaagggagcttctcatggatatgcacctcgaagtttattatgttgtatatgcaacagccttcttaccaagacctcttctagctttcgtgttcgggttttcagttgtggtcacgcaactcatattcaatgtgagcttctggaaaacgagtcatcaactagaggcttgtcatctggatgccctgtttgtttgcccaagaaaaacactcacagat

SEQ ID NO: 10584 - DNA, 298 bp, Gossypium hirsutum
  Clone ID: uC-gsflmaxxa049g09b1
tcttacataaataggaaacctttattttcccttcctcttactctcttcctatccgattattctgcgcgctaacggatttacaatctgcctatgtgtcggactaacagtaatcacttgattgaatgcttgaaagcaaattgccacccaaagaagatacatcactgagttccatacttatcttccctctagatatactctttgggccttttaggaggagaattgggaggaggtcatgattacaggaactttgtatgaagcacgttgctcagaatttgctgggcaatgtttaaagggtcaa

SEQ ID NO: 10585 - DNA, 336 bp, Gossypium hirsutum
  Clone ID: uC-gsflmaxxa049g12b1
tcttcacgcgtccgcttcgttgaaaagggcgaggcagaatctgttaagcaaacaccaaattttcatcgtcgaaggggatttgaacgacggcccgttgttgacgaagctgttcgacgtcgtcccgttcactcatgtgcttcacttagcggcacaggccggtgtacggtacgccatgcaaaacccacagtcgtacgttaagtcgaacattgctgggtttgtgaacttacttgaagtagccaaagcggtgaatccacaaccggcgatcgtttgggcttcgtcgagctccgtttatggactcaacactgaaaacccattctccgaacgtgatagaactga

SEQ ID NO: 10586 - DNA, 333 bp, Gossypium hirsutum
  Clone ID: uC-gsflmaxxa049h02b1
gagaaagctaattgagctccatttccctagtaaacagagttctttttttcacagcaatggcagccatgaactccagtgttttggcatgcaactatgctatctcaggcactggatcatctgagcttaatcccaagcttgcttcagcaccatcagttgcttccccagttatgtgcggtggtcacaagttgcctgtgatcagagcccagcaggctaaattttctgattccaaaggatcaggtgccagtgaaggaagaagagctgctatgctctacttggcagctggccttttcaccacagctgttgcttcttctgcaaatgctggggtcattgact

SEQ ID NO: 10587 - DNA, 321 bp, Gossypium hirsutum
  Clone ID: uC-gsflmaxxa049h04b1
aataaaaaatataattttgagctcaatgatctatctttctgtcctttaatattttccattcatcgaagctatacagaaggaatctgaacataaagaagattcatatagctgagaaaagtatttgagaaaagtttaaaaaatgggtgtaacggagaatcattagcaccaccacccaccgtcgacacaagtggatgctccgccggctgctcctcctcctaattttgctctttcaaggggacctacttggactccagctgaacaactttatcaacttcaatactgcatccactccaattcttcttggcctaaagcacttttatt

SEQ ID NO: 10588 - DNA, 345 bp, Gossypium hirsutum
  Clone ID: uC-gsflmaxxa049h08b1
ttaacattgacgttgacttggattctgatggtttgcatctcccaagtagcggtgcagagccaatactactcagagagcttaccatatgatcccaggccggttaaggtcactaatcttcacttctttttgcacgaaactctccgcggtaagaacccaacagtagtcatggtagcccaagctaacaacacaagcaacgacaactactcatcagtgccatttggcaccctatatgccattgatgatcccctcaagataggtcctggggacaactcagaggtgattgggaatgctctgggacttgggatcttggccggcaaaaattcaacgaccgtggtgatgtactta

SEQ ID NO: 10589 - DNA, 233 bp, Gossypium hirsutum
  Clone ID: uC-gsflmaxxa049h09b1
tcttttacccatgcgggccatcaagggctgtaccctgtgttctagggacagagattgttagctcaccacccagggccataacctgggaagttcgacaaggggccgaatactgactatgatcggattgtggacatttgaggatagtctcctgagcatgctacataaagttttggcgaaatggaatcagaacactcgacgaacaacaggctacctccggactctacagacctttg

SEQ ID NO: 10590 - DNA, 340 bp, Gossypium hirsutum
  Clone ID: uC-gsflmaxxa049h10b1
tcttaaagaaataaaggtagaagaagcaatggccactcttacagtgcccacgacagttccttcagtgtctgaagattgtgaacaactaagaaaagccttttcaggatggggaactaatgagggcttaatcatagatatattgggtcacagaaatgcggagcaacgaaacttgattcgaaaaacctacgctgaaacctatggagaggatctcctcaaggcactagacaaggaactctcgaatgactttgagaggctggttctgctttgggctcttgatcctgctgaacgtgatgcccttttggctaatgaagccaccaaaaggtggacttcaagcaatcat

SEQ ID NO: 10591 - DNA, 335 bp, Gossypium hirsutum
  Clone ID: uC-gsflmaxxa049h11b1
gtcttgggcctcaacgatcactgccacgtgttggatttatgatagtccgtcgtatcggagcgttaatcctccggcgtatttcccaacttccccttccagatcgtaccttattccattcatccgcagcttcaaatcgcaggttctcaaaccatttcgtcgacgatgacgaaggaggtagcgcgatttaccggcttgcgcttaaattccagcggccgacgactgtggaagtggagccttcatcgcggaaccgcatcagcttaataggaacagtggacgagcctctcaaagttatgaataccaggagcgataactttggggttcagactcgcctcaat

SEQ ID NO: 10592 - DNA, 333 bp, Gossypium hirsutum
  Clone ID: uC-gsflmaxxa049h12b1
ttcttgggcctcaacgatcactgccacgtgttggatttatgatagtccgtcgtatcggagcgttaatcctccggcgtatttcccaacttccccttccagatcgtaccttattccattcatccgcagcttcaaatcgcaggttctcaaaccatttcgtcgacgatgacgaaggaggtagcgcgatttaccggcttgcgcttaaattccagcggccgacgactgtggaagtggagccttcatcgcggaaccgcatcagcttaataggaacagtggacgagcctctcaaagttatgaataccaggagcgataactttggggttcagactcgcctca

SEQ ID NO: 10593 - DNA, 51 bp, Gossypium hirsutum
  Clone ID: uC-gsflmaxxa051b05b1
tctttctgttccaataccatcaggtaatagcgccaccggtgctattgaagg

SEQ ID NO: 10594 - DNA, 539 bp, Gossypium hirsutum
  Clone ID: uC-gsflmaxxa051c03b1
tcttaaaaatatagtaatttctagatactcacaaaacaagtctctgtagctttaacaagaaatggcgaaagaattcacggtgccgtctgttgtttttttttcttttttgttttttcttcttttttttttttattttttctcttttttttttctttctttttcttttccttttttttctcttttttttttcctttttttttttactttttatttttttttttttctttttcttttctctctttttttctttttttttttttatttctcctttttctttttttttttttttttcttttttttttcttttcctttttttcttctcttttcttttcttttttattttttctttatcttcttttttctttttcttttttttttttcttttcatcattttttccttcttctttttttcttttcttttcttttttttctatttttatttctttttcttttccttttctttttttttcttctttttttctcttttctttttttctcttttttttctttttttttttctttatttttttctctttttt

SEQ ID NO: 10595 - DNA, 509 bp, Gossypium hirsutum
  Clone ID: uC-gsflmaxxa051c08b1
attgtatgcaccttctcttagtatacaagaaaggcaacaaagaaaccccagaaaaatgagaactagcaaccatttgatagggttactaaacttcttaacatttttgttgtcaatagtaatattgggtggtggaatattttttatatttttttttttatatacttttttttaatatttttctttcttttttatattgttatttttttttctcttttttttcttattttcattattttctttctatctttttttttttttttctcttctattttttattttagttatttttttctttttttttttttctttattttttttatatattttatttctcctttatcttatgtattctattcttcatttttttttttatttttttttttttattaatttattcttcttccattatttctattttttattctttttttttctttattctttttcttttcttctttatttttattctactttttttacattttcttaatttttctctcttttatttt

SEQ ID NO: 10596 - DNA, 91 bp, Gossypium hirsutum
  Clone ID: uC-gsflmaxxa051c11b1
ttgctcttcctcatgccatcctccgtctagaccttgctggtcgtgatctcactgattttttgatgaagattattactgagagaggttatat

SEQ ID NO: 10597 - DNA, 149 bp, Gossypium hirsutum
  Clone ID: uC-gsflmaxxa051d04b1
tgttattcacaatttacccccaaataatgttgaagccacatgtttaccatcctcacaccaccaccaaaaccctagccttgccattgtataagccatatttccacggcactgtcctcgtcattttttctttaaacgtctgtcttttattg

SEQ ID NO: 10598 - DNA, 94 bp, Gossypium hirsutum
  Clone ID: uC-gsflmaxxa051d07b1
acgttactctctccctctttcatcgagatctccgctctctttttttttaaataacgtaccaaaaaatcccgatcccaatggcttttttcaattg

SEQ ID NO: 10599 - DNA, 179 bp, Gossypium hirsutum
  Clone ID: uC-gsflmaxxa051e08b1
tttctccccacccttttttttcctttcaacacctaacatacatgtttcattacgcaaaagccatctttatctgtttctcatgtgactctgaagcctgacaactttgttctttctttccttcaacatacccatgcttttaaaggggaatcatttagttttggtcaaatcctatggagtga

SEQ ID NO: 10600 - DNA, 438 bp, Gossypium hirsutum
  Clone ID: uC-gsflmaxxa051e11b1
tctttattgcaccgttattgatgcacctggacaccgtgactttatcaagaacatgattaccggtacctcacaggctgactgtgctgttctcattattgactcgaccactggtggttttgaagctggtatctctaaagatggtaagactcgtgagcatgctttgcttgcttttaccctcggagttaggcagatgatttgcttgtgtaacaagatttttcatcatctttaaattatctcattggtatggatttatttatttgttttttaatttctatttttctttttatgttctttttttttcatctttataacttattatttttttaattttatatatttatattttctattatttttatttaatatttattgtttatttttcttttttttactttttatttttttaattatattctttttcttcttttattttctttt

SEQ ID NO: 10601 - DNA, 157 bp, Gossypium hirsutum
  Clone ID: uC-gsflmaxxa051f03b1
ttgactcgtgggcgttcggagaacaaaatacagagaaagatgctcatgaaatgctcagttatgctcttgaacatggaatcaatgttctcgatacttttagcagcctacccaattcccatgaagaaagagatcagttttttaacttatatttacattt

SEQ ID NO: 10602 - DNA, 65 bp, Gossypium hirsutum
  Clone ID: uC-gsflmaxxa051f11b1
tgatcgaaaaaagagagatggcgtctgtaataaaatctgcaatcttaattctgtcggacattatt

SEQ ID NO: 10603 - DNA, 102 bp, Gossypium hirsutum
  Clone ID: uC-gsflmaxxa051g02b1
atcagtggaagagaaaccaaagaaaatggcactcctttgtgctttaacctcagtcatctttctcttcttcttcttttttagagaggactctcttagcctcca

SEQ ID NO: 10604 - DNA, 80 bp, Gossypium hirsutum
  Clone ID: uC-gsflmaxxa051g08b1
tctttttaattcccgttttctaatctttttgggaaatcggttgcaaaaaaatgtcctcttcttttaggaagatcttcctt

SEQ ID NO: 10605 - DNA, 127 bp, Gossypium hirsutum
  Clone ID: uC-gsflmaxxa051g09b1
atcgctcacgcgttcgttagcaatggcttcttctctagctcttaagaggctcgtctcattcaacatcctccctagctccttactcgtagccatcgctccattccatctcagacattttaacaccaac

SEQ ID NO: 10606 - DNA, 78 bp, Gossypium hirsutum
  Clone ID: uC-gsflmaxxa051g10b1
tccctaacccagaaaatagataaaatacccatcttttttttatcttctcttgcggatctaaacctgcttaccaaaatc

SEQ ID NO: 10607 - DNA, 108 bp, Gossypium hirsutum
  Clone ID: uC-gsflmaxxa051h01b1
ttatctcctcattctttacccggaacacaaataaacactaagaacaagacaatggcaccaaaagctgagaagaagccagctgagaagaagccagctgaggagaagaag

SEQ ID NO: 10608 - DNA, 106 bp, Gossypium hirsutum
  Clone ID: uC-gsflmaxxa051h03b1
ctcactcgtgcgaggcaatccgagatccttccctatctcacctatgttctgagcttgcgtgcgggcctaggacggatctatgaatctattcctttagcaacccctg

SEQ ID NO: 10609 - DNA, 230 bp, Gossypium hirsutum
  Clone ID: uC-gsflmaxxa051h04b1
tctttcgtcgccaccaccaccaccaccaccaccaccaccatcccattttctctttcatcttcaccgctcaaaatgtctcttcaccatttgctctttccccattctaacacttgcattctccactgcttcttcattagctgccactgcaaatgaccaaactttatacactcatcaagttgtgctctttacaccccaagctttcacccacgattccttcctttttcaaaaag

SEQ ID NO: 10610 - DNA, 253 bp, Gossypium hirsutum
  Clone ID: uC-gsflmaxxa051h05b1
gtgatacaaaggagattgtgcagactcctgagcaatgtggaaggctcacatttcccatttctttgaagcagcctgttccccatgagtccccgattcaatgctatattagaagagacagagcgatttctacatatttttcgttttactggtttttgcctctttgcgttatgattgtaatctttctcaatattatttatattatattcttttatttattatattttaccttttcttttttattttcttaaatttt

SEQ ID NO: 10611 - DNA, 350 bp, Gossypium hirsutum
  Clone ID: uC-gsflmaxxa051h09b1
tcgttactgactaataattttaagtaccaacaaccatcattcatgtaatgtacttgtttgtgggcatagcacgaatctatgaacattcctttagcaaccctgagctgtgtggtccttatttggggccttgcaaagatggggttgctaaaggaacacatgaaactcatgttaaaggtggactctctgcatctttgaagcttttgctcgtaataggcctgcttgtcttctccatcttgttcgcagtcgcagctataatcaaagcacggtccttgaagaaagcgagcgatgctcgggctaggaagttaaccgcgttccagcgcttggaatttacttgtgatgatgttcttgga

SEQ ID NO: 10612 - DNA, 148 bp, Gossypium hirsutum
  Clone ID: uC-gsflmaxxa051h10b1
atctttccgccgttagtaaaagcttggaagaagactaacgtgtttcaaaaaatgggccccaagttatgtggaaaggattccttttatccaacaattctactttctatcaatcttatattctttttttatactattattatattacttt

SEQ ID NO: 10613 - DNA, 90 bp, Gossypium hirsutum
  Clone ID: uC-gsflmaxxa051h11b1
cttgtaagtgtagatcgaggccaattcaggaatcctgtcattcaatgaagctgaagattccatgaagaatgttattcgcaatcatataag

SEQ ID NO: 10614 - DNA, 230 bp, Gossypium hirsutum
  Clone ID: uC-gsflmaxxa052a07b1
tctgtttaaaacaactggcagaaatctggcttgccagtgtcatcggttcagcgaggatttaataagttgtttcttctttttacttattatcctttttttttttctttttctttttcttctcttcccctcctttttcttatactttctttttttctttctctttctttttctttttttttttccttcccttacttttctttctttcttttttttcttttttttctcttctc

SEQ ID NO: 10615 - DNA, 77 bp, Gossypium hirsutum
  Clone ID: uC-gsflmaxxa052a11b1
tttggacgcgtgggcgggcgaatcaggaagctagttgcagaacatagagattctgatatctcgagagtggagctact

SEQ ID NO: 10616 - DNA, 495 bp, Gossypium hirsutum
  Clone ID: uC-gsflmaxxa052a12b1
tccacgcgtccgcccacgcgtacgtttttttcactgtgcatatgaaaaagatgaagattttttaagatctatttgttcttaattattactttattttattttattttctttatattttattatattatttatttttactatattaatattactatttttttttttttttctaatatattcattatttatttcttttaatttataatttttttaatatatatttattttttatttttttatttttattatttatattttttttttatattttattttttattttttttttttattaatttatattatttttatatttattattatttatttattttatttttttttttttttatactactattttttttttataatcttctatatttttaatatatttttatttgtttcaatattttttttatttatgtttattttttattttttaaatttttcatatttatctatcttattttaaatttacttaaaatttattat

SEQ ID NO: 10617 - DNA, 200 bp, Gossypium hirsutum
  Clone ID: uC-gsflmaxxa052b09b1
tcgatcaacaccaaaattacatcagggaataaattcataggccaccatgactcgctcgttcaactttctacccatgctcctcttgcttactttatcagccctgactgtccaagaaatttcagctgcaccttcctgcactgaagttgccatagaattactctcatgccttagctacctgtctggtatcggtgctgcacatc

SEQ ID NO: 10618 - DNA, 101 bp, Gossypium hirsutum
  Clone ID: uC-gsflmaxxa052c05b1
gatataccaacacagccggcagttattcccagtgacacccatattatgcgatatggtgaagatacaattaataaacaagtcacattttgtgacctttttag

SEQ ID NO: 10619 - DNA, 270 bp, Gossypium hirsutum
  Clone ID: uC-gsflmaxxa052c08b1
ggggatcacaagattactaatggacacattgctttattcttgatcaaccgatttaaggctgctatacgggaaactatggtgcttccaaactgtgaaagtgcatacattccatggatgatggcagaaaaagatgattggatccctagaaacgttgccccactatatatggctcaatcatgatttgttctcatcttctgatcttaaaacactctcgtgaatgttccaggccccttcttgtttcttgatttgtgagctatatgaaaactcttt

SEQ ID NO: 10620 - DNA, 55 bp, Gossypium hirsutum
  Clone ID: uC-gsflmaxxa052c10b1
tcgtacaactaaacttataacgttcgatcgtttaacgcaaacccatttttaagtc

SEQ ID NO: 10621 - DNA, 85 bp, Gossypium hirsutum
  Clone ID: uC-gsflmaxxa052c12b1
tgttataactagctctaagcctcgatgccaagagaactgtgttactcactgactagagttgcaaagtcatctctcttacttcagc

SEQ ID NO: 10622 - DNA, 73 bp, Gossypium hirsutum
  Clone ID: uC-gsflmaxxa052d11b1
aaaaaaagttatctcatcctgagcaaagtcacagtcgtcctcatcgaacaactatggcagccatcaacgtcca

SEQ ID NO: 10623 - DNA, 94 bp, Gossypium hirsutum
  Clone ID: uC-gsflmaxxa052d12b1
tccacgcgtccggtctagaccttgctggtcgtgatctcactgattctctgatgaagattcttactgagagaggttatattttcactacaatttt

SEQ ID NO: 10624 - DNA, 109 bp, Gossypium hirsutum
  Clone ID: uC-gsflmaxxa052e03b1
ggaattcaccttctaaacccaccacctatcagtgtcgccatggacgaataattcatctctcagtttctctagcgcttcaaagttgtgatgatcacctttttgcctctat

SEQ ID NO: 10625 - DNA, 58 bp, Gossypium hirsutum
  Clone ID: uC-gsflmaxxa052e12b1
tcgtttttttagagattcacatttgcagagtgctggcttgttgataatgcttacccaa

SEQ ID NO: 10626 - DNA, 93 bp, Gossypium hirsutum
  Clone ID: uC-gsflmaxxa052f01b1
ttatttccattttagttacatgatgaagagaagccatgaaagttagaggcaactttttttttattttaatatataacaacctctatacttcat

SEQ ID NO: 10627 - DNA, 91 bp, Gossypium hirsutum
  Clone ID: uC-gsflmaxxa052f03b1
tcatttcttggattttccatggaaaaagtggttgaaccttatttaataatactcccttaactatcaattattattaaattaatttattaaa

SEQ ID NO: 10628 - DNA, 125 bp, Gossypium hirsutum
  Clone ID: uC-gsflmaxxa052f05b1
ttctactttaacctctctgtctccccttcaacactgaaacaaaagaacccatattcacctaaatctcgcaagtgttccttattagcatttcttatcttacttttttgtttcttagtattctcttt

SEQ ID NO: 10629 - DNA, 77 bp, Gossypium hirsutum
  Clone ID: uC-gsflmaxxa052f08b1
tctgtttttacgccataatcgaagctctatctttcgagttttcaatcatgagtttcttcaaaagctaatttacgtta

SEQ ID NO: 10630 - DNA, 72 bp, Gossypium hirsutum
  Clone ID: uC-gsflmaxxa052f10b1
cttgacttgaaatcggtaagtaaaggatcaaattgggagctttttctacttccccttcctcaattttcaaag

SEQ ID NO: 10631 - DNA, 182 bp, Gossypium hirsutum
  Clone ID: uC-gsflmaxxa052f12b1
tttctttccctgcctatcagcctccattcaaagattttcatcactttagaaaggggaataaaattaatgttcacattgattctctaagattcttttgctaacaaagcttcatttcctctttttcccttttctttattatttttaatctccttcattcattattcttactactaaatttatta

SEQ ID NO: 10632 - DNA, 54 bp, Gossypium hirsutum
  Clone ID: uC-gsflmaxxa052g02b1
tggtcgcgtggatagtaatatctatagcatacagagatttacaggcaaagaacc

SEQ ID NO: 10633 - DNA, 71 bp, Gossypium hirsutum
  Clone ID: uC-gsflmaxxa052g05b1
tgttttactcactccactttccacattgagttctttcatttagccatatatatggcagcccttggaaatgg

SEQ ID NO: 10634 - DNA, 310 bp, Gossypium hirsutum
  Clone ID: uC-gsflmaxxa052g07b1
tctaatttgatatgttcagagaagattttataatacacatcttttctggatggaggagtttttctacttcattttttaattaatattctcttttccttctttttttcttctttccattttttatctttttaattctttctcttacttttcatttttttttaatttactctttttttcttattttttttttctttttatcatcttttttatttcttttttactttttcttttattttttctctctaattttatttcattatcttttattttactatctattattcttttaatctcttttcttatctattct

SEQ ID NO: 10635 - DNA, 147 bp, Gossypium hirsutum
  Clone ID: uC-gsflmaxxa052g08b1
ttaaacttatgctgaggctttgaaaatcaaggatgcacctgccctcgataaaatattggctccttcgaggaatagaaggaatacgacgatgcatgtggacctttcacatggcgcgcctatcgatatgggtacggctcttgatgctag

SEQ ID NO: 10636 - DNA, 186 bp, Gossypium hirsutum
  Clone ID: uC-gsflmaxxa052h04b1
tccactcgtccgatcgctcctactgatgtttaccaaaggttggtcagtttcctacatgctgcaaaaccgcattgaaacactgcttcatccttacaaaacattggggaaaatttcaggtgacatgggttagttacctggttatgttgtcatcatcaactaagggatgtgattcactagcatcattgt

SEQ ID NO: 10637 - DNA, 63 bp, Gossypium hirsutum
  Clone ID: uC-gsflmaxxa052h07b1
tctaatttgatatgttcagagaagattttataatacacatcttttctggatggaggaaattct

SEQ ID NO: 10638 - DNA, 292 bp, Gossypium hirsutum
  Clone ID: uC-gsflmaxxa052h09b1
attttgcaagaacaagatgctgggaatccaaaaatgctgataaaggttgtagctgaaagggaaatcaaacaaagtgatcctttacttctgaattacggatgtctaagcaatgacttttttctactggattatggatttgttataccatcaaatccgtatgaccatatcgagctcaaatatgatggtgctcttatggatgctgccagtatggctgctggtgtttcttcacccaatttctcatcaccagctccatggcaacaagaaattctctttcagcttaatttagatggag

SEQ ID NO: 10639 - DNA, 468 bp, Gossypium hirsutum
  Clone ID: uC-gsflmaxxa052h10b1
attatcagctgaattctactctcgcttaccctgcaagtttggggcagacgatttctcctaaaatattagctcattcctcccacctcagttcgacttgaatttcataagacaaagtttacaaccatgagctggaatttaaagtaatctgctttctgtaacgatctttggcgtaaaagagagtgtttggagcttttaatttgttgaaagagaatgaggaccaagcgaaaacgagcatgcaagaaatccccagccagaaaatcagctgcagtggccagaaatggaaaagcaacgaaccaaagtgaaaaggcagtgaaccaaaataaggaagcatttttaacttctattaacaaaattaacaaagaagactctgtgtcttgagactctaacgatttggtagttactgataagtgtgattctgaccctgatgatgcccagagaaatttattattattcgccctcttctagtga

SEQ ID NO: 10640 - DNA, 428 bp, Gossypium hirsutum
  Clone ID: uC-gsflmaxxa054a02b1
atttcttccaaatcgacacctcttcactgctgggggcgggaatgtatgcagctgggggggctggacatcttcggaatcatggcgaaatgcgggccagatgctgagctctccgccaaggagatcgcggcacaattggctaccaacaactcagaggcattctccatgcttgacccaatcctcatagtgctagccagccatggaatcgtgggctgctccatggcggatgaggaaaagggtaatccttccatgctgtacagtttgacgcccgtcctcaaattctttgtgcggaatgaaaaaggggtttccttaagcccttttgttggattgttcaagacaagggcttcattgatagttggtcgcaactgaaggatgctattataggatgaggagctccctttgacaaggttcatggaacaaacccatttgaa

SEQ ID NO: 10641 - DNA, 382 bp, Gossypium hirsutum
  Clone ID: uC-gsflmaxxa054a04b1
ctttctcttactgcctatctcccttctctcaaacgcaaagcattcatacagacaggctgtaatagaaacaacttcaaattcaaaacacaggccattttcgattaaactatggccccctagtgaaagcactcgactggtacttgtgcaacgcttgacaaacaatctctccagtaattctatttttacccagaagtatggtgctcttaacaaagaagatgccgaggagaatgctaaaaaaattgaggatatatctttcaacgtggcaaatgaacagtatgatagggagcctgatggtgatggaggtgctgcattgcagatttatgccaaggaatgtagcaagcttttgttggaggttcttaaaagatggcctgatgaaaaggag

SEQ ID NO: 10642 - DNA, 281 bp, Gossypium hirsutum
  Clone ID: uC-gsflmaxxa054a06b1
ctttaacaaagctctagcagagactaaagctataggagaggaaaaattcaaatagcgggtgagaacagattgtggatctgttataattgacgatggtagtggaactagggaacggcgatgatggcgtcacctcattggcgtcaccgacctccgccatggccagtgttcttcctgtcgcttgcgtctctcaacagtcgtacgtgtacgagcttctgttcttcactctcgatcggctacataaagagtcagaacttgttctagttgatgcggaaaggattcag

SEQ ID NO: 10643 - DNA, 362 bp, Gossypium hirsutum
  Clone ID: uC-gsflmaxxa054a07b1
tctgtttaacattgtttgcctttcatttctttcggtaggccttgatgcttcttcggcggcctctaagattctgagtaatataaaaaaggatggggctgtcttttgctaagctctttagtcggctgcttgccaagaaagagatgcgaattcttatggtgggtcttgatgctgctggttagactaccattctgtataaactcaagctcggtgagattgttactaccattcccaccattggctttaacgtggagaccgtataatataagaacatcagcttcactgtttgggatgatggtggtcaagacatgattccacctttgtggaggcactacttccaaaacactcacggtctaatctttgtt

SEQ ID NO: 10644 - DNA, 452 bp, Gossypium hirsutum
  Clone ID: uC-gsflmaxxa054a08b1
ccttcgcgtccgcttatttgtccttcatttggccgaggttaattacaacaaacgggggcaagctgctgtgtgttttttcttctttctcttgtcccactgttcctttgatctgttgctgaaataaaataaaataaataaataacttcgacaaaaaatggcattcactggaactttggacaagtgcaaggtttgcgacaagactgtccatgtggtcgatatgatgacactcgaaggagtgccataccataaaacttgtttcaaatgcagccattgcaagggtaaccttcagatgaccacttattcttggatggatggaatactgtattgcaagcctcattttgagcaactgtttaaggaatctgggaattttaacatgaatttttaaacagggaccaagccgactggactgaataggactcccaacaaactttcattcctgttttctggaaccc

SEQ ID NO: 10645 - DNA, 377 bp, Gossypium hirsutum
  Clone ID: uC-gsflmaxxa054a10b1
tttattgttgtgtgttctctaatagaatcgaggtaagagacactgggctcaggggacatcaattttaactagaagaacatggtcatatttagagtgaaaagtcttgcattttatctagtgctaaggtggtgcatattagtccgtccatggatcaatgcatatttgattttcttttcacactgctaggtgctttcactcatctgtaaggattggggtagattatctttaaaatagttgagcggagctcatcgatgaacttacttggaattgcttgtgtgctggcgcttacatgatttggaaatggattttgattgaaatattcacgcaatatctatatgcatggcatggctagaattcgggatgcaatttaactgaaa

SEQ ID NO: 10646 - DNA, 402 bp, Gossypium hirsutum
  Clone ID: uC-gsflmaxxa054a12b1
tcgattttattttctttaaactgtgaatttcatgtgcttgcagacagagagagagagagcagtgcagtgcagtgaaggtgaaatggctttcggtagtactccagttcttctttggctcttcttcttatctttatctccattgaccaaagctaaagttccagccatcatagtgttcggagactcctccgtggattcgggcaacaacaacctgatctcgacggttttgaagagcaattttcagccttacggtcgtgatttttacgggggtcaaccaactggacgcttctgcaatggccgaatccctcccgatttcatcttcgaagcttttggactgaaaccaggcatcccagcttacttggatcctgcttataatatatcggatttcgccactggtgtttggtt

SEQ ID NO: 10647 - DNA, 522 bp, Gossypium hirsutum
  Clone ID: uC-gsflmaxxa054b01b1
ctttgataaggtgcttgcaaaagaagtgctgacgggcagtttctatgttgtacagtgagcattattttggctgtcttctgccatctcaacagatctcgggcttttcttgtaaattacagacaacaaggaggaaatctaagaaaattttgcaggaaaactgttttgcagcttgttgaaaggtatctctgtaagtgaggataatttggtctctgcaaaaccatcatgcaaggaaaacgggcatttgtagatgaaaaggattgcttatgattaaagaggtaaaagtttctcggtttggataataaaaattctgtaccaacacttgttcagttgtagtaggcacgtttactacttggtgctttttaaagcatttcttggacttgcactctgttgtagatacgaggacattaattttgcgggagaactactcaagtgatttataacatacagatgctatgttttggtgggctgattttggagtttttatgttctgagctaattagaaggggatatttcattattatt

SEQ ID NO: 10648 - DNA, 441 bp, Gossypium hirsutum
  Clone ID: uC-gsflmaxxa054b02b1
tttttatttaattatctttgaagattcttcctgggttgggccctagactctctaatcttcgctgtttatcttactttcttcatcttttttctcagatcctttcgattttcttcactgatttctgtcattaatcttcgtcttggcttttatggagatttgatttaactcacactttacgagtgtgtgatggattcggataatctcttgtctgcgggtgggcttgaggttgcccatcaaaatggtgtttatccgcaacttcgggtgtctggggacgacagtggtattttgaataatgttaatggaaatgctgaggaaactgtcgggacttgttcgcagaatggaatagatgaccatggagcaactatggaagctagagaacgatccaatgacttagtcgataacaacggatcaattgggtctaaggaagaggaagtaaatgat

SEQ ID NO: 10649 - DNA, 464 bp, Gossypium hirsutum
  Clone ID: uC-gsflmaxxa054b04b1
cttacgcttccgcccacgcgtccggttttaattgggatggcaataacaacctggcgagccaatccaactaaatacatatgcaataaatgccttggtcttcacaaaaaagaagaataagaggctgagcatctggtagctttctctttgttcctccaaactgtgtgcttagatttgaagacctagtccctgtgaacaaatcttgttgttcatttctgggtttaatttctcaagaaaaagaagatgacaaaagataggcaaatcggtgtagcaatggatttctccaagggaagcaaagcagctcttaaatggacaatcgacaatctggtagacaaaggggataccctttacctcatccacgtcaaacccaatcagagcgacgagtctcgtaaccttctttggtccaccagtgggtcacctttgattccattatcggagttcagagagaaggaagtgatgaaacatta

SEQ ID NO: 10650 - DNA, 201 bp, Gossypium hirsutum
  Clone ID: uC-gsflmaxxa054b06b1
tttattttttcgaggacgcgtctacttttgaatggggagggtcctagttattgagggatcacgcatacattatagatccataaaattcgtaataaatcatctatgccctgttggagctatataggatatactaaagaataagcccttactggattcctacatgtaatgtcaaaatcctctttgtattctattataatatat

SEQ ID NO: 10651 - DNA, 335 bp, Gossypium hirsutum
  Clone ID: uC-gsflmaxxa054b07b1
ttttgatattctgcttgcaaaataagttctcacggccgggttctttaaattacaggggtcattaaacaagctgccttcttccatcttaacttatcttcgtcttttcttgtaaattacacacaacaacgatgaaatctaataaaatttttcatgaaaactgttttgcacctctcttaaatgtatctctttaagtcaggataatcttgtctttgcaaaatcatcatgcattgaaaaccatcatttttttatcacaaccaattctcattattaaaacatataaaattttccttttactggataataaaaattcttttccaacactttcttcaatttta

SEQ ID NO: 10652 - DNA, 463 bp, Gossypium hirsutum
  Clone ID: uC-gsflmaxxa054b09b1
tttgagggaaagaaaaaatcattcttttctcattgttgagactttggctcaaagctaccatctttactgtcactcccgaaggactcaaatggtagaggcgcaaacatggactacaaggaggatgagcaacccaagattggaatcaaccgccactgccgaccaccaacttttggacatcccggctaccccaacagctgaggtgagaaacggcatctacagcgttggatcacatctatctcctaatctcttaacggcactgatcattgcttcatggttcatgtccaacattggggtccttttactcaacaagtatctactcagcttttatggctaccggtatccaatctttctcaccatgctccacatgaactcatgtgcttgttacagctacgtagccataaactttcttgaaatagttccaaggcaacatattttgtcgaggaagcagttttttaaaatattt

SEQ ID NO: 10653 - DNA, 391 bp, Gossypium hirsutum
  Clone ID: uC-gsflmaxxa054b10b1
tcgcccacgcgtccgcggacgcgtgggctgctcgctcttagtttccctttttgtcccttgattatttgatactcccccctcatggctgccgctgatgtcgagttccggtgcttcgtcggagggctcgcatgggccaccgacgaccgggcccttgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacataactgtcaacgaagcccaatcgcgcagaagtggaggcggtggccgaggatttggaggaggaaacggtggttaca

SEQ ID NO: 10654 - DNA, 384 bp, Gossypium hirsutum
  Clone ID: uC-gsflmaxxa054b12b1
tctttttaggagcttttggagaggtaagattgggtcaggataaaaaatcagggggtgtttttaacacgaaaaagtttaagaagtcagaaatgcttatcagaggacaggttgaacatgtaagagctgagaggaatttgctggcagaagttgccagtcacttcattgtgaaactctattattcttttcaagatgctgagtatctatatctaatcatggagtatctgcctggtggtgacatgatgactttgctaatgagagaagacactctaactgatactgtggctagattttacattgcttaaagtgttctggccattgaatccattcataggcataattacattcccagagacattaaacctgataatcttctattggacaaaa

SEQ ID NO: 10655 - DNA, 205 bp, Gossypium hirsutum
  Clone ID: uC-gsflmaxxa054c01b1
ccatgcgtttatttatgctgcgaaacctgtaaaaactgacgggcggtatttaaaaaacggcgccggtaaaaaaccaacttgagactaacatcataattccgtaccagataacatcgccgaacccacacatcccgtatggaacaaacaacaatttatggttatctcacaaaacctctccaaggaacataatttaacccaattagta

SEQ ID NO: 10656 - DNA, 538 bp, Gossypium hirsutum
  Clone ID: uC-gsflmaxxa054c02b1
ctttttccgctcatataagtagtgaataataaggaaagggttttcaatagttgtagaaagagagccctagcagtcatttaaacttataaacagagagagatggcagccgaggtgatcttgaagctcacaatatgcttcctagcattaatggttggtgtccaaggtggagacccttacttattcttcacatggaacgtcacctacggcaccatctctccattgggagttcctcaacaaggaatactcattaacggtcaattcccaggacccgaaattaatgccaccagcaataataatatcgtggtcaatgtgttcaataaccttgatgagccattccttttaacatggagcggtgttcaacataagaaaaattcatggcaggacggtgtacttggaacaaattgtcctattgcacctggtactaactttacgtaccaatttcaaagtaaagaccaaattggtagctatatttattatccattcacagctttacatagggcagccggtggttttggtggtcttgggttcatagtcgttt

SEQ ID NO: 10657 - DNA, 503 bp, Gossypium hirsutum
  unsure (1)..(503): unsure at all n locations
  Clone ID: uC-gsflmaxxa054c03b1
cctttttggacttttcatccatatgattgcaagggtgtaaccgttaggaatgtaaccatcttagcacctgtatttggagctccaaatactgatggaattgatcctggtaagtaatccctgattataaattttgaacttttgtctataaaaatttttggtagctaaggctctagactcgattctcattcatgctactagtagttgtatagaaatgctcactgtacatatataactcgcttattgagcaagcttggttgacaaatctgtagaatgaattcaagactataattgaagaaggtttgcagaggctattatatacattagttaaagtacgactgtgcatttgttggaacgtatagaagcaggaaggtgagaacttagatgtaagatgtatggatatggtattctgagctgaattcaatgaaatgtgtgggcaaattgcaacanaattgctttcattattttggcttttcttctttttcccattcctctttaacacatac

SEQ ID NO: 10658 - DNA, 82 bp, Gossypium hirsutum
  Clone ID: uC-gsflmaxxa054c07b1
tgtttcgcgaacaaagaaaagactataatcgggggggctttaataaaatcagcggctgataacccacccatagtccaaaact

SEQ ID NO: 10659 - DNA, 185 bp, Gossypium hirsutum
  Clone ID: uC-gsflmaxxa054c08b1
ttgtttttacgttcaatccctattcttgcaacggggggacttgttaagaacgaggccgtcttaacacctgcatttccaactccaaacactgatagaattgaacctatgcaataatccctcattattaaatcccaaacttcttgtctataaaaattttttggtagcttaaggtttaaactccattc

SEQ ID NO: 10660 - DNA, 327 bp, Gossypium hirsutum
  Clone ID: uC-gsflmaxxa054c09b1
atctgatattattcaggccaaaaatcgggttctgaatatcatagacgggggttcctaccattgatcgatcttgtccttttgagatgcatctttcgataattgcgagggactcgccttcaaaaatgagtgactgccatcccttgtcaatacctattttgactgcggtccaacatgccatggtttcaacagcaaaaggagacgaaacgtcatccataattttttagtaagataaaagggcatttccttacgaatctctacccacaatacctgaagctgaccgattttgggattctatatatgcacctgccaacactgatcttgacaaac

SEQ ID NO: 10661 - DNA, 403 bp, Gossypium hirsutum
  Clone ID: uC-gsflmaxxa054c10b1
ttgttttttcgctgtgtttcatctctcaggtaatggcaatggcgatggcgaagccgtggatgtattgcttgcttgtttgtttaggtatggcgttgaacaatgtggcttcagggcaaggagaaaacccttttgagccagatggtggaaggagaagagaaatggtgcctgctatgttcatatttggagattctctcattgacaatggcaataacaacgacctcccttctttcgctaaggctaattatttcccttatggtattgacttcaatggcggtcctactggtcgtttctctaatggttacaccatggttgatgaaatcgctgaactactaggacttcctttaatttctgcatattctgaagctttcggcgggcaaagttttcatggtgtcaactacccctc

SEQ ID NO: 10662 - DNA, 432 bp, Gossypium hirsutum
  Clone ID: uC-gsflmaxxa054c11b1
ttgttttaatctctctaatcctcgctttcttccgcatcaaacacaccttcgattttcccaaggttgtagaagatggcagaaggtgaggatattcagccacttgtttgtgacaatggaactggaatggttaaggctggatttgctggggatgatgctccccgagccgtattccctagcatcgtcggtcggccacgtcacaccggtgtgatggttggcatgggccagaaagatgcatatgttggtgatgaagctcaatcaaagagaggtattttgactttgaaataccctattgagcatggtattgtgagcaactgggatgatatggaaaagatttggcatcataccttttataacgagcttcgtgttgccccggaagagcacccagttctccttactgaggcttctcttaacccaaaagctaattcggagaaa

SEQ ID NO: 10663 - DNA, 536 bp, Gossypium hirsutum
  Clone ID: uC-gsflmaxxa054d02b1
atttataacatggcaccacaccttagtattgttccttccatgtttgtacttttattattattcatttcagcctctaaagtccagtcagatgcttttgatgttgttgccaagtttggcgcaaaagctgacgggaaaacggatttgagtaagccatttttggatgcttggaaagaagcatgtgcctctgtaactccatcaacagttgtgattcctaaagggacatatttattatcaaaagtaaacttagaaggtccatgcaaggctcctattgagattaatgttcagggcactatacaggctccggctgatcctagtgctttcaaagaccctaattgggttagattctatagtgttgaaaatttcaaaatgtttggcggaggaattttcgatggtcaaggaagcattgcttatgagaagaatacttgcgagaatcgtgaatttcgttccaaacttcccgttaatataagggttgactttgtgaccaatgcattgatacaagacataactagcaaagacagtaaactattccacattaa

SEQ ID NO: 10664 - DNA, 492 bp, Gossypium hirsutum
  Clone ID: uC-gsflmaxxa054d03b1
cttacgcgtgggatcggcgccgacgactcctctggacggcgttcagggtacctgtgccaccatttctgaagatgagcgccagaggcagcagctccagtccatcagtgcatcgttggcgtcactcactcgaggaacagggccgaaagtggtgagaggggacccggcagggaaggttcaatcggtgtcgcatgtggcgcaccaccaccatatcgaggcgccaaccattagcgtcagtgacagttccttgaaattcactcacgtcctatacaacctctctcctgcagagttgtatgagcaggcaataaagtatgagaagggttctttcattacttcaatcggtgcactcgccaccctatccggagccaaaaccggtcggtcaccgagagataagagagttgttatcgatgacaccacccaagatgagctttggtggggaaagggctcacccaatattgaaatggacgagcatacctttatggtgaacagagaaag

SEQ ID NO: 10665 - DNA, 73 bp, Gossypium hirsutum
  Clone ID: uC-gsflmaxxa054d04b1
ttttctttttcttacacaagtccttcaacccttgcgcgggtattattcaataatcggatcgtaacaactatat

SEQ ID NO: 10666 - DNA, 154 bp, Gossypium hirsutum
  Clone ID: uC-gsflmaxxa054d05b1
gttattttttcttttacatttcaaacatcaatatctggggaatatagtgctttaatgacagtgactgctatcttggtcccagtagttgtcctcaaagtattgatcctactgatgcaattttatgttgaatattatgggtgcttgccagaatgga

SEQ ID NO: 10667 - DNA, 474 bp, Gossypium hirsutum
  Clone ID: uC-gsflmaxxa054d09b1
tgtttattttgtgaaagctgagaaaaaggggaggaaagatggtgaaactgactatgattgctcgtgttactgatggtcttcctctggcggagggactagatgatggtcgggatctgacagatgccgaaatgtacaaacaacaagttaaggctttgtttaagaatctctctaaaggccataatgaagcttcaaggatgtctgtcgagactggtccttatgtattccactatatcattgaaggtcgtgtttgttacttgacaatgtgtgaccgttcttatcctaagaaacttgcttttcaatatctggaagacctcaagaatgaatttgaacgtgttaatggagctcaaattgaaactgctgccaggccttatgcatttattaaatttgatacattcatacagaagacaaaaaaattataccaggacacccgtactcaacggaatatttcaaagttgaatgatgaactctatgaag

SEQ ID NO: 10668 - DNA, 450 bp, Gossypium hirsutum
  Clone ID: uC-gsflmaxxa054d10b1
tcgatccatcttctcattctactctttacctaccaagagcaagaaacctcaacaatcaacaactaccaactagatttggattaagtcacccaaaaccaatcaaccaaccaagcaaccgagaagcaaaaagaatggattctgattatggcattcccagagaactttctgatcttcagaaactccgatctcaataccaaccacagctccctccttgcctcgagggaactactgtcagggttgagtttggtgataccactacatctttagacccggctgatgctcataccatagcccgagcttttcctcacacttatggcaagcccttggctcactttctcagggcaactgccaaagtacctgatgctcagattataactgagcatccagctattagggttggacttgtcttttgtgggagacaaatccctgggggccataacgttgtatggg

SEQ ID NO: 10669 - DNA, 542 bp, Gossypium hirsutum
  Clone ID: uC-gsflmaxxa054d11b1
gtgacaatgagaggaacattgacgttgacttggattctgatggtctgcctctcccaagtagcggtgcagagccaatactactcggagagcttaccatatgatcccaggccggttaaggtcactaatctttacttctttttgcatgaaactctccgcggtaagaacccaacagtagtcatggtagcccaagctaacaacacaagcaacgacaactactcatcagtgccatttggcaccctatatgccattgatgatcccctcaagataggtcctggggacaactcagaggtgattgggaatgctctgggacttgggatcttgtccggcaaaaattcaacgaccgtggtgatgtacttagattttggatttactgccggaaagtttaagggcagctctattagcatattttcaaggaatccgttaataaagatggaacgtgagctttcggtggtgggaggaagaggagaattcaagatggcagaagggtatgcacgactcaagaatactttttcgatggcaccacttgtattattgatataacg

SEQ ID NO: 10670 - DNA, 500 bp, Gossypium hirsutum
  Clone ID: uC-gsflmaxxa054d12b1
tcgcttacgcgtccggttgataagcatgttgatttgcagaattcgtctgcaaagaggatgattggcaaagtcgcagttgtaactggtggtgcaagagggattggagctgccacagctaaattatttgctgaaaacggggcttatgttgtcattgctgacatattagatgaaacagggaccatgcttgctgactccatcggagctcgctacattcattgtgatgtagccaaggaaagtgatgtcgaatcagctatccaacttgccatcacatggaaaggcaaactagacatactgtttagcaatgctggcattggaggcactgcaagcagcataaccagccttgacatggaacaagtcaaacatctggtctcaatcaatctgcttggcaatgtacatgcgatcaagcatgccgcacgagccatgctgagatgcaatacaaaaggttccatcatatgtacatcaagttctgcaggcatcatgggagggctagcgtcttaccc

SEQ ID NO: 10671 - DNA, 468 bp, Gossypium hirsutum
  Clone ID: uC-gsflmaxxa054e01b1
tgtatttcaagtattctttttccagctttaatctgtcactttatgagttaagttggcgaattttaatgtgcatatagattttcttgttattcggtatgattttagatctgttatggatgtctaaggctttcaagatttgatacttctttgctcatttaacaagccacttccctgcattttttttttaaactctgagttgctccatttcaaagtaggagagaagcaagtttttttttttttaaatcatgatgaatcggggacttgaagttctatctcaaacctcttacttacagacttggaattggttgtttcaagagagcaaaggaacaaactggagtgctgaagagaacaagtgtttcgaaaatgctctagctttatatgatacagacacgcctgaccgatggtttaaaggggcagcaatggttcctggaaaaacttgtggagatgtcatcaaacagtatagagaat

SEQ ID NO: 10672 - DNA, 508 bp, Gossypium hirsutum
  Clone ID: uC-gsflmaxxa054e02b1
ggtaggtgttgaatttgcaagagaatatactaaactggaagttaaatttgttcctgaaatctctgaattttcagaaactaaatcagatgaagaccttgccaaagaagttgctcagtttgcatctctggtgcaagattctgtaggggtcttaacagagactagcaatctatttgaatcaatgtccagatatccattttctgcttgctctggtttggtatttgtaccaaagatcactgcaaagaatactgctaaattgtttgacctgatggtagaagatattagatctttcataaatggaagagggagaatgagccctgagataaatttccacttgcttgggataggggatccatgtgagacaagatttgtgcttggcaaaattattttagaaacaatgaaggctggtccccgtggagatgcgacagagataggcaatgatgagaaagaccttcaaccaaaggcgactgatgaaattttgtccaataatgaaattccagggaacgaggtt

SEQ ID NO: 10673 - DNA, 512 bp, Gossypium hirsutum
  unsure (1)..(512): unsure at all n locations
  Clone ID: uC-gsflmaxxa054e03b1
cttagtagggccgatccaaaatgtcnaancgagggaggggaggtagtgcggggagacgagttcaaaatgtcgctgggtttaccggtggcggctacggtgaactgcgcggacaacactggggccaagaacctttacatcatttctgtcaaaggaatcaaagggcgtctcaacaggctcccatcggcttgcgtcggtgacatggtcatggccaccgtaaaaaaaggaaagcccgatttgaggaagaaggtgttgcccgccgtcatcgtccgacaacgcaaaccttggcgtagaaaggacggcgtctacatgtacttcgaagataatgctggtgtcattgtcaatcccaagggagaaatgaaaggatctgctatcactggtcccattggaaaagagtgtgctgacctgtggcctaaaattgcaagtgctgccaatgctattgtttgaaaggtttccatggntttgtttgctactcgtgatgttatctttcaattacttacaacatattttgagag

SEQ ID NO: 10674 - DNA, 110 bp, Gossypium hirsutum
  Clone ID: uC-gsflmaxxa054e04b1
ctttcttattcttccacacatccatccacccctgcgcgggtttaataaaatcaactgaccatctcaaaacttttcctccactactttttcctcaaacaatttctcccacc

SEQ ID NO: 10675 - DNA, 485 bp, Gossypium hirsutum
  Clone ID: uC-gsflmaxxa054e06b1
tgttcgtttgggagatctcttccttctcacccatatcagaaattttctataccacctgttacaaaatttccccagcaaaaccactcaaatctcaaaccaatattctttttcttttttcattattttatatgcactaatattgttttttagtgagttaaatcttagattaaatcagcaaaattttagcatctgataaacaaagcccagagaagaacagattctgattattagttaaacagtaatcgacagttagaggcagagacgactaatcatactgttgtaaatttccaatccttttaagagagaaagagagagagatgaaatatagtttctcttgttgattcaatactttttgtgttcttcaattgatatcacttacatatttgtgggaatccgtgggctgaatcggcttgggatgttgaattatgaaatattgattcttgattggtagaggttgcagagtggaagctcacgttttggggggg

SEQ ID NO: 10676 - DNA, 513 bp, Gossypium hirsutum
  Clone ID: uC-gsflmaxxa054e10b1
tttcccacgcgtccgcttgcagcgttgaaaagatggggaatggttgctaccttctttaggagactctccaaagccaccccagctaccttcaacaatgcatttcgaggtcaacccaagtctggttttgctggatttcgcttcactaccatcgccgccgttgccggtggaatctctacttactactgcttctccgactcaaatttggttcatctagatcaagtcaatgaagagactggtccaaaagttgctttgaaatctgataagtggcttgaatttaagttgcaagatactgcaagagttagtcacaacactcacttgttcagggtttcatttgatccctctgctaagttgggattggatgtcgcttcatgcatccttactagggctccattaggacaagatgctgaaggaaaaaccaaatatgttataagaccgtatactcctatatcaaatccagaagctcagggatactttgacttattaatcaaaggggtttcaaaaggaaaaaatagt

SEQ ID NO: 10677 - DNA, 238 bp, Gossypium hirsutum
  Clone ID: uC-gsflmaxxa054f01b1
ggttacatggtgtccaaggggaagttcattattaccatcgacgatgactgctttgttgctaaggacccatctggcaaagcaatcaatgcacttgagcagcacatcaagaacctgctatcaccatcgactcccttctttttcaacacattgtatgacccatttgcagatggtgcagatttcgtccgtgggtatccattcagtctccgagagggtgttccaaattcataccacacatggg

SEQ ID NO: 10678 - DNA, 386 bp, Gossypium hirsutum
  Clone ID: uC-gsflmaxxa054f03b1
cctacttcttccgaattctacgacttttaccaagagaaaagtgtgaaatagctttcagttttcagcttagcttcttcaaagctatgggaacccgaggagttatcggagataaatggtctatgaggattctctgggggtgtgcaattggaagtgcagtcgccctgtatatggttgctgtagaaagacaaaaacagaacagagatcaaatgatggcagaaagtttaaaggccatggaatcggaaggtagtggtgagcgagtttgaacattgacatgtttaaatgttcatagggtacttataacaaacttgttaatgaggcttcccaacacttgcttttggtcttaccttttggctggaagtctgatgcgtgggttgcaaaaatttttt

SEQ ID NO: 10679 - DNA, 101 bp, Gossypium hirsutum
  Clone ID: uC-gsflmaxxa054f05b1
cctactttttcttccacacttccatccacacttgggctgatataaaaaaatctacggatcatctcaacttaccttttactcttctcttacctcaatcaata

SEQ ID NO: 10680 - DNA, 67 bp, Gossypium hirsutum
  Clone ID: uC-gsflmaxxa054f06b1
ctttctctttcttccacacttccatccactcctgggctggtttaataaaatcaactcgtcctctcaa

SEQ ID NO: 10681 - DNA, 103 bp, Gossypium hirsutum
  Clone ID: uC-gsflmaxxa054f07b1
tcttttttatacactcccacaatattatccaagggggggcttttataaacaatggtggccttcaccacaccacctctggtccacctattctcatcatgcaatt

SEQ ID NO: 10682 - DNA, 483 bp, Gossypium hirsutum
  Clone ID: uC-gsflmaxxa054f08b1
tcctttggaacgtttaaagattttacttcagggtcagaatccacatagtataaaatacaacggaacggttcaaggcttgaagtatatttggagaacggaaggttttcgtggattattcaagggcaatggtactaattgtgcacgcattgttccaaactctgcggtcaaattcttcagctatgagcaagcttcaaagggaatcctgtatctatatcaacagcaaactggcaatgaagatgctcaactcactcctcttctacgccttggagctggagcatgtgctggaataattgccatgtctgcaacttacccaatggacatggtacgaggcaggcttactgtacagacagacagctctccttttcagtacagaggaatgtttcatgctctgtcaactgtgttgcggcaagaatgcccacgggcatttgacaagggttggtttctttagtcattggagttataccatatgtgggtttgaatttt

SEQ ID NO: 10683 - DNA, 447 bp, Gossypium hirsutum
  Clone ID: uC-gsflmaxxa054f09b1
acgcgttcgggtgaataaataaaatggggggctgtctaagttttcaggccttcggctgcttaatttttttctcttgtatgctattctgctcatacgcacccactttcgcattaaccgacgtctaacaatcttacatcgctcgtggtcaactattggcactccgtgagaatcgtaaactccccgatgggtatgaatatactgtgaaaacgacagagaaattcgagaatgtatggcttaggggggctttcattgctcttcaagcatggaagaaggctatgtactctgaccccaagaacatcacgagcaactggtttgggcccaacgtgtgtgattacaaaggtgtttattgtgtccgagcaatggatgaccccaaattaaaagttggggctggtattgatcttaaccatgctgacatcggcggttaccttccggtggagttggggttgc

SEQ ID NO: 10684 - DNA, 251 bp, Gossypium hirsutum
  Clone ID: uC-gsflmaxxa054g01b1
cgcttgtctttgctttggttacatggagtccaagggggggtacatttttaccatcgacgatgactgctttgctgctaaggacccatctggcaaagcaatcaatgcacttgagcagcacatcaagaacctgctatcaccatcgactcccttctctttcaacacattgtgtgacccatttgcagatggtgcagattccgtccgcgggtatccattcagtctacgagagggtgatccaaattcataccacacat

SEQ ID NO: 10685 - DNA, 517 bp, Gossypium hirsutum
  Clone ID: uC-gsflmaxxa054g02b1
atgcgagttgtttgaacaataatcagcaaagacaaaacagttacttggatataatctccccttgtcaaacctaccctctgtaagcaatccgccatggacacattaacagctcgattcaagctcatcgttttgccctttctatgcatttgtttgcttttcttaccttttctccaggccactgatttcgattactgcgataataaaggtaattacgttgtaaaagtcgatggagtcgacatatcacctaatcctgtgattagcgggaaaccggccaccttcacgatctcagcttctactggtcaagctatcactggtggcaaagcggagattgacgtttacttcttcgggtttcatatccatcaagaaactcatgacctttgtgaggaaacatcttgccctattactgttggcaactttgtgctctctcacaatcaagttttacctgggtttactccacctggttcctacaaacttaagatgacattatcaggtgccggaattaaactgttaacttgca

SEQ ID NO: 10686 - DNA, 477 bp, Gossypium hirsutum
  Clone ID: uC-gsflmaxxa054g06b1
gtttcgttgaacatcagcatcagagcgtaagggtttagagaagaatatggcggccaaaaggaagacccccgtcaagtcccgaaacccagatctcattcgtggcgtcggaaagtattccaggtctaagatgtaccacaagcgtgggctttgggcaatcaaggccaaaaacggcggagttttcccccgccatgaccccaaacctaaggcccccgccgtcgccgccgccgagaaaccccccaagttttaccctgctgaggatgtcaagaagccccttctcaacaagcgcaagcctaagcccaccaagctgagagctagcattacgcctgggacggtgctgattttgttggctggtagatttatggggaagagaagttgtttttttaaagcaactttcttctgggcttcttttggttactggaccgttcaagattaatggcgttcctttaaggcgtgtgaaccagtcctatgtcattgcga

SEQ ID NO: 10687 - DNA, 485 bp, Gossypium hirsutum
  Clone ID: uC-gsflmaxxa054g07b1
gctctttggcttctcattttctctctttcctcacttccttactttgattaccctttttatatatcacaaaaattttgcagtctttctttcagacgcaagcagcaggcacctgtcctagaaacagagatcttctcaagttagttaaataacggtttttgctatccccattttgccctttcattcttcttcttctccttcatcggaagatgattagttggaacgatctttacaccgttttaacggcggtgatcccactgtacgttgctatgatcttggcttacggctccgtccgttggtggaaaatattcacccccgaccagtgctcgggtatcaaccgctttgtcgccatatttgccgttcctctcttggcttttcacttcatttccaccaatgacccttatgccatgaacttcaggtttgttgcaatcgacacccttcagaagctcatcatgctctttgctcttggattggggactaatttaaca

SEQ ID NO: 10688 - DNA, 499 bp, Gossypium hirsutum
  Clone ID: uC-gsflmaxxa054g11b1
ttcattggccaagatttgaattgccagaagctgtggttatggaaattctaaatgcttccagttaaatcccttactcgcttcaactgtgtttgtaagtattggtgttcttcttttcaaactcctcatttcatttccaaaaattatcacaacaaccttgaaaacaacaaccttaatctacttcttagtcgctgtgatggtaacaccttccaaccttatttatcttcactttcaaatgaaaaagatcaaaactatatagtaaaacaaaacattcacttgcccttttttgaggatgatagcccctctgtttatggtgcatgtcatggattattgtgtttatttgattcttcaaaggataaggctgccatttggaacccatcaacaagagagtttaaaatcctttcaccatcttcaatccaaccgcctccatatttttccccattcgaagaaacctaccttcttttgatgacgtttttttaacaacgctgcttttgggtttgat

SEQ ID NO: 10689 - DNA, 489 bp, Gossypium hirsutum
  Clone ID: uC-gsflmaxxa054g12b1
tctctcacgcgtccggaaattccatctgcctttcccggtctatttgctcacagtcacaggttcagctgtagaacaagaaggaaggcgcttcgctcaaccaaaggtgtttcactgcattatctgtttagccagtccaaacgatggaccgatctagacttaatatgaggggtcgttgctccggttcaacaccatcagaggaatcggctttggattttgaaagaacctgctgctgtcatcctcatcttccttcatttagttcaccgacacttcagccttttgcttcggctggacagcacagtgataacaatgctccttacttttcatggccgacatccagcaggttaaacgatgctgctgaagagagggcaaactattttgctaatctacagaaaggagttctgcctgagactcttggtggggtggcaaaagggcaacaagcaacaacattgctcgagctaatgaccctaaaagcatttcatagcaagaatt

SEQ ID NO: 10690 - DNA, 423 bp, Gossypium hirsutum
  Clone ID: uC-gsflmaxxa054h04b1
atttatttcaagtacaatactgtttggccaaaggggtgggaaggttgaaaatatgtggagaataaaaaaagagttcgattataaaagtttgtccagaaagcttgaaatgcatctggacaagctcattgcacaaaatgaactgcaacagaaagtatttgatgatgaagttgaaagaataaacttagaagcactaaaccgtgtttcggaggttgagagaaattttgcaggtgccttatagaaggagcgactaaagtgccagatggaatatatggagtccgttaagaagctggaggaaaagatgattgaaaatcatacaaaagcatgggtgtgatggcttaatgcaggataaatgtaacggagaggggcctcggtcttttattgttgaggatgttgttgatttcaaaaagcttcttggtgaaagaa

SEQ ID NO: 10691 - DNA, 490 bp, Gossypium hirsutum
  Clone ID: uC-gsflmaxxa054h05b1
cccacgcgtccgcccacgcgtccggttccgttccgttttccctaacaaacctgcatgagatccgatcagatttaactcagatccatccgtatcgggtcttctaaattccagatctttacttttctcgagtaaaggaagaaagaggaagggagagatgagagagattattagcgtccacattggccaagctgggattcaggttgggaattcatgctgggagctttactgtcttgaacatgtaatccaccccgatggaacaatgccgagcgacacctcaatgggcgtcgcacacgatgctttcaacactttcttcagcgaaacgggttcgggaaagcatgtgcctagagctgtctttgttgatctggaacccactgttatcgatgaagtccggaccggcccttatcgccaacttttccaccctgagcagcttatttcccgcaaggaagatgctgctaataattttgccagaggccactatacaattgggaag

SEQ ID NO: 10692 - DNA, 451 bp, Gossypium hirsutum
  Clone ID: uC-gsflmaxxa054h06b1
gttattgtgatttttgaaattcgctgcttcaacgggggcgtcatttcagttaacaggtgatatacatgatgaagtggagagtcataatcgtatgcttgaccggatgggcaatggcatggatgctacaaggggcataatgtctggcaccatggatcggttcaagaaggtgttcgagaagaagtccaacaggaaaataatggggcaggagtatttgctcatgtattaaaggattgctcgcagcagtggtggtcaacagcttggccgacgaacttaaccactccatccaatcatctcaattttaaggaatggatggcgtggaacttagctccaaaagcctggcatcatgttcacaaagtgccatggaaagtctttttctcctttattatttggcaaatcttgcttgccttaaaatgcaagaatctttaaaaaccacaatgaccacagtcgagtg

SEQ ID NO: 10693 - DNA, 334 bp, Gossypium hirsutum
  Clone ID: uC-gsflmaxxa054h07b1
ttccctcgcctccgctctgctattctcccaaagggcaggcactcttacctttttgggggtcttaaaacccggaaatagcttctgtgtgtttcacacctttaactatcgctgaagtaaaaatggagaattcttcaaaaaccctttatgggtacactgccattctcctcaaaatcgtctaaaaatcctctttccccccaggttttcagccatggaaatggtgactcattaacggaagtgtctttcaaggcaatgtgtaaaacaacctagattcctttgcagtctttgatgatggtggctgcattgcacttgacaccatactgcttcgcgccccact

SEQ ID NO: 10694 - DNA, 410 bp, Gossypium hirsutum
  Clone ID: uC-gsflmaxxa054h08b1
tgttttgtatttcatactcatttagccccttggggggcatcgaaatcactccaggtttctttatcactgaaaaatgtcttgctgtggtggaaactgtggctgcggttctggctgcaagtgtggcagtggctgtggaggatgcaagatgtacccagacctgaacgttgccgagatgaccacaactgagactctggtttttggtagccccccataaagcacactttgagggagctgagatggaattcggggctgagaacggctgcaagtgtggagacaactgcacctgcaacccttgcaattgtaaatgattagagaccaaagccaaagcttcctggaagcagagacgcctttgtctttaagaaataatatgttttgctgtttatgtgtttttagaataaagtagccatggc

SEQ ID NO: 10695 - DNA, 340 bp, Gossypium hirsutum
  unsure (1)..(340): unsure at all n locations
  Clone ID: uC-gsflmaxxa054h11b1
tactttttcgcccatccagtcccctcccatgtgggaggatttaacgacnaaacggggacgctctccaacgactctcgcaacggtgcatggaagacagacgtgcgcggcgtggaaggagaacgtgcgacgtgttgtgatatctgcgcggaggctatttgctgctgcggtactgaggcgaaggggctagggttctttgattctgttatgggtttattgggctaatgtaattgggttacaatttgagctcgttatttgtttttttatccacgccaaaattgggctattacattaataactcggataattcaactaattcaaataaaagattggtggctgtcac

SEQ ID NO: 10696 - DNA, 476 bp, Gossypium hirsutum
  Clone ID: uC-gsflmaxxa054h12b1
tttatttccttccaaagccatttgcagctagctggaccggaccatggcttctaaaccaggaattctcacagactggccatggacacctcttgaaagctttaagtacataatcctgggtccttgggttacggagaccatatactcaattatgggtaaggatccaaaggaatgggacctgaccaacttttcggtaatcccattcatgttatggagaatgttgcacaaccagctatggattagcctttctcgttatcgaactgccaaaggcactaacaggattgtggacaagggtatcgaatttgaccaagtcgacagggaaaggaactgggatgatcaaatattgttcaatggaatcctgtttttcttggctaacaaatacgttcccggggcttcacacttacccctatggagaacagatggtgtgattataacccatgtgctccatgtcggtcctgtggagttcctttactactggc

SEQ ID NO: 10697 - DNA, 187 bp, Gossypium hirsutum
  Clone ID: uC-gsflmaxxa055a01b1
gaagattttacacaagacttttgcctgctagacgaattatatctctcggccaccgccaggaaggagccatccggttaacaggaagggcttccttccttttgccttcaccttcttaatattctcatgaactttcttatcagccagtcatggattggggtttcccaaacccaggcatttttattcattc

SEQ ID NO: 10698 - DNA, 349 bp, Gossypium hirsutum
  Clone ID: uC-gsflmaxxa055a03b1
ctagggttctgctctctttgggagatttagattttatcttttgctttttcttctcaacagaaagtgctaaagcagatgatggaattcttggctgatagctgcctgactcctttttaggaacttatatgaaaaagatgaaaaatggtgatgatttcttgaatttcctcccttgcgacttgtcaataaagatacttactgctttagagggtccatctgatcttgctcgcatcactgctgtctcacgcaactggcgacatttcgtgattagacatggtctatgtaagcatctgtccctccaaatgtttccccaatttatctagagttgatcgtgtcaattagctatgtgggc

SEQ ID NO: 10699 - DNA, 318 bp, Gossypium hirsutum
  Clone ID: uC-gsflmaxxa055a07b1
ggtgggatgcatattttcgtcaagacgttgactgggaaaaccataactttggaggtggagagttccgatacgatcgacaatgttaaggcgaagatttaggacaaagaaggaattccaccagatcagcaaaggttgattttcgctgggaaacaattggaagatggaaggactttggctgattacaatatttataaagaattcactttccaccttgtcttgcgttttcggggtggtttttaagctctcctatgaaaatgaaggtttctggattgtatgggaatgatttgtgaagtctggccctgttaaggccttattaat

SEQ ID NO: 10700 - DNA, 216 bp, Gossypium hirsutum
  Clone ID: uC-gsflmaxxa055a10b1
ggtcagcgtaccggtggcagaagggctgtatgagggactggactggctttccaacaacattgcttacaagggttgagggttggttgaatttcagtcatatcttcaggcagctatccttcattattttcctggaatcctttttttaagtcttttacaaggaaaattgtaccaccattgtgttatcataattaacatctattcgccgtactactgaat

SEQ ID NO: 10701 - DNA, 393 bp, Gossypium hirsutum
  Clone ID: uC-gsflmaxxa055b06b1
agctttcagtggaaagcaatcggataccagaggctgctcttatggctcgatcttatcttccaagcaaggtttcagagatagtgacaatttggagaaaagacctcaacaaggttaatcccaaagctgctgaatctttggccgatcctggagagtatcctaacttgtttgaggattgggagctttctctttctgttgagtctaaagtggcagaaacaaggggtgtttatcctactgcatcgggctatttgaaccatgctgatacatcggagatgacacttgtggaagctttcagaaacatgcaagtagaggatgaggagccacttgaaaatggtgatctttatcatgagtcttgcagaaccaaatggatgtaatcagattttagagcagaatgga

SEQ ID NO: 10702 - DNA, 371 bp, Gossypium hirsutum
  Clone ID: uC-gsflmaxxa055b07b1
ttttatcctgcaaaattaattatttttgcaagttgcctctaccattttgacatttggagttgaagctaagaaccgctcggtgccaataattggagcataattagagatgacaatgggacagatttggagcaaaatcattttggagtttttcgagtttggtgtgtgcgctaggatttggggcaagctcggtattttcttcgtaattttcaaactttataaaagatgtaagcattctaacatgttcttgttagagttcaattgagctcagatttaaatcactattttttttttatcaaatttcacttcatgggttgagacttgggatgtggccatggtcaataccaaaaacctaagtttgaacttaacttctt

SEQ ID NO: 10703 - DNA, 312 bp, Gossypium hirsutum
  Clone ID: uC-gsflmaxxa055b08b1
gttttgtgatttttcctagtttgcgagaacgggatgctaatggttgaagcccaagttcaaaggccagaatgcgaggggaagtgtgcatcatggtgcagcaagtcatggaagccgaagatgtgccttaaaacatgcaacgcttgctgcaacacttgcgatgggtgagtgccccctggccctactgctaacaaggaagttttgcccttgctttgcctagtacaagaatggcaagttgcccttgaatactttctttctattttctaaacacgcattcgttcatggattcattctatattatcaccttgttattta

SEQ ID NO: 10704 - DNA, 403 bp, Gossypium hirsutum
  Clone ID: uC-gsflmaxxa055b11b1
cgaatccaccaacattggattctgcaagtggggctggtcacgttgagaatcttgctggtcttcaacacttatgtttctgggtctctccaatctaagcttgctgtttttcttatctctgatattttcggatatgaggctccaaactttagaaagctcgcggacaaggttgcagccgctgggtttctatgtggtggctcctgacttcttttatggagaaccctatgaccctaataaccctgatagacctctatctgtttggataaaggatcatggaccggataaaggttacgaggatgcaaagctcgtaattgacgctttgaaaagtaaaggggttttaaccattggagctgctgggttctgttggggtgctaaaagcttggctggaccggctaaggatccctta

SEQ ID NO: 10705 - DNA, 303 bp, Gossypium hirsutum
  Clone ID: uC-gsflmaxxa055c01b1
agcgaagttccttgctaaaaagcttatatttgtatcagaaccatcaaagtctttgtactttgaagtaaaaacccagactcagtaatctaatgggggaggaagagaaaaaaccagctgaagagaataaaatggtagagaaaaaggttgaagatgatggaaagaaaagtgaagaaaagaaagaaactaaagaagaaaccattttaccaccaccaccaccttgacaagtgattgtgttgaaggtttacatgcattgtgaaggctgcgctcgtaaagttcgttgtgttttagaggatttcaaggact

SEQ ID NO: 10706 - DNA, 406 bp, Gossypium hirsutum
  Clone ID: uC-gsflmaxxa055c03b1
aggagatcagaggcaattgtttgtcatccaaagagttcactagttgcagtgatgattcaagctattgctcatagggtgaactatgtttgggttatagaagaagattgtagcttggttgggattgttactttttctgatatgttaaaagttgtccgggaaagttttgaaaccatggcctgaaaaggaaaatgagatgagaaagtttttttgtttttttaataatttttggttgatcatctctgtcgatgctaacaatgctgagagaacttagttgaggctggtaggagaagaataaaaaaatgaaaaagatttgtgtgaatattggaatttttttgttttgtttgtactgtcatgtgagaattgagatgatttggagtttggtatttcatttcttgtagcatattta

SEQ ID NO: 10707 - DNA, 482 bp, Gossypium hirsutum
  Clone ID: uC-gsflmaxxa055c04b1
ttggatttcgacatcggagaagaagaagacgaagaaggaacgccatcgccgtcatcgatatcgccgccgcttcagtacttcgacagagatcgccacgtggcgttcttggagatgatgtacaatttgatgccccatcactatcaatcgcaggagatcaatcgcctcactcttgcatttttcactatctctggccttcatctcctccgagccttagatcgcgttgataaggacagagttgccgattgggtttttatcatttcaagctcatccgagaagtcgagccgaattgaaaattggtcaattttatggatttcatggctctagaacttcacagttccctccagatgaaaacggggtttcagctcgtaatgctggtcacttggcaagcacgtattgcgctctagccatactaaagacagttggcttataatttcttgaccatagacaaagaatcaatttttgatatcattggaggaattttc

SEQ ID NO: 10708 - DNA, 465 bp, Gossypium hirsutum
  Clone ID: uC-gsflmaxxa055c06b1
ccccaagagccatcgccagcctaccagactctaccaagggtagccccatcaaggtcccataccttaaccagccatggaaaaggatattgtccccgttggaatccaggcggatgcaggtgagagctgcacctgatcgcttatcggagaaggtggagcagagcatcaaggaagcacaagaggcgtgctcggatgacccggccagcggagagtgcgtggctgcttgggacgaggtggaagaactgagtgcagcagccagccacgccagggataggctgaaagataacgatcctctcgagaattactgccaagacaaccccgagacagatgaatgcaaaacttatgataattgaaactatgggttttttcttttaagtttatgaagatccttctgttttagatgatgaatatgggagtaagactactcttatgtgaaactgaatgtattctttttatggattgcatgac

SEQ ID NO: 10709 - DNA, 440 bp, Gossypium hirsutum
  unsure (1)..(440): unsure at all n locations
  Clone ID: uC-gsflmaxxa055c10b1
taagaatgcgacattgacagtgctgcacattccgaccgatggccaccaaacccgagctccaatccagcgactggtcatcggcagcagcagcggcaccgcagccagaaaccactccttctgcacccaagaaacccgacggcggggcacggatccacttcacgaacccggatgatgccatcgaggctttcgtcgatggctgcccggagaaaatgcccaagggcatgaccgttcttcaggcctgcgaaattgctggtgttgacattcccgggttaggtggtcatagtcgactgtcaatcgctgggaactgccgtatgtgcctcgtcgaggttgaaaaatcccccaagcctgtcgcctcttgcgccatgcctgctctcccaggaatgaagattaagacggatacacctttggcaaagaaagcacgcgnaggagtaatggagttt

SEQ ID NO: 10710 - DNA, 451 bp, Gossypium hirsutum
  Clone ID: uC-gsflmaxxa055d03b1
ttacagcttctctccagagttttataatgggtaaggagaaggttcacatcaaccttgttgtcattggccatgtcgactctggcaagtcgaccactactggtcatttgatctacaagctaggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactttatcaagaacatgattaccggtacctcacaggctgactgtgctgttctcattattgacttaaccactggtggttttgaagctggtatctttaaagatggtcagacttgtgagcatgctttgcttgcttttac

SEQ ID NO: 10711 - DNA, 458 bp, Gossypium hirsutum
  Clone ID: uC-gsflmaxxa055d04b1
tcctgaagagagtgatgatgataatgaagacgacaatgctattccattaggtccacagtgctctctcaaagaacagcttgaaaaagacaaggatgacgagagcttaaggaaatggaaagaacagcttcttggaagtgtggatattaacaacattggagagacactcgatccagatgtgaagttccttagcgtgtcgatcgtgtcggcggacaggcaggacatggtgctttcgatccctgaagatgggaagccgcatggcttatgggttacactgaaagaaggtagtcaatatcgcttgaagatcaccctttaagtcagcaacaacattgtatctggtctcaggtacactaatactgtatggaaaacaggtgttaaggtttatagcacaaaagatatgattggaacttttagtcctgagctagagccttatacgcatgaaatgccagaagaaacagccc

SEQ ID NO: 10712 - DNA, 445 bp, Gossypium hirsutum
  Clone ID: uC-gsflmaxxa055d05b1
tcacccttgaggtagaaagttctgatactatcgataatgtcaaggctaaaatccaagacaaagaagggatccctcctgaccagcaaaggcttatctttgccggaaaacaactcgaggatggccgaactcttgccgactacaatatccaaaaggagtccaccctccacctagtccttcgtctaaggggtggcatgcagatattcgtgaaaactcttactggcaagaccatcaccctcgaggtggaaagttctgatacaattgataatgtcaaggccaagatccaagacaaggaagggatcccaccagaccaacagaggcttatctttgccggtaaacagcttgaagatggccgaactcttgcggattacaacatccagaaagagtctaccctccaccttgtccttcgtcttaggggtgggatgcagatctttgtaaaacccttact

SEQ ID NO: 10713 - DNA, 448 bp, Gossypium hirsutum
  Clone ID: uC-gsflmaxxa055d07b1
tgattttcattcctcctgcgccattacatcctcacatttatagcaatggacatatttgtttagatattctgtatgatagctggtccccagccatgactgtaagttctatctgcatcagcattctctccatgttatcaagctcaactgccaagcaaaggccagctgataacgatcgatatgttaagaactgtcgcaatggcaggtctcccaaggagacgagatggtggttccatgacgataaagtataataatatgaacttattatctataatctgtgtataaaaactgaggctacagggataggtaatcgtttacatttgtcatgcttgtgtatgaaattatgaattaaacgtagatttatttttgatattgttacctaatgcaagaagcagactgaacaatataaacctttcttttcttctaatccagttatgcacacactttgttg

SEQ ID NO: 10714 - DNA, 450 bp, Gossypium hirsutum
  Clone ID: uC-gsflmaxxa055d08b1
tatcgcaaccgtgtttaaatttgtagagcgtccggagaataatgaggtgcaggtggatttaaagagtaaagttaaatttaagataatgagtttgaaggtaacagctggagtggattacttgcctgagctttttgatgaacaaagggatcaagtgactgtagaaagaattttgcgggttgtatttctagatatagggcggcctatccctgcattggacaaacttaagcgtcagttagctgaggccgatgctgcttttgaagcatgcaagaaacctgcccctgatacaggtccccgtgttgttggcgaaggtcttgttatcgatgaatggaaagagcgaagggaaaaatacctggcacgtcagcaagttgaagcggttgattcaacatgaagcggtgtttgatctgctgagagagctttctttttttttggttgaatcgtcaattatgactt

SEQ ID NO: 10715 - DNA, 414 bp, Gossypium hirsutum
  Clone ID: uC-gsflmaxxa055d09b1
cattggttctgatgaactcatttaacacccatgatgacacattgaagattgttgagaagtatgccaattcaaacattcaaattcatacttttaatcagagccaatatcctcgtctggtggctgaagattttactccatttccttgcaaaggccagcctggcaaggatggatggtatcctcctggtcatggtgatgtgttcccagctctaatgaacagtggcaagcttgctactttcttatcacaggacaaggagtatgcatttgttgccaactcagacaacttgggtgctattgttgacttgaaaatcttgaaccattttggtcaaaaacaagaatgaatactgtatggaggttacacccaaaaccttagctgatgtgaaaggtggtacttcttattcttatgaaggaaagttc

SEQ ID NO: 10716 - DNA, 465 bp, Gossypium hirsutum
  Clone ID: uC-gsflmaxxa055d11b1
tacccaaatatttgcatgcctgttcttcttttctggtacgttttttgaacttggaatcatgggaactctttaaattgattggttcttgggattgcttaggcttatgttatctattgccttgaaagtggtggacgtgggtgatttaagaggagactttttgatgaatctagattgagggtatggaggcaggtttataactataagggtagcttttggatttggcaatttgtgcggtctatctttctttgtttctttgaatgtatcttattgttattgaagaaaaggatcggcttgtgaacctgcccggcttttatctggatgttctcaagcctttgaatttactaccctttgaacagaaaatcgttttttttttgtatcccaagagatagatgggataaagagttcttcaagcttcagggtgggtaaatataatttggccaaatttattaaattgaggaagatctt

SEQ ID NO: 10717 - DNA, 61 bp, Gossypium hirsutum
  Clone ID: uC-gsflmaxxa055d12b1
ttattcggtcaaagttttagaaccccatttttgcagattttataaattggcttcctttttt

SEQ ID NO: 10718 - DNA, 483 bp, Gossypium hirsutum
  Clone ID: uC-gsflmaxxa055e04b1
ttttgttgcagcagccttgattctccttgccggtcaagtcacggccagacgtgaaatcatagaagtcaaaggtcgcggagtaacggaccctatcctcgaagccaaactaatagacatgcttgaagaaacagagcgtacaaaggataaggtaccggtacttggtaatagcgagatggttaagtattgtgataatgcctatggaatgtccataggaaacttgaaaaaggcattgggtatgcttcaacgtggtattaaatcaccccaaggtttcaaggaactcgaagccatcgtgttggtagtgatgaaggcttatgaggaatgtgatcatgtttttgcagagaatgcttagcctttaccttttggtattagtaatactaaattgaaatcactgggcactaagtgtaagcaatatgctgaagaggatgcttaacagaactaaattttatgtatgtgcatctgtatgtgtatgaaggttgatgtttc

SEQ ID NO: 10719 - DNA, 425 bp, Gossypium hirsutum
  Clone ID: uC-gsflmaxxa055e05b1
tgatatatataatatagcattaatgatgaagagtccaaacaactttaagggttattattattctctgtttatgatcagcttgatgctttgtttaggtgcgaggtcccaactaactactgatttctattcacaaacatgtccatctctcctttcaacggtacggaaacaagttcagagtgcgatcaagaccgaaatgcgaatggcggcctctctgctccggcttcatttccacgattgctttgtgaatggttgtgatgcatcagttttgttggatggagacaatagtactgagaagtttgctcttgcaaatgtcaattcggcaagaggatttgaagtcatcgacgcaataaaaagcgccgtctagagctcatgcagaggagttgtatcatgtgctgatatattagccatcgctgctcgcgattctg

SEQ ID NO: 10720 - DNA, 399 bp, Gossypium hirsutum
  unsure (1)..(399): unsure at all n locations
  Clone ID: uC-gsflmaxxa055e07b1
gatgaccacgagagaagtatattgacaaagctgaaacagcagtgtggtggccagttcacttcaaagatggaaggaatggtcacagatttgacattggcaagggaaaaccagacaaattttgaggagtacttgagcaataatccaaatgtaaatccagggatcgacttgacagtaactgttttgacaactggcttctggccaagttacaagtcttttgatctcaaccttcctgctgagatggtcaagtgtgttgaagttttcagggacttctatcagacgaaaaccaaacatagaaaacttacttggatatattctttgggtacttgtaaccttatcgggaagtttgagccaaaaactatggagttgattgttacaacatattangcctctgccttactg

SEQ ID NO: 10721 - DNA, 377 bp, Gossypium hirsutum
  Clone ID: uC-gsflmaxxa055e09b1
ttcccggacagttgatttgggaggtagtgaagaagaacaattgctttttggtgaggcagtttggaagaggaactgctagccttcagttcagcaaagaacccaacaatctctacaacctccactcctacaaacactctgggttggcaaacaagaaaacagtcaccattcaaagtgggggcaaagaccagtctgtgctgctagcaaccaccaaggctaagaagcagaacaagccttcggccttgcttcacaagtcccttatgaaaaaggagttccccaagatggccaaggcggtcaaaaaccaggtgacagacaactacttacaggccagatttaacaaaagcagtccttgcatggttgagtgcttagcacaggagtct

SEQ ID NO: 10722 - DNA, 455 bp, Gossypium hirsutum
  Clone ID: uC-gsflmaxxa055e10b1
gcctcctatggtaagaggaccggaatctccaccatggctgacggagccgatgggtttcaaccaagcaacgggtttccgcatgaagctgatcctgattcttcaacctctatcgatcctgatcctaccggattcggtgctgggataggtataggttatgaaagaagcccttactgtatcgactgcgacgatgtggatatcatgggcggcagcttttgcggcgcctgcaattacggatgcccttaccgcaagttcaataatgggtgtggtggtggtattgcttatatggatgaactcaaaccaacgattaaggaccttaccatgaaacttgatgccaatggtcttttaagagaaaagaaggccatgaatatacaagctatggtgccagaatctttatagaaatcttcatagatctgatatatagattattggaacttccggttttattcaaaggcatg

SEQ ID NO: 10723 - DNA, 459 bp, Gossypium hirsutum
  Clone ID: uC-gsflmaxxa055e12b1
tcacaactcgaagggagaaagaagaaaaaatcgaaaatggagaaagatgaatcgttggcaaccgtagcacccaaagcgccagtaactagtgaaaggaagattctagataacttggacgaaaaattaccaaagccctatttggcaagagcactggtagcacctgacgtggaacatccaaaaggaacggaaggacgtgtgaacaatggaatgagtgtacttcaacaacatgttgccttttttgatcgagataacgatggaattatttatccctgggacacttataacggtttgcgagatattggttttggtccagtatcctcttttattttaggagttctaatcaatggaacaatgagttatcctactctgcctgggtggataccaaatattttattaccccattacatagacaggatacataaagcgaagcatgggagtgattcagccacatttgacact

SEQ ID NO: 10724 - DNA, 483 bp, Gossypium hirsutum
  Clone ID: uC-gsflmaxxa055f03b1
ctttggtgttggtgttgttcggttgatgggttcagctgtgccatatcaccacagctgcttcttcccgccaccagctccgccttcaagaaactctgtcatctatgtaatgtgtctagattgaagcatgtatggtctgaaacaactttcaaactcatgacaactggcaattttcgatgtgcaaatgatgctgactgcccttcgtgctcatcttacttattcttcaatgcgaagaaccaagaaaagggtttggaattgcgggtaatagtggatcattcaagatatatacttacaggagaaattcatttaacacaaggaaattgcccaacacccttatagatgtcaatgtgttgtaagttttcgcttgtgaaaacaattacctgtcaattcacaaaagattgaatgtctttttaaaaacgaaaggcaatttttaatttgcagaatttatgtgcacaacggcacacaagggagctgctgctttgttta

SEQ ID NO: 10725 - DNA, 445 bp, Gossypium hirsutum
  Clone ID: uC-gsflmaxxa055f05b1
tagacccatttccttgaactctccaaggcccttttatgtctgcttcaaactaagacttcctcgtacacccggtgccctccggttcagctcctctccttctcttcggttcgtaaagttggttccttttgcttctaatggtggtgaaactgaaaccgctgagacccaagaagaagttgaagaacctcaaattgaggactcttcagatggtgctgtcagtgttgaagaggacaccactggagatgagagtaatgattttgaggatgcaccgtcttcaactatcgtgtcattgctccaaacatacaaagaagctttggccagtaatgacgagtcaaaagttgccgacatagaagcgtttttaaatttcattgaagatgagaaagttgatcttgaaaagaaaatggctttctttgtcagaagaatttgtcaattgaagaaggatcggggt

SEQ ID NO: 10726 - DNA, 469 bp, Gossypium hirsutum
  Clone ID: uC-gsflmaxxa055f07b1
ggacatcatatctaccaataccgtcgtcgttttcagcaagtcctactgtccgttctgtgtggatgtaaagcaattgcttcaaaaacttggagcttctttcaaggccattgagctcgacaaagaaagtgatggagctgatattcaagcagctctggctgagtggaccggtcagcgaactgtgccaaacgttttcattggtgggaatcacattggtggctgtgattctacaacaggcttgcataaccaaggtaagctggttcctctgctgactgaagctggagcttttacaaaatcatctgtttagaatagagttaagctgcttgtctcccctaaaattaataaacgaataccaagtttggattcatgttgattctgtcctttaacgtgaatccatagcatagcatatagatattgaactgaattgcttgtgaacttcctagaattatttcatgttcagtttcttttacag

SEQ ID NO: 10727 - DNA, 442 bp, Gossypium hirsutum
  Clone ID: uC-gsflmaxxa055f09b1
tcgtctcccattaccaaatttccccattaaaaccaaaaatgagaatcccaaatctcaccaaagcctttattttgttaatggcaataactctgatgtcaacccaagccagcggcctaatcccttacggtagatccttatgggacgtgatgcttgctgaagacccattcaaaatcctggaacaaaccccagtgaccgtccccaaaggatcagaacccgtcgctttagctcgagctgactggaaagaaaccccacggtaccatgccattaccctggacatcccagggatgaaaaaagaggatttgaagatcgaggttgaagagaacaagagtgttaaggatcagtggtgaaaggaaagaagaagcagaaattgaaggagagaaatggcatagagctgaaaggaccaatgggaagttttggagcagctcaggttgcctgcgaatgt

SEQ ID NO: 10728 - DNA, 472 bp, Gossypium hirsutum
  Clone ID: uC-gsflmaxxa055g05b1
cttcctctttacatttctgcttctactcccacttctcatttcctcttcccctgttcaagaccctgagcttgtagtccaagatgttcacagggccatcaatgcgtccaggaggaacctagggtatctctcctgtggaaccggcaaccccattgatgactgctggagatgcgaccccaactgggagactaatcgccagaagctagctgattgtgccattgggttcggcaagaacgccattggcggaagagatggtaagatttatgtggtcactgactcgggcgatgatgaccccgttaaccccaaaccagggacattacggcatgcggtgattcaagacgaacccgtgtggatcattttcgttcgtgacatgaccattcagcttaaagaagagctgataatgaactcattcaagaccatcgacggttggggcgccagcgttcatattgcagggggtccatgcattaccgatcag

SEQ ID NO: 10729 - DNA, 478 bp, Gossypium hirsutum
  Clone ID: uC-gsflmaxxa055g06b1
gctttgacaacatccttatgctggaagattgtggctaaaactgttgattcaactggagttggactcgtaatatatcaaaagccttcctcatattcctgttacaagcatcgcaaagaaaaacttccacctttgtgtgaacagaaaaccaatcagaatgcctcatggtacgagcctcttagttattgtatttcgcgccttccagttgacaggatgggtaatttgctcagatggtccacaccatggccacaaaggcttagcagtaagcctccaagccttccatccgaaccagatgctgaagacatattcattgaggacaccaaacattgtgcagcacttgtatcagaggtgtatcttgatgggctagctataagcttgggacgtataagaaatgtaatggatatgaatgctggttttggaggggttgctgcagctcttattgaccaacctctttgggtgatgaatgttgacccattgatgc

SEQ ID NO: 10730 - DNA, 321 bp, Gossypium hirsutum
  unsure (1)..(321): unsure at all n locations
  Clone ID: uC-gsflmaxxa055g07b1
ccggcactgatttgatatatgttgtaggatttgctgcttcgtaccagtttgagatgtaccaaatcaatgctaagaatggagagttgttgaagcatgaaagtgcatccttttctagtgggttttcgggagaagtttcactagtttccactgagacagttgtggctcttgattccacagggtcaattttgctaacaataagttttcaagatggaaaaattagttctcaacagacacccattttcaaatcttgtcgaggattctttaggaccggcngtcttaataccttcatcagccttaggaatatttgcaataagacagatg

SEQ ID NO: 10731 - DNA, 415 bp, Gossypium hirsutum
  Clone ID: uC-gsflmaxxa055g09b1
caataccggagccttccttgtcttcttcatcgctgcaatcttgctggccttgtccactacctgtacagctttaaacatcactaagtcgcttgcgccgtactctgattacagcactctcagcgatcttttcagtaagaccaagctgactgatgctataaaccgtcgccagaccattaccatactagccctggacaataattccatccaatccatcacagacaggtccagcgatgaactgaggaagattctcatgaatcacatttatcctcgactattacgataggcaaaagatccaaaagctggggaagaagagcgccctcctcaccaccttgtatcaaaccactggtttcgctataaatcaacaaggtttcgtcaacattaccaggatagcacggagtgaggatgtatttggctc

SEQ ID NO: 10732 - DNA, 471 bp, Gossypium hirsutum
  Clone ID: uC-gsflmaxxa055g10b1
ttgataaatataaaataattgcagtagttgacatttcgagtagcaatggctcctggaggcagcgcttgcaaagaagtcattgaatctcattcccctgttgcagattatgacatagcttcagcaaaatctgagagtaataatgccactagtactactacaacaacaacaatgaaaacttcagttaatttagttggaaaacatggaattcattcaaacaacggtgtttatgagctccttgagtgtcctgtatgcacgaatttgatgtattcaccaattcaccagtgcccaaatggacacactttgtgttcgaactgcaagattagagtgcacaactgttgcccaacatgcccctatgatcttggaaatataaggtgcttagctttggagaaagttgcagaatccttggaactcccttggaaataccagaatttacgttggcaaaaaatctttccctattacagcaagcttaag

SEQ ID NO: 10733 - DNA, 385 bp, Gossypium hirsutum
  Clone ID: uC-gsflmaxxa055g11b1
gattctttccaatcttacgccaaaaattccaatggagagaaagtcgatttttcaaactatggccaatctttcaatgaaggaaccgataaattcacggggtacggccaaggagccgtgggtcaatccattgggttcaaaatctatggaagaaacaacactttcaaggattatgcaaaaaaggagggcatcgttttcggtagatacaacaatggcagctcctctgaaactgctcaagttaagggcggtagcagtgccgtgagtaaatgggtggagccgggcaaattctttcgggaaaagttgttgaagcagggaaccgtgatgccaatgccggacattaaagataaaatgcctgtaaggtcatttttgcccggactattgttcaaaa

SEQ ID NO: 10734 - DNA, 359 bp, Gossypium hirsutum
  unsure (1)..(359): unsure at all n locations
  Clone ID: uC-gsflmaxxa055h01b1
tcccattagggtttggttcagcatgcagccgccagaccaccatcagtccgatggccgacggcgcgaaccacagactctgtcgacggaggtcgtaaccatggagatctgggaagtcacttctttccctttcttttattttttaaaaaaaatccttcaaaatcgtattttcacttcttttcaaaaacaaccaaggccgaataaatttcacaaggaataaaaccgttncggacccctttgcttcggaaattcttcctttaatctttcggaggataacctttggtggttgtcttcaattcgggttgtccggataaccaaaatattttccttttctttttatattgccttacaaattcgccaag

SEQ ID NO: 10735 - DNA, 311 bp, Gossypium hirsutum
  Clone ID: uC-gsflmaxxa055h02b1
acttctagcaaactgggttgttgaaatggcatcgaagttgtgtgactcatgcaaatcagcgacggcgactgttttctgccgggctgactcggcgtttctatgctccaactgtgactccaaaatccacgcagccaacaagctcgcctcgcgtcacgctcgagtttgggtctgtgaagtctgcgagcaagcgcccgctcacgtcacttgcaaggccgatgcagccgcttcttgtattacctgcgaccgtgacatccacttcgccaacccttttgctaggcgacacgagcgcctacctgtaacccccttttacg

SEQ ID NO: 10736 - DNA, 463 bp, Gossypium hirsutum
  Clone ID: uC-gsflmaxxa055h04b1
tctgtatgttcccgatccaatacccagaagtatgggaaatgtacaagaaagccgaagcgtcgttttggaccgcagaggaagtcgatctgtcttccgatcttcgtcactgggaagctctcaccgctgacgagcaccacttcattagtcacgttctcgccttttttgccgcctccgatggcatagtccttgagaaccttgctgctcggttcatgaaagaggtccaaatctccgaggcgcgtgctttttatggttttcaaatcgctatcgaaaatatccactccgagatgtacagtctccttctcgagacttacataaaagattccgatgaaaagaaccgtctttttcgcgccatcgagactgtgccgtgtgtggctaaaaaagccgagtgggctatgaaatggatcgacggcggagaaactttcgccgaacggttaatcgtttttgttggcgagaggggatcttt

SEQ ID NO: 10737 - DNA, 313 bp, Gossypium hirsutum
  Clone ID: uC-gsflmaxxa055h06b1
cgagagtgatagaaaaaacggagactaggtttttccttctaatttggttgttggttaaattcggctgcaatggagccgcgagttgggaacaagtataagctcggtcgaaagatcggcagcggatcgattggagagatctatcttggtaccaatattcaaacgaatgaggaagttgcaattaagcttgaaaatgtgaagaccaagcatccgcagtttgatgtatgaatcgaaggtggttaaaatactttcaaggaggaacctgggaatttcaaacgtgagatggtttggcattgaatgagactataatgtcctt

SEQ ID NO: 10738 - DNA, 115 bp, Gossypium hirsutum
  Clone ID: uC-gsflmaxxa055h09b1
aacacaacctttgtcttcttatcctccaaatattcgcagttctgatcggcaagacacagctgagtcttctgcggagtcagagtttccaaccctgaggactagttctagatcgcga

SEQ ID NO: 10739 - DNA, 306 bp, Gossypium hirsutum
  Clone ID: uC-gsflmaxxa055h10b1
agctttgagagataacagcatggctggatacatgtcgagcaagaagacaatggagatcaatcctgagaaccccatcatggaagagctgagaaagagggctgatgctgataagaatgacaagtctgtgaaagaccttgttctgttgctctttgagactgtccttcttacctttgggtttagcctcgatgacccaaatacttttggcaacagaatccataggatggtgaaaccttgggttgagcattgatgaggatgcacgagatgctgatgcccactttgatatgccaccattgggagatgcttatg

SEQ ID NO: 10740 - DNA, 217 bp, Gossypium hirsutum
  unsure (1)..(217): unsure at all n locations
  Clone ID: uC-gsflmaxxa055h12b1
ccaccgacccccgntccctgactgactttatgcatctaaggggactaaaaatgcagtctttgggtcgcgaggttgaacttgctgagaagctgcctcacatacaatcactttgcatacatgagatggttactcgagctttcaaacacgtgctcaaagcaatcgttgcatatgttgacaaatatcgaggaccttaactctgcagggtattagcttttca

SEQ ID NO: 10741 - DNA, 525 bp, Gossypium hirsutum
  Clone ID: uC-gsflmaxxa057a01b1
ccatgagataggtatttcctgttaaatctacctgatgcgttgaagatttgaagtgaatatttacctttccaagggtccatttcaaagtttactggaatgagatatgtaatgtcttactcgacgcggttcatcaaattgtgtcaaaaaactttttatatggtggatggataccctgtttatagcatggctactccaacaattattggtgctaaagagatgctggcatatcttggtgccaaggtcaatgcaggattttctggtcagaaagtggtggtaactgatctgagagaagaggcagttgtgtacattaatggcacaccatttgtactgagagaattaaataaacctgttgagaccctaaagcatgttggaattactggccctgtggtggaacatatggaagcacggctaaaggaagatatattgtctgaagttagacagtctggcggtcaaatgcttttgcatcgtgaagaatataacccatcatcaaatcagtccagtgttgaagggtactgggaaaatatc

SEQ ID NO: 10742 - DNA, 493 bp, Gossypium hirsutum
  Clone ID: uC-gsflmaxxa057a03b1
cctacgctttcggaagcagagacctctctaccaggcactggttcacgttaacaggggtcattcagcttcttcttttcgtttctacgcaaaatacatacagtttattccctttgtttcttcgtttttggtttccaaaggataggaaaaggtagatactgagtgaagtgacaatgggcaattgcttgcaatacttctggcctactgcgcaaaataaccctgacacttcaggacttacaaccggtctcctgagtgaaataacatctgaaagtgattttccaaccgtcaatctgaaagttttcacatatgctgagctagacaaggctactagaaacttcgctttggcgaatcgccttggggacggcgggtccagtcatgttttcatggggtacattgatgagcggacctgtagagctgcaagccttgcaactggaacaccccgtgctgtgaagcgggttagaaccggcagcaatctgactcatgatgagttgctgag

SEQ ID NO: 10743 - DNA, 260 bp, Gossypium hirsutum
  Clone ID: uC-gsflmaxxa057a04b1
tcttgagttatgctgattctaatggggagctaaacaagggaaagatgaaagacgcttttgtacatctggatgctggcatgccgtaccggcaagccgaaaaagccctctgtgtcgtcggcaaaagctattacattaacatgaaggatgaaaccgaccttaacaccctagccgactatgcttacaacaaggggtacggggattcaatttgattagctaattgatcagcttacggtctcgttctttttcacttttaatcatct

SEQ ID NO: 10744 - DNA, 299 bp, Gossypium hirsutum
  unsure (1)..(299): unsure at all n locations
  Clone ID: uC-gsflmaxxa057a05b1
aaatcatttccatcttcctctcttcaagatgaatgccttggtctacatctataggtcttgacgaacagattcagagattcctcccaccaggtaataactctctcttctcttaaggcttccttcgcaataacatgagcgatcatattttctgctttagggacaaaatgaaactcaatctcctagaatctgtgttttatgctttgaatgtctctaatgattgctccaatggccaatntatctgtttctgtactctgacattttctaataacaaattttgagtctcccacaacatccatttt

SEQ ID NO: 10745 - DNA, 290 bp, Gossypium hirsutum
  Clone ID: uC-gsflmaxxa057a06b1
cttttgagccctaatgaaatcaatggatagcagaggagttttggtggggaggaacatcatgttcttcttcctcatctgcgtgcttggttggagttcgaagctgtcggaagctcaaatggtgccggcgttatttgttttcggggactcccaagttgatgttggaaacaacaaccaccttttcttttccattgccaaggctaattttcctcacaacggcgttgattttccgacccagaaagcaaccggagaatttttaatggcaagaatgcagcagattttctggctgaaaa

SEQ ID NO: 10746 - DNA, 452 bp, Gossypium hirsutum
  Clone ID: uC-gsflmaxxa057a07b1
tcgaatatcccaaccttttttccaaagaagaagaaaaggttcgtttttgagcttaacccaacaatgctaccttgtttctgagtccagctgtagcctccatttcctcaaatgggttgttgtctaagctctaaaaaaggttcttctcgtggaaaggaagcacatttacatgcgggtcttgaatcttttaaccaaaagccaagccttgaaagcagagctccgccgccttcagcggaagaagaaacggtgaaagaagttctgtctgaaactccaaagccgaaagctcgcatctttatcccacaagaagaagagaagaagaaaccccagatagaaaaaccggcgtttgtcaagatccaaggggaggaaagcctgaattttaacatcaagcctgagccgaaattgcctgtcaatggtattgaagagtcagcgttggaggatgtttctgagatttgtag

SEQ ID NO: 10747 - DNA, 413 bp, Gossypium hirsutum
  Clone ID: uC-gsflmaxxa057a08b1
tcgtttacgcgtacgcccacgcttcctgaacggactggggaaagttaaattgtggcgattacagatgcccttaccgcaggttcaataatgggtgtggtggtggtatcgcttatatggatgaactcaaacgaacgattaaggaccttaccatgaaacttgatgccaatggtcttttagggaaaaagaaggccatgaatatacaagctatggcgccagaatcttcatagatttatatatagattatagaaactacggattctatacaaagagaaagaaaataaagaataaccaagcagcttgatatatgattgaattacaatgtgctagctgtttttttttatctttaattattatatgaataaaagagatttaaagtaagcttgattgcataaaaaaaacctccttgttgtaat

SEQ ID NO: 10748 - DNA, 348 bp, Gossypium hirsutum
  Clone ID: uC-gsflmaxxa057a10b1
tcgccttacgcgtccgccaaaatgtcagctctggtttggatttgcatgcttttcatttcttcagtgacaccaattcttgggtgtggttcatgtgggaaagcacacaagcatcgaaagcctaagggaaagtcccctaaaggtcccatcactttgcctccccttgtgaaacctccaatcaagttgccaccggttgttcctccaatagttaagccacccattgacctccctccggttacggtccctccaattaaccttcccccaaggacggttcctccagtaactaagccaccaagtgggaaacccttgccaacaccaccaaccaaggacacttgccccattgacacactg

SEQ ID NO: 10749 - DNA, 335 bp, Gossypium hirsutum
  Clone ID: uC-gsflmaxxa057a11b1
tctgatatatatatatacatggaaagaaaggggagcaaaagtctgatggtaaactataggtaacaaatacatacacataatggaaaagttataactttatagcaaagctttaagcttgaactataagataaaatgaagagcatcagcatttccccccgtcccatctttccccttatactcccacagcttgaacatcgctacaaaatatcccgcctcaaccatcgcttgcctcttcttcaccttgacggtgccggtcgatcactcttgttgatggcctctctcagcaaccacaaccacaaccacaaccacaaccacaaccaccattttcggcacgc

SEQ ID NO: 10750 - DNA, 413 bp, Gossypium hirsutum
  Clone ID: uC-gsflmaxxa057a12b1
gctttttcactttgtgaagctttcatttctactccactcttcttctcatcttcagatctcatctccttccttaaggttaaccaatggcaacagttcgaaatctgaaaatcaagacatcgacttgcaaacgaattgttaaagagcttcactcatatgagaaggaagttgaaagagaagctgctaaaacagctgacatgaaagagaaaggagctgacccttatgacctaaagcaacaggaaaatgtgctggctgaatcaaggatgatggtccctgattgtcacaagcggctagaggcttcattagctgaccttaaagcaacctttggctgaattggaggaagcgaatgaaaaggaagggccctgatttgaagatgctcgcagcaccataaccgaagttgaaaagttgttttaaac

SEQ ID NO: 10751 - DNA, 495 bp, Gossypium hirsutum
  Clone ID: uC-gsflmaxxa057b03b1
aaatggttggatttttgggaccagagtttggatctttcttgttcatgaattaagcttttgttcaagattttaatggcttatttgtctgagccatcatcttctttgagtttcagttcatcttctcatctatctaatggctcaatcactcacaatataccccctttttctgttcctgaaactggggctaaccttgaagctttaagtttgaccaagctcagctctagtttggagcaactaattgttgaaaattgtcctgtttttagtgatgctgatatagttgttgaaggtgttgctgttggtgttcatagatgtattttagctgttaggagtaagtttttcaatgaggtttttaaggatggatctgggtcttctgagaaagatggaaagccaagttataacatgtctgagttgttgccttatggcaagattgcacttgaagctttccaggtgttcttgagttatttgtatactggaaagctcaagccttctcctatg

SEQ ID NO: 10752 - DNA, 406 bp, Gossypium hirsutum
  Clone ID: uC-gsflmaxxa057b05b1
cccacgcgtccgctcctgtctctgttttgcttccatttctttcttcaattatcttttctcttcaaagatttcaactcttttctcagaatgggaagtactgatgggaccagctatggtgcttacacctatgatgccctggagagggagccttactggccatccgagaaactccgaatttccatcaccggtgctggtggcttcatcgcttcgcacatcgctcgacgtctgaagagtgaaggacattacatcattgcttctgattggaagaagaatgagcacatgacagaagatatgttctgtcaacgaatttcatcttggtgatcttcgagtgatggaaaattgcttgaaggttaccaatggagtggatcatgttttcaaccttgccgctgatatgggtggcatgggc

SEQ ID NO: 10753 - DNA, 533 bp, Gossypium hirsutum
  unsure (1)..(533): unsure at all n locations
  Clone ID: uC-gsflmaxxa057b07b1
tcgggattcaacaaaaacacaatgttgatgcgctacgttcgttcgtccctcatcgcgtcgcgttttttctcgacggcagcgtcggtagagaaagcagtaccaactaacgaagtcgctccgaaaagcagcggtggaggtcgacgaaacacgttgggacggaggcttataggccttgtgtatccgaaacacaccgctgtagctacaatacagaaatggaaagaggaaggtcgtacggtcagaaagtatgagctcaatagagtcgttcgagagcttcgtaagctcaagcgctataagcacgccctcgagatatgtgaatggatgagattgcagaaagatatcaagctcttaccaggtgactacgccattcacttggacttaattgcaaaaattcgtggtttagatagcgcggagaaattcttcaaagatcttccagacaagatgagagaccaagccacatatacagctctgcttcacacgtatgtccagaacaagttatcgggtaaagccgaagctttaatgaagaanatgtctga

SEQ ID NO: 10754 - DNA, 532 bp, Gossypium hirsutum
  Clone ID: uC-gsflmaxxa057b08b1
tcgctttgacacaccgccacctaaaaaggccgcgcgtatgcttaaatttcattaaaaactaaaactagaaagaaaaaaaaaaagagaagaaaaaaatcaccatcaccatcatcgtcagattcagatctgggttttcactcatttatagccaatagtacaccattttagctataaatagccaacctctccactctctaaaattgtgccacttcttcctcttcatctctctgtatctctttgagtgacttctttttagttctctctccggttccacctccgttcacttcgaaaaatggcctctcacattgttggatatccccgcatgggacctaagagagagcttaaatttgctttggaatctttctgggacaacaagagcagtgccgaggatttgcaaaaggttgcagctgatctcaggtcatccatctggcaacaaatggctgctgctgggatcaagtacatcccgagcaacactttctcttattacgaccaggtgctcgatgcaacatcgatgcttggagctgttccacct

SEQ ID NO: 10755 - DNA, 521 bp, Gossypium hirsutum
  Clone ID: uC-gsflmaxxa057b09b1
aaattttcatccccaagttcccaacccatttgccaccgaagacgccgactagaccacctggtgcatcaccctcgactaacctctctgctgcgccgccgtcgctgtcgtcgtcgctctccactcctaaaaaataacttttgcttacccgctcgttactccctcttcttctcatctgtttttaaagccctatgtatactgattggttgggctactttggtctctcaatgagaacttcacatgctgaggcttagctgtcagcagtagcccaatcttgagaacaatgattaatttgtttatcagtagttaacctagtaaaaagtctcttgaagagccatccatatgtattctttttctttcaataacctctttttccccagattctgtggtcaggtggtacattctttacaaaagcagggaatattcacggaaaatttgagaatactcagcctaaccagacaccttcgcagaacttcagccaatttggtgggggtaatgtcaataaaccagggtcctttagggac

SEQ ID NO: 10756 - DNA, 470 bp, Gossypium hirsutum
  Clone ID: uC-gsflmaxxa057c02b1
ctcgttcttcatcgacgcctctgcttatcgcatcgtcagccatgtcaaggagaaaggttagggagccaaaggaagagactacgacccttgggcctgctgtacgagacggagagcatgttttcggtgttgtccacatttttgcatcttttaatgacactttcattcatgtgactgatttgtctggaagagagactatggttcgtattacaggtggtatgaaggtgaaagccgacagggatgaatcttcaccttatgctgcgattcttgcagcacaagatgtttcccagagatgcaaggtacttggaatcacggccctccacatcaaattacgtgctacaggaggtaacaaaaccaagacccctggtccgggtgctcagtcagctctcatggctctcgctcgctccgggatgaaaaatggccgtatcgaggattgtacacccatttcgactgatagcacccgaagaaagggt

SEQ ID NO: 10757 - DNA, 505 bp, Gossypium hirsutum
  Clone ID: uC-gsflmaxxa057c03b1
ctctctggtaaattaaaaaaagaaagaaagcagggaaatgcttaatctatggaatcttctcttcctctcctttgttcatttctcatcattcagtgttactttgggtggggtgtcgggaaacccatttactccaaaatcctccttcattcgctattggaacaaagagctccacaaggaaatccccaacacccattttttactctctaaagtttcaccattaactgccgtcgactccgccagtttctcgaaactcgccgcccacaacaacctcgcttctcgtcttccttccttttgttcctccgctaaactcttttgcttccccgacttatcgcccagtctcgagaaacattccaaagacgttaacttcgccgtctacctcgacaggaacttcactaattacgactccgatcgactcgctggactcgactccttcaagaactactctgaaaacgacaacgttgtcattgactcttttcgtcgctacagccgggactccgcgggtcac

SEQ ID NO: 10758 - DNA, 480 bp, Gossypium hirsutum
  Clone ID: uC-gsflmaxxa057c04b1
gttcttgatgcacaagaaattaaaagggaacctggtatttttcctaaggaggatgaaattgtgcctaacgagaatgaaattgtagacatacaagatggcacaaacgatgcagaaccagaggttcatgctaatgaacctgctggtgaatctccactgaagatagcactagacgcaaagagaaaagcttttggtgaaattgaggaagaagaaagtgaagagagtacctgcttggaggagagcattaaggctgcaaatcaaccttcaaccaatagttttgctgattcaagtggcgtaaatgctaaacaaagggtttctattcgtccagaggtgaaagaagctctgggaacattggagaaggccatttcaattgtacggcaatatagatttaatgcccaaagcagatcttctagtttctctgatgaaaaactccgaatttgaagagggtgctgtagaagacttaacttttttgcaaagccaatg

SEQ ID NO: 10759 - DNA, 420 bp, Gossypium hirsutum
  unsure (1)..(420): unsure at all n locations
  Clone ID: uC-gsflmaxxa057c06b1
cccacgcgtccgggtttttaaattccactcgatccaatggcaaccttccagttctctccattgccataatccacaaaaataaataaataaataaacactgtcgctttctcattagccagcttcgaagaatcgcatattactttgatctctccaacgaaatttaagtaataaaaatggtgttcgaggtgatgaaagttccaacgacgacgtttgaaggccagaagccaggcacttctggtcttcgtaagaaggtgaaagtttttgttcagcctcattatttgcagaatttcgttcaagcaacattcaatgcccttacacccgagaaaggtaagggtgccacacttgtcgnttctggggatgggtcgtatttctcaaaggatgctggtcaaattataatcaagatgtcagctgcaaatggag

SEQ ID NO: 10760 - DNA, 500 bp, Gossypium hirsutum
  Clone ID: uC-gsflmaxxa057c07b1
tcgcttttcgcgtgggcggacgcgtgggcggacgcgtgggcggacgcgtgggaaatttcatggctcggaaattctttgtcggtggcaactggaaatgcaatgggacaactgaggaggttaaaaagatcattacaacattgaatgaagctgaagttccttctgaggatgttgtggaggttgttgtgagccctccatttgttttccttacctttgtgaaaagtctgttgcggtctgatttccatgttgctgctcagaactgttgggttcgcaaaggtggtgcttttaccggagaaattagtgctgagatgcttgttaatctgagcattccatgggttatcatcggtcactctgaaagaagggctctcttgaatgagtccaatgagtttgttggagacaaagtagcgtatgcactttctcaaggcttgaaggttattgtctgcattggggagacttttgagagcgagaatctggctctaccatgcttgtgttgctgacaaacc

SEQ ID NO: 10761 - DNA, 450 bp, Gossypium hirsutum
  Clone ID: uC-gsflmaxxa057c08b1
cttacgcgtgggcttggggtttgaaaaagggaggccaacaccaaaatgacagttgttattatgattagcatgctttacatttcttcagtgacaccaattcttgggtgtgagagatgtgggaaagcaccacacatgcgatcaaagcctaagggacaagcctctaatggcactatcactatgactcccattgtgaaacctccaatcaagttgccaccggtggatgcttcaatagctaaacgacccatagacctacatccggttacaggccgtacaattaacctcacttcagggactgatactccaggaactaatccaccaagcgggagactgtgcctaacaccaccaaccaaggacacttgccccatagacacactgaaagtggtggcttgagttgatctgctgggagggatagggcacaatggactaggcgacccgggttgaatcattgtt

SEQ ID NO: 10762 - DNA, 337 bp, Gossypium hirsutum
  Clone ID: uC-gsflmaxxa057c09b1
tcgctttcgcgtccggtcattagtttcttgagattagggtttgaagaagatgaagaaaaacaagtgtttcaaatgtcttttgtgggattgtagtttgttcacggtgtttagtttagtaggtagtctaggcttcttagtttaatgtgaatataatctaatcatcaatatctgttacttggttaatagaagagttgtgacttttttttttcattaatgaaattaatgctatatttcaatttcaaaaaaaaaaaaaaaaataaaaaaaaaaaaaaaaaaaaataaaaaaaaatataaaaaaaaaaaaaaaaaaaagggcttcctatttaaaaaatacaag

SEQ ID NO: 10763 - DNA, 509 bp, Gossypium hirsutum
  Clone ID: uC-gsflmaxxa057c11b1
tcgcccacgcgtccgttttcttattaagttcctttattcagttttagcaaaaactctcagttaacagtggtatttgagccaagttatcaaaaaaaaaggttgtagctttttgtattcaatggcgtctgaaaattttgtgcaactagcaataccttgttttgatagtcattatgatcactagagtatgctaatagagaattttctaagatcaaaatagtattggcaagttgtctcgaatggagtgccaaagtctacattaacaatgtcaaacacaaaaatagaggggatgaagttgaaggatcttaaggccaaaaactacttgtttcaagctattgaatgtttaatcttggagacaattctttgtaaaaataccttcaagcacatttgggaccatatgaagaagaaataccaagggtcaagtaggattaagaggcaatagtttcaagctctacgattcgaatttgaaacattgcggatgaagactagagaatcaatttctaatttttttt

SEQ ID NO: 10764 - DNA, 396 bp, Gossypium hirsutum
  Clone ID: uC-gsflmaxxa057c12b1
tcgaattgcttatgcttttaaatactccatacgcccgctcactttctcgctcattagctgcttcctctttcccttctcctcccacgcgccgccttcttttcctttcttccacttttacccttcctccccctcgattcccccattcctccctcgtttcctcgagggtatccccgtcttttcgcacccaagcttcagccgccaccgcgaccatgggtgacgctcccgacgttggcatggacgctgtccaaagacgcctcatgtttgaggatgaatgtattttagtggacgagagtgataatgttgttggccatgaatcgaagtacaactgtcatttgtgggaaaagattctaactggaaagatgctgcatagagcattcagtgtattttttgttaaca

SEQ ID NO: 10765 - DNA, 511 bp, Gossypium hirsutum
  Clone ID: uC-gsflmaxxa057d02b1
tgcaatcttcctcaagctgtattcttttccctttacgtttctagttaagagttttggctttgcctatttctattctactgtcacttgccctagaaaaaattatcttgctagcaaaagagaaaaaacaagaactttaccaggaaaaacagaaccaaaagaggagcattgtgatgcaacgagtggtgtcatttaattttttgatttgatttgatttgaaattttgttgttgttgggaggatttgtttggtgaccatggtcattggtatgtgccgttcctttcgcgatcgagctctcgaccgatgctatcactgcttcccttgcctctccgatcctgcacggagatcatcgttggttttgaaagtgacattagtgatgctgcatctggtatacgttggcattctcttccttttcgatagtgatttgatagataaaacgaaaaaagaaccctggtacactgctttatatttggtggtgtttttcgccacattggtgcaatacttcattacttctg

SEQ ID NO: 10766 - DNA, 527 bp, Gossypium hirsutum
  Clone ID: uC-gsflmaxxa057d03b1
atttcctacaataaaagtgttcgtccctggaaagccacctgtagattatatgggagctagagatgtcaaacctattgccgaatttgctctccagcaggtaaaggcacttttgaaagaccgtctcgctgggaaagcatctggaggatcaagtgagaaatctgagtctagtgcatctgtagaattgaattcccacaactttgatgaattggtgctcaaaagtaaagaactttggattgtggagtttttcgctccttggtgtggacactgtaaaagacttgctcctgagtggaagagggctgctaataacttgaaggggaaggtgaagcttggtcatgttgactgcgattctgagaagtctctcatgagcaggttcaacgttcaagggttccctaccatcttagtatttggtgctgacaaagacagcccagttccttacgagggtgctagaaccgcctctgctattgaatcatttgctctagagcaactagaaactaatgtcggaccggctgaagtgacagagctgactg

SEQ ID NO: 10767 - DNA, 69 bp, Gossypium hirsutum
  Clone ID: uC-gsflmaxxa057d06b1
gttggatttcaacatatgcaagcttccctcctaaccaagagatattaacgtttccactcttttccacaa

SEQ ID NO: 10768 - DNA, 514 bp, Gossypium hirsutum
  Clone ID: uC-gsflmaxxa057d07b1
tcggttgtgacagcattgacccttctcaagagacaccttttcaactaccaaggctatgtttctgctgctttggtactaggtggtgtagatgtcactgggcctcatttgcatactatatatccccatgggtcaactgacacattgccatttgctacaatgggttctggttccctggcagcaatggctgtatttgaatcaaaatacagggaaggccttactagaaacgaaggaatagaacttgtcactgaggctatatgctctggtatcttcaatgacctcggtagtggaagcaatgttgatatttgtgtaataactaagggtggcaaagaatacttgaggaaccatttacaacctaatcctcgaacttacaccagctccaaaggctattctttttccaagaagacagaggtcctcttgacaaaatcataccccttaaggagaaagtggagatcatcgaggaggcgacgccatggaagaatgaagcacttaccaactgatgatagtatatcaactc

SEQ ID NO: 10769 - DNA, 476 bp, Gossypium hirsutum
  unsure (1)..(476): unsure at all n locations
  Clone ID: uC-gsflmaxxa057d09b1
attagctttccacacagaaatgggtgtgagtgcgaatgccaataccggagccttcctcgtcttcttcatcgctgcaatcttgctggccttgtccactacctgtacagctttaaacatcactaagtcgcttgcgccgtactctgattacagcactctcagcgatcttttcagtaagaccaagctgactgatgctataaaccgtcgccagaccattaccatactagccctggacaataattccatccaatccatcacagacaggtccagcgatgaactgaggaagattctcatgaatcacattatcctcgactattacgataggcaaaagatccaaaagctggggaagaagagcgccctcctcaccaccttgtatcaaaccactggttccgctataaatcaacaaggtttcgtcaacattaccaggatagcacggngtgaggttgtatttggctccgccgtgaagggtgcacacctag

SEQ ID NO: 10770 - DNA, 491 bp, Gossypium hirsutum
  Clone ID: uC-gsflmaxxa057d10b1
cccacgcgtccgcccacgcgtccgcgtttctgttttttttttgtttttttttttgggtatccttcatctattctacaggagttgttgaagcttccatagatgcgatgtcaacaaaaatagacctctcactctcccgacccaaccgcatctatcgcccctccgagcctcttgaaggcaaaatcttggtgaagtctgcatcttccatttctcactatggaattcgcatggccatcaacggctcagtcaacctccaggttcggggaggatcggcaggagtcatcgagtccttttatggtgttgtcaaaccaattaccatcctgagtaggacccttgagattagaccatctgggaaaattgtttcaggtacaacagagataccgttctctataactctgcggaatcctaaagaagataattcagaaagggtttacgagacctttcatggaaccaatattagcatccaagtattggcaactgtagatataatgaga

SEQ ID NO: 10771 - DNA, 488 bp, Gossypium hirsutum
  Clone ID: uC-gsflmaxxa057d11b1
tcgcttacgcgtggggcacagtatgagaaactaaggcgatcatctgaagaatggggttgtttcagggtagtcaaccacaacatcccttttgaattgatgcaggaaatgaagaaagttgtgagatcattgcttgacctccccatccaaatcaagcaaaacaacgtcgatgtcattgccggcagtggttattgggctcccagtcctaaaaaccctctttatgaagcattgggtctctatgatatggcctcctcccaggctattcataccttctgctctcagttggatgcctctccttcacaaagagacgcagtagagaagtatgctaaagcaatacatgaggtaatcatggatataggtggaaaaatagcagagagtatgggattgaagggtgattactgcaaggaatggccttgccaatttaggataaataagtcccatttcacccctcaatctgtaggctcggctggggtccaattacacacttgatt

SEQ ID NO: 10772 - DNA, 526 bp, Gossypium hirsutum
  unsure (1)..(526): unsure at all n locations
  Clone ID: uC-gsflmaxxa057e03b1
cccacgctttcgattttaaacaaaaatggaagttcatgacaatctttttttagttttttcacaaggatgcaacatgggaatggtgatgctagcttgcatgtttatttcatggatctttgtttacagattgaaccagaggaacaaaaatggccccaaaacatggccactcatcggagcagcgttcgaacaattaattaactatgatcgaatgcacgattggctcgtcgaatacctgtccgcatcgaaaactgttgtagttccaatgcctttcacaacttatacttacattgctgatcctgctaatgttgaacatgtacttaagaccaaatttgccaattaccccaagggtgaaacgtaccattcatatatggaagtgctgcttggagatgggattntcaacgtagatggtgagctatggaagaagcaaaggaaaacagctagttttgagtttgcatcaaagaatttgagggatttcagcactgtagtcttcagggaatatagtctacaactccattctattctaact

SEQ ID NO: 10773 - DNA, 510 bp, Gossypium hirsutum
  Clone ID: uC-gsflmaxxa057e05b1
gaaaaatggctttggcaagcttggtgagaagaaaggcataccttttgtctagaaacctgtcgaattcgcccgcagatgcgttgaaatactctttttcactcagcaatttctcgaggggtttcgcttcaggatctgaagagaacgacgtcgtcgtcatcggcggcggacccggcggctacgtggcagctatcaaggctgcacagctaggtctcaaaacaacctgtatcgagaagcgtggtaccctcggtggtacttgccttaacgttggttgcatcccatctaaggcgcttcttcattcatcccacatgtaccatgaagctacgcattcatttgctggccatggtgtgaaattctcctctgttgagattgatttgcctgccatgatggcccaaaaggacaaagctgtttctaatcttacccgtggtatcgaaggtctgttcaagaagacaaggtaaactatgtcaagggctatggcaaattcatttctccctctgaagtttctgtagacac

SEQ ID NO: 10774 - DNA, 535 bp, Gossypium hirsutum
  Clone ID: uC-gsflmaxxa057e07b1
tcggttcaagctcatgcccaactccaagcacggttacaagcccaaggtttgggccttaaccaggctcagaatgctggctttgggacattaggttcgtcttcaccctccatgtctactcctggcagtgcaagtgcaaagaggatccttcaaaggccccccatgcgccctcctggtgttcctatgatgaacacaatgtcacctttgagaacaatggaacttacagccgctgcacgtagaaagaagcagaagcttcctgagaaacaactacaggatggagtggcagcaattcttcctgaatctgctttgtatacccagcttcttgagtttgaggcacgtgttgatgctgcattagctaggaaaaaagttgacatccaggaagcacttaagaacccaccttgtgttcagaaaactcttcgaatatatgttttcaacacttttgctaatcagattaagacaattccgcagaagcctaatgcagaagcctctacgtggacccttaagattattgggagaatcctggaagatggagtagatc

SEQ ID NO: 10775 - DNA, 519 bp, Gossypium hirsutum
  Clone ID: uC-gsflmaxxa057e08b1
tcgccttgtgttggttaatttatcttcgaatcttttaaccggcgagttgccggcgtgtctgcgagaaaacgtcgaggaaggggttgtttcttatgacgggaactgtttgtccggtgaagaaggaaatcaaaagcctttgagtttctgccataacgaagcgttggccgtcgaagtttcgcctcaaaagttgcggcataaagaacgtaaagccatggctgtgcttgtatcgagtttagtgggagggattgttggattagcggtgatagttggtttgagtttatggggtttttcagagaagaaatagaagggcggccatgaaaggaccttcaacaaggttgataactgagaagctttcgacagtaaatacagtaaagttattatctgatgcaaggtatatattagaaacaatgaagatgggagcaaacctccctacgtatcgtgcctttgctttggaagaactaaaggaggctactaattatttctcttatccattcatcgttggtgaaccttcacttattt

SEQ ID NO: 10776 - DNA, 445 bp, Gossypium hirsutum
  Clone ID: uC-gsflmaxxa057e09b1
tcgctttccctgctttgctctgaaaagtccaagtttttctccaatggcgaccgtctctccaactcctctgttgaaagatgagctcgacatcgtgattcccacgattaggaacttggactttttggagatgtggagaccctttttccagccttaccatctcatcattgttcaagatggtgatcctaccaagaccatcaaggtccctgaaggcttcgattatgagctttacaataggaacgacatcaacaggattttgggtcctaaggcttcttgtatctctttcaaggattctgcttgtaggtgctttgggtacatggtttccaagaagaaatacatctataccattgatgatgactgctttgttgctaaagatccatttggcaaagacatcaatgcattggaacagcacatacagaacctactgaggtcatccactccatttttc

SEQ ID NO: 10777 - DNA, 521 bp, Gossypium hirsutum
  Clone ID: uC-gsflmaxxa057e10b1
tcggtttttcttctgtttgggttcctggaaaagtgttagtgagagatagagagacaaggtgaggatgttgttttgccggggattttctaggattcgtacaactcccggaaagagcttgtttggtttcgttctctctcgtcgaactgacccttctctattccttctctctaatcaatatgtttactctactataaaggttcgtagtggcagagaaactctttcttggagttttccttcattgcttggtcttggacggcaaattcatcagagtagctctctaatagaggaacaacttgatccattttcacttgtttctgatgaactgtcacttgtcgctaacaggttgcgggctatggttattgctgaggttcctaagcttgcttcagctgctgagtacttcttcaaattgggggtggaaggaaagagatttcgtcccacggttttgcttttgatggctacagctttgaatgttcatatacctgaatcagttggtggtggtgtaggagatattgtgacaactg

SEQ ID NO: 10778 - DNA, 509 bp, Gossypium hirsutum
  Clone ID: uC-gsflmaxxa057e12b1
tcgcctacgcgtccgcccacgcgtccgcccacgcgggcgttccttttggatctaacgtaaccgtaaacggaaacggaaacgtcggtggcggaggttctccggtatcgaagatcttctcggccttgcctgtacgaaagactgcagcagataattttttgaattcggagaacgaaaagtctgattatgattggcttcttactccacctggtacaccactatttccctctttggaaatggaatcacagaagactctaatgagccagattgggatgtctaatgctcgtccagtttcactgaaaacaaggctggcaaatctcccggaggaacctgctttgaagagcacccttgccttaaagcaacaagctccgtcagccggagtaatcttttccagtactctaaatagaaggccatcctcttccgggggttcaaaatctgctagtagacctgcacacctactggtcggcccactcttccacgacaaccaagccttaaggtcttttattctacat

SEQ ID NO: 10779 - DNA, 102 bp, Gossypium hirsutum
  Clone ID: uC-gsflmaxxa057f01b1
acgtacccgtacgcttttcgatccactcttttgccaaatcgcgggagccctaacaaaaccttgaacctttttatttgtttacttaatcttttctgatcttaa

SEQ ID NO: 10780 - DNA, 472 bp, Gossypium hirsutum
  Clone ID: uC-gsflmaxxa057f02b1
gtgtctattagcggtggccccgtctatgtcagtgaggcgcctgggagacacaactttgagcttctgaagaaactggtgttgcctgatgggtccattcttcgtgctcgtttgcctggacgccccacacgcgactgcttgtttacagatccagctcgtgatggcgttagcttgttgaagatatggaacatgaataagtacaccggagttctagttgtttacaactgccaaggtgcagcatggaacagcgcggcaaggaagaatactttccaccaaaccaagacagactccttatcaggccacgtaaaaggtcatgatgtccatctcatttcagaggcctcattggaccctgaatgggccggtgactctgcagtttactgtcaccagactggtgaacttattaccctttcatacaatgctggcatgccagtgtccctcaaggtccctgagcatgaaatcttcacaataacaccta

SEQ ID NO: 10781 - DNA, 505 bp, Gossypium hirsutum
  Clone ID: uC-gsflmaxxa057f03b1
cttgggttttaggcccagtttggaaaatagggtaagagatgagggagagagcaagaggagcagcgaccggcgagagagatggcaggagcgttttggggaacaagagtgatggagatagtgaagaagcacgactctggtggtctcgtttggaagagaattaagctcacttccacccgcaaagccaacgccaagaagcgtctccatcgcgtttggcagaatgaagctgttttgagagcatgcgcagaaccacctccttcgaaagcaacggatgtagctggtggtggtggtgagaaaggtgtggaacaatcaacttaatggacaattaaggaagacactacataagcctgaaaggaagaaattggtgactctttgggggttaatggtgcaaaatttttacaatctgagatttgaaatttagttgtatgggatcattgaccacctttttttattgttgttaaagacgattgtgtgaggcggtggtcaatgctttaggcaaaccttaata

SEQ ID NO: 10782 - DNA, 524 bp, Gossypium hirsutum
  Clone ID: uC-gsflmaxxa057f05b1
cccacgcgtccgtccaaagttgggttaacagttgccctgattcagggattaaaaagaaaaaaaagctaagttctatattcgggtgtggcaatggctactaataacaataatagcaagttagagaagttggcttctattgatgcacagctacgtgctttggttcctgctaaagtgagtgaagatgataaactggtggagtatgatgctttgcttttggaccggttcctcgatattcttcaagacttacacggcgaggatcttagggaaacggttcaagaatgttatgaactttctgctgagtatgaagggaagagtacccccaagaaacttgaggagctggggaatgttttgactagtttggatccaggggactccattgttatagctaaggctttctcccacatgcttaacttggctaacttggctgaggaagttcagattgcttaccggcgaaggatcaagttgaagaaaggtgattttgccgatgagaactctgcaacaactgaatcggatatcgaagaaac

SEQ ID NO: 10783 - DNA, 329 bp, Gossypium hirsutum
  Clone ID: uC-gsflmaxxa057f08b1
tcggatgaactgaagacaaaagtgggacatgttatagtgatgattctattggtgaagatgtttgaaagaagcaaaatggtggccataaacactggcatggatctccttagttatgctatctgtattttcctctcttctgcttctttgtacatccttcatcatcttcacaagcctgaatagttccatcactccctctcctctcactttctatatacatgtagacactattttctacacgtcaaactgttactttgtgggatttgtagagagtaacacatgcactacttggttgatattaataagagaatttgagtccttaatttttattt

SEQ ID NO: 10784 - DNA, 503 bp, Gossypium hirsutum
  Clone ID: uC-gsflmaxxa057f09b1
tcgggttgaaacaccactttcaaggattatacaaagaagggtgtcactttcagtagatacagcaatgagagttcaacagcttcaggtaaagttgtggtaagtaagtgggtggagccgggtaagttcttccgggaaaagatgttgaagcgaggaatggtgattccaatgccggacattaaggataagatgccggcgaggtcgtttttgccacggactatcctttccaaaatacccttttcgtcttccgagattgatcaactgaaacggatattccacgcaggggacaactccacactggcgaccataatgctggatgctttaaaagagtgcgagcgaccgccgagcccgggcgagacgaagcgctgcgtgggctcggccgaggacatggtcgacttcgccacctctgttctggggcggaacgtggaggttcgtaccacccaaaacgttaatgggtcaaagaagaatataatgataggaaggtgtggaaaaaacattggtgggaa

SEQ ID NO: 10785 - DNA, 500 bp, Gossypium hirsutum
  unsure (1)..(500): unsure at all n locations
  Clone ID: uC-gsflmaxxa057f11b1
tcggtttctctatttacattagagaatatattactggatttcccttgaatcacattaataaactatatttcctttatttttaaattttaacccagcaaataaagatggctcgccaagttatgctcgtcgtcgcccttgttctcattgccgttgttggggcttatgcggcggatgtgcccaagacctcttcttcttcatcaccttcaacatctcccgcctcatctccctcctcctccattagcactagcagttcccctcctacaccagacggcggtgctctcgctccatcaccatctagtgccgtttctctcaaagcctccagcttcgttggtgctgttaccgctgttgccggactgggactcttttacttctaaggtttaacacgccacatgcatggcccgtggatcaacgctntttatttatttatttatacatatatatgattaaaatgtattttgcttgcgaatagccgcggcatacaatgtgtgaacagtctttga

SEQ ID NO: 10786 - DNA, 404 bp, Gossypium hirsutum
  Clone ID: uC-gsflmaxxa057g01b1
atttcttttttatcctttgcttttttttttttaaggattttcgtccgaggcgtcggcgtcaacggcccccaacgcactgtttaacacctcattgagggatttcgcgacggaggaatcggtttttgaggttgcgatcggaggttttttgaggttgaagatgacggcggcgcgtgattttcagtgaaacagaggatgctgtatgtggaaagagtgaagtgaagccatcgtttttgagttgattttgaagaaagctttgtctcgtaaaagatggagaatagttcatattttgttgcatctaagcacaggctcagtacctttttctccctcatattccggtctcctacttcctatcatccattggtagcccttgctgtgtccaagctaataatgcaagacccggggaa

SEQ ID NO: 10787 - DNA, 374 bp, Gossypium hirsutum
  Clone ID: uC-gsflmaxxa057g02b1
tgatttatggttagtagcagtggccaaatggccagccagttttacggttactcatgcgcatcaccttccgcctccactctccaccgttatctggactccgacgccgcgtctcagtctcagtctcatttgcttcaacaactccacccctccgctgctgccgctgccgctgctgccgcctcactcatcaaacgcccctctcaagttctctaccatcagaatgttttggatgcccaaaacacacttgggcagattgaagcttggtattctgctagctctttagtcaagcgacctagattggagagtgcaagcaatttacctatatatcctcaaaggccaggagaaaaggattgtgctcattatatgctcacaagaac

SEQ ID NO: 10788 - DNA, 291 bp, Gossypium hirsutum
  Clone ID: uC-gsflmaxxa057g03b1
gattaatttataattcaacccataatattagagggagagaaatgagggagggagagagggggtaattcacaagggaagaaaagcctgcttccaccgttacaccctctctcacattttcgttaagtttctctttttgtttttgtctttctctctctctttctttatttacatcttagctaccctttttttttaattcaatgctctataaacgaaaattttgaaggtgggtttttggttcttggttttgaatttggtgatctgtgtttttttttgtgcgtgggaattgttggg

SEQ ID NO: 10789 - DNA, 522 bp, Gossypium hirsutum
  Clone ID: uC-gsflmaxxa057g04b1
cctacgcgtccgcggacgcgtgggtttgactcgtaggattaaataaaagaaacttctgcaatgcaaacgtctcagaaacataaaattacaggcaagtgcattgactggcccgtgcaagagctggagtcctattgttggcctcccaaccagagcttagagccataccagtcaggttctgatgatggcagcaatagtgtgcaacattcagttcctaacctgttactcgcgtaaatgctgttgctccaggttttgttcctaccaactttgcagcatacatcacaaaagatgagggtgtgaaggcggctaacgaggaaaagaccttacttggaaggcttggtaccccaaaagacatggctgctgcagctgctttcttggcatccgatgatgcttgttatattacaggggaaactctaatagtggcagggggattgccctctagactctaaggatactttttttactagctaataagtccttcacttgcgggaaaaataagtgatacttgtagagatatctcgtcct

SEQ ID NO: 10790 - DNA, 548 bp, Gossypium hirsutum
  Clone ID: uC-gsflmaxxa057g05b1
gcttctattctcaactttttttttcttttaatccttcaaattggccaagttgctggaaaagaaagactgagaagaagaacaataataaaagaggaaaaagaagacttaaaaaggcatcatcagtgaaaattttcgagcaactagagacgctgaataaaacaaagaaaacccaaattgacacaggaaatcagattccattgaattgcagatctcttttagcttttgctagttcttgttttgtatatatgggagcagtggttgtctaggatgctgtgcgaggcccattttcaatcccttggtgaatgagtcatcaaaaggattaaaatttcaaggacagacagtgagtaaacccaatatatcagaaggtttctggaccactagcacttgtgatatggataacagtgccgtgcagtcacagggaagcatctcctcaatcagcacaagcaaccagacacttgatccaaatggcaatgctgcaagtgctaatggcccctccgaatttgaaattatggccttattcactggaaccagactaggcagcggggggg

SEQ ID NO: 10791 - DNA, 517 bp, Gossypium hirsutum
  Clone ID: uC-gsflmaxxa057g06b1
cgcttcttgaggctggcctggctaagctacaaacttcatttggtagtgataggattcctgatgctcatcttcttgaacaggctgagctatctgccaagaggaagaagctgaaaatttgggagaactatgttgaaggagaggaagtttccaatggacctgccactgttgaaaacaagcaaaaagaactgctacaggtggtggttacagaaatattgggtggcggaaaattttatgtccagacggtgggagatcagagagtatcagctatccaaaaacagcttgcatctttaactatccaagaagctcctgtgattggtgcctttaaccctaagaagggtgacatcgtccttgctcagtttagtatggataattcctggaatcgtgcaatgattgtcaatgcacctcgaggaggagttcaatctcctactgacaactttgaagtgttttatattgattatgggaatcaagaggaggttccatacagtcaattacgacctcttgatccctcattatcagc

SEQ ID NO: 10792 - DNA, 365 bp, Gossypium hirsutum
  Clone ID: uC-gsflmaxxa057g07b1
tcggttctagcagccgcagccagcaagcagcgggagcttcaaatgagcgggggattgtctcacatgaaatttgagcacccaaggcatggtttccttggatttcttccaaggaagcgagcctctcttatagacgaaaagtgaaggcattcccaaaggatgaccctaccaaaccttgcaagctcactgcctttctggggtacaaggctggtatgacacacattgtcagagaggtcgaaaaacccggatctaagcttttacaagaaggatacatgtgaagctgttacaatcattgaaacccctcctatggtgattgttggggtggttggatatgtgaagacaccacttgtcctttgcttttttaacac

SEQ ID NO: 10793 - DNA, 409 bp, Gossypium hirsutum
  Clone ID: uC-gsflmaxxa057g08b1
tcgcctacgcgtccgcccacgcgtccgctttgatttctccttcgtagtcaccactcatcaccactatttccattactggaaacaaaaagagtccccccttccctctccaattcctttaaaaaccagtaaaaaaaaaaattttcctacatcctcaaccgtagcccatagatatataaaacaaacatatattcttctgaaccaaaaatatctataaatacccaatgcttcttttttaaatacagttgggactgtacaaagggggagagagagccagctttgtgaggaagaaaaacaaaaacccaaatgcataataataatataccctttgcttggtttgtgttttttggtttgtgagtgagaacaaagatctgggcttttgaacttattggtatctttatagctgagatct

SEQ ID NO: 10794 - DNA, 507 bp, Gossypium hirsutum
  Clone ID: uC-gsflmaxxa057g10b1
tcgattcgggaatgctctgaagccctcagagctctggtcatcggacctccgcaagcgcccacgcgacaccgtcgactttgccatttacggcaactggaagctgaaaagcttcgttttttcgcctataccgaagggtaagcgagaatctcggcgatgagtgctagcgttgattcgtgcattgactatggcgtgatactagtgcaggagtcatggcgctgatgaagcccactgaaacggcgcgagacgaaagggcgtggcgcttgggatggttgcggcgcctagggtttctgaaaccctaggcctttccgtattttgttaacaatttgggcctcttgggccccgttcgttttttgggctaagggtgtaatgggtaaataggttttgggccaagggtttaagctaatcgggtcttgggtgtaaccgggcatagggcttttgggctaaccgagtttggcttgtaatgactgttaaagggccttattaatggactgtaatatttttgttttt

SEQ ID NO: 10795 - DNA, 458 bp, Gossypium hirsutum
  unsure (1)..(458): unsure at all n locations
  Clone ID: uC-gsflmaxxa057g11b1
tcgaatcatttaatgcaggggtctttctttccttttacaaacactgacatgcaagcagcagcctctaatgttctaccaactttatctctgtggttgatgacttgggaaaagaggaaacaagcatgaggctgatgaacttgcagagaagatgttagagatggcttcagatggtagagtggaaaataagatatctcgaaaaccaaagaaattgatccatagaaaagaaacgaagtatggtggagatgactggcaaacaatagtacacaggtatggctaaagtagtaattctgtttggtgctaaatgataatttccaaatatagacagtagtgaactatagtcttccctcaaaaaagtattaaagaaccattatctaataaaatcacatatgtcatgtcatgacactgccaagtaagccctttggtatcctggactcctatatgtgatatattntttatta

SEQ ID NO: 10796 - DNA, 389 bp, Gossypium hirsutum
  Clone ID: uC-gsflmaxxa057h01b1
cattagcatatggtttggttggagtccaagtctcggagagtgaggaggatgaggtgatccatcatgctgatagcctcggatatgaatatgtactggtaaatgatgacgagaactttcaacttttgatgcattagttagatttaattcccaagtagacagggagaggctcagttcacatcttagagaaaggcatgaagccgatagaaaggggctttccaatcctcttaatcgccagtggaatagccaggtcatgtggttattctcattcattttttgtaatatatgggtttgggtactgctggcttagtagattactaggtttcttgctatgtaccatcacacatgcatatatgtgtttgatgctttgaatcagttaataatctatcttg

SEQ ID NO: 10797 - DNA, 491 bp, Gossypium hirsutum
  Clone ID: uC-gsflmaxxa057h02b1
cgttttccttttgtttctggtcaagccaatctcgggagacggcccttttagctcacagctcctctcttgagtactataatgggtaaggagaaggttcacatcaacattgtggtcattggccatgtcgactctgggaagtctacaaccactggtcatttgatctacaagcttggtggtattgacaagcgtgtgattgagaggtttgagaaggaggctgctgagatgaacaaaaggtcatttaagtatgcatgggtgcttgacaagcttaaggccgagcgtgaacgtggtattaccatcgatattgccctctggaagtttgagactaccaaatactactgtactgtcattgatgcccctggacatcgtgacttcatcaagaacatgattactggtacctcacaggctgactgcgctgttctcattatcgactcgaccactggtggtttcgaagctgggatctcaaaggatggtcagacacgtgagcatgcttt

SEQ ID NO: 10798 - DNA, 490 bp, Gossypium hirsutum
  unsure (1)..(490): unsure at all n locations
  Clone ID: uC-gsflmaxxa057h03b1
ctgattactttttgttaagattaaatgattctcctgaagccaaaggcgcttcatttttctattttttatgttgtttctagcttataattgcctgcagcaagggaggaaccagcattgaagaccttgcagagaaatatcctgatatgattattaaggtacctgttgatgtcttcaagggaattactgatgaagatgctgccagagttgttgatggtttggctcccaaggttgccgatagaaatgattctattgaacaagtgaagaaactatataagcttttctgtgaacgtgattgcacgttgttggaaatcaatcctcttgctgagacttctagcaaccaattagtagctgctgatgcaaagttgaactttgatgataatgctgcctttcgtcaaaaggagatatttgctctccgtgatccatctcaagaggatccctcggaggttgctgctgccaaagctgatttaattacattgngttagatggagaa

SEQ ID NO: 10799 - DNA, 521 bp, Gossypium hirsutum
  Clone ID: uC-gsflmaxxa057h05b1
cccacgcgtccgccattctacattaattgccaagatttggatccagaaattataggaaatattcatggcatcacggctgcaaatcgagggcgatgcctcagtgctgcttcgagtcactcactccaacctcaaaagcttcgccgctgacattcgcttctctcttcagatgagcgtggaagcagtgaaagataagctatggaagaaatgtgggacttcagtaaattcaatgcggttagagctatatgatgattgtaaaaataaactttgtgatttaagggatgattcaagacctctcggtttctattctccagtagatgggttccgactacacattatagatcttgatccttcatcggtaacttcgggagggtggcttgaagatacgtcattagtcgagaagtactcgatttctgaagatgaatacaataaacgttctggtacatttaggaaattcaaggaacagatggcatctcaaaatccatcagaattcaggaataaaatgtcagatgactacatgggag

SEQ ID NO: 10800 - DNA, 497 bp, Gossypium hirsutum
  unsure (1)..(497): unsure at all n locations
  Clone ID: uC-gsflmaxxa057h06b1
ccttcgcgtccgcagtttctcatcaaccaaacaggaaatttcagtctaaaattcggattgtcgttttctaagttaaaatagaaggggagtgagggattgagactgatagcgataaggagatactgttttttatttgatttagcgaaggatgtctgcggcagtgtgcgggagcaagagatcgttcttcgaagatatcccgtcaccgccatcggcttcttcctctaagaagcttcggcgctgctcgccgtcgtctccttcttctgttcgtttatctccgtcgccatctgctctcaatcacctccagtctatcttccctcacatggacccccagcttctggagcaagcgctattagaatgtggcaatgatatagacactgccatcaagaagctggaggatctttgcttangagcagcagaggctagagggggaaagacttgtaccgttgaggaactgggcacatactgagcagggtatattgactaataatggagaagct

SEQ ID NO: 10801 - DNA, 458 bp, Gossypium hirsutum
  Clone ID: uC-gsflmaxxa057h08b1
tcgcctttgcgtccgaaccagcaaaagaaagggagaggaggcaaccctttataccccactttaagttactcaaaatttccgtacttttcctttttgcatggcagtaagtctattgtcacatgagttgtctgacctgtgtcttgggaagccagcactaaggtcactttccatcacatccaccattgctgaagctcttgaggtcttgaaaacctctgatgacaactttgttagtatctggaattgtgatgatgatgagtgctgtagtagatgtgtaggcaaagtttgcattgtggatgtgatttgttatctttgcaaagatgaaaatttcgtatcaccttctattgctttgaaacaaccagtttctgtacttttacctaagatcccttgtcttattatccatgtggaaccatcttgcagcttgttagaagcaattgatcttatacttgaaggagcacaaa

SEQ ID NO: 10802 - DNA, 479 bp, Gossypium hirsutum
  Clone ID: uC-gsflmaxxa057h10b1
tcgcttttaatggcagaaagagaaatttgagagagagtgggaagagttagatgggaaaaagttaaaaattgagaaagagttgaagaatgtcaacctacagcaggagaaatttgacaaagaaaaacttgctgaggatgaaaggttaaagaatgagaagcaagtcgccgaggattgtataaaaagagagttggaagctcttgaagttgctaaagaaacatttgctgccaccatggaacatgagcggtcagtggtagctgagaaagctgaaagtgagagaagccaaaggcttcatgaccttgagttgttgaaaagtcaacttgagagtgatatgcaggatatatttgaggagatggaaaaggaattacgagagagaaaaaagccctttgaggaagaaaaagagagagaattgtacaatattaattatttaagataggtagctttgagagagatggaagagttgaaacaagaaagacttaaga

SEQ ID NO: 10803 - DNA, 498 bp, Gossypium hirsutum
  unsure (1)..(498): unsure at all n locations
  Clone ID: uC-gsflmaxxa057h11b1
tcgattataaaagaacggcggaaaaaggcctggggaaagcgtgaaggactttcaggagctgatatgcggtttcttccagacagtgccgccatggataatgaccagcagtgttacaaatcaagggcgggatgagatactgttgcatatggctcaacttcgaaattattggctgaaacactgaagggaagagaacccatggtcaaagctttttgtatgttgttaacgtagttgattttcaaacgccatttatttcaagtatcccaatgattacattttcattccgatacacaatcagtgtctgattagggatggtaagataactggaatttatcagactgactcagacctaacctgaccttataaggagatatataacttttgaaaatcaagttcagtgattgggtgagacttanagtaaaatgttggggtgttttataaatgtatattaaaatattaaaaaataaatactttcatgaaatacttaccttttttaatgcc

SEQ ID NO: 10804 - DNA, 459 bp, Gossypium hirsutum
  Clone ID: uC-gsflmaxxa058a02b1
aatttaatcaaattactctttttattaaaaggaaggaaggatgaggtggaaatgggtggtaaaagaatcgagggcaatgaagtttatgctctagcaatgtgtgtaagtattctcctctttgctccgattgttgtgtcacaaccaataccggcagataaatcccaagtggaagcttggtttaatggcattatcaagccggtgaaggaaaggggtacaaccttagaccctgaattggttcaagccgagacagaacctagaatcataaaggtgatgcaaggtgggggtggagaattcgataccataaccaaagccatcgagagcgttccatcagggaacgccaaacgcgtgattatatccatcggacctggatcttacaaagagaaaattagaattgaaagaaataagcctttcattacattgttaggagatcctaaaaacatgccaaatttgacatttgac

SEQ ID NO: 10805 - DNA, 355 bp, Gossypium hirsutum
  Clone ID: uC-gsflmaxxa058a03b1
ggttatacatacaacgagaaagaaaaattcgaagagggagagaaaaaatgtttggatacgatcgcgtaagccactcgagtgccaacaaggcggatgagatagatttagaatcaggggagactttgtacccgggactcagctacggcgagaaccaactccggtggggttttatccgcaaggtgtacggcatcttggcggcgcagctggttctaaccaccgtggtctccggcttcgtggttctttctgctccggtcaacgagctccttcgtggaaattctggcctcttgctcttcctctggttaatccccttcgtcttgttatggcccttgcacgtctatcaccaaaagcaccctgt

SEQ ID NO: 10806 - DNA, 422 bp, Gossypium hirsutum
  Clone ID: uC-gsflmaxxa058a04b1
aagtacaattaagggtttgattttgatttgagagagaatcgaagaatgaatggagattcctaggcaaatctcagcaatggaggcattcgagaaattggagaaggtgggagagggaacctacggaaaggtatacagagcaagagagagagcgacggggaagatcgtagccttaaagaagactcgtctacacgaggacgatgaaggcgttcctcccaccactctccgcgaggtctccatcttgcgcatgctctctcgggatcctcatgtcgtcagattgatggatgttaaacaaggacaaaacaaagaaggaaagacggttctttccttggtatttgagtacatggatactgatctcaagaaatacatccgctcctttcggcaaactggggaagacattcccgttacattgtcaagagcttgat

SEQ ID NO: 10807 - DNA, 528 bp, Gossypium hirsutum
  Clone ID: uC-gsflmaxxa058a07b1
tcggttttgatgatggttgttatgaagattggagtcgtgaccttttagtggcacggaagatattgggaaatgagaggcttcctagaattcctcatacgatgattcttgaaggtggaagtatacatgtagatggagaaggaacttgcctcactaccgaggagtgccttttgaacaaaaacaggaacccaaatatgactaaagaagaaatagaaaatgaacttaaggcatatcttggtgttgagaaggttatctggctgcctcgtggattatatggtgatgatgatacgaatggtcatattgataatttgcgttgctttgcaaagcctggagttgttgtgttgtcttggattgatgatgaaaaggaccctcaatatgaacgttccatggaagcattcactgttctctcgaatgaaaaagatgcccgtggtcggaaattagaaatagtcaaactccatgtccctggcccgctttatatgacagatgacagaactgatggacttgttcaagatggtgaccctaaagcaagac

SEQ ID NO: 10808 - DNA, 527 bp, Gossypium hirsutum
  unsure (1)..(527): unsure at all n locations
  Clone ID: uC-gsflmaxxa058a08b1
tgttattttgccttttcgctatcgtctttgcctatcaactccacggcgcagatccgaggagtctctatttttcaatccaaacaacccctctaaacactctcttcttttattgctcctactcttccagtcatggcaggcttggcaccagaaggatcccaatttgatgctcgtcaatatgaccagaaaatgactgagctgctccagactgatggagatgactttttcacaagttatgatgaagtttatgacagttttgatgcaatgggacttcaagagaaccttctgaggggtatctatgcatatggttttgagaagccttctgccattcagcaaagaggaattgtaccattttgcaagggtcttgatgtgattcaacaggcacaatccggaactgggaaaacagcgactttctgctctggaattctacagcaactngactatgctgtagtccaatgccaggcttctgttttggcacccacaagggagttggcacaacagattgagaaggtcatgccagcacttggtga

SEQ ID NO: 10809 - DNA, 489 bp, Gossypium hirsutum
  Clone ID: uC-gsflmaxxa058a09b1
tgtcttcgcgtccgattgattccgccggcgagggccctttgaattaccaaccggatgtgggtattccaaatgacgacgtcgttttaatccaattacccaaagacccatcggaacccaccatcgtcaccgtcaattgccccgataagcccggtctcggctgtgatatttgccgtacccttctcgaattcggactttcaatcaccagagcagatttttcgacggatggaagatggtgttacatggtgttttggttggttccaaatgtttcgaattcatgtgaaattgattgggaaagcttgaagaataggcttgtttcgatgtgcccttcgtgtttgggtccatttttttcctttaattatcagcaaggaggagatggaaatggaagcacaacccatcctttgattatttgttgaaactttgttgctgggaccaaagcaattgctgaatttggagttgttttcttgcttttcaatattggccttgagttat

SEQ ID NO: 10810 - DNA, 404 bp, Gossypium hirsutum
  Clone ID: uC-gsflmaxxa058a10b1
ccctcgcgtccgttcttcaacttcagcatcttcaggatacttcgtgatcccccgcacttgctcctctcacctaccaccgccacatcacttcattccctttgctttcgcttttttcaaaaatgttgggggctccgatcaaaatatcttcttcgccttcttgctgttcttcttctgaaaatagaaaggcgatcatgttgtcgccggtttgtttagataaatcgaggtcttttcagtttcttttctcgggttctaaattgcagtgctccaaaactttggatatcaagcagctctccagcgccaagttccgggtctcccgaggatcgaaatttcgagttttctgtgattccaagacacaagaagttgcagattagaaggtgttcgcctttactagaaaaggcatcact

SEQ ID NO: 10811 - DNA, 517 bp, Gossypium hirsutum
  Clone ID: uC-gsflmaxxa058b03b1
cctttgcgttcgcccacgcgtccgagtgactacgccacttcaacaacttccatcactcctaacccagctgcactcagtgagtgaaccatctcgagttcttcagctttcgatcaatggcaaccctgacaacctcacactttgtttcgacaagttctcatttcagcagccatggagcagacactaaggccaatcttgcacaggttggtgccaggaatcaagccatgactcacaatggtttgcggtctttgaacaaggtcgataggttgcggatgaggaccaccaacgcaaaggctgtcgttacgaaagctatgaaacaggcagattacaggcctttgggaaaaattatttgcggaatagggatgaatatagtgtttgtgtcagctgagtgtggcccctggagcaaaactggtggactcggtgatgtcctcggtggactttcttccgcaatggctgccaaaggacaccgtgttatgacagtgtggcctcgctttgatcagtacaaggatgcatgggacac

SEQ ID NO: 10812 - DNA, 474 bp, Gossypium hirsutum
  Clone ID: uC-gsflmaxxa058b04b1
ccctcgcgtccgcccacgcgtccgcccacgcgtccgcagtcgacgaagctcttcagattgtgctcagcgttgcccagaaactgccacctgtcaccgtcccacttcaccaagctcttggaaaagttttggctcaagatatcgttcctcctgaccctttgcctccttatccagcctcaatcaaggatggttatgctgtgattgcttcggatggtcctggtgagtatcctgtaatagttgaatcaagagctggaaatgatgggcttggtgtcacagtgactcctggaactgttgcatatgtcacaactggaggaccaatacccgatggtgctgatgcagttgtccaagttgaggacactgaacaggttaaagctccttctgaaacaaagtatgtaaagatatttggtgcaactagtaaggtgttgatattcgtcaagtgggatgtgacattcagaaagatgcagtagttctaaaatc

SEQ ID NO: 10813 - DNA, 441 bp, Gossypium hirsutum
  Clone ID: uC-gsflmaxxa058b06b1
cattcaaattaaaaaagaagcaaaaaaacatggccaaaggtctgttgttcattgctctatgtgtgcttccagctttggttagtgctacacgcattctgaataaccaattggtggttgaaggctatgtgtactgtgatacttgccgtgctggttttgaaacccctaagactagaaggctagctgatgccatggttaagctggtatgctccgacaggaagaccggcggagttgttttcgagaaggagggatataccgacaaaaccggaaaataccagattcgtgtatccgaggatcacttggatcagatctgtgatgcagttcttgtgaagagcccccagcttggatgtgccacaatgtcccccggtcgtgaacgtgcccgtgttattttgaccaactccaatggcatttcatccaccaccccgtatgccaatagcatgggct

SEQ ID NO: 10814 - DNA, 493 bp, Gossypium hirsutum
  unsure (1)..(493): unsure at all n locations
  Clone ID: uC-gsflmaxxa058b07b1
gggattgatgatggttgttatgaagattggagtcttgaccttcttgtggcacggaagatattgggaaatgagaggcttcctagaattcctcatacgatgattcttgaaggtggaagtatacatgtagatggagaaggaacttgcctcactaccgaggagtgccttttgaacaaaaacaggaacccaaatatgactaaagaagaaatagaaaatgaacttaaggcatatcttggtgttgagaaggttatctggctgcctcgtggattatatggtgatgatgatacgaatggtcatattgataatttgtgttgctttgcaaagcctggtgttgntgtgttgtcttggattgatgatgaaaaggaccctcaatatgaacgttccatggaagcattcactgttctctcgaatgaaaaagatgcccggggtcggaaattagaaatagtcaaactccatgtcccctgcccgctttatatgacagatgaagaggctgatg

SEQ ID NO: 10815 - DNA, 479 bp, Gossypium hirsutum
  Clone ID: uC-gsflmaxxa058b08b1
tcgcttttgtcacttattgtatcactttcgtccaagagctgagattaggagagactatgggaatcaaccatttcatccttgcacttatctccctcacctgtctcttctccttctcaacctctaccgatgcacctccacccctttttgatgcttctggctccgcttctttgaaactttatgatatgattgagatcatgtcagaatcaccatctccatttgcattcgatggtacaatattggaaagtattgaggatgtgttaagcatactacctggaggtgttgaccctgcccttcaggaaatttgtgggaacactgaccaccccgtcgaatgtataaaagcaactatgccattcctagatgagaaagctcctattaagcctttttctgtccttaaagctggggttgaagcaatggataaccagaccaaaaatgcattggctgaggttacaaaactctcaatgaaccctactacccttaaa

SEQ ID NO: 10816 - DNA, 527 bp, Gossypium hirsutum
  Clone ID: uC-gsflmaxxa058b09b1
ttgcccacgcgtccgcgcaacgagaacagatttggaaacccaagaaaaagaaaacctttttttattagtatttttcaatttcatataagtatatacaatcattgcaatttcaatcattttctcaatccatctttctcaaagggatagctgagcaatttgggaataaaatgggagtgaaggtggagcactgatgtcactgttctggtttgtgattcgtcaactagctgaaattgaagaacaaatggctacctcgaagaaagtgattacacgggaagagtgggaaaagcgattaaacgatgttaaaataaggaaagaagacatgaataaattggtgatgaattttctcgtcactgagggttatgttgaagctgctgaaaaatttcaaatggaatcgggaactgagccagatattgatcttgcaacaatcacggatcgcatggctgttaaaaggctggacaaaggggaaatgttgaggatgcgatcgagaaaggtaacgattaaatcctgagccaagtttttagaggagt

SEQ ID NO: 10817 - DNA, 438 bp, Gossypium hirsutum
  Clone ID: uC-gsflmaxxa058b12b1
tcgccttcgcgtccgcaaaaggtcctagatgttggctggggcatttgtggaggtgacatttatatggctgaggaatttgatgttcatgttgtgggcatcgacctctccgtaaacatgatatcctttgctcttgaacgagctactggactgaaatgctcagtggaatttgaagttgctgattgccccaagaaggtttatccggacaacagttttgatgttatctacagccgtgacactattctacacattcatgacaaacctgcactgtttagatctttctacaaatggttgaagccaggaggcaaactcctcataagtgattactgtaaaagttccaagactccatccacggagtttgctgcgtatatcaagcagagaggctatgatcttcatgatgtaaaatcatatggacagatgcttgaagatgctggttttgat

SEQ ID NO: 10818 - DNA, 526 bp, Gossypium hirsutum
  Clone ID: uC-gsflmaxxa058c01b1
gtaaattttgtgttcagggctacccaactattcaggggttcttaaaaggctcttgggatcctaaaaaatatgaaggaccacgaaccgcagaggcccttgctgagtttgtcaacactgaaggagggaccaatgtgaagatagccacattaccatccagtgttgtagtgctaaatgctgataattttgatgaggttgtccttgatgagacgaaagatgtgttggttgagttttatgcaccttggtgtgggcattgcaaaaaccttgctcctacctatgaaaaggtagcattggcattcaaaatggaagaagacgtaattatagctaatctagatgctgacaagcacaaggatctagctgaaaagtatggagttagtgggtatccaacactgaaattcttcccaaaaacaacaaagctggtgaagactacaatggtggcaagggtctagatgactttgttcctttatcaatgaaaaatgtgggaccagccgtgatggaaaagggcagctgacttaaaggctggtatttt

SEQ ID NO: 10819 - DNA, 535 bp, Gossypium hirsutum
  unsure (1)..(535): unsure at all n locations
  Clone ID: uC-gsflmaxxa058c03b1
gttttccataaaaagttctcattcattttcagtgtttgttttgtggaaaatgaaaacattttacaaacatggataaaatccaaagcaacattttggaaattgtcttaccgatttctaatccgtatgacattttccctttctcctttctcttctaagtaaattttcttccacatcctctgcctcctcatcttcgttcgtcacctcacctcaccatctccgtccgtcatctccatcgaccgtcggccttacttgtattttgaagaaaccctaaaaaattagcagccacagtcaagaaaagaagacccagaagcaatggttctctctctgtcatcaacaggatgggaatgaagttttctttaggatcaaaagaaacactcaactgaagaagctcatgaatgcatattgtgatcgacaatctgtggatttcaactcgattgccttcttgttcgatggtcaccgnctgcgaggcgaacaaacttctaatgagctggaaatggaagatggtgatgagatcgatgttatgcttcaccaaact

SEQ ID NO: 10820 - DNA, 399 bp, Gossypium hirsutum
  Clone ID: uC-gsflmaxxa058c04b1
ccctcgcgtccgcccacgcgtccgcccacgcgtccggatacacgccccttcttacttttatcattcaataattttcatcaacgaagaaaaatgagagagtgtatttcgattcacattggccaggccggaattcaggtcggaaatgcttgttgggaactttactgtctcgagcatggcattcagcctgatggacaaatgcctagtgacaagactgttggtggaggagacgatgctttcaacacctttttcagcgaaaccggtgccggaaaacacgtccctcgagctatatttgttgatctggagcctactgttatcgatgaagtgaggactggaacataccgccaactgttccaccctgagcaactcatcagcggtaaagaagacgctgcaaacaatttt

SEQ ID NO: 10821 - DNA, 488 bp, Gossypium hirsutum
  Clone ID: uC-gsflmaxxa058c05b1
tgctattttcccctttttacccttccaccactactagcaacgttgccgtcatttcagtcgctgacccaaccacaccgacgaaaccataatcaatggctgccgcgttacaattacaaacacacccttgcttccatggcacgtgccaactctcacctccgccacgaccttccgtttccttcccttcttcctcccgctcgtttccatctagcagacgttccctgtccgcgcatgtgaaggcggcggcgtcgtctttgtccaccaccaccttgcaggaagggatagcggagttttacgatgagtcgtcggggatttgggaagacatatggggtgaccatatgcaccatggatattacgagccgggttccgatatttcgggttcagatcatcgtgccgctcaaattcgaatggtcgaagaatcgcttcgttttgttggaatatcagaggacccaacaacaggccccagagaatagttgatgttgggtgtggga

SEQ ID NO: 10822 - DNA, 508 bp, Gossypium hirsutum
  Clone ID: uC-gsflmaxxa058c07b1
gatgaactctacaaatggcagaaacaggaggaaaatgccttcaattccaaaaatgcactttctccgtccaaatggcccagacccttggcatgcttcgataagagatgcttctgttaaaatatttccttaagctaacatttccttctatttatttctaacccattcaatttatggtatacgaaagatgtaaaagtgtgttccaacacactaactagacttgtagttgtatgttcgatctgtcgagaagtgtgtgtgagagggaaaagatggggattctattagtagcatctagtcagcttacctggtcatttggatggtagtatctttagactgtcttgtttatgatttgtctgtttatataatatgattgagccattttttgcatttgaaatgtagtcaacatgactgatcgtataagatataggaagttaatattgcaatgccttggtcaggtactgtgaatgctttgcatctggcatgtattgtgatgagtgcaattgtgttaatt

SEQ ID NO: 10823 - DNA, 522 bp, Gossypium hirsutum
  unsure (1)..(522): unsure at all n locations
  Clone ID: uC-gsflmaxxa058c08b1
tcgccttcgcgtccgcccacgcgtccgctcttttctgcacctcaaatttccaataataataataatggaaaaccaaaacccgctccaaaatggagctcttgagggtgccgctggaaacggtggtcgcagtggtgatggatcggctctgatctttcttggaaccggctgctccagtgccgtcccaaacgctatgtgcttgattcagccctctgatcctccctgtcaagtctgctcccaatccctctccattccccccgatcgtaaccctaattacaggtgcaatacatctttgcttatagattattgttccagcgatggtatacgcaattatattattattgatgtgggcaagacatttagggaacaagttcttcggtggttcactttccacaagattcctcgagtagattctattgttttgactcatgaacatgctgatgcaattcttggtttggatgaatttcgtgccatccaaccttatagtcctactaacgatattgatcccaccgncatttaccttac

SEQ ID NO: 10824 - DNA, 519 bp, Gossypium hirsutum
  Clone ID: uC-gsflmaxxa058c09b1
cccacgcgtccgcccacgcgtccgcgctagcgcacatattattacagcagtcattggttcaggggttctgtcactggcttgggccacggctcagctgggatggatcgctggtccaatagtgatgattttgttttcttttgtaacttattacacctccactcttcttgccgcttgttaccgctctggtgaccctgttaacggcaagcgaaactatacttacatggatgctgtccgatcaaatcttggtgggtttaaagttaagatttgtgggtgggttcaatacttgaacctttttggagttgccattgggtacacaattgcatcatcaattagcatgatggctatcaaaaggtcgaattgcttccatgctagtggcggcaaaaatccatgccatatgaatagcaacccttatatgattgcttttggtattggtgaaatcattttctttcaaattcctgactttgatcgactatggtggctttccattgttgctgctgtcatgtctttcacctactctac

SEQ ID NO: 10825 - DNA, 443 bp, Gossypium hirsutum
  Clone ID: uC-gsflmaxxa058d02b1
gtcgccatcatggtcacgggattcaggcagtgagcagtctaagagtgttggtggtggaatggatgagactagaggtagtagtaaggtgcaactgaaggatgttagggatgtgagctcacctacacggtcaagggattctttgggggcaggcagggttgttggggaatcaggggaggaggatttgaagaggagaagctccaagtcgaagtctaagtcaaggtcaccaacatggtcacgggattcaggcagcgaacagtctaagagtgttggtggtggtggtgtagaggagaagaagaatgaggaaacaccggtggagaatgggactagtactgagatggaggaacgtgaattttatcctggtcctcatgctaagtgtgaaactgatttggctactggagctggaaccgtgaatgatgggaatgagtttttgtaattataaatgg

SEQ ID NO: 10826 - DNA, 514 bp, Gossypium hirsutum
  Clone ID: uC-gsflmaxxa058d03b1
ccctcgcgtccggacccacgcgtccggacaactggtgaatcataccagatgactctttagattgttcaaaaaaggctgcccaggtgcaatctaaagagtcatctggtatgcttcattacttatctggtggtgcatgggatccacatgacatgaatgctgttgcgacaacttgtgaatcatcagtccagttttgggatctacgtacaatgaagaagacaaatgcaattgagcgtgcccacatccgcaatgctaactatgatatgaagaaaagtcatatacttgtcactgcagaagatgaatctgggatacacatatgggatcttagaaagcccaaaagtcctgccaaagagcttactggacatacacactggacatgggctgtcacttgtaaccctgagtatgatgggctaattctgagtgctggcacagactcaactgttaacttgtggcaggctcctatatctgcagaagataaagcaacatctgaaagcataactgaaccactcaatcaaca

SEQ ID NO: 10827 - DNA, 496 bp, Gossypium hirsutum
  Clone ID: uC-gsflmaxxa058d05b1
gctcaatgctttttgtgaaaagcacagtgtggaacagagagcaaaggctgaaactcagaagcatggagttgaagagttgaaaaacatgaagcaaattcgggttaaactggagaggttacgccttctttgtgatagaatcatcaaacgtgaaaaattgaagcgggagttggttgtttgctcgcatgaaatacttgcacgcaaaagagatcatgttactcgttcactgctttttcatagtccttttcatccagatgttagcttagaatcggcaacaacttccctcaaaggtcacacggatggttacagatcatgcagtgaatcgatgagatcagatgatataactgtagatagtactctttcagttaaacaccaaataaagattcctgtgtccgtggaaaatgatcaaaggactgatgatagttccacatcacagagcccttttgtcccaaagccaatggatagggttagattctctgggagcagatccctcagagat

SEQ ID NO: 10828 - DNA, 392 bp, Gossypium hirsutum
  Clone ID: uC-gsflmaxxa058d06b1
cccacgcgtccgcttttccttccctttttctttctttcctctcttggccttttttttaaaaaaaaatgcagagaatcatagcagtggtgttgtttttattttgcgccacttctcaattggcctcttctctcaatgatggtttgttgccaaatggaaattttgagtatgggcctaagccatcggaattgaaaggaactaaagtaatgagccctaaagcaataccgaattgggaaatttcaggctatgttgagtacatcaaatcaggtcaaaaacaaggtgacatgttgctaatagtacctgaaggaggctttgcagttaggttaggcaatgaggcattgatcaagcagaagattaaagtgattaaaggtatgttttactctctaaccttcagc

SEQ ID NO: 10829 - DNA, 387 bp, Gossypium hirsutum
  Clone ID: uC-gsflmaxxa058d07b1
tcgagtacatgctgagggccatatcatagactctggaggcagagatattatattaaagtttcaaggttgttgatacacgtctaatatttctgctgtagcaagaataacaattttgggtcaagccaaatggtaaagttgaacaactttaagtcttgttatcatgagttaaggctgaacctggggcttttgttcgggtttggtttcacttggttaatattctagaaattggtgctatttattgttgtcacgaaatcgctggacatacaaatgtactagcatggtgttctgtaaatttagagaactctttgttctcatcttgttcttataactttggttaaatattgatttttaagataaaacataattacataagaaagtcgtgctgtt

SEQ ID NO: 10830 - DNA, 443 bp, Gossypium hirsutum
  Clone ID: uC-gsflmaxxa058d08b1
tcgtgtatatcttaacagagagaggctactctgtcacggcaactgtcgaacgagaaatggttcgtgacatgaaagaaaaacttgcttatgttgctctcgattttgagcaagaattggagactgccaagagtagttttgctattgaaaagagttacgaattgcctgatggacaagttatcacaattggagcagagaggttccgttgccccgaagtactcttccaaccatctgtgattggtatggaagcagccggaatccatgaaactacatacaactgcatcatgaagtgtgacgttgatatcaggaaggatctatacggaaacatcgtgcttagcggaggatcaaccatgtttcctggtattgccgataggatgagcaaggaaatcacagctctcggccctagcagcatgaagatcaaagtggtcgcaccttcaaaaagaaaa

SEQ ID NO: 10831 - DNA, 499 bp, Gossypium hirsutum
  unsure (1)..(499): unsure at all n locations
  Clone ID: uC-gsflmaxxa058d09b1
tcgctttgaacccagatcattgatgaaatcttgcaatcttttaaatctattcggcctcggtcccgcccccggattgtgtatgatcttcttctttcctacacccttcagagttccgacccaatccctctttcacttgccgtgctgcaatgcactcttcgttctggctgtctccctgctccccaaataaaactcctcctatctgaagcgtggcttaacttccgtggccattcacagccggtgtcagacagccttctggagatgcaagacattgggtttttccctgactctatgacatgtaattaccttatatcttctctttgtgctngtgatcagttggaggaggcagctaaaatcttgaagggtatgagcggagctggctgccctcctgatctggagagttttgctggtttaattactgcaatgtgcacatttagaaggactggtgatgcaatagagttagtgaagcaaaggtgcaaaaagcttgattgacaccaaggca

SEQ ID NO: 10832 - DNA, 531 bp, Gossypium hirsutum
  unsure (1)..(531): unsure at all n locations
  Clone ID: uC-gsflmaxxa058d12b1
cccacgcgtccggcaggtactctagcttccggtctcccggttgactcttttgtcacacttcaactgctagctccacttccaatatttctcggtggtctacctctattagcagcactagtttgtctggcactctaaaatttttcttcttcaacactttttgggaaatccttaatataatgttctcgggaaccacatttgaaacaagcctggctaatcgtccaacactccctgaaatgttgtttaccacagtactgacactcgagtctattagatctcacattacctacattcgccattgaagtagcttgagctttaaaaccctaatatgatctcccacaatcccgatacgagtgtccagttgaaacagtcaaccgaggattcatttctttagacttctttgactgagattggaatgacttactcattggcctctttcttgcgtcactggctacattcacagctttccttttctcgttgctcagtttttcagctttacaagctcgatcaccaataccacanactctttcactt

SEQ ID NO: 10833 - DNA, 461 bp, Gossypium hirsutum
  Clone ID: uC-gsflmaxxa058e02b1
ctttcgcttgggctgaaaactttaaaaatccatcccacaccgaccgttcaaagtgtagtggttgtcggcgagctttttctgatggggattcgagaaagtcacacgttcagtgcctggaaatggctaggcttcgtatctgcagtatgggtgcagaccatttcaggcaataattacactttctcaaactactctgatgccatcaagacgcttatgaaccttacccagcttcagcttaacaatttgtcagtggctaaagatgttggtaaggcttttggtctccttgccggtcttgcttctgatcgtttgcccactcccgtcatcctccttattggtgccattgaaggcttgattgggtatggtgctcaatggcttgtcgtcagtcagaaaatccaaccacttccttactggcagatgtgtatatttatgtgcttgggaggcaacagcaccacatggatgaacac

SEQ ID NO: 10834 - DNA, 431 bp, Gossypium hirsutum
  Clone ID: uC-gsflmaxxa058e03b1
cccacgcgtccgcggatcccgtggttcgaccttctttcacagagattgctagacgtttacgaatcatgtcatcagcatgccagacaaaaccacagggtcatcagatgcagaaccaagcgtccaagtaaaatgttcctcaaataatccccatattttgatgctagatgcactcattaatgacattatgatagtatatgttcttttacatactccataaacgtgtgtattattttatatgaagggtaagggaggaggatctcccattgagtttgagagggggcctgtgagatatgatatgatatgatataattgtgttttgcaagtcaaagaaaaatatgtttatatgtaaagctcttattatttgtgtcacaatcaatatccattttggtgcttgcttgtaactaaagttcaatacaatttttttttttttt

SEQ ID NO: 10835 - DNA, 484 bp, Gossypium hirsutum
  unsure (1)..(484): unsure at all n locations
  Clone ID: uC-gsflmaxxa058e05b1
cagagcacgtccagttccacattccactacttcccaaagctgattgtgaatttctcattccatcaaaacactcgaaaaattggtccacgctataaagaggcaagaaactcaacaggttagaagaatcgcatttgaaaagattacaatgcataatcttaggaggtaagtttcagcattaaattctccctcattcatattttatactcagtaatagtcgatgcagaaccattgaagcaatttttagaaaatgttctttaatattcgaattagaaatgcttaagatttcttttttatgaacagagataacatgcgaaacaatgacagtaaatactacacgcaagctagacggggcttttttctttggtattctctaaattttggtactcgtagatatgatatataaggtttctgaataaaatcttagaagcttatgatattagttcctttcagaaaaactctacatanaatttaattctgcagaaac

SEQ ID NO: 10836 - DNA, 499 bp, Gossypium hirsutum
  Clone ID: uC-gsflmaxxa058e07b1
ttggtttcaggcatttattggagaatctgagttggccagaactgaggttgtcaagagattgtggacctatatccgagagaagaatttgcaagatccaaaggacaaaagaaatgtattatgtgatgactcattgtatgctctttttcgtgtgaagtccatcaacatgtttcagatgaataaagctctgtctaaacacatatggccattaaatgaggaagaagtgacggttcaagctgactctgcaaaaacagaaagaaaatctaaacaagcaagggaacgggttgcagatgaaccaaaacagaaagaaaagaagcagaagaaaggggcatctggttttcttgctcctcttcctctttcagatgctctagtgaaattttttgctactggtgaaaatgcattatctcgcgctgatgttgtgaagaaaatgtgggagtacataaaacagaatgatctacaagatccatctgataagaggaggattttatgcgacgataagctc

SEQ ID NO: 10837 - DNA, 522 bp, Gossypium hirsutum
  Clone ID: uC-gsflmaxxa058e08b1
tcgcatcaattctgttagatggcttcaaatgcagtcctcttccgatcttgatcttcattcgcagttgaaggaattgattcctgaacaacaggagcgcctgaagaaactgagggcagaacatggaaaagtgcaacttgggaatattactgttgatatggtcattggtggaatgagaggaatgacagggttgctttgggaaacctcattacttgacccagatgagggaattcgctttaggggcttgtcaattcccgagtgtcaaaaactattaccagctgcaaagcctgatggagaacctttgcctgagggtcttttatggcttcttttgactggaaaggtgccaagcaaagctcaggttgatgctttatctcaggaattgcgtgaccgtgctgttgttccagattacgttttcaaggccattgatgctctacctgtttcagctcatccaatgactcaatttgcaactggtgttatggcactccaggttcaaagtgaatttagaaagcatatgagaaaggaatt

SEQ ID NO: 10838 - DNA, 523 bp, Gossypium hirsutum
  Clone ID: uC-gsflmaxxa058e10b1
tctctttcacatttgtcaaggacagtggaagacatattgaagagaacaagcttaaggttgcccttgtcagcccttctgattcgccagtgctatcaccaattaatgggacaatgaatcagggaatggattatgatagagttgagacttttgcaacacttccaacggttgtgacgattgaggaatcaaagatgagaaatactgaggatttgaagccaacaaaggatgcagagtggaattcaaggaaagatatgttatatgaggagaaattaaaaccaaagaaggatgcagagctgaagcccatgaatgatatatttggtgacaatttaaatataataaaagacactgaactgaagccaaagacggatgcagagctgaagccaatgaatgatatttttggtgacaatttaaatataataaaagacactgaactgaagccaaagaataattcttttaatagcaaggagttaaagccggtgaaagatgaggaatcaaagccaatggaggatattctagagaccgagga

SEQ ID NO: 10839 - DNA, 523 bp, Gossypium hirsutum
  Clone ID: uC-gsflmaxxa058e11b1
tttaagcattagtggcaaagacatgatctttagagctggtcacattgatttaaaaagcttagacatgcagctggagaagcacctgagccgagtttggtctaggaacattgacaaacaaaggccagctgaggaatgggagattgatttggctaagttggatttaaggaatgttatagctcatggcatctatgggactgtttatcgtgccacttatgataatcaagatgttgcaggtaaattttcagattccatataaatatatatacttgtattatctatgttagttcttaagctttgtaacttgtttgcttgatgcagctttaaaaattatgttttgttaattcttaatctatctatatatatatatattgggtgtgtgtgtgtgttaattgtgattgaactttgtattgatagtttttcgagtaaaatattgattagtaagaccctttgtagtttattctgcatgttgaagcacatgcattatgtagaactgaattagggcctaagcatggtgatagagggt

SEQ ID NO: 10840 - DNA, 403 bp, Gossypium hirsutum
  Clone ID: uC-gsflmaxxa058f02b1
gattaatgtagtccaacaccaaaatgtcagctcttcttttgctttgcatgcttttcatttcttcagtgacaccaattcttgggtgtggttcatgtgggaaagcaccacacaagcatcgaaagcctaagggaaagtcccctaaaggtcccatcactttgcctccccttgtgaaacctccaatcaagttgccaccggttgttcctccaatagttaagccacccattgacctccctccggttacagtccctccaattaacctccctccagggacggttcctccagtaactaagccaccaagtgggaaaccctgcccaacaccaccaaccaaggacacttgccccattgacacactgaaattgggtgcttgtgtggatctgctgggagggttggtgcacattggact

SEQ ID NO: 10841 - DNA, 452 bp, Gossypium hirsutum
  Clone ID: uC-gsflmaxxa058f03b1
ctttcacttgctatacaaataaaaccttccacttgtttgtttttttttcttctcaagtcctaattgaacccatactatgccctccttcttttagttcatttccattccatctcttaccttaaattaattctctctttcagagcaaagatatcaaggaaataagaaatataaagtctcttatttttcttttctactttttttccccacacccaccacctttctttttgatttttgtgggttcttagcaacataaatatggggctaagggacattggagctacactgcctcctgggtttaggttttatccaagtgatgaggaattggtttgccattatctttacaaaaagattgccaatgaggaagtcttgaagggtactttggtggaaattgatttgcatacatgtgaaccatggcagctttctgaggtggcaaagtttgatgcaaacgagtg

SEQ ID NO: 10842 - DNA, 484 bp, Gossypium hirsutum
  Clone ID: uC-gsflmaxxa058f05b1
gtgtatagcttagacagtagcagtcttaaaaacaccgggaaccggaaacagtcgacgacgcagctaaacatgtcggaaagagaagaagattacgattctgatgcacccgaagagttttcaaatcagcagggaataaagcaagatgagaacataagaaaaatccagaaagaaaacaaggccagggttcgtcgtgagggaaaagaacgtcgaaggctttgggctcagaggaaaacaccccgtcaatctacaaaggttgaaaaggtccaagaagatgtagaaactgatgaggaatcttaggctaagaaggggatgctttctaccaacatcgttgaaatgcttgcatctcgtgaaaaacaagttttcttatccgactccgaggatgagaaggctgaggtaaatccaattccgagaaagaaaaagaagaaaaactcaggggttgaacccggtattttgaacgacatgccaccttcttaatgcttacaaa

SEQ ID NO: 10843 - DNA, 522 bp, Gossypium hirsutum
  Clone ID: uC-gsflmaxxa058f10b1
ttttaaaagaaaaaaagagagatggcgtctggaataaaatctgcaatcttaattctgtcggtgtttttatctgtacgcttcagttcgggtgttaggttgctccaggaacagcccaatgatgaccccaaaaacatggacgctattcctcccattgatgcactcaaccctaccgagttgaatggacccggtgttggcattcacgaagatcatgttgtcccaaaaggtgctgaaattggtactcttggttttggttttgaaggtggtcctgataaatgttgttcttctggatgttccggtaattgtaatcctggtggtttcgttctaccatttccttaaattccagaaatcccaagaatttcagaaatcccacaaatcccacagatccaacaaattccacaaattccactaatcccacagatcccacaatgtccacagattccacaagttccaaaatcccactaatgccaggacagtctgtatgtgagagtggagagtgttgccgtcaggttgtggtgggacttg

SEQ ID NO: 10844 - DNA, 521 bp, Gossypium hirsutum
  Clone ID: uC-gsflmaxxa058f11b1
ggatgtatctttagtctttgatcctaatttagtactgatgttgtttctggcggtgctcttgtttttgcttcagcaaattctcacttgtgcacaaatttatatccctgctgataatattgctctagattgtggttcttcaacttcaggcaattctgtagcactagatggtcgttattggaccggagataacatgtcgtggttcgcggagtccggtaaccaatcagtgtcggccagtgtccaaaagcataacagctctttccatggtgtgccttacatgactgctagaatgtctaaatccgaattcacctacatgttcccagttactgctggtcaaaaatttatcaggctctatttcaatcctgctctgtaccatggctttgacacctctgtctatttcttctctgtcaaggtaggcccttatacactgctcaataacttcacttcttccgttactgccgatcgttcgaggaaagggtcgtcgattagagagttctgtgtaagcttgatgcaaaatcaaactc

SEQ ID NO: 10845 - DNA, 482 bp, Gossypium hirsutum
  Clone ID: uC-gsflmaxxa058f12b1
cccacgcgtccgatccaaacaaaaccttcttacttaattttccaaagtttccgagtagctcatggtgtatcccatccaaatttagtcatttccctacttacaaggtaagctaatcctgtaaaggcagaattgtggagaataaaagagacagtgtaaacaccctagctactgctccatggccatggcaacagcaaccatgatgatgagcagaatgatgaatatgccaccgtcatcgtcatcgtcaacaccatcatcttcttcttcgccgttggcaactcagtcactctcaacaccatcatcaccatcttcatcaaggcaagcaagcagcctcccactccgtacaataccaggatcctacgggtggcctttggtaggaccgatatccgaccgtctagactacttctggttccaaggaccagacaccttcttccggtcgagaatggagaagcacaagagcacggtttttcgtaccaatgttcccc

SEQ ID NO: 10846 - DNA, 462 bp, Gossypium hirsutum
  Clone ID: uC-gsflmaxxa058g02b1
aaataattttatgtatttagctgctattgcggatgcgcaaccgcaatcgatgccaacaatgcctcctcagatggcaccacatcctgcaattccaaccggaggatattttatgcaacatcctcaggctgctgcaatggcacaacaacctggcatgtaccctcaaaaggtgccattgcaattcaataacccacatcaaatgcaagaccctcagcatctcctgcaccaacagcatcagcaagccatgcaaggtcaaatgggaatcaggcctggaggacccaataatggcatgcatcccatgcattccgaggccagtcttggaggtggctgcagtgctggcccccctcaatcttcaggcccaagtgatggacgtgctggaaacaagcaaaaccctgaaaccggtgccaatggacagggcagcacaaccggcgacagagccgaggagggaaagtgactgtgatggta

SEQ ID NO: 10847 - DNA, 526 bp, Gossypium hirsutum
  Clone ID: uC-gsflmaxxa058g03b1
gatgtatgggaaatgtacaagaaagccgaagcgtcgttttggaccgcagaggaagtcgatctgtcttccgatcttcgtcactgggaagctctcaccgctgacgagcaccacttcattagtcacgttctcgccttttttgccgcctccgatggcatagtccttgagaaccttgctgttcggttcatgaaagaggtccaaatctccgaggcgcgtgctttttatggtttccaaatcgctatcgaaaatatccactccgagatgtacagtctccttctcgagacttacataaaagattccgatgaaaagaaccgtcttttccgcgccatcgagacggtgccgtgtgtggctaaaaaagccgagtgggctatgaaatggatcgacggcggagaaactttcgccgaacggttaatcgcttttgcttgcgtagaggggatctttttctccggaagtttctgtgccatattttggttaaaaaagagggggttaatgccccgattaactttctcaacgagtaatctcacgagat

SEQ ID NO: 10848 - DNA, 503 bp, Gossypium hirsutum
  Clone ID: uC-gsflmaxxa058g04b1
gcgtggataccctgaatctctctcttcctctttaggtccacctcaatcccgattcaaacataaccctcaaggtgatgcacaatttccggaggatgagagcacgaagatttttgctaggaaagtagctgatcattatagtgcaagaactaatcagactctggaagaacgagaagcaagtccaatcattcacttaaagaagttgaataattggattaaaagtgtcttgattcagctttatgctcgtaagggggatgccgttcttgatcttgcctgtggcaagggtggtgatctcatcaagtgggataaagcaaaagttgaatattatgttggtgttgatatagctgaaggctcgatggaagattgtcgtacacgttataatggtgatgcagaccatcatcaacgtcgcaaaaagttcacttttcctgcccgtctattatgtggggattgttttgaggtgcgtctcgataaaagtttggaaatgatgctccttttgatatctgcag

SEQ ID NO: 10849 - DNA, 510 bp, Gossypium hirsutum
  unsure (1)..(510): unsure at all n locations
  Clone ID: uC-gsflmaxxa058g05b1
cagtggatatatatgagaaggctgatagaaagttcaggtgctccagggcacatgtatcccttggctctattgtgctatgacattatgccccctccatccaaggtggaaaaagaaattggagaaagaagaatcataagctttcatggggccggattatcagtagctccagaagttgctgctaattgtgaaaagtctgaagaggttaaggatgtatttacacaagctctatacaagtctgtgacagagcaatacaatgtcctcaaatctgccatacatggaaaacaagggttagaggcatccactgcaggtatagctntgtctcagccatggaactagtttatagttaaaaccatgtcaagttatcaacgtaactgcacccaaagccgtagccataggcaattcttacattacgtgtgtatcatgtttgatctacgtgcctattcaaatttgatgttttatgtcatgacatattttggagtgaagaggtccaataattattcattttctttt

SEQ ID NO: 10850 - DNA, 463 bp, Gossypium hirsutum
  Clone ID: uC-gsflmaxxa058g06b1
ccttcgcgtccgggagagatgggaggaggccatggagagagtacaacttacaaaggtctaactttgcatcatccaaagcgatggcatgttgtcaccggcaaaggcttgtgtgccgttatgtggttttgggtcttgtacagggctaagcaagatggtcctgttgtattgggttggcgacacccttgggagggccatgatgatcattctcacggtcatggagataagcattagtgactcccggattgtgtttaggcacaggaagattatctgattacaggcttgctgttgcagatgttgttccaaatgtcttttgttaatttcttcggtttcaataaagtgattgtgaaggaagattgtaagcataatgggatgaaatatgaaactccatttcaacattatgaaactccatttcaacatgattgtttttgctgtttttaagcatggatttttctgaatgaatgcg

SEQ ID NO: 10851 - DNA, 489 bp, Gossypium hirsutum
  Clone ID: uC-gsflmaxxa058g09b1
ctcaatcaattccttcatttaccctaaacgaaaatcagctgaaaaaaaaaccatttatttcttcagctctaagcgacaacaacaatggctgacttcaagaaagccactgctttgattctcacagtggctttgcttgtgaatctcgctttaatggttgatgctgatggtgatgatgataagaagattcgagtcaggaaacataagggtgagaagcagtgtatacaaggatgggaatgttcctactggtcgaaatattgttgcaacaaaacggtttcagatgtcttccaggtttatcaatttgaggacctgtttgctaaaaggaattcgccggtggctcatgctgttggattttgggattaccattcttttattttggctgcttccatttatgagcctttgggttttgggactactggtggtaagcgtatgcaaatgaaggaagtcgcggcttttcttgcacatgtcggcgccaagacatcttgtggagat

SEQ ID NO: 10852 - DNA, 492 bp, Gossypium hirsutum
  Clone ID: uC-gsflmaxxa058g10b1
tcgggttaacaaaaacactactatatatcaccatgccttcttcgccttcttttactcttgtgtctagatgcacggtttccccagaccaaaaatctgacatcaaaaccttaaagctttcggtttctgacatccctatgctttcatgtcagtacattcaaaaaggggttttgctcacttctcctccttattcgttcgacgacctcgtgtgcttccttaaacaatccctgtccactactctctcctacttccctcctttggctggtcgtctcaccactgaccccgacggtcacgtccacatcaactgcaacgatgccggcattgacttcctcgttgtgaaatcccccaatatttccattcacaacgttttggtccctggcgatgtctccgattgtgtcaaacagtttttcacattcgacaagacacttagttactcaagccacttcaagcccttagctgcagttcaagtaaccgagttggccgacggggtcttta

SEQ ID NO: 10853 - DNA, 530 bp, Gossypium hirsutum
  unsure (1)..(530): unsure at all n locations
  Clone ID: uC-gsflmaxxa058g11b1
ttgcactctctcaaattcagttaacaatttcacagttgttttcttcagtctctctctcagccatggctgcagccatctccaccgtcgctgccgctgccgccgccaaccgagctctgggagtgtcagtcccaacctcagctttcatggggaagaaagtgagctcaagattcaacagcaccaggcaggttccttcgggaagttttaaggtgatggcggcggagaaagagatagacgaagagacacagaccgaaaaggaccgatggaaagggttggcttacgatatttcggacgaccaacaggacattactcgagggaaagggatggtggattccttgttccaagctcccatgaatgatggaactcactatgctgtcatgagttcctatgaatacctcagccaaggtcttaaaacgtacaatttggacaacatggatggtttctacattgctcctgcattcatggacaagctngttgttcacatcaccaagaacttcatgtccctccctaacattaaggttcctctaatcttg

SEQ ID NO: 10854 - DNA, 531 bp, Gossypium hirsutum
  Clone ID: uC-gsflmaxxa058g12b1
tttatttaagaatcaaatatgctggaagacaatcttggaggcttgaaatgtgcattggattctattgcatctcaagttggttcttctatgttatttcattttgaaataaatttggaagtcaaacttcaacagttagctttttcacttttttgttgtaggagagagaagaagaggatccaggcttcggctcttctatgaatggtgaaaatcagttaaatgtgctagatgcaaatgaagggcaaaagtttgagattttggaactagagagtcagattgagaagaacaacttaattttgaagtctttgcaggatcttgattctacattcaaaagattagatgccttagaacagattgaagatgcattgacaggcttgaaagtcattggttttgatggaaactgcattaggctgtcattacagacatatattccaaaagtagagggtgttttgtgccaaaacatgattgaggatatttctgagccatctgaaatgaatcatgaattgctggtagaaattgttgatggaatcatgg

SEQ ID NO: 10855 - DNA, 409 bp, Gossypium hirsutum
  Clone ID: uC-gsflmaxxa058h01b1
catttcttaaaaacagtagaatcatttttctctcgggttgcttcatttgctctgtgactttccccagattttataaaatcttacgatttcttttcatctaccaaaaaagtagtacagaaaaaaaggatagaattcttttctttttcttttttttttcccgggaaactgaaatcagtttcaggtcttttttccttcacgttttctatttttttttctgttagtaaggcaatcaagaagttcgttctttcaattctcgagagagaagcataaacttatttcttgcatattttcagttgaagaggagaaggtgatttttctcgtgatttagagccattttaaatacagtttcagtttccatcagatccttttcagttcttctcaattatctttccattcaggtccttttgct

SEQ ID NO: 10856 - DNA, 310 bp, Gossypium hirsutum
  Clone ID: uC-gsflmaxxa058h02b1
aattgaggtacttcatggttgactgctgtgaaaagggcttgtagatcttctactaaagatagcccatgatgatgaaaagaagagagataaacggaggtggatctttaggaaacaagatacaagtcctgtgaagagtgtaggtaataatggtggtggtggtggtggtgcaagtactgcagcagcggagaaaaggcatgctattgctgtggcggtggctaaagcagcggaagctgaagctgcggtggcgactgcagaagcagctttacaagctgctcgggtgactaaacctagttatggcatgaaacatcac

SEQ ID NO: 10857 - DNA, 509 bp, Gossypium hirsutum
  Clone ID: uC-gsflmaxxa058h04b1
tttttcttttgggtttgttgtgtttcgaatcatcggcttcgcctaactttttctccttcaatttttcagatgtgggctgcttcatgccttgcatcgtgctgtgcggcgtgcgcctgcgatgcgtgccgcacggtggtttcggggataagccggaggtctgcaaggatggcctattgtggactatttgccctttctctgtttgtttcgtggatcctccgtgaggttgccgcccctctcatggagcagctgccttggatcaatcattttcacaaaacacccaacagggaatggtttgaaacagatgcggtgctgagggtcagcttgggaaattttctctttttcactatcctatcatttttaatgattggtgttaaaaatcagagggatcctcgggatggtttgcaccatggtagatggatgatgaaaattgtctgctggttcattttagttattttgatggtttttgttcctaatgagattatcagcttttatgagacgatatcaaagtt

SEQ ID NO: 10858 - DNA, 496 bp, Gossypium hirsutum
  Clone ID: uC-gsflmaxxa058h06b1
ccttgctttcgggccactgaaatcatgaataatgagaggggtgtgtaaaaaaatgaggagtcggaggcttcaaatggcattgagaaattagagatttcgaatggcactgatgaggtctccgaaaactcttcatctatgcaaaaagatgaagatggggtgacagaagttgccaaaaagaaaaagaagaaaaataaaagcaaaaaaaagaaggagcccttgaagcagactgatcctccatctattcccgttgttgagctttttccgtccagggagtttcctgagggtgaaattcaacagtacaaggatgataatttgtggaggactacctctgaggagaagagagacttggagcgatttgaaaagccaaaatataatgcagtgcgacaagcagccgaagtccatcgtcaggttcggaaatacattagaagtatcttgaaacctggaatgttaatgactgatctatgtgagaccttggagaacacagttcgcaagctca

SEQ ID NO: 10859 - DNA, 445 bp, Gossypium hirsutum
  Clone ID: uC-gsflmaxxa058h07b1
tcggctttatgctgctggtaaaaccaccattctttacaagcttaagttgggagagattgtcactaccattcctaccatcggtttcaatgttgagaccgtggaatacaagaacatcagcttcacggtttgggatgttggtggccaggacaagatccgaccattgtggagacattacttccaaaacacacaaggacttatttttgtggttgatagcaacgatcgtgatcgtgtggttgaagctagagatgagttgcacaggatgttgaatgaggatgagttgagggatgctgtcctgctagtatttgcaaacaagcaagatcttccaaatgctatgaatgctgctgagattactgacaagcttggccttcattctctccgccaacgccactggtacatccagagcacatgtgccacttctggtgaaggtctgtatgagggactggac

SEQ ID NO: 10860 - DNA, 400 bp, Gossypium hirsutum
  Clone ID: uC-gsflmaxxa058h08b1
tttccctctcgtccggaagaaatgacatcaacaggttggaagaaattagacttgccgaggaactgctaagccaactacaaaatcagtgcatcccagataaagcaataacatcgtcaatgaaggaattcggccttgaaagggcaaaaatgaatgggtggccaaatacgtatgtatttacaaaggcaatgggagagatgcttttagggaagttcaaaggagatttgcctcttgttataatacgccccacaatcattgcaagcacttacaaacaacctttccctggttggattgaaggtgtcagaaccatggatgttgtcctcgtgaattatggaaaagggaagctaacatgttttcctggcaatcttaactctgctcttgatgtgataccagtagatatggt

SEQ ID NO: 10861 - DNA, 443 bp, Gossypium hirsutum
  Clone ID: uC-gsflmaxxa058h09b1
tcgaaataataaaaaaaaatctcttaggtgctctgctagggtttaatccctagcgtcctcgcaccatccttagcagcgcgccgcaacccgatcgtcgtctcagcctccgaccgtgacggagggagactcggtgaagcaggtaagtggtctcttccttttttatttttttcgcaatataaaaacccaaatcaaaaaaaaagatctaaaataactccaataatcaccttaaaaaaataaataagcaactcgctcttcaattgatttttctctgtattttccgtatttctccgtccttattttgcagattaaatggccttttataggccgaaaagagaaaataaaatatataatatatatattttgcttgtttttttctttggactccttgagtccgtttttgcaggccttcgtggagaggccggcgcgcgtggagaggggtcggc

SEQ ID NO: 10862 - DNA, 498 bp, Gossypium hirsutum
  Clone ID: uC-gsflmaxxa058h12b1
ttgtattaatcggcggaagcagatagcctctagccatggctttctagcgtaggaatggtggccgcaacaagcatggccgtggccatgtcaaattcatccgctgttctaactgtggcaaatgctgccccaaggataagtcaattaagaggtttcttgtgaggaacattgtggaacaagctgctgttagagatgtccaagaagcctgcgtttatgacacttatactttgcctaagctgtatgttaagatgcaatactgtgtctcgtgtgcgatccactcccacgttgtgagagtccgatcccgcaccgataggaggaaacgtgatccacccgcccgcttcatcagacgcagggatgatatgccaaagcctggtcagcctggtcaagcaccacgtccaggtgttgcagttcctgctcgtgcttaaggcctgtgaaagcttttaagataaattttctatattcttattttgggtttaaatggttgcattaattttaagaaca

SEQ ID NO: 10863 - DNA, 219 bp, Gossypium hirsutum
  Clone ID: uC-gsflmaxxa060a04b1
acgtttacgcttccgcccacgcgttcggggtagtgagctttttaaacacaatgcttccaaagaagcattaggtgacttgtccattttatttgatgctttgtataaatcaaggtgcatagacaaagtggttttcgatttgagtctcgacagaggtcttgattattatactggtgtcatatttgaagctgctttcaaaggaggtgagcaggttgatttaat

SEQ ID NO: 10864 - DNA, 415 bp, Gossypium hirsutum
  Clone ID: uC-gsflmaxxa060a06b1
ttcacgcttccgaattgctttaaaagaacaatagcagatgaaggcatgatgtctttgtggagaggaaacgcagctaatgtgatccgttatttcccgactcaggccttgaactttgccttcaaggattactttaaaaaactgttcaactttaagaaggaccgtgatggctactggaagtggtttgctgggaacttagcatctggtggtgcagctggtgcctcttcccttctctttgtctattccctggattatgctcggactcgtctggctaacgatgccaaagccgcaaagacaggaggggagaggcaattcaatggcttggttgatgtatacaccaagactctcaaattagatggtattgctggcctttacagagggttcaacatttcaatgtgttggtataattgtgtaccga

SEQ ID NO: 10865 - DNA, 202 bp, Gossypium hirsutum
  Clone ID: uC-gsflmaxxa060a10b1
tttacgtttcacgcgtccgcacttagaaccttaaaatctgaaaccctcagaagcagatctttgttgggttatttgcaaaaacccgatgctactctaaagtaagcaacttaatttttaattccaccagcaatggcctttcgtttgcagttaactactttattattcatcttcttcattacattgaattttatcccaactagac

SEQ ID NO: 10866 - DNA, 72 bp, Gossypium hirsutum
  Clone ID: uC-gsflmaxxa060b01b1
tttactttttctggaacattgcgtcatgctgtgatccagaaccgtccactatggatcacttttgcaaggggg

SEQ ID NO: 10867 - DNA, 497 bp, Gossypium hirsutum
  Clone ID: uC-gsflmaxxa060b02b1
tttaattataaaaaaaaattatcgcacagaaaaatttattcatccaagttggaaacgtctgccgcaaatctccgctccgttaccgatatctgaaaaatgtccggccaaagccagcgcttgaatgtggttccaactgttacaatgcttggaatcatgaaagctcggcttgtgggcgcgacaagaggtcacgcacttctcaagaagaagagtgatgccctaaccgtacaatttcgtcagattctttaagaagatagtgtctacgaaagagtcaatgggagagattataaaaacctcctcattttccctaacagaggccaagtatgttgctggtgagaacatcaaacacgtcgtgcttgaaagtgttcagactgcttttcttaaaggtccgatcgcgacaagaggaatgttgctggagtgaagctttcaaagtttgagtattttactgaaggtgagaccaaaaaagatttgactgtgttggcccgaggtggacaacatgt

SEQ ID NO: 10868 - DNA, 51 bp, Gossypium hirsutum
  Clone ID: uC-gsflmaxxa060b10b1
ttaagaaagaaattttatcattaatattatcatttcttattgagtggaaaa

SEQ ID NO: 10869 - DNA, 271 bp, Gossypium hirsutum
  Clone ID: uC-gsflmaxxa060b11b1
ctcacgcgtccgatcaagcctgcccatgagtctcacacaccaccaatagtattttgcgctatttttcacacgtcggaacatgacgcccacctcgtcaaaattctgacttctgcttgctgttaccggtcttgtagccatattttctacaaccctatacttcactgagtccaaatagtgtagattcaaaagtcacctttttttaactaatatatttggtttctgcaagtatcttaattatatgaacttttcgtgttcgaattctaaatctttt

SEQ ID NO: 10870 - DNA, 487 bp, Gossypium hirsutum
  Clone ID: uC-gsflmaxxa060c01b1
ttatttttaattttccttgttcacttaaccgtgtttagagcttttttttcattttttgagggtttttttttgtttttctttacattatttgcttcttcaccttttttatttcaacttctgttctccaccatcattttaagggtaagtaacttttcctttcttatcttcttctttttgctatgtctttttctttttcaatggcctttgatgatgcttaaacatcttttgagatttctaagtcaccgatgatcgagaatcatgggggagagccaagcaccacaagcggtggtggtcaaaaacaaggtaacccttcaaggaaaaaatggatttatactacccacaaagtctttgaatgcaccaccacgtctaatgagtcaacaagcttactttagagttgagggcttcaccacaaagttacccagtatgagtttttttcaagtggatgagaaatatgacctctatatagtccttgagaaaactcttgctt

SEQ ID NO: 10871 - DNA, 275 bp, Gossypium hirsutum
  Clone ID: uC-gsflmaxxa060c02b1
ttcactcgtccgaaaaaagaaagttttactctcaagaacaaaagcatattctttgatttcaaagcgtttaattcttaagggaaaataatcaaggctcttcattagaggattctctgtcaaaggaaaatcgaactgtttttctttctgttttaatcggcgaaaaagaaaatgcattcgactcatctgttactcgaagagccaatcaggatggcttcaatcctggagccatcgaaggctagccttttttccgtaatgactaatatagtgtgatcttt

SEQ ID NO: 10872 - DNA, 56 bp, Gossypium hirsutum
  Clone ID: uC-gsflmaxxa060c03b1
tttcacgtgtccgcttccttccaacttaaaaagaaacactctgggttttgatcctt

SEQ ID NO: 10873 - DNA, 71 bp, Gossypium hirsutum
  Clone ID: uC-gsflmaxxa060c04b1
tttacgctttcgcaaactcgttaacctttttggaattggagacacaaaaatggctaatttgtttataattt

SEQ ID NO: 10874 - DNA, 58 bp, Gossypium hirsutum
  Clone ID: uC-gsflmaxxa060c05b1
ttcacgtttccgataaaaccccacacatacaggaactcggggctaataaaatgggtta

SEQ ID NO: 10875 - DNA, 64 bp, Gossypium hirsutum
  Clone ID: uC-gsflmaxxa060c06b1
tttacgctgtcgaaattcggttcgacgcggttgaaatgtgaacaattaactgcgcactctcttt

SEQ ID NO: 10876 - DNA, 253 bp, Gossypium hirsutum
  Clone ID: uC-gsflmaxxa060c09b1
ttcacgcgtccgaaaagaaaaaaaagagagatggcgtctgtaataaaatctgcaatcttaattctgtcggtgtttttatctgtacgcttcagttcgggtgttaggttgctccaggaacagcccaatgatgaccccaaaaacatggacgctattcctcccattgatgcactcaaccctaccgagttgaatggacccggtgttggcattcacgaagatcatgttgtcccaaaaggtgctgaaattggtactcttg

SEQ ID NO: 10877 - DNA, 425 bp, Gossypium hirsutum
  Clone ID: uC-gsflmaxxa060c10b1
tatatacttactaacataaatgtataaaagggtaacattttgaaaaaaatttctatacctaattatttatataaagatacatttattttctaatttttaaatactttatttcaattattattttttttttttatttttataatttttattatttataaaaatttttatatttttattaaatattttattatattttatttatttttatcttatttataatataattttttatttttttataaaattatatattaaattatttttataaatatttatatttaatatttaattaatataaatattattatatattttttttaatttattttataattttttattaaatttttattaataattaatatatttacttctatttttcttacttttttatattaataaatttatattttttataatttttc

SEQ ID NO: 10878 - DNA, 372 bp, Gossypium hirsutum
  Clone ID: uC-gsflmaxxa060c11b1
ttcacgcgtccgcccacgcgtccgcctcactccgccatcttcaataatttcttccgttgatctttgttagagattagctttttaatttttcattatgggaaagatcaagatcggaatcaatggatttggaaggatcgggcgttaggttgcgagagttgctctccaaagcgatgatattgagctcgttgctgttaacgatcctttcatcaccactgaatacatgacgtacatgtttaagtacgacagtgttcacgggcaatggaagcatcatgagcttaaggtgaaggactcaaagacccttctctttggtgaaaagcctgtcacagttttcggcatcagaaaccctgaggaaatcccatgggcttgggctgg

SEQ ID NO: 10879 - DNA, 82 bp, Gossypium hirsutum
  Clone ID: uC-gsflmaxxa060d05b1
ttcacgtttacgaaaatacttcaactttcttagtaagtaatttcaataaattgggtaacccttaaccaacaaccaattcaac

SEQ ID NO: 10880 - DNA, 59 bp, Gossypium hirsutum
  Clone ID: uC-gsflmaxxa060d07b1
ttcacgcgcccggaaacacttcaccgggacaattcgtgtatacccaccgctgcccaccc

SEQ ID NO: 10881 - DNA, 77 bp, Gossypium hirsutum
  Clone ID: uC-gsflmaxxa060d08b1
ttcacgcgtccgaaaagactttaaggtgagtggaagagcaaacaaaaagttgggtaagtcgtatatacggtgcggtt

SEQ ID NO: 10882 - DNA, 466 bp, Gossypium hirsutum
  Clone ID: uC-gsflmaxxa060d12b1
ttagagctcgagcatggaacgtgtttatgcattactggtcaaactgctcagaaatggggttgactaaattctttgaaatgttccaatatttagcaggtcagtctgcaaagctcaatcaagctgtcaagcaagtcaatcatgtcgatcaagtccataagaaatctgatgatcgaagtctaaacgttccaccgccaccgtctccaaatggtttacggagtccgatggcgaggaacaaggcttggagttcagcagcgataaaccgagtcaactcacccaggttcagtcaatcccaagaggacaccagcccagcggagtacgagttcgacaacgatgatgactcgattccctattccccatgtaactctaggctccaacaggctcgtctcaagctccgccgcaccaaaacacataattaatttaatttgtaataaaacaaaccaaatttgtccgaagaaatttttgttta

SEQ ID NO: 10883 - DNA, 557 bp, Gossypium hirsutum
  Clone ID: uC-gsflmaxxa060e02b1
tttaggctctctgagtaaatctctcctttcatatcacggacaagaaaaaaaatgggaatcttttctcttttctcctctcctccttttccctttcccttcctcttctcttcttccttctcttcctcttttctctttctttctccctctctcctttcttcttctcttccttcccttcttcttttctcttcttttttccctctcctctattctcttcttcctcttcttttttcctttcttccctccttctcttctcttttcttttctttctctcttgtcctttttctttcttccctctctcctctcttctcttctttttttctcttttccgttctcttctctcctttctactttcctcttattcctccctctttcttttctcctttctttcttccctctttttcttttctttttcctccttttcttctcttccctctccctccttcttttcttctcctttccttccttctccacatctctttccttccctcctttcttttcctcttcctttcttctcttttccctcttctcccttccttttcttcctcttttctcttctc

SEQ ID NO: 10884 - DNA, 51 bp, Gossypium hirsutum
  Clone ID: uC-gsflmaxxa060e03b1
tttacgttttacgaagtcacgttaaacttatcggatatgccaacacaaata

SEQ ID NO: 10885 - DNA, 81 bp, Gossypium hirsutum
  Clone ID: uC-gsflmaxxa060e04b1
ttcacgttttcgtaaaaacttttatttttacgtaatagggtacaaataaatgggtaattagtttaaaagctgagtatcaag

SEQ ID NO: 10886 - DNA, 66 bp, Gossypium hirsutum
  Clone ID: uC-gsflmaxxa060e07b1
tttacgcgttcgaaaatactttttggggtgagtatgtatataaaatgagattggtaattagttaat

SEQ ID NO: 10887 - DNA, 286 bp, Gossypium hirsutum
  Clone ID: uC-gsflmaxxa060e08b1
ttcacgcgtccgcaagttctttctggtcaccatctgtgattttccatacatgtttgtctgagagatttaaagagtatcctgctaaaggctggactcaaatagctggtacggaccctgtaccatggcggtgagcaccgagtttgtaacaattgtccaggtacccaggctgagttgcactctagagtgccctatgaagttgacttatccactggcattgacagtttaaatgtctgcgacagattattcactcctttcctggaaaagaagaaagtctaggacttttttt

SEQ ID NO: 10888 - DNA, 487 bp, Gossypium hirsutum
  Clone ID: uC-gsflmaxxa060e09b1
catgagctgtgaagcagcagccaacctttgttgctgagcggatttagatctaagtaactcatgggttctgcttcttttccttactccccaaagggcatgaattcgttccttcaacagcaacaaaatgatactcagagggctgcagccgctgctgctttaatgatgggtgatgatatgaacaagtttaaccgttccaggcttgaaagaaacgggttttcaatgaacggtgaagcaggcatggttaacccagcttcaagacagatctacttgactttcccagctgatagcactttcagagaggaggatgtgtcaaattacttcagtatatatggtccggttcaagatgtgaggataccataccagcagaagagaatgtttggatttgtcacttttgtttatcctgagaccgtgaagatcatcctggctaaagggaatcctcattttgtttgcgatgctcgggttctggtgaagccttacaaagagaaag

SEQ ID NO: 10889 - DNA, 484 bp, Gossypium hirsutum
  Clone ID: uC-gsflmaxxa060e10b1
attgctttcactctcttgatgatcttaacatacagcgagcttagttacagaggaaaatgatgatgcgattttcacttcaaaaagtgaagaatttaccggctttaaggcctcaggttttggcttctgcgagtcctcgtttctctactgctgccgaatcttcttttaatcaccgtaatccttcgagggttcctaatcttataggaggtgcttttgttgattcgaaatcaacatcaaccattgatgttataaaccctgcgacacaagaagttgtttcacaaattcctttaactacaaatgaagagttcaaagctgcagtggctgcagcaaagcaagctttcccgtcatggcgaaataccccaattacaactcgtcagcgtattatgttcaaacttccagagcttattcgtagggatatggataaactggccaagaatattacaactgaacagggcaagacattgaaggatgctcatggagatgtctt

SEQ ID NO: 10890 - DNA, 445 bp, Gossypium hirsutum
  unsure (1)..(445): unsure at all n locations
  Clone ID: uC-gsflmaxxa060e12b1
ggacacctaagcaaaacaaaatgttcgagaaggctctggctgaatttgaccaggacactcctgagcgctggattaatattgctaaagctgtgggtggaaagtcagctgaggaagtcaagcagcactatgagatcctagtcagggatgtcaaagagatcgagtctggacggtacccttatccatatccaagtgggagcagcaactaaagcagtgagttatcagcttaccgtatccaaagggtaatgtgctagtgactttgtaccactcagtacccaacctaataaataatcagctaatatccaaaaccactttatatgatcattcacagctctattcacttgtgtgaaacccttgtttcgttcaatttcaaagtcgctgtgaaaccctttgtttcgttcaatgtaacanaaaagtctttagttctaaaaaaaaaaaaaccaaattt

SEQ ID NO: 10891 - DNA, 446 bp, Gossypium hirsutum
  Clone ID: uC-gsflmaxxa060f01b1
acttttagattctaggaataatctagggttaaatggtataaataataaaaatggcgttgttttggagagggcttattatattacctctcctatttggtgtatgcaagcagccattttatatatactaaacgacatttcgataaacccgaggtagtacggtttaaggaccttgattacctccacggcgatggcggtggtttccttagtggccccatagaacaccgttgatgggtgtaaagtttcaaagaccgtcggttgaagctgtaagtgacgatgatgacaatgactatgaaccaccgggataagaagaggaaaaagaagaatgaaaagaagaattagaagaattagaaggagaaaactattagcatgaaagacaaaaaattcgatgaaagttttcatacattggccggcgaaagccttgtaaaccaaaagggtgggtgacggaa

SEQ ID NO: 10892 - DNA, 345 bp, Gossypium hirsutum
  Clone ID: uC-gsflmaxxa060f03b1
gtctttttttcttcttcgagcgatctaaaaccttaaatcagaatgaattttacggcttcaaagcaacctgaaagttgcttgcttggccctgaatcggatttccaaaggacactgtacccatatgtgacaggaacatcagtcgtggctttaaagtataaagatgggattctgatggctgctgatatgggaggttcatatgggtccaccctgcggaacaagagtgtggagcgaatgaagcctattggcaagcatttccttctgggtgctagtggagaaaacagtgattcccacgagattttgaagtatcttgaccagcttatcttatatgacattattgtgggatga

SEQ ID NO: 10893 - DNA, 51 bp, Gossypium hirsutum
  Clone ID: uC-gsflmaxxa060f06b1
tttacgttttcgaataaaatcacaccacagcttaccagggaacaataaaat

SEQ ID NO: 10894 - DNA, 350 bp, Gossypium hirsutum
  Clone ID: uC-gsflmaxxa060f08b1
tttcttttattgtttcattatcagctctcatttgtcagacgaaaaacccataaaaagggcaagtagcttcttttttcttgtccaatagttcctttgtttgttcaaaaacatattcttttttaaggttgaaacaagtataagcttaatggaaaatggcattcacgggaactttggacaaatgcaaggcttgtgataagactgtccatgtggttgatatgatgactcttgaaggagttccttaccataaaacttgtttcaaatgcacccattgcaagggaaaccttgtgatgaacacctactcctccatggatggagtcctgtattggcagcttaattttgagcaactattt

SEQ ID NO: 10895 - DNA, 424 bp, Gossypium hirsutum
  Clone ID: uC-gsflmaxxa060f09b1
gttttctcttttcctctttctctgtgtaagggtttcttttctttctgttccttttttttaaaatacaataattataacaacaacaaaaaaagtcatgtcgaagaagaggaaatccgatgctacgcgcctggacgaggtgagtcggagcatgtacactgccttctgcagcgccgctaattctctttctcagctttattcccactccatgaaccaccagagcctctctttccaggctggcgaacgttacgccttggagaaactttttgagtggattttgaggcagcaagaagaaggattgaaagtgatgacaactgatattgttgcttatttgcagaatgagcttgaatatggagcagaggatttccctatgtcccccagacagccatttcagcagcagcagcaccctcggtctgcaacacaccag

SEQ ID NO: 10896 - DNA, 341 bp, Gossypium hirsutum
  Clone ID: uC-gsflmaxxa060g03b1
ttcacttttccggccgctcaaccctgaaaagctgcggagatacctagcaccaaatccctaaaatcattttctttgaagagaaaaaaacaactttttttgtgccaggaaaagtaacttctgtacaagctgactcattaatggctaccgccacttccatcgtacggtctccagcggccctactctctgccaaagtcactgtctccgatcacaaaccaaccccaaccgttcaattctcccgattcccttcaaaacgtagttgtttcactgctcttttgtcttccctccacgacaacaacaacgacgacgacaacaacaacaacgttattcttgcatcccaagcc

SEQ ID NO: 10897 - DNA, 452 bp, Gossypium hirsutum
  Clone ID: uC-gsflmaxxa060g06b1
tttccgtttttgttctttctttctccactaactcaatacttacaaacagcatggaaccacctttaactgaagagatgcaaggttgagggatgacttttgaggcattgaagtttgaatgatctcttaagttcttccactttcttgataactatatgaaattggatgctggattggatggcttgggtgagttggtaagaaacctcattgcaagtaaattatgtttgcagaaacttgctgcaatgctttttatcatcgattgtgagaggatgaaacttctatttattggtggaagggaaattagctcagagtagtggtatttatgtctcagaccgcagtaaaccattgttgaaatgccctgaacataaattagtgtgtgcattttcaaactgatacttactttatttgaaagtagaggaagttgtgaatgacaaatttgaactttttattgatgc

SEQ ID NO: 10898 - DNA, 392 bp, Gossypium hirsutum
  Clone ID: uC-gsflmaxxa060g08b1
ctactgcagcactgccttttggaactattgtagtaatagtcctcatatggacactcgtgacatctccattgcttgttctgggtggtattgctggcaaaaatagcagggccgagttccaagctccttgccgcaccacgaagtatcctcgagaaattccaccattgccttggtacaggagtgccattcctcagatggcaattgctggatttcttccatttagtgctatttacattgaactttactacatattcgccagtgtttggggccacaggatctatactatatacagcatcttgtttattgtattcataatccttctgattgtcacagcttttataactgtggctttgacatatttccaacttgctgctgaagaacatgaatggtggtgg

SEQ ID NO: 10899 - DNA, 462 bp, Gossypium hirsutum
  Clone ID: uC-gsflmaxxa060g11b1
ttcacttccccgtcgcctctccgaaccatgggccgcgtacgtaccaagacggtaaagaaatcctctcgccatgtgatcgagaggtactactctcgcatgacgcttgattttcacaccaacaagaagatcatcgaagaagtggctatcataccttccaagcgtctacgcaacaagatcgccggcttttccacccatctcatgaagcggatccagaagggtcccgttcgtggcatctctttgaagctccaagaagaagagcgtgaacgtcgcatggatttcgtccccgacgaatccgccatcaaggttgatcaaatcgaagtcgataaggaaactctcgatatgctgtcggttctcgggatggctgatattcccggccttgataaggtcgatccggttgctgttgcggttccccaaatcgggttcggtcgcggtggcggaccccgaaggagattttaaggggtg

SEQ ID NO: 10900 - DNA, 470 bp, Gossypium hirsutum
  Clone ID: uC-gsflmaxxa060g12b1
ttcacgcgtccgcccacgcgtccgcccacgcgtccgaaccctccacgtttgatccaagcataatattttttatttccattgctttgatttgattcgcgattatgggaatcgaaataagcggcggcacgatcattccaggaggttggggcgccgccgccatggctgtcgcggctaagacatgcgacggatgtaaatcatcggcggcagctatcttttgtcgtactgattgggtctttttatgcttgaattgtgattccaatttccattccggtcacgggagggtgtctatgtgtgaagtttgcgaacaagctccggcggctgtcacttgtaaagccgacgcggcggctctttgtgtcacttgcgacgccgatatccattcagcgaacccactggctcgccgtcacgaacgtgtactcatcgaacctttctacgactccgctgattccatagtcaaatttttcccttttagc

SEQ ID NO: 10901 - DNA, 362 bp, Gossypium hirsutum
  Clone ID: uC-gsflmaxxa060h01b1
tttacgcttgggcggacgcgtgggtgaaaatgggttggaatggagattgctactacaaggggttgccctgacaagcaagtgtcatggtttccattaaacctcagagtattagactgggaaaatacccacagatttccatgtactttgagtgtccggaaactagtgatgagtaatcaaaggttggcttatttgagtatagattctagtagaaagcaacaaagggtgaaatacttcaaaatctggctgagttccagttctcttgtgtcatgttcaatgcgggtttggagaatgcttgtagtgagcaaggagcaaggaagtctgctttggatagctcaagcagaaacgccggcgacaatgcttga

SEQ ID NO: 10902 - DNA, 338 bp, Gossypium hirsutum
  Clone ID: uC-gsflmaxxa060h02b1
gttcgttatataaaggttttaaagtatttcaaggatttggcatgtatggagactcgtttaattgttattaagttgctaggaattagcttaaaatactgacctatgttatttgaaggtctctattgtataaagtcatttaatgtagatagtcttgattatgttattaattaaatgatgcaatttttgaatgtgcatgcttgcctatgtgtgtggttgaattaaagcatgatatgggcttgtaagctctttttaagggacatcttgaatgtgtttgaaaaagttttaaattaaagtgaaattatgaatacgattttatacgatgattagtgattaagttc

SEQ ID NO: 10903 - DNA, 485 bp, Gossypium hirsutum
  Clone ID: uC-gsflmaxxa060h03b1
ttgacgtttgggttcacactctttttcaactttctcttcttctctttgttttaaagaggggctggagttttagccaaagaaaactccatggctaaacttgttgctactttcttcttggctctcattgccatctccatggttcaaactttggttatggcatcacatggacatggtggtcaccattatgataacaaacgttatggacctggaagtctcaagccttaccaatgtccatctcagtgcacaaggaggtgtagccagacacagtaccataaaccatgcatgttcttctgtcagaaatgttgcaggacatgcctttgtgttcctccagggtattatgggaacaaacaagtttgcccttgctacaacaactggaaaaccaaggaaggaggccccaaatgcccttaaattgctcaaaagaagacccttttttttttacatttatatccctataaattttctatttgaaaattaagtcattgaag

SEQ ID NO: 10904 - DNA, 493 bp, Gossypium hirsutum
  Clone ID: uC-gsflmaxxa060h04b1
acctacgcttacgcttgcgcgcacgtcggcttataattaatgactgcttgatagcgccaccgagtatcaacatcaacgctctacaatgtccaacaagctagaaggcaaggtagccataatcaccggcggagcaagcggcatcggagaagccaccgtccatcatttcgccgtccatggtgcccgtatgatcgtgatcgctgatatccaagatgaattaggccaaaaagtagtcgaagccatcggttcaaataagtgttcatacatgcaccgtgatgttaccgatgaagaacaagtaaaaaatttagtccaatcgacggttcaaaactacgggagcctcgacatcatgtttagtaacgctgggacagttagcaactcaattcaaaccgtccttgaactagacttcgcagcgtttgaccgccttttcaccgacaatgtccgcggcatggctgcttgtgtgaaacacgccgcacgagccatggtggaactgaacgtg

SEQ ID NO: 10905 - DNA, 397 bp, Gossypium hirsutum
  Clone ID: uC-gsflmaxxa060h05b1
tttgcgttttagacatcgagatatacattatttgatctttacaaaatatgggcgtacacaacagatagttagagatggacggtaaaggagaaggtccagctgtaggtatagatctatgaacaactaagtcttgcgacggtgttggtcaccatgaccgagtggaaattatatataacgatcaaggtgacagaacgacaccgcctaatgtaggttaaacagataccgagcgactgatcggagaggcatctaacaaccagggtgcaatgaacacaattaacaccgttgttgatgctaagaggatgatagggcgtagaaacactgatttttcaccgcaaagtgatatcaaattgaggccattaaaggacataacagggcctgttgacaaaccaatgattgt

SEQ ID NO: 10906 - DNA, 400 bp, Gossypium hirsutum
  Clone ID: uC-gsflmaxxa060h07b1
tcgttcacgcgtccgcccatatcgaaacacccacctcgtatttcccgtccgccgccctttcttcttcttcttcttcttcttcttcttcttcttctttgcaagtgattttgagtgaactgattttaatttttgggtgttttaattgttttgaagagattccctcaaagatgagactgttgaaagtcgccacctgtaatttgaaccaatgggcgatggattttgattgcaatttgaagcacattaaggattccataacaagggcaaaagaagttggtgctgtcatcaggctcggacccgagcttgaaatcactggctatggctgtgaagatcatttcttggaactcgatacagtcaatcacgcctgggaagtgtttggaagaaatacttcttggtgattgga

SEQ ID NO: 10907 - DNA, 492 bp, Gossypium hirsutum
  Clone ID: uC-gsflmaxxa060h08b1
ttcacgcgtccgcggacgcgtgggttcccaaaccttaccttatctagggttagggttttgctccttctgagtttctctcagtaccaaaaatatccccaaattgaagatgatgcaacaaccagcacaagctatggtaccaccaccaatggctccacagacccaacagtaccaatatcagcaaccacctccggctccggttcctcaggcacaacaaccttacatgatgatgaacatgatgcagccgcctcagagtcatcctccacctatgtggcccccacaacaaggttcggctggggtacctgctcaacaacagccagctggtcaaccggctaacgcagatgaggttcggactttgtggatcggagatttgcagtattatatggatgagaattatctcttgagctgttttgcccaaactggagaggttgcttctgtaaagttatccgcaacaagcaacccgtcaagtgggggctatggatttatgagtttgtt

SEQ ID NO: 10908 - DNA, 487 bp, Gossypium hirsutum
  Clone ID: uC-gsflmaxxa060h09b1
atttcccatacgaaaaataaaattatattatcaatcattaatttttatctttcagttttagcctataaaaaaaaaacaaaaccatgaatgaatctgattatacatacagttcaatcccaaacgatgtagctctcaaaattgcttcttcccttgaggtgactgatctttcctgcttgagttgttgttctcgggtctggagggatttatggggctccgattgtttatgggaacccttatttaaacaaagatggcctcttttatatgaagatgtcttgaaagaccccgacttcaagggttggaggggattttacataaagcagcacaaggagatgaaggatcaagctgattcggttgttaaatttgtagaaaaatgtttgcaatccgaatcaatccaggtcaatgactatcttgaagcgattgatgcctgaaatgatggggttcgggttaaagatgttcaaatttgctgttaaaaccaagctgaatgttt

SEQ ID NO: 10909 - DNA, 387 bp, Gossypium hirsutum
  Clone ID: uC-gsflmaxxa060h10b1
ttttcctttttgtacagagagaaaaaaagtttggtctcttttttaaaaccggcctctcttgattccctttcatcaacaataaataagaaaattcaaaggtttctttgaaccaaatttatatattgaaagggttcagggggctgatattaatgttaatagttctttttttttctagctttctagaaatttattgttcataaatttgtttttttttcaaaagccaggtttgtgaaatactattaattaaaaagtttatatttgggggaaatttgataaagatggttggaaattcttcaatgggtgttttgggtgattcccaaaaggaagggtttggatcttcatggggtggattaaagaagttggtaagaagaaaacacgttgattctg

SEQ ID NO: 10910 - DNA, 481 bp, Gossypium hirsutum
  Clone ID: uC-gsflmaxxa060h11b1
ttacggtttgaaagtgttcttcagatatggctatgaaacaagttgctaattctgctatcaaagcaattgccaatactgggtcatcctctcattgttaccagacaacttcatgcttctccagggagcaaaaagattgttggggtgttttacaaggccaacgagtactttacgaagaatcccaactttgttggttgtgtggagggagccttggggttgcgcccatggctggaatcacaggggcatcagtatattgttaccgacgacaaagaaggaccggactgcgaacttgaaaagcatatccctgatctccatgtgctcatatcgaccccattccacccggcttacgttacggctgagaggatcaagaaagccaaaaacttgcaactgcttctcacagcagggattggctccgatcatgttgatcttaaggcagctgcagaagctggtttgactgttgctgaagttactgtgagcaatgtcg

SEQ ID NO: 10911 - DNA, 404 bp, Gossypium hirsutum
  Clone ID: uC-gsflmaxxa060h12b1
gttatctctgaaggtgtcttaataaacgccttcgatttaccttcgatttccatttacttctctattgctacgtttttgaatttttagtgagcgaaaatgagagagtgcatttcagtccacatcggtcaggctggtattcaagtcggaaatgcctgctgggaactttactgccttgaacatggaatccagcctgatggccagatgccaagtgacaagactgtcggaggaggtgatgatgcttttaacacctttttcagtgaaactggtgctggaaagcacgttcctcgtgctgtctttgtggatcttgagcctactgttattgatgaagtgaggactggtacttaccgtcagctttttcaccctgagcaacttattagcggcaaggaagacgctgtcaacaactt

SEQ ID NO: 10912 - DNA, 267 bp, Gossypium hirsutum
  Clone ID: uC-gsflmaxxa061a01b1
acaagtcatttaatggtgaggtacattttctgattagttggctttttcgcgtcctgtgtcaagtgaacctaaaggctctggactgattgtgaggaacatgctattatcagaacggatggtgctcgtctctactagaatcttagactgcaaataattaggcctgtgcattcttctgtgatttgtgatgcccgctggcgttcactgtgatagagatgatgggtctctggagctggtggtcgacagacaaacagggtactttatttttca

SEQ ID NO: 10913 - DNA, 501 bp, Gossypium hirsutum
  Clone ID: uC-gsflmaxxa061a02b1
cccactctttcgcccacgcgtccgggacagtacaagagccacagtaaaggaggagttacttaccctgcctacacggatgacaagaccgtgcccaaagatagtttgaccccaacttttgcagccgctgccttgttcatagacaatgcacgatgggatggggtgccttttcttatgaaagccggaaaagcattacataataagagggcggagataagggtacaattcatgcacgtgcctggcaatttatataaccgaaattatggaactgatcttgatcaagctacgaatgagcttgtcattagagtgcagccagatgaagctatttatttgaagatcaataacaaggtccctggactcgggatgagattggaccgcagtaacctaaaccttcattatgctgacagatattcgaaagagatcccggatgcatacgagaggcttctgctggatgcaattgaaggtgagagaagattatctatccgaagtgacgagctcgatgca

SEQ ID NO: 10914 - DNA, 288 bp, Gossypium hirsutum
  Clone ID: uC-gsflmaxxa061a03b1
ggcttgtttcttaaacgggaccagagaccggatggagctcaagccgccatgggagctatccagttcgggtcaaagctctgatggaagaatcattccgacagtatgaggcaactgcccatagagaagtgatggtagtaccgacaacaaccgtgcatagcgcgagctaacaacacaactcttccttactaataccgtcactcagcatacattgcctggcccgaccatgcagtgtatcgggcgcatgtgagacggagctgaatgaacataccataacctacatttattgtg

SEQ ID NO: 10915 - DNA, 503 bp, Gossypium hirsutum
  unsure (1)..(503): unsure at all n locations
  Clone ID: uC-gsflmaxxa061a06b1
ctttcccattgaattatcattgcnttttattttgattttgctgatgaatctgtttctccagcgnngaaccatgtgcacgctctgnaattggttctgggtatggaacagtatgtttaatctcacatgaaatctggtatatttgagcaatgaacaaggaaccaaagttagattctgcacgaattaatacaactgcgagcttagatcatgttcttcgactctactaaatgctggtgacgattgaatcagaaaaaaggtttacgttgaacttgctgtgattgttggttgatatggtaccaatgttgatgtcctgcagcagatggtgttgaaatttggagcttttatgactgctcggaggtgataaccatgcatgccaggcgttagaattattgcctaattgactctaatagaattagaaccgaatagggaatgcggaaagatgtctatgcacgctgagaattgtctatatcaactccacaaggatgtatccggatctggattaccct

SEQ ID NO: 10916 - DNA, 452 bp, Gossypium hirsutum
  Clone ID: uC-gsflmaxxa061a08b1
ttgttcttctaaattcacaagtcatttaatggtgagttacattttctgtttagttggctctttcgtgtacctgtgtcaagtgaactaaaggtctggttgatgtgggaaatggattattgaaggtgggttgtactttgaccttgatgtaatattagcctttcattctgctgtgatttgtgatgcccgctggcgtcactgggatagagatgatgggtctctgtagctggcggtcggcagacaaatgggtgcttatttccatgctttgcatgcatctttcatccatgttgctgagtacattgtagccggacagattgagctgcttatttattctatatttctctaaattcaaggctcccccccgcgcaccgaacacattaatgtcaatagctattgtactagaaattataaaattgagtgggaattatcttacatactggtttttgtgtttgcaa

SEQ ID NO: 10917 - DNA, 592 bp, Gossypium hirsutum
  unsure (1)..(592): unsure at all n locations
  Clone ID: uC-gsflmaxxa061a10b1
tccctcgcgtccggaaccctccatttctctctgcaaccagcggcacccaaagatgcaaatcttcgtcaaaaccctaacggggaagaccataaccctagaggttgagtcttccgacaccatcgacaatgtcaaagccaagatccaagacaaggaaggcatcccacccgaccaacagcgcctcatctttgccggcaagcagctcgaggacggccgcaccttagccgactacaacatccagaaggaatccaccctccatctcgtgctccgtcttaggggaggtgctaagaagagaaagaagaagacctacaccaagcccaagaagatcaagcacaagaagaagaaggtcaagctcgctgtgctacagttctacaaggtggatgaatcgggtaaggttcagaggctgaggaaagagtgccctaatgctgagtgtggtgctggaactttcatggctaaccatttcgataggcactattgcngtaagtgtggactcacttatgtttaccagaatgctggtggaagataaatagggctcgtgcaaaaagatgatcttttagggttttcaatatgggtttaggttttaaattttagtatc

SEQ ID NO: 10918 - DNA, 581 bp, Gossypium hirsutum
  Clone ID: uC-gsflmaxxa061a11b1
tctgtttctttattttctaagccaaagcaaagcaaagcaatagtcagtccttcaccaacctcctcacttcactcctcctcctccttcaccaccctatcttcaaatatctctatcttatttgagtttgtttgtttttcagttcccttttgagcaccatgggttcttccatctatggtgtctcttcctcccacatctcccttttccttttcttctcctttctttcgctctccacggctgcattgcctcaaaacccgtctgggaaatcctcaccttctggtcagatcaactccaactccgtccttgttgctcttcttgactcgcattatactgagttagctgaactcgtcgagaaagctttacttctccagacgcttgaagaagcggttggcaagcacaatattaccatttttgcccctcgcaatgaagccgtggagcgtcaactcgaccccgagttcaagcgcttcttgcttgaacctgggaacctcaagtccctccaaacccttcttatgtttcacattatccccaaaggggtggatcccatcaatggcctgatcccataaccggtcctgtcatgcacaaca

SEQ ID NO: 10919 - DNA, 501 bp, Gossypium hirsutum
  Clone ID: uC-gsflmaxxa061b01b1
aacagcaatatgatcgtttcttggaatcatatcactccttggaaaaaaaatactaagggccaacctgatagtgttgttgcattagccaaatggaggatcttaaatagattgcatgacaggaatgaaacactatactacagagtccttatggacaacatcaaagattttgcacctataatttatacgccgactgtggggctagtatgtcaaaactactctggattgtttagacgcccacgtggtatgtatttcagtgcgaaggataaaggagagatgatgtctatgatatataattggccagctcaacatgttgatatgatagtcctgactgatggcagtcgtattcttggccttggtgaccttggagctcagggtattggaataccaattggaaaacttgatatgtatgttgctgctgctggtatcaacccacaacgtgtgctccctgttatgctggatgttggcactaacaatcataagctacttgaagaccggctttat

SEQ ID NO: 10920 - DNA, 533 bp, Gossypium hirsutum
  Clone ID: uC-gsflmaxxa061b05b1
ctcttctttcctcctagcccaaaaaaaaaaaaccctctttcctttctctcgttctttttcccgttcaatcatgtcttgcttcattagcaaatatgccgatgagttggctaaaaacgctgcttacattggaacccctggaaagggtatccttgctgctgatgaatccactggcaccatcggcaagcgtctttcaagcattaatgtagagaatgttgaagataacaggcgtgctctccgtgagctcctattcacaactccaggagctcttcagcacctcagtggtgttattctctttgaggaaaccctctatcaaaaaaccgtttctggcaagcccttcgctgatgttttgaaggaaggtggcgtcctccctggcatcaaggtcgacaagggtaccgttgagcttaacggaaccaatggcgaaactttcacccagggtctagatggccttgcacagcgatgccagaagtactatgaagctggtgcccgctttgctaaatggcgtgctgacctaaaattagtgctaatgagccacc

SEQ ID NO: 10921 - DNA, 497 bp, Gossypium hirsutum
  Clone ID: uC-gsflmaxxa061b06b1
cggttgttttactcaaggttacaaacctccaactcttaacgagcttcaaaatctgaatcggttaaaagccagaaaattctacggcaacaagaagaaattcaataacagcaacaaccggtttgctccttacgctccgcggaatacgacttcgtttataatccgagcgaaaaagtcaggtggaatagcatctttagtgtcgccatgtcctgtgactcccgccgttcttactacgccaatattttcaccatcgagggaggttttgggtgatatggccaaggaagaatggggtgtggatggttatgggtcgatgaaagggctgattcggcttcgatcaccataagctggtcatgatgactaggaagatgactatggtggaaatggtgggggttcgagtgacagcgatgtggaagaacatgtggaagcggagaggagattggaccatgatttacgtaggtttgagatgatatatccaagttattgaggtgattataacaatg

SEQ ID NO: 10922 - DNA, 477 bp, Gossypium hirsutum
  Clone ID: uC-gsflmaxxa061b08b1
tcaaaatctctgaactcaaaatgcttgaccaaagctaaagcttttggggtagatccaattcacccatcaaaccttagtttgccctgccaattttattttccttagagaaataagaaaaaaatgacaatccattcggatgtaatccaaaaactcttaacaacaaatgctcacatcggtcgacaagtaacaacccaccacttcaaacagttcacctacggcttccgaaatatacaatgcattatcgattgcgtcaagaccctaatctgtctccgcaatgctctcaacttcctttcctgcctctctcgtgatccttgttgctctttcctcttcatcaacactaaccctctgttccaacccataatcgacgagatgacctccagagtcaccagcttaagccctgaaagggctagtagcctttggaagatgcgtggctttatgaccaacagctgtaggcctaagaagattcggtctatgcac

SEQ ID NO: 10923 - DNA, 531 bp, Gossypium hirsutum
  unsure (1)..(531): unsure at all n locations
  Clone ID: uC-gsflmaxxa061b09b1
cttttctgttcgtccttccagaaaaagaaattcaggttgggagtattgcacagctttcttttggttagctcctctttgtccaccatttttgcccccaatatgaagatcttgttcacgaaagttctaacgaacaccgatgtagagaaaagattggcggttcccaacaattcactgaagcatttcgagcttgaaaatggtaattgctccaaatcttttgaagttaaagatgaaaacggaagcacatggacttttcgttgctatgttcgtaacgacggtgcctacaagaagcctgttttatccagtggttggcgtcaatttgtcctcaataaaggagttcaccagggagatttgatcacactctataaggatgttgtagcataagcttcgtataagatcgaagctcagagaataatcaagttattaggcatggagtgctggtctagtctggaaccagaccatcctacatgcgcaacatcacaagctcagagataaatcctgttatttgcaaggagtgctngtattttctggaac

SEQ ID NO: 10924 - DNA, 539 bp, Gossypium hirsutum
  Clone ID: uC-gsflmaxxa061b10b1
tccctctcgtccgcccacgcgtccggttatctctgagggtgtcttaataaacgccttcgatttactttcggtttccatttacttctttatttctacgtttttgaatttttagtcagcgaaaatgagagagtgcatttcagttcacatcggtcaggctggtatccaagtcggaaatgcctgctgggagctttactgccttgaacatggaatccagcctgatggccagatgccatgtgacaagactgtcggaggaggtgatgatgcttttaacacctttttcagtgaaactggtgctggaaagcacgtccctcgtgctgtctttgtggatcttgagcctactgttattgatgaagtgaggactggtacttaccgtcagcttttccaccctgtgcaactcatcagcggcaaggaagacgctgccaacaacttcgcccgtggccactacactattggcaaagagatcgttgacttgtgcttggaccgtatcatgaagcttgctgataactgtaccggtcttcaaggtttccttgttttcaacg

SEQ ID NO: 10925 - DNA, 355 bp, Gossypium hirsutum
  Clone ID: uC-gsflmaxxa061b11b1
tcccatgcccgcgtcctgccattcccctagaccgcgataaataataatagcaccggacgtctaaataaaaagggaagagaaggctcgactaacggaactatcgaagataaatatgttcatatgatccatgcttatgaaccatggcactgatactagcctatttagcgaatggaccataaagtatagctccatttcttccatgtgcgagactctaagggagcttaatacctaccgacatgtctccaaagacactttcaatattaccaacaacctcgatatggacgtcaccgagcctaataagcgaaaggatccattcctttgatcacggaactagctggatcgtatgaagaactgt

SEQ ID NO: 10926 - DNA, 512 bp, Gossypium hirsutum
  Clone ID: uC-gsflmaxxa061b12b1
ggcacttcctggtgataatgttgggttcaatgttaagaatgttgctgttaaggatctcaagcgtggttatgttgcatcctggacaaattggaaacggatatgccccagtcctcgactgccacacctcacacattgctgttaagtttgctggaccgcggcatcaccttcttgcaccggatgggaatcgggtttttgatctcagtattagccactctcgtagcagggttcatagaagtgaagcgtaaacaagcagctgtggcacatgggcttgaggacaagcctcattctatcatccccatgtcagtcttttggctcgtgcctcagtacggtctacatggaatagctgaggctttcatgtcaattggacacttggagttcttttatgatcaatcaccagaaagcatgaggagcagtgctactgctttgttctggactgcaatttcagttgggaattatgtgagtacgttgctggtctctctagtgcacatatatagtgctaaacctgacggatc

SEQ ID NO: 10927 - DNA, 465 bp, Gossypium hirsutum
  Clone ID: uC-gsflmaxxa061c03b1
gagaaattttggacgtataagagtcctcagagaaggagagagagaatattgtggtatttgcataaccaatatacgttttattgcaggagatgtgaaatttgcaagcaaaaatgacatcttccagtgggtaaagcattggtttaaggttggtactttggttgtcttctactggctcttgttgcagagctttactatttgctttggtggaagaagagaattaccggctcacaagatgaagatgattacaacaactacgcaaaggagctcgatcaactcttctgctgaaaaaaatctgcttctttgcatgcattcaccgttgtcaacaacaacaataatcaaggtttagttaaaaacaaagatagcaatagtgttgaaccagactagtaacttgcctcaagcaggagtttgctggtaaaggccttggtgaagagggtgttgaataataactcatgagactacacactc

SEQ ID NO: 10928 - DNA, 436 bp, Gossypium hirsutum
  Clone ID: uC-gsflmaxxa061c04b1
gcgcgagatccggcaaattgtcgtcggatttcgtccatttgtcgtcggggttcgatagtactctctctctttctaagtttctaaccgccggagtagaaaggaattatcgaaaaatgaagggatctacacatgttgtcgcgactttgctcgctgcttccacggtggcgctctcatcatcttcctgccccggaatacacaatgtttcattttctactaccttttacaaccaggggacaagaaatggtgcgtcgaggaatttaacggcgacagagcgggagaatttcacgccacgatttgatgggtagagattcatagaaacattgatcacagctcacagataggatgagatgattaagcacacaaaataccgtcctttctctccgtgcactaattagatgctatttattgtgtcgggccaaactgtaattggtacata

SEQ ID NO: 10929 - DNA, 536 bp, Gossypium hirsutum
  Clone ID: uC-gsflmaxxa061c06b1
cggtcgcttgggtttcaatttctcatgcaatcatcaaaagctatagaacccattttgttcaaaacccatttatccactatgctcaaaatcctccacaaaagaatcaaaggccttttccctcgtctccgatggccggttcgatgccgttcaaattccaaaatcgtcattaaagtctacaccaaacctcacgatgataccgtgaatggaggttcgcaaattcaccaaaatggcgaatcgggtgttttaaactcggcgtcggcgaggccaattcgtatagcgaatttcaatgccgccatgttttcaatggcacctgcaatgccaaaaccagataaatcttcgagttttgactacgataatgaaggttttacaaagtctacaaacgatcaccggccaaagggtatactaaaacaatcccccttacacccaaattccatgaacgaaaacgatagtctcacgaaacaacaaatattcgtgaaatctaagctgagggtgccgattaatttaccagataatgagatttgcgtgctgagaaaccg

SEQ ID NO: 10930 - DNA, 228 bp, Gossypium hirsutum
  Clone ID: uC-gsflmaxxa061c07b1
tcttttctatcgaaaaccatggaaaaccccgataaaagaggaggggtagtgctgagatggggttgcctccaatgctttcttctccctcacaaatctcttccgccattccccccctcagcttccattctgaggctaccatccgtctacatactctaccatacttctgaactcctccaatacttcttatttctgcttcctcgcacatcctgtgcctgcaacccactcatt

SEQ ID NO: 10931 - DNA, 548 bp, Gossypium hirsutum
  Clone ID: uC-gsflmaxxa061c10b1
gaatattaagaggccggatttcaaaaccctttctctttaaaatatagagaaaagagggaccaaagtgaaagaaaatcgaagcatagatttgattttcaatctgcattttcagggtgtggaacaatgggtgcaggtggcagaatgtcggttcctccaagtcaatggaaacatgaatcgggctcaatgaaaagagcccctatatctaaaccaccatttactctcagtgaaataaaaaaagccatcccaccacactgtttccaacgctcacttatgcgttcattttcctatctcgtttacgacttcattttagtctctatcttttactacgtagccaccacttacttgctcaacctccctcagccactatctttcgtcgcctggccaatttattgggctcttcaaggatcagtcctcactggcgtgtgggttatcgcccatgaatgcggtcaccacgctgttagcgattaccaatggatcgatgacactgtcggtctcatactacattcatgccttctcgtcccgtacttttcgtggaaatatagtcaccg

SEQ ID NO: 10932 - DNA, 552 bp, Gossypium hirsutum
  Clone ID: uC-gsflmaxxa061c11b1
gcctcccaaggtgaaggcttttttggcggtggtgtcggggatggcggctcttgttttgctccgattcatcgtacacgaccacgacaacctcttcgtcgccgccgaatctgtccattctctcggaatttctgtactcatctataaactcacaaaagagaagacttgtgccggactatctctgaaatcccaagaactaacagctatatttttagctgttaggctgtattgtagctttgtcatggaatatgatatacacaccatacttgatttagccacattggctacaaccttatgggttatttacatgatccgttttaaactcaagtcgagctacatggaagacaaggacaactttgctatttattatgttgttatcccttgtgcagtactagcttctgttattcatccatcaacttcacataatcttatgaaccgaattttctgggcgttctgtgtatatctggaagctgtttagttttacctcagttgcaagtgatgcaaaataccaagattgtcgagcctttcacggctcattacgtatttgcattgggt

SEQ ID NO: 10933 - DNA, 562 bp, Gossypium hirsutum
  Clone ID: uC-gsflmaxxa061d02b1
ttcattttatttctatttctatcatttatttgcttctatagtggtttctcaaaatccgcgaacatagattcggatcgcaagaggaagaaatcttcgatctcatccgcagatcgaacggcggcgaaggagggcgaaaaacataaagataaagctcccacttcctccaccaatcaccaccaccaccaccaccaccacaaaaagaagagcaagatgtcttcttcatcgcccgccaatcaagtgagggcttctcacatcctcatcaagcaccaaggctcccgccgtaaggcctcttggaaggatcctgaaggtcgcgtaatctccaacactacccgagatgccgccgtctcacagctcatagccctccgtgacgacatcacttctggcaacgctaagttcggtgaggttgcctctcgccactccgattgcagctccgctaaacgcggcggggaccttggtccttttggtcgaggccagatgcaaaagccatttgaggatgcaacatatagccttaatattggtgagataagtgacatcgtggatactgatagcggagttcacatca

SEQ ID NO: 10934 - DNA, 554 bp, Gossypium hirsutum
  Clone ID: uC-gsflmaxxa061d03b1
atcaaatcccagcttagcaacctcacaaattttttctttaaaaaacccatctttctggttctaaactcacccccatccatctcttttgcatataccttcagtcactaagcaatagcagccactactgcaaatggcttccaacaaaacctgtgctgtccttacagttttctctcttcttcttttcaacttatcattccaccacctgctgcatgccctccaccaccagcaaagcctgcttcttgccctaaggacacattgaagctaggtgtttgtgctgacctacttggactggtaaacatagtggtgggaacacctccttcgagcaaatgctgtgctttgctccaaggcttggctgatttagaagctgccctttgcctttgcaccgccattaaagccaatgtgcttggggccaacctcaacatccctattacccttagcttactccttagtgcatgtcagaaggaaatccctccaggcttcaaatgttgattttttctaagaagcacacctcagttgtgatgtcgcctaatggctgagtttgctctactctaaat

SEQ ID NO: 10935 - DNA, 63 bp, Gossypium hirsutum
  Clone ID: uC-gsflmaxxa061d04b1
agaaaagttaccacagggtcttcttctactgcgggtacgcccacgcgcgtcgttagatcgcga

SEQ ID NO: 10936 - DNA, 496 bp, Gossypium hirsutum
  Clone ID: uC-gsflmaxxa061d05b1
cccacgcttccggtcaaaggttaagtttcaagaccaaagctgcgggttcagttgaaggaaatgtactggacaaagaatcggctagtatcagtgacaagatagattatggagttgttggtattcaccatgttggaattctatgtgaaaaccttgaaagatcgcttgaattttatcagaatattttaggtcttgaaataaatgaggctaggccacatgataagcttccatacagaggtgcttggttgtgggtgggttctgagatgatacatttgatggaacttccaaatccagaccccttaatcggaagacctgaacatggaggccgagaccgtcatgcttgtatttcaattcgagatgtatctaagctgcaagcaatccttgacaaagccggtattccctacacacttagccgatccgggaggccagcaatatttacacgagatccagatgcaatatgcactagacttcacacaagtctgaagcctgtgataatact

SEQ ID NO: 10937 - DNA, 537 bp, Gossypium hirsutum
  Clone ID: uC-gsflmaxxa061d06b1
gcgccctctcttccgctttaactgtccatgaaccgaagctaaaggtggacttgacagcgtatgtagaaaaacatgagttctgttttgatgctgttctggatgagcatgttacaaatgacgaggtttatcgggaaactgttgagccgattattcccataatctttcagcgaacaaaagccacttgttttgcatatggtcaaacaggtagtggtaagacgttcacaatgcaaccgttgcctctcagagcagcaaaagatcttgttagatacttgcatcagcctatttatcggaatcagagatttaaattgtggcttagctattttgagatatatggtggaaaactcttcgaccttctgagtgatagaaagaaactttgtatgagagaagatgggtgacaacaagtctgcattgatggatcgcatgaatttgtggtgtcagacgagcacattgtgaaggtatacattgagagaggaaatgccgctagaagcacaggatctactggtgcaaatgaggaatcttcaggtcacatgcaatttt

SEQ ID NO: 10938 - DNA, 590 bp, Gossypium hirsutum
  Clone ID: uC-gsflmaxxa061d07b1
tcgtctaagaggaacaccacgtcaataatcaacagccatctgaacagaaagcttccgattcttatcaagatgccttaaacgacgagcaattgaaagagaaagctttggcacaagcaaatgatgcgaaaatggaaggaaataaattgtttggaaacggacaattcgaggaggcattgttacagtatgagattgctttgcaaattacagcggagatgcctactgccgttgaacttcgttccgtttgtcattcgaatcgagctgcttgctttctgaaacaggggaaatatgaggataccatcaaggaatgtacgaaagcattggatcttaatccttcttatataaaagctcttgttagacgaggagaagctcatgaaaagcttcaaaattttgaagaagctattgctgatatgaagaagatattggaatttgatccttctaacaaccaagctgtaaagaccatacggcgccttgaaccactagctgctgaaaaacgagaatagttgaaagaggagatgatggcaaaactaaaagaattgggcaactctgttctgggtacattcgggatgagcgtggacaacttcaaagctgtc

SEQ ID NO: 10939 - DNA, 61 bp, Gossypium hirsutum
  Clone ID: uC-gsflmaxxa061d10b1
tccctcgcgtccggccacgcgttcgcccacgcgtccgcccacgcgtccgtctagatcgcga

SEQ ID NO: 10940 - DNA, 441 bp, Gossypium hirsutum
  Clone ID: uC-gsflmaxxa061d11b1
tcggtcgcgtgggcggacgcgtgggcggacgcgtgggtttgctttgtatattgaagtttcctttctcgattttctatttagccaaacaagatgcagatcttcgttaagactctaaccggcaagacgatcactctcgaggtcgagagctccgatacgatcgacaacgtgaaggccaaaatccaagataaggaaggcatccctccagaccagcagcgtctgatcttcgccggaaaacagctcgaagacggccggaccttggccgattacaacatccaaaaggagtcaactctccacctcgtcctgcgtctgcgcggtgggatgcaaatcttcgtgaaaaccttgactggcaagacaatcactctcgaggtcgagagctccgacacgatcgacaacgttaaagcgatgatccaagacaaggaatgcattccctcaaaccagcaa

SEQ ID NO: 10941 - DNA, 489 bp, Gossypium hirsutum
  unsure (1)..(489): unsure at all n locations
  Clone ID: uC-gsflmaxxa061d12b1
cctatatgaaatgtcagccttgtctgtactaatacctgaacagaatcttctaaacacacacaaaaacaaatgccttgtatttaagcctgaagctattgataagttgcttcaagagaattaagaaagctaaggatggtgttaaattactggagaaatgcatgcgtgttctcctctatcgtgatagatcagctattaacaagcttcagatagctaagatcactgaagaaggcatgacgatttccccgccatattcgataaagacctactgggagttctctgcttttgagaatcctactcagggtgctgtaggatcatggtagacgtcgccatcattttatgctttgtggaaacatttcatggtacgagaagaacatcgatgaccccactaggagttgaaataaaaatgatcaaacttttgatgtctgtngtgtagattaacntttttattggaattgttaattattcctatagtttttgtttttggtattt

SEQ ID NO: 10942 - DNA, 452 bp, Gossypium hirsutum
  Clone ID: uC-gsflmaxxa061e01b1
cgtttctcttgggtcttactccagctattagtctgctagttgattttgctgctgtgtctgaaagctcgccctgtcttttgctcaccatatcccctcagttttagatgtttctaccacctgataaaatccttcactttatccaccagcacctgtagatcctcgaccgtgatgtgcatcattgagcatgtggccctttttaaggtcacaggtgacacagaacaggaaaaggtcaacgcgatgcttaatcacctcaatggtatggtctctctggatcctgtcctgcacctcactgctggtaccgaccattgtatcaaatctcctatcttgaattacacccacatgctccatagccggtacaagtctaaagaagatttgaacacatattgcgcacatcccgaacaccgacctgttgccaaggaaaacgtcatccccatttggacgatataatggct

SEQ ID NO: 10943 - DNA, 583 bp, Gossypium hirsutum
  Clone ID: uC-gsflmaxxa061e04b1
ccctcgcgtccgaaaagctttagatctgaagtaaagtaaaagcccagaaatctttgcttaaaataagatctgggttgcgacttctgctgctaggtgtatgtcatttagtctggtaaagtgctgtttctagctggtcaagaaggctaggttgaagtggtcgagtaaatggcagtaatggatgcacaaaaccctcttctaggagaaaccacttgtggcactttactgcagaaactgcaagaaatatgggatgaagttggtgaaagtgatgaagagagagacaagatgcttcttcagatagagcaagagtgcttggatgtgtataaaaggaaggttgagcaggctgcaaaatcaagagcagaacttcttgtgaccttgtcagatgccaaactagaactttccacacttgtatcagctcttggagacaaaagttttcttggtgttgatactgtgaaggcatcggtgacaatcaaggagcaacttgctgctatagcaccagcgcttgaacagctgtggaaacagaaagaggagagagttaggagtttttgatgtcaatacagattcagagatatgtggggaattactg

SEQ ID NO: 10944 - DNA, 513 bp, Gossypium hirsutum
  unsure (1)..(513): unsure at all n locations
  Clone ID: uC-gsflmaxxa061e08b1
ccctcgcgtccgtttccttgttcaagcccttatttttgtctgtgtgtgtgttttttttctttctctgatcctcctatattgtacattcccgtagcaccaaccagcaaataattactattggatgtgaactttctgatatatccatgaagtagcgggactcaatgtttcaaaacacatgatctttctgcaaaatgtttggtggtgcttacaagtctcagattattggaggttggacgatttagactctccagtgtcaatggcgtcaggtaccggaggaatgaacaaaggtggatttaatgtacagggctacaaatacagtggtccaggaaagaagaatgcatcaaagaaatcatttaatatagggatgatgaaaggaccagaaggactactaacattgagtcgcaacctcagatccgaggtgacacgagttgtgttcccggatgatctcaaagtgtccgataaaatgatatgtgatccnaagataaatctattttgctatggaacaggttcttt

SEQ ID NO: 10945 - DNA, 554 bp, Gossypium hirsutum
  Clone ID: uC-gsflmaxxa061e09b1
tttgacgcgtgggcggacgcgtgggcggacgcgtgggtagctattaagatttggaactaaagagggaataagaaaaggaggggaaacgcgtcataagtcagcaactacttaaaacaccccaaaacaacaattgaaattctcaaactagttgaagaaatcccaacactcgaagaatcaaatacccttccaaacacacgcattcatataatatgcccaaccataacagcagaaaaccaagttgcaaatcaatctttaaggaataatttcaagttttcaggtctccagttatagtaaaaggggggggggtgggattcaatcaaagcaaatcaagttcgaagataaaaaaaaaaagtaaaaagggggctttacgaagagagaattctaccggaaaaataaaagaatcaagccttggtagacctggaaagtcgctccaaagaaaattcgtgcaatttatagagacagaaatgggttttctgcgacatttccttcgattagaaaccctaaccccataaaataataatataataaaaaagggaagggtattggacacttga

SEQ ID NO: 10946 - DNA, 336 bp, Gossypium hirsutum
  Clone ID: uC-gsflmaxxa061e10b1
ctggatcgacccatgcgtcctgttgtgcgctacttgggcgtgtctcacccgacaactagccgttgaagagatggatatctcgggtccatgagtggtacatgtgatgctaggggtatatgatttagtgagagaaacggctgctcgtagctactacatatgcacctggtgtgagcgacttactactgaggcagatgattgcccttcacagtatataatgcaaactgagttagttgacattattgacaaaagtggctgacgtttacgagctattgagctgaagcgcattacgcgtgtggactactattcacctctattatgcttgagaagctatgttgg

SEQ ID NO: 10947 - DNA, 507 bp, Gossypium hirsutum
  Clone ID: uC-gsflmaxxa061e11b1
accttttctgttactttccctcaaaatggtggaaattttgagaagagaacaagtaagtttaaagttttatgctttgcttggcaatccttaagcaagctaaagtgcaaatcatctggaaaaaagaacgaagaaaaagttggaacattgctaagaggcatgaagagagagaaagaaagagagatttatagtgatatttcctaaaaccccaaaccaaaacacatagctgtcgtttatgcctcatggtgaatgccatgtgggcgtcatgtcgttgtccctgccctttcctctacatgctttcttttatttatctcttgttttctctctcttgcatctttggtctgatcggaaattctgtatcagattagatcagatcaccttacctcttttttttggataagagttctgcataaagacccaacttttatttctagggaacacaaatgaaaggaatttttttctttctttcttttagaggtggaatgatctcaaagctgcgaatttgaagct

SEQ ID NO: 10948 - DNA, 583 bp, Gossypium hirsutum
  unsure (1)..(583): unsure at all n locations
  Clone ID: uC-gsflmaxxa061e12b1
tcctcgcgtccggtttttttggtcaaggaatcaacatccaagaaacgcgttaaagaaagtggaagaacactgtctatgaactggaaggattttgagtgaaagatccaaaagaaaaaaaaaaacaacaaaagatctaatgatcatttccacccaagagagcagaaaatctgaagatcttcaagaatttccctctgctttcacaattcctctcaccttcatttccattccttcaagaacagaatcaacagaaaggctgaaactttcaagaaataaggagtctcagaacacccaaagtttggatcttaatggcatggccctctcattcccacctttcctcaaatccacccttctttgcttgacactcctttcatctattctcttcttcttcttcctccaagccccacgaaaacccccacgaatccctcaaagatccctcctttcaacttcctgttattctcgacattcttctgatagtaccctcattaactacctttccctcattactgtcttttcaatgaaaaagttttcctctctatttcctttcttttcctttttttctncttactttacattctatcaaaca

SEQ ID NO: 10949 - DNA, 456 bp, Gossypium hirsutum
  Clone ID: uC-gsflmaxxa061f01b1
agagtatgtaggatttcatacgcaagtaagacattatctgaaactcaaaagggtggggaaaaaaggattcatgcctatcaaactcgttatgagtaaagcatactatctagttgaatggtgctttgaggaatgggtaatgaatccttttttccccaccctattgagttatacagtatgttggatttcatacgcaagtaagacattatatgaaatcagacttcttggtacgtaagcactttgagcttaatcaatacatttatgcattactcctatgagtcgtctagcaatgactttctctatcagcttgtatatcacatagcataatctaatcgatctaaactgggtaatcctggaaggactctggactgttgtgacaagcacaatgttcgctctattgatcgagcgtatatgcataccttgatttaacctgtgaagacaatatttggaacatcttct

SEQ ID NO: 10950 - DNA, 161 bp, Gossypium hirsutum
  Clone ID: uC-gsflmaxxa061f02b1
ggaaactgttgatggagaagagtttatgagcctcttcattgatggaaaagctgagctatatgtttcttagattaaagattgcacatttttggcttaagtctctattgagtcttttgtgctagtactagtatcaattcaaatcccatacctttttcttctgt

SEQ ID NO: 10951 - DNA, 553 bp, Gossypium hirsutum
  Clone ID: uC-gsflmaxxa061f04b1
cccacgcttccggttgaaaaaatatgggtttccaaagaaacatattgggtttccttttcttgatattggcttcactaacaagcctctcttctagccttcctagtgaatactccatagtggaacatgagattgacgcatttctttcggaggaaagggtgttggagattttccaacagtggaaagaaaagcatcggaaagtgtaccggcacgccgaggaggctgagaaaaggtttgaaaatttcaaggggaatttgaagtatatcctagagaggaatgcaaagagaaaagcaaacaaatgggaacatcatgtgggattgaacaagtttgctgatatgagcaatgaggagttcagaaaagcttacttgtcaaaggtgaaaaagcccatcaacaaagggataaccctgtcaaggaacatgaggagaaaggtgcagtcttgtgatgcaccctcatccttggattggaggaactatggagttgtgactgctgtcaaggaccaaggttctcgtggaagttgttgggcattctcatcaactggagccatggaaggatcaat

SEQ ID NO: 10952 - DNA, 530 bp, Gossypium hirsutum
  Clone ID: uC-gsflmaxxa061f05b1
ctccctctctctctttctcttctctttctgaatttccaaaatcggatcaaatcctaattgtccaaattctcatcgttttaatccaaatcagatcacatttcaattcacatataggcgctgataatcgttattcgatctttgttcattttctcactgtatctacagataaattgataggcattttgggggataaggaaccgtaaaacttacatttaatcctaatggcgtgtataaaaggggtgaacagatcgtcgtcagtggcactggcgccggacgcgccctacatggctgctgggacgatggccggagcggtggatctatgcttcagttcatcggcgaatctcgagatcttcaagtttgatttccagagtgacgatctcgagctccccgttataggcgagtgcccaagctcagagcggtttaaccgcctatcttgtggcatgaacggatccagttccgatgagttttctctttgactcattgctggtggcctcattgatggtagcatcgatctttggaattctttaaaa

SEQ ID NO: 10953 - DNA, 551 bp, Gossypium hirsutum
  Clone ID: uC-gsflmaxxa061f09b1
tccctcgcgtccgaactagagataaaatcaatcatggctcgagggaagatccagatcaagctgatagagaactcgaccaacaggcaagtcacgtattcgaagagaagaaacggtcttttcaagaaagctaatgaacttacagttctttgcgatgctagagtttcgatcatcatgttttccactactggtaaactccatgagtttatcagcccttccaccacaacgaagcaagtaattgatcagtaccagaaaaccttggggatcgatatctggaacacccactatgagaaaatgcaagagcagttgaagcagctgaaagaggttaacaggaacctgcgcatagagattaggagaaggatgggcgactgtttgaatgatttgagcattgaagatcttggcgctttggaacaagagatggagagctctgtcactcttattcgtgatagaaagtatcgtgttctctccaaccagatcgatacttccaggaaaaaggtgaggaatgtggaagagatacacaaaaatctcttacatgaactggaatccctgaaaga

SEQ ID NO: 10954 - DNA, 525 bp, Gossypium hirsutum
  Clone ID: uC-gsflmaxxa061f11b1
tgtttagatctaaagggttattgcctttctttgacagtgcttaccagggatttgcaagtggtagcttatatgcagatgcacaacctgttcgcatgtttgttgcagatggcggggaatgctttatagctcaaagttatgcaaaaaacatgggactttatggggagcgtgttggtgctctcagcattgtctgtaaggcggctgatgttgcaagcagggttgagagccagttgaagcttctgattaggcctatgtattccaatccaccaattcatggtgcctcaattgcaatgactatcctcaaaaatagtgatatgtataacgagtggaagattgaactgaaagctatggcagaccgaattattagcatgcggaaacaactatttgatgctttaagtgctaaaggtactccaggtgactggagtcacattataaagcagattggaatgtttactttcacaggattggacagtgatcaagttgctttcatgatcaaggagtaccacatctacttgacatctgatggga

SEQ ID NO: 10955 - DNA, 417 bp, Gossypium hirsutum
  Clone ID: uC-gsflmaxxa061g01b1
gtgtctttgcgcttatcatcggatctgggttcttcttctttcttcacaagttggttctttcagcattgggagaagctgatcaaataaactttgatggctcatggggataaagatttaaaacttgacattgaaaatgaaccgatcactggtgaagaagaagaataccaaaaccgaaaccctattttaggccttaaaaacatggcagaactgctgcttgctaaggctagaggcagtttcacccaagggtcgtcggacgatggagtgtctctgtctagtgatgcttcgaattcaggtagtgtttatgcaaagaacatgcaggcaatgacgagcatgaatgttgtgggacatgatcataatatcaaagatgatggtaaagagaataaattagtgaaggagaaatgtaaaagtttgagcaat

SEQ ID NO: 10956 - DNA, 537 bp, Gossypium hirsutum
  Clone ID: uC-gsflmaxxa061g02b1
gcataaggaatccgtcaataacatgattgaggaagctctattagaggctgaggaaaaaggtgctagtgtgttgagtctaggcctcatgaatcagggtgaagagctaaacaggtacggagaggtgtatgtgaagaagcatcctcagttgaaagtgaagttagtggatgggagtagcttggcagttgcaattcttctaaatagcataccaaagggaacaacccaagtactccttagaggcaacttgactaaagttgcttttgcagtcgcctttgccctgtgcgaaaagggcattcaggtcactgtattgcgtgaggatgaatatgagaagcttgataagtcacttggcaccaaatctgagggtaaattggttacctctaagagttatagctcttggcaggtatggttagttggagatgacttgaccgaagaagagcaaagaaaggcaaataaaggaacactatttattcccttttcgcaacttccaccaaaaaaattgcgcatggactgcttctatcacacaacaccagcgatgcagac

SEQ ID NO: 10957 - DNA, 516 bp, Gossypium hirsutum
  unsure (1)..(516): unsure at all n locations
  Clone ID: uC-gsflmaxxa061g03b1
ccctctcgtccggccaaagatcaccgctggttttggggtgccttcaatccatccctgaaatctggttccccattccgtccccagctcagctctctttctaaaatacaactcctgatttagctttttaatttttgtggatcaagatgccagagaggtcaaaatcttcttctgtaagtaatcttccactcatcctggacattgatgactttaagggtgatttttcatttgatgcattatttgggaacctggttaacgagctcctgccatctttccaagaagaagaagcagatacagcaggtggacatggccttggtgggactgaggctctaccaaatggacatgcccgtgcctcttccgatgcagcaaaatttgcacaaggagactctatccctctatttccagaagtagatgctntgctatcactgttcaaggattcttgtaaagagttgattgatcttcgaaagcaggctgatggaagactccacactctcaagaagaggtttctactcaagatgc

SEQ ID NO: 10958 - DNA, 493 bp, Gossypium hirsutum
  Clone ID: uC-gsflmaxxa061g04b1
ccctcgcgtccgcccacgcgtccgaagtcggccatggcggatgcccttttgacatccatgtgggttttcagcatgccctttcttaagattctcactttcgaaattgcagctttcctcggccttcgacccttccctttggctgctttcttcatcaccaccctcttggtcagccttatgatgtttatcttcaccatcatcggcaacgctctcggcggcgccaccttcaatcccacggcctccgtcgctttctacgccgctggcctcaggaaagactggtctgccctttccatggcagtgcgttttcccttccaggccgtcggtggagtggtgggcgtgaagacagttttgggggttcttccaagggaatataaagaaaccatcaaaggaccttctttgaaagtagatatacagacagggtttttagctgaagggttgctgacatttgggctatgtctagctctattggtgattttgataaggggtgctaacaacc

SEQ ID NO: 10959 - DNA, 554 bp, Gossypium hirsutum
  unsure (1)..(554): unsure at all n locations
  Clone ID: uC-gsflmaxxa061g05b1
gcattgttttctctgtttgccatttgccttaatcatcttcctctttctttaaaacctcttgaactctgctatagatcactctgtgcttgtggtgatcggccaatagctgatggaagccttcttgatttcttacggcaagtttctacctttgggctttcacttgtgaggcttgatatccgacaggaatctgatagacatactgatgtccttgatgctatcacaaagcacctggatattggatcttatcgagaatggcctgaggaacgccgacaggaatggctcttatctgaactcagaggcaagcgccctctattcggccctgatcttcccaaaacagaagaagtcgctgatgtattggacacatttcatgtcatttctgaactgccttcagacagctttggtgcctatataatctcaatggctacagccccatctgatgtgcttgctgttgagcttttacaacgtgaatgccatgtaaagcaaccattacnggtagttccattgtttgaaaaactcgctgatctngaaactgaatcaaaggaggtggtaaagag

SEQ ID NO: 10960 - DNA, 550 bp, Gossypium hirsutum
  Clone ID: uC-gsflmaxxa061g06b1
tcctctcttccgcccacgcgtccgtgaactaagtgctgcttggtgtacttatctgtttatgatggagttacttgcttccatccactgttacttttggagtccttcgagaactatttgcttatggatgtctctggtgcttttgctccaatatagtaaaacagtagtctccaaatccgattatttgatcggacttggaagctacgacattactggtcctgcagccgacgttaacatgatgggatatgctaacgcggaacaaattgcctcggggattcacttgaggctgcgagctcgctcattcattgtggctgagccacaggggaaaagagttgtatttgttaacctcgatgcttgcatggcttctcaattagtgacgatcaaagtgattgagagattgaaagcaagatatggggagttatatactgaacagaatgttgctatcagtggtattcatacccagtgccgaccaggaggttatctccaatatgtagtgtatcttgtaacatctttaggagttgtccgcagacatctgatgtcctggttgatggca

SEQ ID NO: 10961 - DNA, 498 bp, Gossypium hirsutum
  Clone ID: uC-gsflmaxxa061g08b1
ttaggactcgaggctctgcgaatttgcttcatttttaaaaaagatagaggcggattcgaatgctccgttgaaggtgaagccgatggatgcttggattgcattctcaaaagccgtcgacgctcatgctaagaggcatgaaatctaaacttccatgttactgaccaagggctgtaatactggaaataggcatggcaaaatgctacactaaagagcaggataaatcgataatacaaacagacatactactcaaagcctggcattcgaacaagaaaagagcagactagcgattgagaactcatgttcgagcagcgagttgcataagctgatataatccataaaaatgttagagccatgcaagacacaactcatttgactgaagtggttgcatgagaaaggcaacagaagaaagcagaggatgaaatgagtctgcgacttgtattgcgacggcagaactaatgcagataaatgggatggagctcaaaccactcattatgttgg

SEQ ID NO: 10962 - DNA, 400 bp, Gossypium hirsutum
  Clone ID: uC-gsflmaxxa061g09b1
cccacgcgtccgccgagttgctccagattattatagatagaagctagcaattcgacatcatccccaggaactaacgtgttgattgcgtcataggatctcatccctggtggcaagaccacatcattctcagtgaacagcggagttatcactttttcactcagctgttccttaattgtgtttgcgactgatctatttactcgatcctggtagttctctgttgctaaatttcgcagcctggcgactctccaactggctattattaaaataaacgacggtaaggcaaggccggaaataaaatcaattagatagttaagaacttgatctgacatgttgcattctactcgaatgtaagagaaattcaaatgttataactagcatgaaagtcgatctattacgaccg

SEQ ID NO: 10963 - DNA, 507 bp, Gossypium hirsutum
  Clone ID: uC-gsflmaxxa061g10b1
tatttcttgaacatttctcaatgtcaattcaaacaattaatcaatcttcataagcacatataagattaagtgaggtaacaatatatttctatattgaaacaatttaatcacaataatcttgcaagttatgtaaggctaatgtaccatttaataccgccgctaatttatccttcagctaccttaaaagattaaacattcaccaattaaatatcatgtcaattaattacaatttcaatatgtttaataattaattaattcattaccttacactttataatgcatgtagaacataagcatgattttatttaattgaacaacttaccaatgcctataacaacataaatatgattttaataatttaagtggacagaatgaaatcaatataacatgaattaaatttaagtcattttaattagaagaacaacaacgcataaattattcatattcagaatcacaacatgaacaagataattaaagagaagggaactaggatgcaaatctagtatt

SEQ ID NO: 10964 - DNA, 569 bp, Gossypium hirsutum
  Clone ID: uC-gsflmaxxa061g11b1
tcggtctcgtgggccgggacaaaaaagaagaagaagagcggccattgaaattttcttcgtcaagctgcttttctcctctggttaaaaccccagaattcgagttttccgaggagaaggaatcgatggatttagatcaatggatatcaaaggttaaagaagggcagcatctcttggaagacgagctccagcttctttgtgaatacgtaaaagaaatcctcatcgaggagtcaaatgtgcaacctgtcaacagtccagttactgtttgcggtgatatccatggtcagtttcatgatctaatgaaactttttcggactggaggtcatgtaccagagacaaattacatttttatgggagattttgttgatcgaggttataatagtcttgaagttttcactattcttttgcttcttaaggcaagatacccagcgaatatcactctcttgcgtgggaatcatgaaagcagacagcttactcaggtttatggtttctatgatgaatgccataggatgtatggaaatgctaatgcatggcggtattgtacagatgttattgactatcttacactttca

SEQ ID NO: 10965 - DNA, 531 bp, Gossypium hirsutum
  Clone ID: uC-gsflmaxxa061g12b1
gattcagtctgttgcttctgaagttacagctgacgactgtgatggtaaaagtattgactggtggcgtggagggaagttgtcaacccatgtgttccagaaagcaattttgcctgcctcaatggttagaaaagctgcacaacaaggtggtgtgagaaagatttctggtattaattatgttgatgattttgagattcctaaaagaagcagacaattaatttggagagctgcagtaaaaaggagtaagaatgcagcgcagcttgcacttcaggttagatacctagatcttcatgtgagatggaatgatcttgttcgtcctgagcataacatctcagatggaaaaggttcggagacagaagcatatgtttttagaaatgcaattatatgtgataagaaaactgtagaaagcaagatccaatatggagttgcttttggaaatcaaaagcaccttccttcacgtgtcatgaagaatgtagttgacatcgagaaaatcgatgatgaaaaggagaaatattggtttcatgtaacatacat

SEQ ID NO: 10966 - DNA, 460 bp, Gossypium hirsutum
  unsure (1)..(460): unsure at all n locations
  Clone ID: uC-gsflmaxxa061h01b1
atttgttcatgtttcttccttcactctcttttgtttcctgtcccatgaatcggtggaacaaccaaaatccataataacattctttcacttccttctttctttttctcttttccattttgatccctcacaatttctgggtctgcaatcaaggacgtctaaacctttcacattcatcacaaccgggtctgtttatattgtctcaaaggttatcataagcctatataataataaaagaaacatgcaaaaggataacagtgcaccatctacacctactagtgctcgagctcggcaccgaagacggtccaatgagtttccggctgatgagagcaaaacaaacggacatcttttactagtaaatgatcacaacaaataccggtcaatgtggattcgagctttttcatctctgtggatgctggggttcttcctcctggttatctatttgggtcatncttatgtattg

SEQ ID NO: 10967 - DNA, 102 bp, Gossypium hirsutum
  Clone ID: uC-gsflmaxxa061h02b1
gttttactcttaaaggtcctaaagtatctttagtcttcggcatgtttaaagactcgaacaaccgacatcaagtagctcggaattttcttaacttactgacct

SEQ ID NO: 10968 - DNA, 483 bp, Gossypium hirsutum
  Clone ID: uC-gsflmaxxa061h03b1
cccacgcgtccgcttcactatcctcaccctctcaatcaacaatggcctctacttcatctgtcaacctatctcaagccctcctctctcgcgctatctcttcccatgcctccgcccaatcctccgaccaccgcccctccctctccactctctcttttcccggtttctctggcctcaaatcttctatccctcgcgcttcctcttcccgtcgacgccttccctcccgctccaaccacaagcgccaggtccgtgctgctgccgtcgaaacaattggcaccgccgccgagacttccttggtcgagaaatccgtcaacaccatcagattcttgtctattgatgcggtcgagaaggcgaattcaggtcatcctgggttgcccatgggctgtgctcccatgggtcacattttgtacgatgaagtcatgaggtataaccccaagaacccttactggttcaaccgtgaccgtttcattctgtccgctggtcatg

SEQ ID NO: 10969 - DNA, 529 bp, Gossypium hirsutum
  Clone ID: uC-gsflmaxxa061h05b1
ttcttaaccaaataaaaacatggcaccacaccttaatattgttccttccatgtttgtgcttttattattattcatttcagcctctaaagttcaatcaggcgctattgatgttgttgccaagtttggcgcaaaagctgacgggaaaacggatctgagtaagccatttttggatgcttggaaagaagcatgtgcctctgtaaccccatcaacagttgtgattcctaaagggacatatttattatcaaaagtaaacttagaaggtccatgcaaggctcctattgagattaatgttcagggcactataaaggctccggctgatcctggtgctttcaaggaccctaattgggttagattctatagtattgaaaatttcaaaatgtccggcggaggaattctcgatggtcagggaagcattgcttatgagaagaataaagatccccacaatcgtgcatttcgtgtcaaactccccgttaatataaggtttgactctgtgaccaacgcattgatacatgatataatctagcaagac

SEQ ID NO: 10970 - DNA, 430 bp, Gossypium hirsutum
  Clone ID: uC-gsflmaxxa061h07b1
tcctctcgtccgcccacgcgtccggttctcagtctataaaaacaggttttccgggcaatttccagccaatttcggtcggttctcccctttgattagtattgacatatcagagaatcaattttcaggtggattcccgaggttcttgtgtgagaggggaaagctaaaactcttactggctcttgagaacaacttttcaggggagtttccggattcttatgttgaatgcaaatcactggtaaggctcagggtgaacaagaaccatctttctggaaatattcctgatggattttgggcacttccgcatgccaatatgattgacttcagcgataatgacttcactggaggagtatccgccagcattggatcttccatcggcttgaatcagttggttttgcaaaacaataaattttcgagctctcttccctccgag

SEQ ID NO: 10971 - DNA, 460 bp, Gossypium hirsutum
  Clone ID: uC-gsflmaxxa061h08b1
ttcttatcttttgttgctcaatcgacccccaagtgctcctctcagcactaatttgccaccacgagcaacgatctgcgcatccgagccctaaaggaggggttttcgcctttgaaacccccattcagacttcgatttcgacgaagtaaagggggaatgacggctagcctctcaaggtaagctcctctttcattttatattattatacacgagaatatgtgcgcaaaaactaggaagaaaagaacagattcaaaaagagaagatgaatgaagctctcgaaaatcacctttcttttctttttcttttgtattcaatctgccaatattgtatatgtatttgcgtattgcctgttgtgcgtttgtgttgcgtaaaaaactcacctaggctattacatggcctttatagccgaaaagaaagaaaaatcaaaaaatgaaaattctatttttcttcttccctattcgct

SEQ ID NO: 10972 - DNA, 523 bp, Gossypium hirsutum
  Clone ID: uC-gsflmaxxa061h09b1
tcggtcgcgtgggcaaaattcaaaaccctagttagggtttttatcttcctcaatctcccgttgtcacactgcaaatcggccacaatgtcgatgtccaagagttccaaaatgcttcaattcatcaactaccgtatgcgggtcactatccaagacggccgtcagttggtgggtaagtttatggctttcgatcgtcacatgaatctcgtactcggtgactgcgaggagttccgtaagttgccgccggctaaagggaagaaaaaccccagtaccaatgaggagcgtgaagatcgtagaacgcttggtcttgttcttcttcgtggtgaagaggttatttctatgactgctgagggtcctcctcctcctgaagagtcgcgttcaaagtctgccgctgctaatgctgttcctggacctggtattggtcgtgctgctggtcgtgggattccgactggtcctcttgttcaagctcagcctggtcttgctgggcctgatcgtggtgttggtggaccggctcctgtgatgatgc

SEQ ID NO: 10973 - DNA, 518 bp, Gossypium hirsutum
  Clone ID: uC-gsflmaxxa061h11b1
tgtctttcaccatggaatcccgctctttaatacagatggtcatgatggcaagctcacgtactggtatagatacaccgtctccgtcaccacaaccaccgccacccttcttttcatcatcatcaccaccaccactttctctgtctgataacaccactagcattactattatcccatcaccctaaggcttaccattctctctatcaccgcaaatagaccccataagtcacaacggaaacatttccatagcgagcatcaatccaccaccacctttacctgattcacctagaagcgttgatttgtgcccactcgaattcattcttgctcttatggcagtcataacgaacccagctatagtctacgctgtatttttcacatcaggtgccctcctagttctttcgacgaacgccatgacaggtccagggacaaccatggtagtgctgacgaagtaaccgagagaagggagcctgtttcaggtcttatgtatcgaaaagaaactcactctaaagatctgggcagtg

SEQ ID NO: 10974 - DNA, 577 bp, Gossypium hirsutum
  Clone ID: uC-gsflmaxxa061h12b1
tgtgttcatggaggaagaaatctgtgaagagcctaaaacctctgaaattatgattgttgagtgtgttgaaactgctacaaacatgccatacatttttagtgctcatgaaagcgtcaaacaggatccatgccttctaactgttgatacatccgatgggtattgtcttgccatacttaagtcttcaacaccatgtgtctcacctatagtgaatcagactacgaagagtctgaggacatcatcaatgtactctgcttcacagaaagatcttagggatgataaaccagaaactatgcgggtcacaccaaccgaacatttagcagctagcctgcaccgtggtcttgagattattgatagtcaccgacagagtttggcattgaggaggtcatcatttcgtttttcattaaaacctgctgattctaagccaatccttgcagctagaaaagttgatgtcggagttcatacttttccacaagaagaagacccagcagcatttctatgtagcaattgttcacagagaacatacctagaatgcaaagatgacactgaagactctaacctgcaatagttcctgttgatg

SEQ ID NO: 10975 - DNA, 535 bp, Gossypium hirsutum
  Clone ID: uC-gsflmaxxa064a02b1
gtttttgttgttgatacaagtcaaagggttgtagaaaaagatgtttatactgttgactttgataaacagctgtcaaagtttccgtcaggttactctttcaacaggagagaggaaagtggattgacttctgggccaacaggtcgggagagatttgaagtgaataactcctacggcagctcaacaaaaagagtttactcatcaaattctcaaaactcagctgatacagaagagaaactgcagaaggtgtcaccacctcctagaaaagtgactagagaagaaaagtcagataagatgaccgggatcgtagctaagaaagacgggggaggatctgatttgtccactacaaagtctaggcagtcaaatgctgttagttatagcaatgcagataatgttggacatagacaatatgatcccgagcctcctgatgagaatatcaatgcaatacttgaggaggaagaggctttaattgctgctcacagaaaagaaattgaggatacaatgggaattggtcgtgaagaaatgaagcttttgcaga

SEQ ID NO: 10976 - DNA, 586 bp, Gossypium hirsutum
  Clone ID: uC-gsflmaxxa064a04b1
ctcattcgtccgattgaagggtgattactgcaaggaatggccttgccaatttaggataaataagtaccatttcacccctcaatctgtaggctcggctggggttcaattacacactgattctggcttcttaacaatacttcaagacgatgagaatgttggtggacttgaagtgatggacaaatctggtgaatttgcagctgttgatcccttgcctggcagcctccttgtcaatcttggggatatggccacggtatggagcaatggaaggttacacacggtgaagcatagagtgcaatgcaaggaggcgaaaactagagtgtcgatcgccacgttcctcttgggaccgaaagaggaagcggtggatccgccaccggagctggtggattcggaccatccgcggctttacaactcgttcacgtacgaggagtacaggaagctgcggctgtcgacggaattgccagctggtgaggctctagcactagacatacctgatcttaaagaaagattgtgaaagcatattgcaatgtatgaaagttctcccttctgccctctgttgatgaataagcatgaattaaatttctaaaaa

SEQ ID NO: 10977 - DNA, 472 bp, Gossypium hirsutum
  Clone ID: uC-gsflmaxxa064a06b1
gtattctttttacgttttaacttaaaaaaaaccattgaaaattcagcctaacccctttcttctccttcttcttcttcttcttcttcttcttcttcttcttcttcttcttttctttttacttctttccacaaaattgacattaaaaaaaaaaaaaagaacctaaagtaaataaaaaaagaacaagtccaatttgattccaacatgtagtgactacccaatgcctgacgcaaagccaaaattgaaaaaggaaaaaaaaaaagcaaagaaaaattatcaaaacaaaataaaaaagcctcacgaaaacaaaagctgaaaggtcttcaacaacgtcccacggaaaacgcagactagtttaagcttcctattaacccaatttctctctctctctctctctcccttcttcttcttggtcggtttagtcaggcaaaaacctcaatccatacccttcaaggatttctttgctatttaattc

SEQ ID NO: 10978 - DNA, 547 bp, Gossypium hirsutum
  Clone ID: uC-gsflmaxxa064a07b1
cttcttttgggattctttcaggcatcgggtcttctgccttcgtctgcggaactctgtctacccgtttcctctctactgcttccactttccaggtcgcgacagcaatggggatgctgtcagcggtttacatgagggttttcctcccggattcgatcgtaaatgataatctttctactccaattatgtcagaaggaaaacttgatggcattgttaatcaggatgaagagtcagacaagaaaattcagatgtttaaaaccctaccttcaatagaagatatgcttgtcttgttgaaaagcagcttgacgttttcacaagcagcaattgtttcttttttcagcactctttccgatgtcggcctccatgcttctttactgtattatttgaaggccaggtttcacttcaacaaagatcagttcgctgatttaatggtcatcactggaattgcagggactgtatcccagcttcttctcatgcccatactagctcctgttcttggagaagctaaattgctgtcaatagggcttttctttactgtgtacatatgatc

SEQ ID NO: 10979 - DNA, 547 bp, Gossypium hirsutum
  unsure (1)..(547): unsure at all n locations
  Clone ID: uC-gsflmaxxa064a09b1
tttgttactccttcagatacttactatctttccctcaaaaatggttactttcaggtttcatcagtaccaagttgttggaagggctcacccaacagagagcgatgagcatcctaagatctataggatgaagctctgggccaccaatgaggttcgggcaaaatccaagttctggtacttcttgaggaagctgaagaaggttaagaagagcaatggtcaagtccttgccatcaatgagatttttgagaagaaccctaccaagattaagaattacggtatctggctccggtaccaaagccgaactggttaccacaacatgtacaaggagtaccgtgacactactttgaacggagctgttgaacagatgtacaccgagatggcttctcgccacagagtccgtttcccttgcatccagattatcaaaactgcaacaatcccagccaagctatgcaagagagagagcaccaagcagttccacaactccanaatcaagttcccattggtggtcaagaaggtanggccacctaccccagaagctgagacaacctac

SEQ ID NO: 10980 - DNA, 374 bp, Gossypium hirsutum
  Clone ID: uC-gsflmaxxa064a10b1
tcgtagagggtcaccctgacaagctctgtgaccagatctctgatgcagtgcttgacgcctgcctcgctcaggaccctgacagcaaggttgcctgtgaaacatgcaccaagactaacatggtcatggtgtttggagagattaccaccaaggccaatgtagactacgagaagattgtccgtgacacatgccgctccattggatttgtttctgatgatgtgggtcttgatgctgacaactgcaaggtccttgttaatattgagcagcagagtcctgatattgcccagggtgtccatggccactttacaaagcgtcccgaagagattggagccggtgaccaagggcacatgtttggttatgctactgatgaaacccct

SEQ ID NO: 10981 - DNA, 466 bp, Gossypium hirsutum
  Clone ID: uC-gsflmaxxa064a12b1
tcgcttacgcgtccgctttcagtggttttggttcccttccgagcttgaatttgatcaagtttcagttgcctagtgttatctcttggatttcagatgacggggctcaaaaagattctttctttttgtcacctactcttcattccaattgcagttcatcacagaacgagaagcaaaaactgggttttctgacagatgatgatttagagcatttatataaattagttgaagaaaaagatggaggtcctgcttggattcacatgatggataagtccaccccaactatgggatatcaggcttggcaaagagatcttgagattggtcctacacaatatcgtagccggactgttttcgatgatgcccctcctgagatggtgagggatttctcttgggacgatgaattccgatcaaaattgaagtgggatgaaatgcttcctagtgccgaaactctcgagtcgtctcccactga

SEQ ID NO: 10982 - DNA, 534 bp, Gossypium hirsutum
  Clone ID: uC-gsflmaxxa064b03b1
cttactcgtccgatcgaaacctcataaattagagtccgttgattccttgacggagaaagtagattcggatctatctttgagtgctccgaaagaagttcaaaatcatgttggttctggattaagtcagattggtgaacaagagaagaaagcattggaacatggaagtaattcagcttcggctaaatccagtgatggggccactggcgttgtcaaggttagtggtggtgccaaagtcggtgatcgcccggattatattgagagcggtaagagcagtatgtgtagaggtagtacaagcagtgatgtgagcgatgaaagtacgtgtagcagcttaagtagcagtatcaacaaacctcataaggcaaatgatataaggtgggaagccatacaggccgtccgagcaaaagacggtgtattgggtttgaaccattttagattactgaagagattaggctgcggagatatcggaggtgtctatctttccgaattaagtggcacaaagtgttattttgcaatgaaggtgatggataaagcttc

SEQ ID NO: 10983 - DNA, 524 bp, Gossypium hirsutum
  Clone ID: uC-gsflmaxxa064b04b1
tttcttcattcgaccaaacctaaatcctcactcaaccatcgcctcgcctccgtaatcagcaaacggagtcgcacgaaggcctaatcgaccctgttcgaccatgaatccgagggttttgccattcttaagcctcacaatccctatttgagcttcgatttcttcaaagcaaacaaggattcgagggcctttatcacgataagtatcttccctctcctttatttttgattttttactcctatgataacgaaaatcaaagagataaaagcaaaatgaaaaagaaaaatgatctttcaaattaccacttgaaaacagtcttttattcaccctttttggtaccgatttgtatgcgtaaatatgcgtgtatatttctgccaaaaaaaaagatcccatttacatcatttttctggctttttatagctgatttacatcataaataaaataaaaattgtattctcttgctgtcatttattggcctatttttctgttatcatttctggtgatcttctcgcaggctcattggagat

SEQ ID NO: 10984 - DNA, 472 bp, Gossypium hirsutum
  Clone ID: uC-gsflmaxxa064b05b1
gcccccctgcaccagccgccgaattcctggggggacccacgacgccgattttctcagttcttctttttatttgcatgctgttcatttcctcagctactccagatcttggctgtcgtgcatgccgcaaagcacatcccaaggttaagcctattaaaaaggcccattctgtgaaacccccaatccatgtaaaaccaccggttacagtccctccggtcactgtcccaccagtgacagtgcctccaatagacaaaccaccaggtacaggcccaccagagactgctccatatgtgaagccaccatgtgaactccatccgattgcacaaccacccatcacagacccaccagtgactgttcctcctgtaaagccacctgttgaactccttccgattgcataaccacgcattacaggcccaccagtgactgttccttctgtgaagacaccagttgaattccttcggattgcaaaaccacc

SEQ ID NO: 10985 - DNA, 362 bp, Gossypium hirsutum
  Clone ID: uC-gsflmaxxa064b10b1
tttttcttctttcctcctagccaaaaaaaaaaaaaaaaagcctctttcctgtctctcgttctttttcctgttcaatcatgtcttgcttcattagcaaatatgctgatgagttggctaaaaacgctgcttacattggaacccctggaaagggtatccttgctgctgatgaatccactggcaccatcggcaagcgtctttcaagtattaatgtagagaatgttgaagacaacaggcgtgctctccgtgagctcctattcacaactcctggagctcttcagcacctcagtggtgttattctctttgaggaaaccctttatcaaaaaaccgcttcgggcaagcccttcgttgatgctttgaaggaa

SEQ ID NO: 10986 - DNA, 495 bp, Gossypium hirsutum
  Clone ID: uC-gsflmaxxa064b12b1
tttttcaaaatctcaaactgcaccatcactaatacttcgaatggagctcgaatcaaaacttggccaggcgagcatggtggggcattatcagaaatacattttgaggatattaccatgaataatgtctcttcccctatcctaattgatcaacaatattgcccatggaataaatgcaagaaaaatgaagaatccaaagttaaactaagcaacattagcttcaagaacatccgtggcacatctgcgcttccagaagctatcaagtttatttgcagcggttcttcgccatgtcaaaatgtggaacttgcggacattgacattaagcacaacggagctaaacccgcaacatcccaatgtttgaatgtcaagcctataactagtggcaaattaaatccgattccatgttccggccctatcccaaaaacccctagcgccaccgcttaaagcataccaacaaattcaatgcaattggaattaatatatttattcatattatat

SEQ ID NO: 10987 - DNA, 317 bp, Gossypium hirsutum
  Clone ID: uC-gsflmaxxa064c05b1
ccgcgcggacgcgcgggcggacgcgcgggttctcttctttggcggctactgggctacccacttttttatagcgtgttcttcaaccgcgattgcgggttctgttgctttcttactattgggctcggggtgaaacatcgccagagatcccatttcttcctgtttttgcctctatgaagcgtcttatacgatacaaccttgggtcagtggcccttggctcattggttgtatcctttgtggaatcaattcgtttcattcttgagtcaattcgtcgtaccctcaaagttgctggtgttacatcagatggcttggtttggaaa

SEQ ID NO: 10988 - DNA, 147 bp, Gossypium hirsutum
  Clone ID: uC-gsflmaxxa064c06b1
ccctcgcgtccgaaaaaagagagatggcgtctgtaataaaatctgcaatcttcattctgtcggcgcccctcttcgctccgcttctcccgcccgctcctccgttcccctccccccccctctttctctcctctccgttctctccccccc

SEQ ID NO: 10989 - DNA, 497 bp, Gossypium hirsutum
  Clone ID: uC-gsflmaxxa064d01b1
aaagatatagaaaaatggttctgctagagaaactttgggatgatgtagtggccggacctcaaccggaacgtggccttggccggctgaggaagatcacaaccaccccacccttgtccaccaaagatgaggcttcatcaatggcgatgccgacgagtccgacgacacctgggacaccgtcgacgccggtgtcggctcgtagggacaacgtgtggaggagcgtgttcaatccaggtagcaaccttgcaaccaaaggtattggcgctgaagttttcgacaagcctcaacctaactctcctactgtttatgactggctttacagcggggagacccggagcaagcatcaccgctgattgggcgatggctgacggcggcggagggtagcaaaaccactagcagaaggttgctgctactgaaggagcaggatttgcatgtaaatatatatatcgttcttttttaaaagttttcaatgggtcaattaagtagtagtagtagtaagt

SEQ ID NO: 10990 - DNA, 196 bp, Gossypium hirsutum
  Clone ID: uC-gsflmaxxa064d03b1
ataaatctcagatacttggtcgaggaagaaggcaaagcacagccaaaatgtcgtcgtttttgcaatcacttttggatccgaagaagagctggttagcttctttgcatatgaaagcccttaccacacgcctccgcaaatacggccttcgttacgacgatctgtacgatccttactatgactcggatatcaaggaggc

SEQ ID NO: 10991 - DNA, 424 bp, Gossypium hirsutum
  Clone ID: uC-gsflmaxxa064d11b1
tcgcaatattttgatagtgtgaaccaagctctaatgttccttgatccccaagctagcttggcaacactataaggaatggaaagaaaatgggactaagctttaaagcttagtaagtttgcatgcatataataagcaacatatatcattcattaatcatgtaactactcaacataagttaacataaatattatcatgtatcttaggcataacttcctcattagcattcttactaagagttcatctcatacaaaagttcacactcatgagttatagacacatacatgtaccaacacgtaacatagtcacatacttcgtcatctttgacatactcttcggattaaccgttaaacacttggaatactatcggatacatagggctcagaccactgctgtaacgacaagacgggctcttgaaagacttgct

SEQ ID NO: 10992 - DNA, 51 bp, Gossypium hirsutum
  Clone ID: uC-gsflmaxxa064e02b1
cctactcgtccgcccacgcgtccgcaaaaatatagagttggcttgcggact

SEQ ID NO: 10993 - DNA, 330 bp, Gossypium hirsutum
  Clone ID: uC-gsflmaxxa064e08b1
tcgcaataatctttttttctttttgcttagcggttgagacttggaaaataagcaatttttaccagtcttctcaccgctgtggctataattccctcgctgatgccgggcggcgaattgtccaccgacgggaccgagccgttcatggcctctaaagttaaagccttttctactccgtcgccgatcgttgaaatcagccgaaaagatgaacctataatggaaaagaaagagaaggatccacgaaaaattgctagaaagtatcaactggagttatgcaagaaagccatggaagagaacataaacgtttatttggagactggttgtgggaagacc

SEQ ID NO: 10994 - DNA, 113 bp, Gossypium hirsutum
  Clone ID: uC-gsflmaxxa064e09b1
attagatttgaagaagggttctgctagagaaacggtgggatgatggaggggacggacctcaaccggaacgcggacttgggcggctgaggaagatcacaaccaccccacccttg

SEQ ID NO: 10995 - DNA, 57 bp, Gossypium hirsutum
  Clone ID: uC-gsflmaxxa064e10b1
actgctcacgcgtacgcccacgcgtccggaatgcctggcttatttacaagaggccac

SEQ ID NO: 10996 - DNA, 60 bp, Gossypium hirsutum
  Clone ID: uC-gsflmaxxa064f05b1
cataaattggtcgctactgtaatttctctttgttaaccttgactcaccatctttgccaaa

SEQ ID NO: 10997 - DNA, 107 bp, Gossypium hirsutum
  Clone ID: uC-gsflmaxxa064h06b1
catcatacccgccccctccagaaaccatcccgaggaacaaaaaaaaaggatccagccaacacacggggcaaccacaacccagaatacgtcgacccacaaaagcaaga

SEQ ID NO: 10998 - DNA, 494 bp, Gossypium hirsutum
  Clone ID: uC-gsflmaxxa067a01b1
ctggtacggtggagagatcggatttgacacttacttgtcaatggccagaggaaatgcctctgtgcctgccatggaaatgaccaagtggtttgacaccaactaccacttcattgttccagaattgggccctgatgttaacttctcttatgcatctcacaaggcagttgatgagtacaaggaagctaaggcgctcggagttgacaccatccccgtccttattggccctgtctcatacttgttgctgtctaaaccagccaagggtgttgagaagaccttctctcttctctctctcctcccaaaaattctccccatctacaaggaagttattgctgagcttaaggctgctggtgccttatgggttcagtttgatgaaccgacccttgtcttggatctcgactctcaccaattgcaagcttttaccgctgcttatgctgaattggaaaccactctctctggcttgaatgttttgattgagacctactttgctgatctca

SEQ ID NO: 10999 - DNA, 470 bp, Gossypium hirsutum
  Clone ID: uC-gsflmaxxa067a02b1
cggtctcgtgggttttggacaccgtgagaattggagaccgagaatccgtctttttagggtttggttcggattttaattttgtagcaatggcggaggaatcggagagtaagcagtcggcggtggagtcggtgatggagaagatcagcgagaagattcacggccatgattcatcgtcatcttcggattcggattcggatcatgagaaaccggcttctccttcttccgttaaggctaagatttatcggttgtttggaagagagagaccagttcatcatgtgcttggtggtggaaaacctgctgatgtgttcttgtggaggaacaagaagatttcagctggtgtccttggtggagcaaccgcaatttgggtcctttttgagttgattgaataccacctacttgctttaatctgtcacatttcgatactgtcttgcactactgtttttgtggtccaatgctcataccttcatcca

SEQ ID NO: 11000 - DNA, 492 bp, Gossypium hirsutum
  Clone ID: uC-gsflmaxxa067a03b1
ggtttctagaaaagacgagaaaaaatggagaaaacaaaactaggaaggcaagaagttgttttttttgttccctgtaaacatggtagcaacccttacccaaatttagcagagaaaaaacaaaaagaagaccaaacaatgatgatatatgttgtttctttcattcttgttcatgcattacattgttaatcataacgcagtctttcctccggctcgctgtgacaatggaagaaacctctggatatacagccattgccgtcgacaaggacaggaacagccaacttgctgcaaaatgggcagtggatcacctgctgaaacccggctccaaatgcttcttcgttcatgttttaaagagtttgcatccgcaggagtttgaagccatacctatggaaggtcggtcgtcgtctgaagctgagatgcaactctacttcctttcttgccgaggatactgctctcgaaaagggattgaatcacatgagatggtcctccatggca

SEQ ID NO: 11001 - DNA, 289 bp, Gossypium hirsutum
  Clone ID: uC-gsflmaxxa067a05b1
agcctatttcaaagaacgttgcattggctcaatcttgggggatttgactgtctttcttccccattataaatactgatggtaccaataccttactcaccgaaacctgttaaaaggttacgaacaaggatctttgcacctcaagccttggggccgaacatgccacccaagacgcaaaagacgtagccgacctcgcattgatagctatcaacgatggttgcaaccatggcgtcaacacttccgtctacatcaagaagcagcttcttgaccgtaagattttggaacctacaac

SEQ ID NO: 11002 - DNA, 482 bp, Gossypium hirsutum
  Clone ID: uC-gsflmaxxa067a08b1
cggtcgcgtgggaaaaaaaaaaaaaaacgaaaaaaaggaagtaaaaaattgtaaccgaggtctgtaggcaatgtctaggaggccagtgaatccctctagacgttacggcgatgccggcggcggagctgctctcttttcgctgtctaaatctcgttctccgcctttgctctccattgttctcattgtcctgggggcattgcttattgttgcgtatttccatagcggatcaggatctggaggcataaggagccttgtttccagagttgaaggtgacttttcctgcacatttgaggttctacgggcgcttcctattctgaagaaagcttatggtggtggcattcataaagttttgcatattggtcccgattcttgttcagtggtctcaaatttgttaaaagaagaagaaactgaagcttggggggtggaaccatatgacattgaggatgctgatgctaactgcaaaagactagtgcgtaatggca

SEQ ID NO: 11003 - DNA, 428 bp, Gossypium hirsutum
  Clone ID: uC-gsflmaxxa067a09b1
gaatttatttgtgtagtagcagtacctgtgaaaaggtgttctcattatgatttgaggaactaagcgaatatggcagtagaggaaggccaagtctatggctgccacactattgaatcatggtacgaacagcttctagtgggtagcgtatcctgaatattgggggtggcagacttgactgcttaatggtgcggaccctgccgatacattgcacctttgctggctgaactagacaagaagatcccttatgttacctttcttaaggtggatgctgatgagttgaaggaagtcgctaccgtttgggcattggaggctattccaactttcatggtgcttagggaggggaagattgttgacaaagtggatcttagcaaagaaagaagagcttcatcagactgtgtgaaagcatatggctgtgctcagtactactt

SEQ ID NO: 11004 - DNA, 459 bp, Gossypium hirsutum
  Clone ID: uC-gsflmaxxa067a11b1
attttctcgctctctcttttatcctcactttctcagccatcaaagacacccttttcttttcttaaggttgtaaaagatggcagatggtgaggatattcagccacttgtttgcgacaatggaactggaatggtgaaggccggatttgccggtgacgatgctccgagagccgtgttccctagcattgttggccggcctcgtcacaccggtgtgatggttggtatgggccaaaaagatgcatatgttggtgatgaggctcaatctaaaagaggtattttgacattgaaatacccaattgagcacggtattgtgaacaattgggatgatatggaaaagatttggcatcatacattttacaacgagctttcgtgttgccccagaagagcaccccggttttacttaccgaagctccccttaacccgaaagctaaccgtgagaagatgactcaaatcatgttcgag

SEQ ID NO: 11005 - DNA, 423 bp, Gossypium hirsutum
  Clone ID: uC-gsflmaxxa067b01b1
cccacgcgtccgctttcttcgacgagcggccacctgtcgttaatcatgggtcattctaacgtctggaactctcaccccaaaacctacggccctggctctcgcgcatgccgagtgtgtggaaaccactatgccatcatcaggaagtacgggctcatgtgttgcagacagagcttccgtagcaaggccaaggaaatcggatccattaaggaccggtgaggaatggatatatggctagaagctggaaacactgtttggctagtatgaacctttgtttcgaaattggagcaactcttaagataacattgctgttttgtgttgaatttagtttaagagcttgaagttttgtatctgcacaggataatttgttgttatctcaatgaagtaatcatactgattttatgttactgtttatttttagttttg

SEQ ID NO: 11006 - DNA, 489 bp, Gossypium hirsutum
  Clone ID: uC-gsflmaxxa067b02b1
cccattcgttcgaaagtggtacatggtggtggaggagatttcgacaccataaccaaagccattgaaagtgttcccacaggaaacaccaaacgtgtgatcatatcgattggacctggagtttatcgagagaaaatcaaaattgaacgaactaagcctttcattacattgattggagatcccaaaagtatggcaaatttgacattcgacggcacggctaagcagtatggaactgtagatagtgccacccttattgttgagtctgatttcttcgtggctgctaatctgtttatagtaaacattgctccaaagccagacggtgaaatggagggagcacaaggggtttccttgagagtttctggtgataaagcagctttctataattgcaagatcattggtttccaaaatactttgtgcgatgacaagggcaaccatttctttatgaattgctacattcgtggcactgtcgatttcatttttgggaatgggaag

SEQ ID NO: 11007 - DNA, 491 bp, Gossypium hirsutum
  Clone ID: uC-gsflmaxxa067b03b1
cccacgcgtccgaataaatttacctacctttcataaattctttccgtctttcttaccttttgaaaagctttgtttgaataaaaaccaaaatcctttgaataaaagccatggtggtagcaatggtagcagcatccatggcttccggtttgagaataaaagcaatggcagagctttgttgttatttgacggtggtgctttgtgcattcttggttccatgtttggcgaagcttacaacgattgaacaccccgtcaaacctaatcgctcccttagctttttggtcgttggagattggggcagaaaaggattttacaatcaatctgaagttgcttttcagatgggaaggattggagagaaactaaaaatagatttcggcatctcaacaggtgataatttctatgataatggtttaaccagcgtatatgacccatcttttagagactctgtcacaaacatatatactgccaaaagcttgcataaaccatggtacagt

SEQ ID NO: 11008 - DNA, 434 bp, Gossypium hirsutum
  Clone ID: uC-gsflmaxxa067b05b1
gagattcttgcttaaaatataagaaaaaaaatcatacgcaatgatcactgctggtctggttattcgttgcaaagctgcggtggcatgggaggcggggaagccactatcgatagaagaagtggaagtggcaccaccccaaaagcatgaagtccgtattaagattctgttaactgctttatgtcacactgatgtatactactgggagtgtaagggtgacactcctatgtttcctcgtatacttggccatgaagcctcaaggatcgtggagagtgtgggtgagggtgcgactgatttgaaacctgtagatcatgtgctccctatcttcaccggagaatgcaaagaactgtcccactggctgtcaaaagaaagcactaacatgtgcgaactggttacgatccactgcgaacgatgtgttatgcttgctgatgggaaaa

SEQ ID NO: 11009 - DNA, 398 bp, Gossypium hirsutum
  Clone ID: uC-gsflmaxxa067b06b1
cggacgcgtgggttttccaccaagaatgcattgatcattggcttgaatcacataaaagatgcccagtttgtcgttaagagttagatgtgactagtaaatcaatagtaaatccctgaaatctctaaaatctcaagttttacaggtgatcggggattttgatctaaaagagttcatcatgtttaatcgactgttcaggaaacctaagcaggacacaaatgctctaaccacgttagaaaaattaatcgaggtgtaggatttgattatcttttattttttcactttaattggcaaaccagttattcatttgggtatgtctcttgctttgcttgagttcaaaaatttctgcgatatatgtaacagttttttgcgccacatagcccacatattccacaaatgtt

SEQ ID NO: 11010 - DNA, 493 bp, Gossypium hirsutum
  Clone ID: uC-gsflmaxxa067b07b1
ttcactgcccaacaacaacaaaaaggaaactcttcgcttcacttaaatccacgtaaaaggaaaaacccacagctctttccctttcatttcctattttgatttgttatgttcttttagttaatacgatcccttaaccttagttagatctaaagttaatttgtaggggaactagtgttaattgtcccaggagaaccatacgggagctgtggaggttttgaaagatgaggcggagaggactagattttaggagaccagtgaggaagaggtttcccaatgtggtgtggtggacagtgtgcggaattttggttttggttctcatcgtggttttgagcagagagggtcagattgaatcaaaacccactatttctaggaaaccttatcggcgtgacagaattatggaaggtgtaaccgtcactgatgaaatgttgagctccaactctgtcaccagacaacttactgatcaaatttctcttgcaaaggcttttgttgtgat

SEQ ID NO: 11011 - DNA, 387 bp, Gossypium hirsutum
  Clone ID: uC-gsflmaxxa067b08b1
ttctaatcaacgggctccaacacccttatggagctgggcatgtggttgatgctatacgtcgcgactgcacccctttccgtaaccgatgtatgtagacggataacattgattaaaacgcctcatggtacgcactgactatcaaactattgctgaacacgagcaacatacaagtgattatgtaggacactcgtaatgatcctcacgttcgtatcagttgtatgactagcgagtctgacatgaacgattgagacgtatgaattattggctgatgccctgaagtccgtatactcatgaaaagtaggtgtctgatcaagatctataaaggtaagtcaactattagaaggattccagagctcgcccatctctcgtatcatgagcctatatact

SEQ ID NO: 11012 - DNA, 494 bp, Gossypium hirsutum
  Clone ID: uC-gsflmaxxa067b09b1
cacgtttgggatcaattgtccacaagaaaattttcctattcctgaattcccatcaaatgaagaggtagtcggtgttattaccatggaggatgttatcgaagaacttcttcaagaggagatattagatgagacggatgagtatgttaatatccacaacaggataaagatcaacatgcatgcaccttacgaaaatgctagcatcccaacccctgcatcttcgtcacccttggacgctccaggtcctacaccaaccctttcggtgtccaccagtacttcaaatacaggttcacctgccgcaacccttttcccgatatgatgtgatagtcaaatacggacaaagaaaaatatgttaatagtccgttacttggtaagaatcaatgactgaccctacttagttttaggtcggaattgccggtaagatgcatgcttttatagagaaccggtacttgttgaaaaactcatatatggacctcatcctatatagaattaaagat

SEQ ID NO: 11013 - DNA, 456 bp, Gossypium hirsutum
  unsure (1)..(456): unsure at all n locations
  Clone ID: uC-gsflmaxxa067b10b1
gtggaatgtatggcggtggccttggtggtggctttgggggtcctatgggtggttatgggatgggcatgggtccatatggcgagcaagatccaaataatcctttcggagctcccccatcccctccaggcttttggatgtccttcctccgtgtgatgcaaggtgttgttaactgctttggcaggatatctattctgatagaccagaatacacaagcattccacatgtttatgactgctcttcttcagcttttcgatcgcacgggattattgtatggagagttagctagatttgtgttaagactgctgggaatcaaatcaaaaccccgaaagatcaatcaaccaggaccaggtggactcccaggaccccataaccctcatgggaatcaaaactacattgaagggccaaaggctgctcccagtggtgtatgggacaatgtatggngagaaaatggcagcg

SEQ ID NO: 11014 - DNA, 436 bp, Gossypium hirsutum
  Clone ID: uC-gsflmaxxa067b11b1
tccacgcgtccgtccacgcgttcgcccacgcgtgcgcctatacaacctcccgagggagtaaattcagtaacgtttcagggaagaaaatatggggagtgaagaggaaccaaaagaaggtttcccgaagatggtgaaccctgggaaagccacaattctggctctgggaaaggctttccctcaccagcttgtcatgcaagaatttctggttgatgggtattttaagaacaccaactgcgatgacccagatctcaggaagaagctaagccgactctgcaaaacaactactgttaaaacaaggtatgtggtaatgtcagaagaaatcctgaagcagtatccagagcttgccattgaaggactccccactgtgaagcaacgattggatatctgtaacgatgctgtcacggagatggctgttgaagcctcacgagtttgtatc

SEQ ID NO: 11015 - DNA, 500 bp, Gossypium hirsutum
  unsure (1)..(500): unsure at all n locations
  Clone ID: uC-gsflmaxxa067b12b1
aaataaagagagatggcgtctgtaataaaatctgcaatcttaattctgtcggtgtttttatctgtacgcttcagttcgggtgttaggttgctccaggaacagcccaatgatgaccccaaaaacatggacgctattcctcccattgatgcactcaaccctaccgagttgaatggacccggtgttggcattcacgaagatcatgttgtcccaaaaggtgctgaaattggtactcttggttttggttttgaaggtggtcctgataaatgttgttcttctggatgttccggtaattgtaatcctggtggtttcgttctaccatttcctcaaattccagaaatcccaagaattccagaaatcccacatatcccacagatcccacaaatcccacagattccactaatcccacagatcccacaagtccacagatcccacaagtccaaaaatcccacttatgccaagacagtcggnatgtgagagtggaaagtgttgccgtcagggtt

SEQ ID NO: 11016 - DNA, 488 bp, Gossypium hirsutum
  Clone ID: uC-gsflmaxxa067c04b1
gtgatgagatatcgagttcaaacaaagctgtgcaagccctatgtcaacccacgaattataaagagacatgccagaaaagcttggcgtcgtcaaattctagcgatgttaaggagctgattaggacaggtttccaagccgggctagtcgagataaagaatgtgttggcccgttcagtgactgtccaagagttgatcaaggatgagaacaacaaagcggcacttggtgtttgccaagaggtgttggacttagccattgatgactttcaaaagtcattcgacatgctaggggaatacgacatgagcaagatcggaaaataccttttggaattgaagacctggctaagtggtgcattcactagtcaacagacatgtatagactcattcgcgcaatcaagtaacgaatcatcgcagaagatgcaatcaatcttgaaaactagcatggagattactagcaatgctttagcgatgcttaatgggttatccaccatc

SEQ ID NO: 11017 - DNA, 485 bp, Gossypium hirsutum
  Clone ID: uC-gsflmaxxa067c07b1
gaactactgaaatccctgcctataatcaatctcttagcaaagggccaagctatagacaatggcagaaggcgaagaggatctgccgagggatgctaagattgtcaagtcactgcttaaatcaatgggcgtggaggactatgaacctcgcgttatccatcaatttctcgagctttggtatcgctatgtcgtggatgtgttgacggatgcgcaggtgtactctgaacatgccggcaagcaaaccatcgattgcgatgatgtcaaacttgctattcaatctaaagtcaatttcagcttctcgcaacccccacccagagaggtgcttttggaattggcaagaaataggaataaagttccattgccaaaggcaataccagggcctgggattccccttcctcctgagcaggatacattgataagtacaaactaccaactggctatccctaagaagcaaccggcacaggcgatggaagagatggaagaggatg

SEQ ID NO: 11018 - DNA, 492 bp, Gossypium hirsutum
  Clone ID: uC-gsflmaxxa067c08b1
aaatttccccccaaaattctcccaatctttcttattttcttggcaataattctcagccccagtgatgaaaacaggatttcacatcaactgtaactaaggaattcgattttagtttcagccatgtgttatagcaaagccccaaaaatgaacaacaatgatgtaatgagtgatattttactgaggctaccattgaaggatttggtgggatgcaaatgtgtctgcaaatggtggaatactctcatctcggaccccattttcaagttgaattattcgctgcgaaaccctcagtacaatatctcagggttcttcctacagaaattcttgtaccttgagctgcattcgaaattgttgttctttccttgtgaaggacgagtagatgctgctcctaaaccatctctctctttcatagaagatgataaaggtgtttgtatacaacattcttgcaacgggcttctcatatgcagcagtttccgatgtggagaagaagatcgc

SEQ ID NO: 11019 - DNA, 487 bp, Gossypium hirsutum
  Clone ID: uC-gsflmaxxa067c09b1
aaacaaacaaacaaaggtagcctgagcaaactatgaggaagtgggcgatcccttccgctttggttcttctttgccttctcagtctcctctcagatcatgggagaaaagtacaagcaaatgccgaggaaggaggtgtagatcctcctaaagtcgaggaaaagatcggcgctgtgcctcatggcttacaaactgattctgatgtagttaaaagggaatcggaatccatctcttcgagatcgcttcgcaataatgcggagaagtttgagttccaagctgaagtgtctcggcttatggatatcattatcaattctctttatagcaacaaggatattttcctgagggagttgatctccaatgcttctgatgcactggacaagattaggttcctttcactcacagacaaagaagttttgggtgaaggcgacacttccaagctggatatccagattaagttggacaaagagaagaagattctttcccttcgcga

SEQ ID NO: 11020 - DNA, 485 bp, Gossypium hirsutum
  Clone ID: uC-gsflmaxxa067c10b1
gtgactccaagctccattacatgcgcgatattattcttcgttactctcctgaaggcgaacgtactcgcgttcaaaagcagcgagaatacaggcaaaagattatatcacactatcagcctctacaaagggaactgtatgccatgcatgcctcaaacttctttgcgccctcatttctcaaagcaattaatgagaataaaggggaaagttttagaagtataatggctgaacctactcaaggagtttttacatttgaaatgcttcagccccatttctgtgaattgttgttatctgaggtagaaaacttcgaaaaatgggtccacgagacaaaattcagaatcatgcgaccgaacacaatgaacaaatttggtgctgttttagatgactttggtctggaaaccatgcttggcaagttgatggaggactttatccgacctatatccaaagttttcttttctgatgtgggtggatctactctggattctcat

SEQ ID NO: 11021 - DNA, 411 bp, Gossypium hirsutum
  Clone ID: uC-gsflmaxxa067c11b1
agaaagggaaccatcccaccatggattcggctggttcgtcataaaaggaaaagcatcaccagaaaccttcaccgaaccaccatacggcacagaaccatccaccactgccgcacccgaaccgttatcaaccgacctcgtgaagctcgcacccccgattccggaccaccatactcgcgattgaaacggtaatagcacagttgagccaagtgtccaaaccggccacatatctggcactgagcgcaagaccgaaacgctctcactcgactaacagacggtcgaccaccgcgcccagagtcaacaaccgctggcgtcgaaaaggcctctacgaaatgagcatggaccggcacctcttgaaccgctcgaacctgccgactttcaaattccaacagaacctcgaccaaacgctgaaac

SEQ ID NO: 11022 - DNA, 484 bp, Gossypium hirsutum
  Clone ID: uC-gsflmaxxa067c12b1
atccctctctcgctatctcctctccaaaccaaaatccctaacctccttcctcttcccttcatgccgccctttctcttccttttccccctccgccgccgcttcccccgtgaaaacccttataacctcatcgccatccccttccctctttttcctccgtcgtctccgtgccccactttgctactcgctcctccttcgcgactcactttcccccactgtcaaatcgttctccactcgagcagccaggtcctccctcaatgacccgagtcctaattactcgaatcggcccccgaaggaaacaatattgctcgacggctgtgattttgagcactggctcgttgtggtggagccccctaaagaggatgttactagggatgaaattattgatagttatatcaaaaccctagctcaagtagtgggcagtgaagacgaagctagaatgaaaatttattcagtttctactcggcattattatgcctttggagct

SEQ ID NO: 11023 - DNA, 345 bp, Gossypium hirsutum
  Clone ID: uC-gsflmaxxa067d02b1
ttttgatccaactacacaatgctagattgttaatcacagagtagcatcattttttcaccaaaaattcaagctttcttttttttttcttcaaaattgaagtgaaaatggaaactatctcagttcccaaattcatatttttcttcatcacagccatgtttatgagcatcaatctgatccactgcaccattacctatgacaagaaatctattggcatcaatggacaaagaaagaaatcctaattttgggttcattcattattccaggagcacccctgatatgtgggaaaggcttattaaaaagggttaaaatggtggcttggatggtatagacacatatgttttttgg

SEQ ID NO: 11024 - DNA, 484 bp, Gossypium hirsutum
  Clone ID: uC-gsflmaxxa067d03b1
aaatttgggaagctctctctcttgttgtcagctaaggaaggaggctccattttctattcctttttctcttaattttctttagagaaagagagagatggcttcctttgatgcgtacggaatggaaggagaagaggttcatgcaggtgcagcacctaataaccatcctttcgatgtagacgacgacaagagctattccaattacggctcttactctaacttcaccgacaatcagcaattcccggccgacggtggtgatgtggcggaggatcacttggcttcttctcctgagatcttcggcttcggatctttcgatccgtgccctgcttactcgcaatctgctttcggtgctacagattcctgtggaaaacggatactgatcgaatggatttagcggtggaaacgactatgttttcagttctgatggtcctgtgcttcctcctcctactgagatggcgccagaggaaggctttcttcttcgcgagtg

SEQ ID NO: 11025 - DNA, 394 bp, Gossypium hirsutum
  Clone ID: uC-gsflmaxxa067d04b1
cggatcttttgggtaaaattcctgaaccgggacgcgggggctgtttgctacctttgggagtccgtagacgccagacgatgcctctggaagagttatcttttctgtttaacggcctgcccaccctggaaacggcttatccggaagggggtgcctccggcccgaagagcactgtctttcgcggaaagaaggttgcggcccctgcggcccttgaaaattccgaggaccgagtgccgtccgcgcccggtcgtacttataaccgcatcaggtcttcaaggtgaacagtctctggttagtggaacaatgtaggcaagggaagtcgggaaaatttgatccctatccttcggatatgggttgactcttagggctgggcacgggggtcccagatccaaacccg

SEQ ID NO: 11026 - DNA, 488 bp, Gossypium hirsutum
  Clone ID: uC-gsflmaxxa067d05b1
tgatcgggatgctcctacaagacctgtagaaattatggggactttgagtagcataatcaaggctgagaagcttataaatgctgtcatagcagaggctgatgctgggggttctccttccctagtagctaggggccttgctaccacacaggctgctggtgctgccgatcaaattgagatacaagttccaaatgagaaggttggtttaatcattggtagaggtggggaaactataaaaggactgcagacgaggtcaggggctcgaattcagttgatacctcaacatctcccagaaggggatggatcaaaagaaaggacagtgagggtaactggggataagaagcaaattgagattgccagagaaatgataaaagatgttatgaatcagactgtcaggccatcacctctttctggtggtttcaatcagcaaggctatcgacctcggggaaacagtggtccacctcagtggggtccccggtggcatcctcctc

SEQ ID NO: 11027 - DNA, 356 bp, Gossypium hirsutum
  Clone ID: uC-gsflmaxxa067d06b1
ccctctttagcgttgacgctctggatgagcacaacgggtggggaatgacaaacggttccctaatttcgcatctcttattctcctctatctcgccgccaccgctattgctgaagatttctgagaagaacggtttgaagatggatgggaaagttgctgggtaaaatcagactgggagaatgatgagaacatggctggggaatggaattacactgctggaaaacggaatggggatcttaatgacaaaggtattcaaactagtgaagactacaggttatatgctattccacctgagtccccaggagttaacaacaagggatagactttagtcgtgcaaaattctgtgaagcacgagcaga

SEQ ID NO: 11028 - DNA, 490 bp, Gossypium hirsutum
  Clone ID: uC-gsflmaxxa067d07b1
atatgatccaactacacaatgctagattgttaatcacagagtagcatcattttttcaccaaaaattcaagctttcttttttttttcttcaaaattgaagtgaaaatggaaactatctcagttcccaaattcatatttttcttcatcacagccatgtttatgagcatcaatctgatccactgcaccattacctatgacaagaaatctattgtcatcaatggacaaagaagaatcctcatctctggttccattcattatccaagaagcacccctgatatgtgggaaagtcttatcaaaaaggctaaaaatggtggcttggatgttatagacacatatgttttttggaatggccatgaaccttcaccgggcaattataatttcgagggcagatatgatttagtacggttcatcaagacagtgcaaaaaatgggtttatatgttcatcttcgaattggtccttatgtttgtgcagagtggaatttcggaggatt

SEQ ID NO: 11029 - DNA, 492 bp, Gossypium hirsutum
  Clone ID: uC-gsflmaxxa067d09b1
tttcttgccgatgataggtatgggactgttgtttcagagatcataaaatccaaagctaaactttatgatgccttgaataaagccaaggattccagttttgacgctacacttgctggggcaaacagactgaatcataacaatacagaggttgaaaataatgcagtcactaaccatgttccaaatactacccacccaagctctggagctaaacatctacgccatgagttcaagatttcaaaatcaggagaaggtactgattgcattgatcttccaattgcttttgtgccagcagtcattggacagggttcagatgctggtgaaagttctttaaaaaagcaacgcaagaagaagaaaagggctaaactgaatactacttctcagtcggtagttgctggtagcccattcaatcaaacaacaccttgttcacttgctctatgaaacttgcccatcgcttgcgtgatttgtagcatatattttgtaaggtttggcact

SEQ ID NO: 11030 - DNA, 482 bp, Gossypium hirsutum
  Clone ID: uC-gsflmaxxa067d10b1
gaaattttctttctcgattttctctttagccaaaaaagatgcagatcttcgtcaagactctaaccggcaagacgatcactctcgaggtcgagagctccgacacgatcgacaacgtgaagaccaaaatccaagataaggaaggcatccctccagaccagcagcgtctgatcttcgccggaaaacagcttgaggacggccggaccttggccgattacaacatccaaaaggagtcaactctccacctcgtcctccgtttgcgcggtgggatgcaaatcttcgtgaaaaccttgaccggcaagacaatcactctcgaggtcgagagctccgacacgatcgacaacgttaaggcgaagatccaagacaaggaaggcatccccccagaccagcaacgtctcatcttcgccggaaaacaacttgaagacggccgtaccttggccgactacaacatccagaaggagtcaacgctccatcttgtccttcgt

SEQ ID NO: 11031 - DNA, 479 bp, Gossypium hirsutum
  Clone ID: uC-gsflmaxxa067d12b1
cccacgcgtccgcggacgcgtgggcggacgcgtgggcatcttcctcttcctctagaaggggataattaataaattacggtcggcgaaaaaaagggtaggagatggctcgattgctgttaatatcgatgctatttctctgggcaggatcaatccttatggttcagggtggagatcctacccttttttttcgaatggaacgtcacctatggcaccattgctcctttgggagtgccagtaaagggtattcttattaacggacaattcccaggaccaaatattaactctaccaccaacaacaatattgtgatccatgtgttcaataaccttgatgagccattccttgtaacatggaacggcattcagcataggaagaactcttggcaagatggtgttctgggaaccaactgtcctattccccctgggaagaattacacatataaattccaggtgaaggatcagattggcagctacatctacta

SEQ ID NO: 11032 - DNA, 499 bp, Gossypium hirsutum
  Clone ID: uC-gsflmaxxa067e01b1
aatttgtttcttgcactggggcccttcagacatcaatggctcagcatatgtccaaggaagaggaacaggtgtttcccttgcttattgagaagtttacatttgaagagcaggcgtcattggtatggcaatttctttgcagcatacctgttaatatgatggcggagtttcttccatggctttactcctctatatcacctgatgaacatcgagacatgcgcaagtgcttgagcaagataaattcaagagagaaacttctttatcaggttattttcacctggatggcaggtgtcaagacagctgagaaatgtaaaaatggcaaaggcgaggctcgatgtgaagcttttggagctagtgtcttaccaagtcaaactgaaagtggttactgtgcatgtgaatcttcgaaaagttgtgaaaggaaatatatggagctaagttctagacctaaggattctactctgtccagtcctatagatgaaattatgctttggcataatgctat

SEQ ID NO: 11033 - DNA, 339 bp, Gossypium hirsutum
  Clone ID: uC-gsflmaxxa067e02b1
ggtcaccggtgtatctgagagttacaggcactgggcatgggctacctattgtgcagtggccaaagcgagcaataaagcctagttaatgaaagaaggaccagggaagcttgatgaagttctacagccctgacgccattctctacctaggcgcattagtagacatgatgacggacatgtttctgtgtttttacaaaacatgatgtgcgttgcgagacatatactaaggaccatgtatttgtcaacgatggggcatctatacagtaatcttacgctaactgataaaggcttatgtcgctttctacaaaattagtaaccccgggactcaaattcaagcctatg

SEQ ID NO: 11034 - DNA, 486 bp, Gossypium hirsutum
  Clone ID: uC-gsflmaxxa067e04b1
ctttgtttattttcatagtttacaatctctttctctgtgatcacactacttgcatattggttaaagtgatctccttttaaaaagggtctgctcaaatgaaaatgtttagcttttctcgtagacctatgaagcttaacagagtgaaaaaggtataactttcagaatctgttcatggaactagaagccctataagaccatccaaaagaaacaacaatacaattgtggaatcagctttgcctgctggtactagtcattgtaatgattttgatccttcgactgcccccgagattaattcgtcggggaattccgagaactggatggtgttatcggttgctggctaaaaacccgtgccacggtttaatcacgcagccgctgtagtcgggaataggatgatagtggtcgggggtgaatccgggaatggattgttagatgatgtgcaggttcttaatttcgataatttttcttggacctcagcatcatcgaagc

SEQ ID NO: 11035 - DNA, 405 bp, Gossypium hirsutum
  Clone ID: uC-gsflmaxxa067e06b1
cccacgcgtccgacgaaatggcggaatcatagcaacaaagaaactgaatggcaaacccctacagacagacgctttatgtgtttcaatatatagactgaaaaactggggaaagtagaggtgaagaaattggcttactaaaggacaagatcaaagctgtgagctccaacacgtccatacataactttaccaccaaaactagcacagggatggcttattttcaagtggcatagggctaaaggcagggactatgacactgctggcatgattgttatgcgaccttgactcaacagaaagtaggaaattttatcagatgatagcttcagcaatgacttaagctgtagctctattacccacctctacaatggatggatgattgatggagtacagcatgaaagatggagggga

SEQ ID NO: 11036 - DNA, 503 bp, Gossypium hirsutum
  Clone ID: uC-gsflmaxxa067e07b1
gcaaaccgtttttattctctagagtcttcccttgtccctgttaaaatctgtcactgtgatcattaatggccaccgctgaacctgaagttccagtcactgagcagcagcccgcggcagcagaggagccaaagccggcggaaaagcctgtgaaggagaagagacccagagctccaaaggagaaaaagcctaagcaacccaaatccgcagcacatcctccttattttcagatgatcaaggaggcgcttttggctttgaaagagaagagtggatcaagtccgtacgctatagcgaaatacatggaagagaagcacaaggcggtgcttccagcgaatttcaggaaaatcttaggtcttcagcttaaaaactcagctgccagaggcaagctgataaagatcaaggcctcttacaagctctccgaagccggcaaaaaagagagagcccctgttacgaaagctaagatggagaagaaagctaagccagcttcgaagccgaagaaagctgag

SEQ ID NO: 11037 - DNA, 247 bp, Gossypium hirsutum
  Clone ID: uC-gsflmaxxa067e08b1
gtttttatgtagaaaatacttggttaaaagtgtcggtagactctggcattttgagattccttccgctgctaacatgagcagccacggcggcgctcagttttgctaaaatgcgctccgttcagtcatgctagtgtgtgtcagaactcactcataaatgatatattttggaatagtgataatttttcgttttactgaattaagggttttcttttatattataaataaaaatcaaggatgggttttattg

SEQ ID NO: 11038 - DNA, 472 bp, Gossypium hirsutum
  Clone ID: uC-gsflmaxxa067e11b1
ctttgaccttcccttttattagttcactctctcttttccctttggggttttgggtttctctcagtttctcaatcccaattgtttttaaaatggcttcttccactgctcaaatccacgtactcggtggcatcggtttcgcttcttctcgaaaacccaaccaccatgcacccagaaccgttttcttcggtcaacgacttggtaaaccgtcgccgttaaacgcagccttcttacggttagcgaaaaccaatggaaaacggtacaatgttgggccggttagagttgtgaacgagaaagtggtcggaatcgatctcgggactactaactcggcggttgcggctatggaaggagggaaacccacgattgttacgaacgcggaagggcaaagaacgacgccgtcagtggtggcgtatacaaagactggggataggttggttgggcagattgctaaacgacaagccgtcgttaaccctga

SEQ ID NO: 11039 - DNA, 487 bp, Gossypium hirsutum
  Clone ID: uC-gsflmaxxa067e12b1
tccacgcgtccgggctaaggcaagagggagtgaaaatggttgttaaaacatgtggaagaaaggaagaggtggtgaccagggagtacaccatcaaccttcacaagcgcctccatggctgcacattcaagatgaaggctcccaaggctataaaggagatcaggaagtttgcagaaaaagcaatggggacaaaggatgtgagagtcgatgtcaagctgaacaaacacatctggagccgagggatccgaagtgttcctagatggattagggtccgcattgctcgcaagagaaatgatgatgaagatgcaaaggatgagctctactctctagtaactgttgctgaaatcccagctgaaggattgaagggtttgggcactaaggtcattgacgatgatgatgagtaatttattgatgtttagttctatgaaaaacttgcatttattcaccaagaaatttacccagagttttggctagtgttatatttgtgacc

SEQ ID NO: 11040 - DNA, 467 bp, Gossypium hirsutum
  Clone ID: uC-gsflmaxxa067f06b1
acgaccacgcgtccgaatttgactgagggggaaagattaatatgtaactcacagatttggcctgctggtgaagttttatacgaagagtagtgatttgtgttgtttgagtaggttcgatcctcacgcacatcgcggagattatggacggaaatcgaagatacgccaaaagaaaactattagaagaaggggctggacacgatgcgggcgctatggcgctgttgaaattgagcatttattgctatgaactcggagtgaaatacattaccgcttatgctttttccatcgataattttcgaagaaagccaagtgaagtgcaaaaaataatggatttgttgaaggaatgtatgactgtgttggccaagattgcgaagcatcatccgatcaaagttaatttcgctggaaaccatcagcttttgaatgcagaacttaaggatgaagcttgtcaactcatgggagcaaccgtcgag

SEQ ID NO: 11041 - DNA, 494 bp, Gossypium hirsutum
  Clone ID: uC-gsflmaxxa067f07b1
attttgcagatcggcactataatccttttttcggggggagcgttgaatatacgtttggtggttgctgaagaagagctactaccatggctgcaaagaagagcgttggggacttgaaggaagctgatttgaagggaaagaaagcgttagttagagtcgatctgaacgtgccattggatgataacgttaacataactgatgacacaaggatccgtgccgctgatcccaccatcaagtatttgatgggtcatggctctaaagtcatcctatctagtgatttgggacgcccaaagggtgtcactcccaagtacagtttgaagcctcttgtgccaagggtatctgaactccttggagtcgaggataaaatggcaaatgactgtgttggtgaagaagttgagaaaatggtggctgcattaccagatggcggtgtattgctgcttgagaatgtgaggttctacagggaggaagagaagaatgatcctgaattcgcaagaagc

SEQ ID NO: 11042 - DNA, 454 bp, Gossypium hirsutum
  Clone ID: uC-gsflmaxxa067f08b1
tttatcttatgggacctatgaagaacttgatagagggaattcggtaaccaatctccatttcaaaatgcgagatatggtgtatctgttggtgcatacatgtgaagtaaaggtaaatggtcagaggacaaaaaaggacatactcaaatccaatgggaaatctgaggtaaatgagtccttgagggattctgaaacaaggtcagatgagaaaagattgcctgatttatctattgatggacctgatattgatgacgaatctgagagcacatctgatgtacatgaggatcaagaaactgaaactaccatgattgcagagaaatctgcagattttgaacagttaaatggggatagcagggacgtgataggaaatcctaaagcaggagcgtgttgggatgtctttcgtcgacaggatgttccgaagttaactgagtatttggcaaagcattggagggatttc

SEQ ID NO: 11043 - DNA, 416 bp, Gossypium hirsutum
  Clone ID: uC-gsflmaxxa067f09b1
ttcttgggttctctcattttcagccggggtcatggggaacgttcctaagactatgaagacctattgcaagagcaaggagtgcaggatgcacactttgcacatggttacacagtacatgatgggcaaagatagtttggctgctcaagggaagcgccgttacgatcgcaaacaatcaggttatggtggtcagaccaaaccagtgttccacaagatggccaagaccaccaacacgattgtgctgaggctgcactgccagggttgcaagcatgtatcccagcatgcaatcaagaggagcaagcattatgaaattggtggcgacaagaaggggaagggaacatctcttttctaaatggtgtttatttattttatgtcatgtcatgttgttgggaactttttaagacagtatggaattttag

SEQ ID NO: 11044 - DNA, 485 bp, Gossypium hirsutum
  Clone ID: uC-gsflmaxxa067f10b1
atttagtttaagaaaaaatttccttagagcataaaagaaaagttacgaacatgccgggtgtcaatcctgaaattgagttcccagccattgagttccgtccatcggatttgaagcgaggaaccgaaggatggaaccggttgtgcaagagggttcaagaggcttgtgagactttcggttgtttcgaggtggtatatgaaagggtatcgacgaaactccgagaggatgcgtttgggttgatgaaagaaatggttgagctcccagtggagacgaaacagaagaataatagtcccatgccttaccatggttgggttggaccatgcaagcaggtttctgtgttgtatgaaggctttggagttggagatgcctccaactatgactctgttaaaagttttgctcaacttatgtggcctaatggtcacccacacttttctgacactattcataccctagggacgcatatggaggagttgaacaagttaatttgg

SEQ ID NO: 11045 - DNA, 482 bp, Gossypium hirsutum
  Clone ID: uC-gsflmaxxa067f12b1
ggatttcacagcctatccaaggcttttcagaagggatgtgtggttaacatcaagatcatcggaacatgtaccgggaaatcaatacactggaacaggatggttgcttccacatgcatgtcaaaacaactcagagaatcctccacctaacctttacaggcaggaattaccagggggaactggtgttcctagtggccggattcctccgggagaatgcttcacgggagttgttgactcaaactgtgctctctctcttctatcaaatcaaccatggggcttcagaaatcagggattgactcttgggttaaatgacatgatcaactccgagctttgttcaatgtctcaaccagcaatgcctcatggtgcagttacgaatccttactcaaatgcctcttggggtttcaagggcaaccactcctgtagtcgctcccaggatatgctgcctcaaatcccagagcctattaacagtcaattgaccgggggac

SEQ ID NO: 11046 - DNA, 399 bp, Gossypium hirsutum
  unsure (1)..(399): unsure at all n locations
  Clone ID: uC-gsflmaxxa067g02b1
gctatttttcaggggaaaaagattaaattactaaggggttgcaatagttacagtctgccagattttttgcgtgataaaactgaggaatttactccgacatcctgcatcaatgtagtgaacccagacgttgtcaattggtaaacaggctagtttatttataaagcaatgagtacagggactaaacctctgcaagaagtttcaagcttcactctgcttcataagtcttccaactgaaaagaccctgtgacacggatatgtggatatagtccggtgaaatatctgttacagaatggcaggggagataccatctgtagatacgaaataaatgggtgaagactttggaatcaatcccgagctaaatnattcccagggattgtctctagtagtgaatggggatgt

SEQ ID NO: 11047 - DNA, 413 bp, Gossypium hirsutum
  Clone ID: uC-gsflmaxxa067g04b1
gactgttttgggggaatccaaaaccagtccaccacggggggtttcttacattttttcactgtttctcactgctgcatgcctctttacaccattgggagctcaacagcagtcacccatcaagaccatagtggtgttggtgatggaaaacagatcctttgatcacatgcttgggtggatgaagcaacacgtcaacccttcaatcaatggagtaactggagatgaatgcaacccggtttcaacaaaaaacccgaacccggaatccatttgcttcaccgacgatgctgagtttgtggatccggatccaggtcactctttcgaagctgttgaacaacaggtgtttggttcttccaccattccttccatgactggttttgtggaacaagcattggcaatgaccaagaacctgtctgaga

SEQ ID NO: 11048 - DNA, 476 bp, Gossypium hirsutum
  Clone ID: uC-gsflmaxxa067g06b1
caaattcaaaccatctctacaaacccatatttccctgggaagaagatgcagatctttgtgaaaacccttaccggcaagaccataacactcgaggtcgaaagctccgacaccatcgacaacgtcaaggccaagatccaagacatggaagggatcccacccgaccagcagcgtctcattttcgctggcaaacagctcgaagacggtcggacccttgctgattataacatccagaaagaatccaccctccacctcgatttacgccttcgtgggggcatgcaaatctttgtcaaaaccttaaccggcaagaccatcaccctcgaagtcgagagttccgacaccatcgacaacgttgaggccaagattcaagacaaggaaggaatcccacctgaccaacagcgtttgatcttcgctggcaaacaattggaagatgggaggaccttggctgattataatatccaaaaggaatccacccttca

SEQ ID NO: 11049 - DNA, 403 bp, Gossypium hirsutum
  Clone ID: uC-gsflmaxxa067g07b1
ggagaagagaagttttgcgctacatcattggagtctttcgtggatttcggtgtttctaagctgggaaaaacatccagcttttgtcagctgagttggagaaagaaacgcaaaacccagagtttagtattggtgatcagggggtgaaattgatgggaaaaacggagattgtttgccacaaaatggattatgcatatgctgtgttcttctgccactcaattgctaaaacaaacgtgtatagggttccattagttggggcagatgggacaagggctacaatattggctatttgtcatgaagatacttcagcttggagccccggacacttggcttttcagactctcaaagttaagccaggaactgttcccatctgccatgttctatcaatagacgcccttgtttggat

SEQ ID NO: 11050 - DNA, 423 bp, Gossypium hirsutum
  Clone ID: uC-gsflmaxxa067g08b1
tcttttcgctcgcggacccgtggctcagctacatgggtgtgattgatagtagggtgacagttgatggcccgagggggttgtttctgggttctcactggagccgtactaggatgtttggtcactgataggtatatgagactgtggagagctctgtcacatgcatattggacgggcccatgtcttggaacggaaaagagggtcagaagtgtattggctaatcgaggacattctgtgcaagcggattaggcgccccagtcgtagaaaatgatgttatatggcacgtaggtacaaggatagtcgggttgcataatttgtgtgctatggcgtttctagttagtcttatcctgtatatcttaaagaaaatggtatcagagaatgataagtactaggttggtttgaccatgttaatggcctttgtctgat

SEQ ID NO: 11051 - DNA, 504 bp, Gossypium hirsutum
  Clone ID: uC-gsflmaxxa067g09b1
cccacgcgtccgcccacgcgtccgcttttaagtttgagattggaagtgaaactaaaataactgagttaatatggcggtccaagttccgagtcgacaattattcatcgatggcgagtggagagagcccattctcaagaagcgactcccaaccatcaatcctgctactgaagagatcatcggtaacattccagcggctacagctgaagacgtggagcttgcggtggcggctgctcggagagctctttctagaaacaaaggtaaggattgggctaccgctcctggcgctgtccgtgccaagtatttacgtgccatcgctgctaaggtaacagagagaaaaactgagttggctaagcttgaagcaattgattgtgggaaacctcttgatgaagcagtttgggacattgaagatgttgctggatgttttgagtactatgcagaccttgctgaaggcttagatgcaaggcaaaaggctcctgtctctcttcctatggagacatttaagag

SEQ ID NO: 11052 - DNA, 489 bp, Gossypium hirsutum
  Clone ID: uC-gsflmaxxa067g11b1
gtttacttgtattctactacaacggagagcagaaaaaagcgtaaatctcgagcgcccgagcggaagcgaagcagttgttttttcatttcttttggctctgattaacggagagactggtttaattgcattcttggagccttctgttatcctcatgatattagctgccaatgctgcagtaggagtaattacagaaacaaatgctgaaaaggcacttgaggagttacgtgcctaccaagctgatattgcaaccgtgctgcgcaatggttgtttctcaatacttcctgcaacagagttagttccaggagacatagtagaagttagtgtgggatgcaaaattcctgctgatatgagaatgattgagatgttaagtggtcagttacgtgttgatcaagcaatttccgagaggttgcgattaaaggattctgggacatgtatgatcccgagggatactcactgtggttttgtgactacaagtacaatgaggagaat

SEQ ID NO: 11053 - DNA, 491 bp, Gossypium hirsutum
  Clone ID: uC-gsflmaxxa067g12b1
cagctaccaagatttccaccctatttataatttattaaacatggcattctatttcatgattcccttatttgcttccattttctttatttttctcttcaattctctgcttaatttgttcaaatccaaaaaatcccgggatttacccctcccgccaggcaccttgggttggccgtacatcggtgaaacctttcagctctactcccaaaacccaaatgtcttctttgcttccaagcagaaaaggtacggctccatattcaagacccatatactcgggtgtccctgtgtgatgattttgagccaccacttatccctgctaagacgattcctgatccagacgataagaaacctgaggactgggatgagagagccaaaattccagacccaaatgctgtaaagccggatgattgggatgaggatgctcccatggaaattgaagatgaggaggctgtgaaaccagaaggatggttagatgatgagcctgaggagataga

SEQ ID NO: 11054 - DNA, 328 bp, Gossypium hirsutum
  Clone ID: uC-gsflmaxxa067h01b1
cccacgcgtccggaaaaaatggcaaaagcttcacagagggccctggtttcaatggcaatctgcttgatgtcttccctcgttggcttcgcctatgccggcagtctcgacaacaagttcgtcgtactcggcacaatttattgtgacacttgccgcgtagagttcgaaaccaaactcagcgaacccattccaggtgccaaggtgaagttggagtgcatgaaacaaggggacgaaactgttacgtacagtcacgaagcggaaacagacgcaaacggtgtgtacaagatcccggtggaaggcaaccaccaggaacagatttgcgaggtgagca

SEQ ID NO: 11055 - DNA, 266 bp, Gossypium hirsutum
  Clone ID: uC-gsflmaxxa067h03b1
caaaactgctgaaacttttttgggaccaagggcctgttcacagaagatttcgcacgcatgaccaacgagtccgccgctcagggggacacgactatcaatgagaccgagcccaaagggtgcaacccgctatggattgtattgctggttagaggtgcactacgggtaacattccttgtggggaactacatactgcactggtacgcgcagaatactcgaagtgctaggaaagagacgcccgtatccatgatgaagacggaacgagagag

SEQ ID NO: 11056 - DNA, 493 bp, Gossypium hirsutum
  Clone ID: uC-gsflmaxxa067h04b1
cccacgtgtccgtgaatcttcaccaccaaaaccaaagtgggatcgagcaaaggttgttgatatcctaggatttgagttagcaaagagttcagtgcttttaccacttgtctggaacatacaagtcagcacctggcttcgtcattatgtttatgagagacttgttaagaaggggaagaagcctggttttttccagctactggccacacagaccgttagtgctgtttggcatggactgtatcctgggtacatcatattctttgttcaatcagctttgatgattgctggttcaagagttatttaccaatgggaaaaagctgtacccacaaacatggctcttgtgaagaaagcatttgccgtggtgaactttgcttacacacttctggttctgaactactcctgtgttggctttatggtattaagcaagcacgagacacttgcatcatatgggagtgtgtattatattggaaccatcattccgatagcattgattatc

SEQ ID NO: 11057 - DNA, 495 bp, Gossypium hirsutum
  Clone ID: uC-gsflmaxxa067h06b1
gaaggctaacacacacaagaggccacctcgtagagctaatgaactctcataacattcttatctctaacctaaccttccggaattcaccattttggaccattcatcctatttactgcagcaatgtcgttattaagggcatgacaatattggctccccttaatgccccaaatacagacggaatagaccccgactcaagtaccgatgtatgtattgaagactgctatattgagagtggagatgatcttgtagcagtgaaaagtggatgggaccagtatggcatcagagtggcacgaccaagctcaaacataatagtaaggagaatctcaggcactacaccaacttgttctggtgttggcattggtagtgagatgtctggagggatttctaatgtaattattgaagatatgaatatttggaattcagcagctggggttcgtataaaaactgacaagggtagaggaggatacattgcaaatatcaccataaaaaacataa

SEQ ID NO: 11058 - DNA, 470 bp, Gossypium hirsutum
  Clone ID: uC-gsflmaxxa067h07b1
ttcattcgtccggcagtttcaaggggaagagggcggggatgcttttggactgtctatagaatggtatcagttactctcaagggtcatatttgataaaggtgcattactttttactactgtggggagcaatgcaactttccagccaaattccaattctgtttaccagaccgagcatctttcttacttcaaattcgttggtcgcgtggttgcaaaggcactatttgatggtcaacttttggatgtttattttactcgatccttctacaagcatattcttggtgttaaggtgacctaccatgatatagaggcagttgatcctgattattacaagaatctgaagtggatgctggagaatgatgtaagcgacattcctgacctgactttcagcatggatgctgatgaagaaaagcacatactttatgaaaaaactgaggtcactgattatgagctcaaacctggaggaagaaaca

SEQ ID NO: 11059 - DNA, 511 bp, Gossypium hirsutum
  Clone ID: uC-gsflmaxxa067h08b1
attttctttttccccattttattctacacaatactgctcaaaacagcttagggtttcttttgtttttccttgacataaaatccccagatttcttcataatccagttcagattgggctctttctcaagccaggaaaagccgagttttaaggaatcctagttcaagaggcttattggagttgaaagttgcttaagtgcattcttgtttaccattattattcctcaaaagatgggaatgtgatatgccttatgctttggttcaagtctagggtggataactgtgggcttcaataatttctttggtttaattttgttgagatttgaccatgcctggttcctgataagcgtgtggagtttcatactttgatgaaaatcttaaactagattactgaacaaccttagtgtgccaacagaaaatagctaatacgggtgcgctttgttgtgtggccgctgggccacatggaacaaaatcacccactaacggtagggactgttccatggatcgttatgaac

SEQ ID NO: 11060 - DNA, 492 bp, Gossypium hirsutum
  Clone ID: uC-gsflmaxxa067h10b1
cggtcgcgtgggcggacgcgtgggtgaaattgggtgcttgtgtggatctgctgggagggttggtgcacattggactaggtgacccggttgtgaaccaatgttgtccggttctttcaggactcgccgagctcgaagctgcggtctgcttgtgcaccaccctcaaacttaaggttctcaaccttaaaatttatgtgccactggctcttcaactccttgtcacatgtgggaaaacaccccctcctggttacacttgctctctctaaaaccaagttgctaggttgatggactctatatgatggaatggacatgagaggatgtcgagcttttctctttgtttcttagttggattggaaatctgatgcagtttttattgtaaaaccaattattttttttcttttaaaagattggtgcaacttgcaagtgtgtttctgtatcttccacaaaaaaaaaaaaaaaaaaaagcaatcaagaatgatatttgtctttggtcaa

SEQ ID NO: 11061 - DNA, 161 bp, Gossypium hirsutum
  Clone ID: uC-gsflmaxxa069a01b1
aatttggaatcgtagcttatctctcctatcctatcaagggcctgtttgtatccaactagttgtttccaggacctaggcttcgatagttaaaataaaaaccaccatgggtattgctggctatagttatagttggtttttgatgccatttttcgccctaattc

SEQ ID NO: 11062 - DNA, 143 bp, Gossypium hirsutum
  Clone ID: uC-gsflmaxxa069a02b1
caacactctaaatgtcagctcttcttttgatttgcatggttttcatttatataagtgacaccgattcttgggtgtggttcatgtgggaaagcacacaagcatcgaaagcctaagggaaagtcccctaaaggtcccattatctt

SEQ ID NO: 11063 - DNA, 133 bp, Gossypium hirsutum
  Clone ID: uC-gsflmaxxa069a04b1
ccctctcttccgcaaggggcatcaagtaataaacagggcgccacagctacaaactaaggtcctttctttctttctttttctgactttctttcaagggaaagaaaggagagaaagattttatgctctttttatt

SEQ ID NO: 11064 - DNA, 162 bp, Gossypium hirsutum
  Clone ID: uC-gsflmaxxa069a07b1
ccctgacagaaacagaagttgtttatgtttcaaaaggaaccaccgacaacagagacaaaaaaccgaattcagaggaacaagtatcatcccctggtgccaactttgggtttcagcattcaagtaatttcaaaaataaagaaaattgatggcaatgttttactt

SEQ ID NO: 11065 - DNA, 162 bp, Gossypium hirsutum
  Clone ID: uC-gsflmaxxa069a09b1
ccctctcgtccggtcactctcctttttttgacttggtgttttctcttttctttttgcagttcaaagaatctttgtcaatgttcaaaatcaaagcttcaaatttcttccccgcctaccactattgaatccttttcccatttcctcaaaaacccttctttcttt

SEQ ID NO: 11066 - DNA, 55 bp, Gossypium hirsutum
  Clone ID: uC-gsflmaxxa069a10b1
cggtctgcgtgggcgcgagcggcgcccttccttgggggttttaattaaaaaagag

SEQ ID NO: 11067 - DNA, 92 bp, Gossypium hirsutum
  Clone ID: uC-gsflmaxxa069a11b1
atgtccactacgtcttgtctggtaccaccttgttgtttctaacttatcttttcttttttatctctatatttctttttgtttcccctcacctt

SEQ ID NO: 11068 - DNA, 171 bp, Gossypium hirsutum
  Clone ID: uC-gsflmaxxa069a12b1
cttttatcctcgctcccaatctaatagtaaaagtgtgagctcctcggaagagtcgccgctgcctcaaccctttcgtttcgactgctagtctcatgggttcagtttctgcgttgaaagagcctttagagcatccaatttctcgcacagactactctctcttccccttcctct

SEQ ID NO: 11069 - DNA, 120 bp, Gossypium hirsutum
  Clone ID: uC-gsflmaxxa069b02b1
ctcttttgcatatacctttagtcactaagcaataggggggactattgaaaatggtttgcgaccataaccagtgctgcccttacagtcttctctcttctaatttccaacttatcattcacc

SEQ ID NO: 11070 - DNA, 161 bp, Gossypium hirsutum
  Clone ID: uC-gsflmaxxa069b09b1
gtccctggagggtatgtttaccagaaggcttatgttgagtttttttgctcaaaggaaaaactagatgcacttgtcaataaatgcaagcccttgtcatctattacctacattgctgtcaacaaaaaagggaatttgatatcgaacattgacactaccgatat

SEQ ID NO: 11071 - DNA, 184 bp, Gossypium hirsutum
  Clone ID: uC-gsflmaxxa069b10b1
gttttctggtgctggcggtggaactagtgctagggctagttttaaaggtagagctagtggtgatactggtgctagtgctagaggtggagctggtgctggagaccaaggaggagtcaaaggttgtgcatgtattatttttatcataataaatattatattttatttttatatatcattttttctt

SEQ ID NO: 11072 - DNA, 126 bp, Gossypium hirsutum
  Clone ID: uC-gsflmaxxa069b11b1
ttttctcattcatagcatagcaggttagtccaactgcacacttaccaccgttggctgtttttgatcatccgaaaaagaatggtgaccgtggaagaagttcgtaaggctcaacgtgcccaaggccct

SEQ ID NO: 11073 - DNA, 139 bp, Gossypium hirsutum
  Clone ID: uC-gsflmaxxa069c02b1
gtggatgttgcccattgtgtttgcggttgagaacaggtggtgttctatagggatgtctgatttgagggctacgcctgatcctcagatttataagaaaggacctgcctttgggatgcctggcatccacgcggatggaatg

SEQ ID NO: 11074 - DNA, 198 bp, Gossypium hirsutum
  Clone ID: uC-gsflmaxxa069c03b1
agaattcgcagttccttcctaacaactccctgttggatgcttggtagaaatcgtataaaactctaataaagggagcaactttatttcatttatgtttgccaccaatggcatctccttcgcagtcaactaacttccccaccatcatcttcatcctgttttcattcgttttcatccgaaccataaatgccgttcctttca

SEQ ID NO: 11075 - DNA, 129 bp, Gossypium hirsutum
  Clone ID: uC-gsflmaxxa069c04b1
cgtaattgggcgcagtcctcgcctggctttgccctctccttattaggttttaagaagccgaactaatagccttgcttagcagcaagcactccataccaacgccagctgaagatggagacggaggaccag

SEQ ID NO: 11076 - DNA, 148 bp, Gossypium hirsutum
  Clone ID: uC-gsflmaxxa069c06b1
cccactcgtccgcacaaatattcgtttcccccctttgaatgcctacttttctctttcggattttcttgctatacaatctccttctcgactatttggtccccagaaagctcaaatctttcctctctccttcttgtactaccacttcccc

SEQ ID NO: 11077 - DNA, 166 bp, Gossypium hirsutum
  Clone ID: uC-gsflmaxxa069c08b1
aatttgaaaaaaaaagatggcgtctgtaataaaaggtgcaatcttaattctgtcgggggttttatctgtaagcttcagttcgggtgttagggtgctccaggaacagcccaatgatgacctcaaaaacatggaagctcttccttccattgatgcactcccccctacc

SEQ ID NO: 11078 - DNA, 120 bp, Gossypium hirsutum
  Clone ID: uC-gsflmaxxa069c11b1
ctgtctcgtgggcagtgagtagagaagtctctgggcattgtttgacaattatctccaattgcattgacttcaaatgcagtgaatcccaattcaatcaaggcgaatgtaagagaatgcctt

SEQ ID NO: 11079 - DNA, 163 bp, Gossypium hirsutum
  Clone ID: uC-gsflmaxxa069d01b1
caaattttgctccttttcttgtgtttcttcagaaggaggaaaattttatcccttatttgctctttattttcgcatcttacttcttaaggagaaaaacaaacacgatcattgtcggctacactcccaaacactcaactctccttcctttcataaacaattcttg

SEQ ID NO: 11080 - DNA, 119 bp, Gossypium hirsutum
  Clone ID: uC-gsflmaxxa069d06b1
caagaatgaggacgcctcatcatcttttgactctaggggtcttcttcaccttcatcgctgtttctgatgaagcccttaatgttggaatgcaggccattgataccgccatctttgtgagc

SEQ ID NO: 11081 - DNA, 139 bp, Gossypium hirsutum
  Clone ID: uC-gsflmaxxa069d09b1
gcattggctatataggtccttaagggggagtattaggaacttgggggacccaaagagggtgagatacgtattaaaaatatagctattggagtgaatttcatcgatatctattttcggaaaggagttctataaggctact

SEQ ID NO: 11082 - DNA, 140 bp, Gossypium hirsutum
  Clone ID: uC-gsflmaxxa069d12b1
tcttctgcgtccggttcatcagtcacagcacattgcagttatttgtgaggttactgtgccttactatcacaacagacatcatcaagatgcttatactaacgccagctgtagatggagacagagatccagtaccctttttc

SEQ ID NO: 11083 - DNA, 203 bp, Gossypium hirsutum
  Clone ID: uC-gsflmaxxa069e01b1
ctttctcttatggtggtttttggatttataaaaacatagcgtttatgcttttagattcatttgtgttttggtgctgtggaggtgcatggggtgtaggcaaagttcataatattgatattgggatccttgggggcgttttccatccattagcaccaaaactgcagggagcgttttgcttcaaaagaaaagggcttaatatgcat

SEQ ID NO: 11084 - DNA, 121 bp, Gossypium hirsutum
  Clone ID: uC-gsflmaxxa069e05b1
cttgcggagacaagtcaagatgataatacggatagtatgtgtgaaggaactgactgagtcgcgatcctttggacaataaagtaatccagtggctgcttacattgcatcaaatatgtctggt

SEQ ID NO: 11085 - DNA, 199 bp, Gossypium hirsutum
  Clone ID: uC-gsflmaxxa069e08b1
gtctttttctgtccagtgtataagcacatgcttaggatagttgttaatgaggagttgtatgagcaggagaagccattgtctttgaaggatgtcagatgcctaattgtcattctgagacaggcgttatggcagctcctatgggtgatttcttctgttcaccctacctgtgggaaatctatctccaatacttcttcttata

SEQ ID NO: 11086 - DNA, 169 bp, Gossypium hirsutum
  unsure (1)..(169): unsure at all n locations
  Clone ID: uC-gsflmaxxa069e09b1
atttaatttctctggaaacaaagcaactatcaactgcntttttctaagatctaaggcgccttgtctcagatccactaaattcaccatgtctactactttcagcggcgatgaaacggctcccttcttcggctttctcggcgccgccgccgctctcgtcttctaccggatg

SEQ ID NO: 11087 - DNA, 96 bp, Gossypium hirsutum
  Clone ID: uC-gsflmaxxa069e12b1
cccacgcgtccggtggcttacatggtgtcacagggcttgttttctatatgtggagctgggttgaacaaaccttatacaaatccttccatacaacta

SEQ ID NO: 11088 - DNA, 163 bp, Gossypium hirsutum
  Clone ID: uC-gsflmaxxa069f04b1
cccgttcttctgtgacattacatggggtgcaggttgttgcactgctgatctcaccctcgacattgctaacaagatgcagaatatcatctgtgtggagacgatgatgcacctcacttgcaccaatatgcccgtagagaagattgaccatgcttttcataccatc

SEQ ID NO: 11089 - DNA, 196 bp, Gossypium hirsutum
  Clone ID: uC-gsflmaxxa069f06b1
cttgcattaagtctcaaagatatcactgcaagaaaaagagaaatccagacatggcttccaacactgttgcatccgctgctcttcttcttaccttgaacttgttgttcttcactttggttagctctacctacgtgccttgcccaccaccaccatagagtcccactttccctcgttatcctctctattctctcctctt

SEQ ID NO: 11090 - DNA, 285 bp, Gossypium hirsutum
  Clone ID: uC-gsflmaxxa069f08b1
gttgtctgctctctgcctcttcatcactctgctatgtgttgattctgttttggatcctaccgctatttgaaaccctaggcgaagccattagaatgggcggaaaaagaaagacgaacgaaaacgaagggatggaaggagaggaggatagcaaacacaacattaaaaagatgaagaaggagaagagtgagatacttccttcctccatttaaaacaaggagaagagatctgttgttcactccacactcaagcaccaaatgatgctcgacaaatataagaagtttaaag

SEQ ID NO: 11091 - DNA, 315 bp, Gossypium hirsutum
  Clone ID: uC-gsflmaxxa069f09b1
cgatgctgttaatggaatcaaaccaacagtgctgattggaacatcaggagtaggaaggacatttactaaagaagtggttgaggcaatggctgcgttgaatgaaaaacctattatattctccctttctaatccaacttcacaatctgaatgtactgctgaagacgcatatacatggagtcagggccgagccatttttgccagtggaagcccatttgatcctgtagaatacaagggaagggtttttcgttcctgggcaggcaaataatgcatacatcttcctggcctcggtctgggtttaattatgtctggtgcaat

SEQ ID NO: 11092 - DNA, 144 bp, Gossypium hirsutum
  Clone ID: uC-gsflmaxxa069f11b1
ccctctgcgtccgcccacgcgtccgcccacgcgtgcggggacgcttgggttcgcctgaaaatggtgtctgtacttcgagaaaagtttgctcaccttaacttgacattttcaattggagggcaaatatagctttgatgctctccc

SEQ ID NO: 11093 - DNA, 113 bp, Gossypium hirsutum
  Clone ID: uC-gsflmaxxa069g08b1
ttttctgcgtgggtcgtgcactaaacaattgaagggggggatgttagaacaaacatgcgaataacccaaccccaactaagaaactgtcataaatgttggacatgacatgggta

SEQ ID NO: 11094 - DNA, 126 bp, Gossypium hirsutum
  Clone ID: uC-gsflmaxxa069g10b1
gaaatactgattccttgagcttcatatgagctacaaggcactataaaacatcctgcactgttccttggtacctcttgcaaaaaaccagataagccattcatcagtattttgcaccagataggtata

SEQ ID NO: 11095 - DNA, 111 bp, Gossypium hirsutum
  Clone ID: uC-gsflmaxxa069g12b1
ctttatactaaattcttgcagattcctgttggggggggacttttagaacaattagcggcacgcgcacaattccatcaagaccagatacgtcttcttgttgtacatgagacc

SEQ ID NO: 11096 - DNA, 109 bp, Gossypium hirsutum
  Clone ID: uC-gsflmaxxa069h01b1
gggcggacgcgtgggaaaacgccgagggggtgcattctaaacaatgatgccccactcttttcccctggatttactcctcattttttccttagcccaaggtctgaacccc

SEQ ID NO: 11097 - DNA, 187 bp, Gossypium hirsutum
  Clone ID: uC-gsflmaxxa069h03b1
atatttttcaatctcttataatataaccaagggaacttttgaaaacttacgggcaactccgcacccaatcctagccgaggatctgttgcatagcctcctctcctcgaacaacagcacgacaagcatcagatgatgaacctcaagcttcgccggcgcagcagaggcctatccatgaccctgactgctg

SEQ ID NO: 11098 - DNA, 120 bp, Gossypium hirsutum
  Clone ID: uC-gsflmaxxa069h08b1
accactcccacattaaatattgttggttagacaattgttaaaaacagttcggcgcatccaaacacgcggcagatgcagagactcaggcgcataccgagcagctccatgaaacgattgccc

SEQ ID NO: 11099 - DNA, 131 bp, Gossypium hirsutum
  Clone ID: uC-gsflmaxxa069h11b1
cttcttctcattctcttcactcgatcagtcttggggtggtttttaaaggacttgaaactgcttgctcggctcgcgtctcgacgttttctcgagacccgtcaagctttccgtcaactctcccaggcccctcc

SEQ ID NO: 11100 - DNA, 108 bp, Gossypium hirsutum
  Clone ID: uC-gsflmaxxa069h12b1
ttttaagtcattgttgaccttgttgatcaatgcgggtcttttaaaagcgtgtgccgcttcttgttaacagtaccacatatgaggaacttttatgtcaggggttagctc

SEQ ID NO: 11101 - DNA, 239 bp, Gossypium hirsutum
  Clone ID: uC-gsflmaxxa070a02b1
gggcgtcatgggcatgcactgcgcagcataggtggatctggggctgctacaggtgagccttcaggcttaccaatggagaggatgttaagaggcgtgcacaatagaaaaagaaccactgtgactgtttacaacagaatggaggtaagctctgcgatcaccactagtgctatgattatagtgaggagcatacacgcttgggtggctagagaagagagacggcttagggatctctgaagctc

SEQ ID NO: 11102 - DNA, 360 bp, Gossypium hirsutum
  Clone ID: uC-gsflmaxxa070a04b1
ctatgtcaagatcgtgcactggcagcttttaatcttgaggccgacaaatggggagtcaatgtgcagccttattcgtgtacttctgcaaatttcgccgtttatacggcacttttgttgcctggtgatcggatgatgggattggattcgccatctggagggcatatgagccatggatggtatatgccgagtgggaagaaagtgtctgctgcgtcgatattctttgagagttttccttacaaggtgaattctcaaacagggtttattgattattataaggttgaggaaaaggcgcttgattatcggcccaagaggctaataagtgggagtagcccagcaatgatggagagcgagcatgcaagg

SEQ ID NO: 11103 - DNA, 200 bp, Gossypium hirsutum
  Clone ID: uC-gsflmaxxa070a06b1
ggctattcgtcagctgctgcactttgctgtatcggatgtgagggatgatgtaaggagaactgctgttttagcgctggggtttgtcctatattctgagccagcgctgactcctcgaatagtgtctttactacgtgagtgttacaacccacatgttcgatatggggcggcactatcggtgagcctatcatgtgctggcccca

SEQ ID NO: 11104 - DNA, 540 bp, Gossypium hirsutum
  unsure (1)..(540): unsure at all n locations
  Clone ID: uC-gsflmaxxa070a08b1
ggaaaagctctcctattcctatcaattgcagtagagcccctagaaatgataagccctttaatgtggaaatccctggggaaggttttctgtactctgagctttgggctggacctgcttattccaattcaccacctcctagttctttgccaataccgaaattctcgcttcgggtgaagaggacagtgtctcttgatttgcctgctgcttaccccattgttgatgttcaccaaactgctaagtctgcacctgcatctcctaccagggagcttgacccttctgtagctgaagttttttgtagtgctgcctctgcgaccaaggctttgcgtcgcattctcaatcttgacaatactgatgactgaaaagagtgtaggagtttttcagctcctgtaaataagtttactgtgcaaatttccgaagttagttttagattgtatataggttgaataagatggttggtagcatgagtcagtatgaattaatggcaatggtaggtcgacaatctccagattntgctttatgatggtttatgagagtttggtg

SEQ ID NO: 11105 - DNA, 350 bp, Gossypium hirsutum
  Clone ID: uC-gsflmaxxa070a10b1
gactacaaaaggtcaggccatggactagcaaggaaggccaagaacatcgagcagcttagtctttagcagcaaagttgccttgctgcaaatccattgataagtctacaaaggtctctcttgttccttctgtttcttcgtgttatttatagctacttcgtttataggatacgattttatacataactgcccaaaattagtttgaataaaatcatgttgaaatttgaattctacttggtaggttcttgcattggggatatagcatccctttttcaatggtaaaatagaaagttatgtagctttaccgtctaggtttcgaactttcagtaaccaagcaatgatgttcatcttgc

SEQ ID NO: 11106 - DNA, 390 bp, Gossypium hirsutum
  Clone ID: uC-gsflmaxxa070a12b1
ctttttcgagacgcagttccagaagagttaataattccgagtccatttttctttcaacagatgataataatgatccaggatttgataacagatggctccttgatttcgatggtgatttcttttatgacggggctgcaggtgattctggttacctcagcagtagaattcatagattaaatgaacgaagacgacactcaagactagagaattggttaaggctgcatggtggacatgatgaaaatcatcggcgaactacattttgtccatctggaatccaccctgatggcacttgctcatgtgattcttccctgatgactgatgagcctagtgctcgtgtaagcatatcttgaatagttatgcttgctgaggctctatttgaggttttgcatc

SEQ ID NO: 11107 - DNA, 374 bp, Gossypium hirsutum
  Clone ID: uC-gsflmaxxa070b02b1
cccacgcgtccgcccaaatgcgcgaagcccatatcctctggggcttcacttctcgccaacccattttcctctacaactccctcatcagagcctactcttctcttcaccaattctctcaatccctcgccatttttcaccacatgatcattgcccaaaggccctttgacattttcacattgcctcccgttctcaaatcttgcggacacttatctcatgtaacacttggaagacagctccatggatctgttgtggctaatgggtattcattcgatttggcaaataacaattctttgatcagtatgtatggaaaatgtggcgaattggaagtgtgcgaagaaactggttgatgaaatgtctgtaagaagctacgtatc

SEQ ID NO: 11108 - DNA, 489 bp, Gossypium hirsutum
  Clone ID: uC-gsflmaxxa070b04b1
gctttccgtaaaagtgaggcttctttcattacttataggggggacgttcctccaaccccgaagaataaaagtaatttcttctactggtatatataacaatggtagaacctcggcgtttactcctgatattctttttgtcgacattgttgattgcttatagcaatgcaaatgtcgaagagattcagaaggataccgaggaaggggacgaagaagttaaggtaggaggtcagaaggctctgggtgtgacatacgacgcaaggtccttgatcatcaatggcaaacgagagcttctcttttcgggagctatccattacccacgtagcaccccagatatgtggccggacctgattaaaaaagctaagcagggaggcatcaatgcgattgagacgtatgttttctggaatggacatgaaccagttgagggacagtccaactttgaaggagaatttgacttggtgaagttcatcaagttgattcatgagcataagt

SEQ ID NO: 11109 - DNA, 365 bp, Gossypium hirsutum
  unsure (1)..(365): unsure at all n locations
  Clone ID: uC-gsflmaxxa070b06b1
atcacttaatggcatcttcaccctttcaattctccacntggggtcttactctcctattatggtgcgccgtcgttacgaaaatccccttgtcttcctttccatccttcattattctcgccggcccttacccagaagaccctcactttctcgactgggactagagccgtttcggggtccggaaaatcccctgggcttcctttccgtccttcattattctcgccgccccttactcagaagaccctcactttctcgactgggactagagccgtttcggggtccgggaagttctgttggagagccaaggcgtcgatgtccgggaccaccatggagaaagggaaagggaaagtccaagtcatctgatttcc

SEQ ID NO: 11110 - DNA, 349 bp, Gossypium hirsutum
  Clone ID: uC-gsflmaxxa070b09b1
cggactcgtgggtaaagcatctatagagaagggaatcaggttctggtttaaggctctccaaacctgcctgctcatagtcagagagaggacccaaccccataacttaaagcatctatagagaagggaatcaagtttgccaaccagaattaaatttatattatttgagatattcttccattagaacaatgaaaattttgcagttacttcggctgctattggtgttttttttcttgcagcaagcagcatcggctttgctgctggtaataggatagccataccataagtttccactaataattcccagtggtatgttgcaagaagtgtgtgattaaaaacccgtttttgttta

SEQ ID NO: 11111 - DNA, 461 bp, Gossypium hirsutum
  unsure (1)..(461): unsure at all n locations
  Clone ID: uC-gsflmaxxa070b10b1
gtttttgccaatggcctttacgacctggtcattggggtgctctttctcgactccaatctcctcataaagctcacttctctccgcagaatccgccgcctggagaccgtgtgggacgatgaancttacttccatgatgctgctaaatgccgctcttttgtcgccaaaaggcttcttcaagaatgcgagaccaagaaaggcaacaatagctcgataagagccgggtatggaggctggcttttgtacaccgctgcctcggctggtgacatccggtttcgtcaagcagctgttggagagagaccctttccttgtcttcggagaaggagaatatggggtgactgatatattttatgcagcagcgaggagcaaaaactctgagcttttcaggatgctgctggatttcgcggtgtcgtccaggggttgccttggcggtggcgaaggtgaattgagtgacactcggccgg

SEQ ID NO: 11112 - DNA, 399 bp, Gossypium hirsutum
  Clone ID: uC-gsflmaxxa070b12b1
ctttaatctccaatctctcccccccccccacccttggtggctgtatgatgtactgtagggtgtactgtgacaacacaattaacttgggtcttttccgacagacagacagacaggcagacaaccaaatgaaaaatcactaatctgctttgagtcttttgaccacccacactctaaaccccttcactttcccttttcctacatcctagccttgtcaaaggaacttaagggttgaatattaccccccacattgggaatttttcattttgcccttccgggcatgaagcggaatcagctgtccgaatgcgggggctgcggcgcccctgagcgttttcttctccacaacctccggcacagagccagctatcgacgcctctgcaccaactgcatcctcaagaacca

SEQ ID NO: 11113 - DNA, 444 bp, Gossypium hirsutum
  Clone ID: uC-gsflmaxxa070c01b1
attttaattactttaacacctcctttccctccttcctccgggcttcattagaatattttagatttaaacggactcgatccctaagctagttttgtactaatgggaacagttagtgttgcaaacaaggatatcaatgttagcttagctgaaaaaaagcctagagttgtttttgttttgggtggccctggcagtgggaaaggtacccaatgcgcaaatatagtcgaacactttcattacacccatctcagtgctggagatcttctccgagcagaaattaagtctggttcggaaaatggaaccatgattcagaacatgatcaaagaaggaaagattgttccttccgaggtcacaattaagctttttcagaaagcaatgctggaaagtgataatgacaagctccttatcgatggtttttctcgtaatgaagaaaaccgtgcagcattt

SEQ ID NO: 11114 - DNA, 524 bp, Gossypium hirsutum
  Clone ID: uC-gsflmaxxa070c02b1
cttgatgattgataatgaatcaccttcaataatgatcttgggccatttcatctctatcccgatttggactgctctacggcaagcgagtgcctccgcggcaaaagctgagcctatctggtgatgaatctctaagcaagatattagggcctttccttcagtgtttctaaccactatccccgaagccgcttgactagatctttcatcatatgctgcgtcaaaattaatcttcactgtctgattagattgtccataacgcgcaacaaaataatcagcataaggaaatgttattctgagcaaacacctaggttagccattgtagaaattccatattagcctgtagaagcttctggaatgataattctgtccatactgtcactgatacagggcattcccggaagagatcgtccatcgtttccactactgattcacaccgggggcaaatgacattagtaattagctctttgtattgcatgttagctcgtgtaggcaagtaattcaggaggttttcaaaccgtaatcttaat

SEQ ID NO: 11115 - DNA, 364 bp, Gossypium hirsutum
  Clone ID: uC-gsflmaxxa070c08b1
gtaacatttgacatgcaatccattcattttttttcatggatcatcaatcatttctgtgattaaaaatcatatcttgctattcaaagtcttcatctttattttgtttcttttgatatataaaaaagaaagctctatttgtactttttttgtgaagatctggctggtggtggagacatggggagattattcgcggcgaatcttgaagggacgggttatggctgcaaacactgcaatacccaccttgctctttgctaagctatcgactgcaattactttcatcgtctgcgtggacatgcatatgaggccatcaaaggcttgtattctactccccattatagggcagatagactgaaaacttccaaca

SEQ ID NO: 11116 - DNA, 429 bp, Gossypium hirsutum
  Clone ID: uC-gsflmaxxa070c09b1
atctttgatagcttcagtttttgagtttttcagggaaccctagaagaaggggaaatgccaggaataaagggaccctctgattattcacaagaacccccacgccatccttctcttcaaatcaactccaaggtgcccttcaatgccgagccgccgcgttctgctttagcttcctcttatgtgactcctgttgatttgttctacaagagaaatcatggaccaatccccctagtcgatgacatagatagatattgcgtcgatatatgtggtttaattagaactccaaaaaagctgtatatgagagatgtaaggatgctgccaaaatacaatgtcactgccactctacagtgtgcaggtaataggaggacagccctgagcaaaaactcgaaagtgagaggagttggctgggatgtttctgctatagggaatgct

SEQ ID NO: 11117 - DNA, 438 bp, Gossypium hirsutum
  Clone ID: uC-gsflmaxxa070c11b1
gggtcaaaaaaatccataaaacagagcacttaaacataaccaaatcattaccaaaagtcaacaacaacatgcaatagaagttatatttaaagggtttttttttcttataaacatggttgatccaacttcattttcatatctttaattaaattgacagcttctttttgtttttgcccttaagttatcaaattgagtgaaaataaaaaacagagacagcaaatgaaaaacgaagaacaagcacgtttcttgtttgggatttcactctctgatttgcctaaatggaaacagtttcttatttgttcttctgggttcttctttggttaccttgctaatggcgcttgtgaggaatatgtatacaacagactccagttcagctatgggtggtacttcaccatttgtcaaggatttgaatatctcttcctaatttatcttcaaggt

SEQ ID NO: 11118 - DNA, 492 bp, Gossypium hirsutum
  Clone ID: uC-gsflmaxxa070c12b1
tgttagtagtgttactgggcagctggaagcttgtttggagacattctttcgaccaacttgcaaccaactcctgagtgatttctgcaaggatctgactggcatccaacaaattcaggtagatagaggtgttactttgagtgaagctctccttaggcatgataaatggctcgagaagaagggcataaagaacactaactttgctgtggtgacatggtcgaactgggattgccgggttatgctggaatctgagtgccggttcaagaagattcgtaaaccttcttactttaaccgaagggataacttaaaaagttccgttccgtaaggttttcggcggcatgagatgcaatctgaaggaggcagctgagatggccggtctagcctggcagggccgtgcccattgcggcctcgatgatgccaaaaacactgctcacttacttacccttatgatgcgcaaaggctttaaatttgcgatcacggactcactgatgtggc

SEQ ID NO: 11119 - DNA, 52 bp, Gossypium hirsutum
  Clone ID: uC-gsflmaxxa070d01b1
ggccgccctttttttttttttctttttttttctacctgggggggtttattta

SEQ ID NO: 11120 - DNA, 261 bp, Gossypium hirsutum
  Clone ID: uC-gsflmaxxa070d02b1
atgagccattccttgtaacatgggacggcgtgcagcataggaagaactcttggcaagatggtgttctgggaaccaactgtcctatcccccctgggaagaattacacctataaattccaggtgaaggatcagattggcagctacatgtactatccggtgacggctatgcacaaggcggttggtggtttcggtggcctccttgataaccgccgtctactcattcctgttccctaccctgatccggctgatgactatactctct

SEQ ID NO: 11121 - DNA, 329 bp, Gossypium hirsutum
  Clone ID: uC-gsflmaxxa070d03b1
cccactcgtccgggagtatcggtcctcaaagttcattttagcgattcagcgatttatagtggaaatatctccaagagacttcttcgaagagagatagagtagtttaagactcgcgatggctggctcgtggagagcacgcggctctttggtggttctagcgatagttctgctcggatgtctctttgcaatctcaattgcaaaggaggaagccacgaaattggggacagtaattgggattgatcttggtacaacttattcttgtgttggtgttcacaagaatggtcatgtcgaaatcatagcccatgaccaaggtaaccgctgtacgccct

SEQ ID NO: 11122 - DNA, 382 bp, Gossypium hirsutum
  Clone ID: uC-gsflmaxxa070d04b1
cggactctttggtttcaagcaaataatatcaaatctccttgggcttcttcttcttcttgttcattgagttgagtgttgcaagaaaaatgggtattaagcaatttataggttatgctttagctgtgttagcaagcttggtggtgccagctcagggctctgattttgcattttataagctgagtctgatatggccgacttctgcttgctatccactcgccaccctgaagactccaatacctactttctctaccatccatgggttatggcccaacatttgccaacgacaccgcagttcctgcttatgggccctataatagatgccatgcccatcctgttggccccgctgctgctgtggcttgactaaccacccattcaagacaga

SEQ ID NO: 11123 - DNA, 437 bp, Gossypium hirsutum
  Clone ID: uC-gsflmaxxa070d06b1
gcagtgttcaagttattccccattttttggtctttcttggtgccatctgaaaatcaaatgaaagacatgaaacagaattccataatggggtcgtcagtcaccgaaggcgagatcgtgtgcgtaacaggcggctctgggttcattggttcatggctcatcaagctgctcttggaacgcggttatgtcgtccgagccactgtgcgcgaccctgacaactcgaagaaggtgaagcatttactggagctacctaacgcagagacgcacttgactctttggaaagcagatttagctgaagagggaagctttgatgatgcaattcaaggttgtacgggtgtgttccacgtggccacgcctatggacttcgagtccgaggaccctgagaatgaagtcataaaaccacaatcaatggagtgctaagcaccttgaaagctttggcc

SEQ ID NO: 11124 - DNA, 430 bp, Gossypium hirsutum
  Clone ID: uC-gsflmaxxa070d10b1
atttctcaaaccttaccttatctagggttagggggggggtctttctgagtatctctctcaataccaaaaatatctccaaattgaagatgatgcaacaaccagcacaagctatggtaccaccaccaatggctccaccaccttctatggcgggtgctccacagacccaacaacagtaccaatatcagcaaccacctccggctccggttcctcagacacaaccaccttacatgatgatgaacatgatgcagccgcctcagagtcatcctccacctatgtgggccccacaacaaggttcggctggggtaccagctcaacaacagccagcgggtcaaccggctaacgcagatgaggttcggactttgtggatcggagatttgcagtattatagggatgagaattatcttttgagctgccttgcccaaactgaaga

SEQ ID NO: 11125 - DNA, 454 bp, Gossypium hirsutum
  Clone ID: uC-gsflmaxxa070d12b1
gcttaaccatgaagaaaaaacctacggcgctaatcgagacggcgtcgaggtactgttccgtaaccttattggccttaatattgatagggtcaatcagggcaaactccgtatcagatgaaccagtgagaggtagccagctccggaaccgaccctgcgatgaaatctatgtcgttggcgaaggtgaaactcttcactccatcagcgacaagtgtggcgacccgttaatcgtcgaacggaacccgcatatccatgaccctgacgatgttttcctcggccttgttatcaagatcatcgcttcaactgataggaaattatagaggtagctgcttatacacatgatacacacagaaaatttaatactggatactgggttttggtcttcttttgtttcttagtgagaagtcttcgtaataggtgaagccctgatattggggcctttgatataggatcatat

SEQ ID NO: 11126 - DNA, 442 bp, Gossypium hirsutum
  Clone ID: uC-gsflmaxxa070e04b1
ccccttttctacttgcaatttctctagcaaatacactagcaagagagagagaaaagagagatattttgtgagtaaaaaaaaaaaaggactaaagttggatggttgtagggttttgcacgtaaaagttcgtgtttaatcatcataatgactagcattatgggcacggaggatgataagtatagcacgattaacttcgaagagacggagttgcgtttagggttgcccggcgccaatggaaacgaaggtgaaactaccaaaaacaacggaaaacgagggttctcggagaccgttaatttgaagcttaacctttcatcaaaggagactgtagccgaggattccgataagatgaaggagaagagctcaactgacactgcaaagccacctgccaaggcacaagtggtgggatggccaccagtcaggtcattccgggagaacataatgg

SEQ ID NO: 11127 - DNA, 414 bp, Gossypium hirsutum
  Clone ID: uC-gsflmaxxa070e09b1
cccactcgtacgcccacgcgtgcgcacatagatggggggggctgcatattgggcttccatatccttactgtcctcagtagtgtatatcggcgggctatggtgagaggaccggagtctccaccatggctgacggtgccgatgggttttaaccaagcaacggttctacgcatgaagctgatcctgaatgttcaacctctatcgatcctgatcctaccggattcggtgctggcatatgtataggttatgaaagaagccctcactgaatcgactgcgacgatgaggatagtcatgggcagcagcttttgcggcacctgccactacaggtgccgtcaccgcatgaacagtcacggctgtacaagccaggagaccaactattgagaactgtcagagattgtttacaagcaaggaagcttg

SEQ ID NO: 11128 - DNA, 464 bp, Gossypium hirsutum
  Clone ID: uC-gsflmaxxa070e12b1
cccactcgtccgctcgagttccacaatttggaatcgtagcttgtctctccaatcctatcaaggtcctgtttgcatccaactagttgtttccaggacctaggctttgatagttaaaataaaaaccactatgggttttgctagttatagttatagttggtttttgttgtcatttttcgccctaatcccaacactaagagctcacatcgctgaatatgatgagtattggaaagcacgagaattggaagccattgagaacctgaacaaggtttatcaccccaatccggaggaggtggtccggcattacaatgaccactttgtcaataccatgcttgagtataataacaccagaagggtgttgaatggaaagaaaaacggtccctgtgagattacttaccccgtgattgttggcggcaatgtaccctacctggctaaagaacaggaacaggctggccgactgtgccccc

SEQ ID NO: 11129 - DNA, 452 bp, Gossypium hirsutum
  Clone ID: uC-gsflmaxxa070f01b1
aaaaatggtataaaaaaaatgggaagaggaaaatccaagggcaggcccactggccaccgccacttctctactccagaagagctccgtgctggtacctcagctcggccccgtacatttaggaaggaagaagctcaagtagaggaagaagaagaacgagaagagtctgaagaggaaatagaagaagagcccgagaaacgaaaagggacccaagggcttattgagattgagaatccaaatttggctaaacaaaagaatgtcaaagccaaagatgttgatatggggaaaacaactgaactatcaaggcgtgaaagagaggagatagaaaagcaaaaagcacatgaacgatatatgaagctccaggagcaagggaaaactgagcaatcaagaaaagatttagagcgcttagccatgattaggccaccaagggcagaggctgctaagaagagagaaga

SEQ ID NO: 11130 - DNA, 454 bp, Gossypium hirsutum
  Clone ID: uC-gsflmaxxa070f02b1
ttgctttgtatattgaagtttcctttctcgattttctggggggccaaacaagatgcagatcttcgttaagactctaaccggcaagacgatcactctcgaggtcgagagctccgatacgatcgacaacgtgaaggccaaaatccaagataaggaaggcatccctccagaccagcagcgtctgatcttcgccggaaaacagctcgaagacggccggaccttggccgattacaacatccaaaaggagtcaactctccacctcgtcctccgtctgcgcggtgggatgcaaatcttcgtgaaaaccttgactggcaagacaatcactctcgaggtcgagagctccgacacgatcgacaacgttaaagcgaagatccaagacaaggaaggcatccccccagaccagcaacgtctcatctttgccggaaaacaactcgaagacggcccgaccttggccgac

SEQ ID NO: 11131 - DNA, 507 bp, Gossypium hirsutum
  Clone ID: uC-gsflmaxxa070f03b1
gtcccttgtggatatcagagggaaaacacaaaaactagggtggtagagagaacgggagccaaagtgagagagaagaggcagaaatttttagtagtagggttttattatattgcttctctagggtttagaaaaatggtggccgacaaaggaaagaagatgaaagtagcagagaaagtagaggaagagaaccatgaacaaatagatggagacctcgtcatttccatcgagaagcttcaagagatccaagatgagcttgagaagatcaatgaagaggcaagcgagaaagtcttggaagtggagcagaaatacaatgaggttcgcaagccggtctatgataagcggaatgaaatcatcaattcaattcctgatttctggttaacagctttcttgagccatcctgctcttggtgatctttttgactgaagaggaccagaagatattcaaatttattaacttacttgagtggaggattttaaagatctgaaatctggatacactattcacatt

SEQ ID NO: 11132 - DNA, 463 bp, Gossypium hirsutum
  Clone ID: uC-gsflmaxxa070f04b1
cccacgcgttcggagaaattacagagcaatggaagccatggcagcagcgaaaccagtgatcaaagtagctgccctttgtgggtctttaagggaaggctcttacaatagaggcttacttcgttatgcaatggagctaactaaggaagagattgatgggattcagattgattacattgacatttcgccgcttcctatgctcaacactgacctcgaggttaatggaaagtatccgcctgttgtcgaggctttcaggcagaggattttggcggctgatagcatcctatttgcttcccctgagtacaactactctgttactggacccctgaagaatgcaattgactgggcttctcgatcaccaaatgtttttgccaataaagctgctgccattgcaagtgttggatgaagcttaagtggggcgcgagcccaatatcattatttgccgattggcgtttatcttgatctt

SEQ ID NO: 11133 - DNA, 515 bp, Gossypium hirsutum
  Clone ID: uC-gsflmaxxa070f05b1
gatttgttgcgttggttaacagaaaaagcacaaaggggacgtgcagagttgaaaagcagtgctgattaggtcagtggcgtcgggcgatggcggaagataaggcagagacacaagcgttcactcctggtcccggatatcggcaattcaaggggagagatgaattcccctccaacattttgcacggcacattagcttgtgccatctggattggatctatgcattttaacgtctccctcctccttttctccttcctcttccttcctttctccaaattccttttgttcgtcctcttcctttattcttttttatgtatggcttttatgcttctgctggtaaaagaaaaagagaaagttaaaacggcgcacaaaatttatctttgattcaatacacaggggtggttgggagtgcttttggattttcggcgttcttcctattgatcataacaagaaatttgggctgagattggccaggtatttatgtcaacacatgtccagttttttttccgcccctcttta

SEQ ID NO: 11134 - DNA, 438 bp, Gossypium hirsutum
  Clone ID: uC-gsflmaxxa070f06b1
ggctgaaaaaaacggtgagattgaaaggggtttcaggtgtccctctttgaacttcagcttcagttcttcaaactcaatagctgaaaggaaaaacatatttttacttcattcattcaaattcccacacgaaaagggggaaaacccagaaattttaagccatgaaacagttacacaagcaatcaagcattaaccataggcgagatgaagagatcttaatacctcaaactcctccttactcacccaaatccttaaaacaccccagatctctccctagatccattaactatctcttcaaagaacaacgccttttgttcatcttcatcggcattttaatcgggtctactttcttcatcctccaaccaactctctgtcggttaggcccaaccgagactcacccttcgatccccaaatctttctctaacacggcgtttcccacac

SEQ ID NO: 11135 - DNA, 511 bp, Gossypium hirsutum
  Clone ID: uC-gsflmaxxa070f07b1
cattgttatcactgcaagaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaaaagcccaccctcggcacctgaacagccaggcacttgccccagagatgcactgaaactaggcgtttgtgctgatttgttgggctcagtgcgcgttgttgctggaccgtcgaggaccaaatgctgctctctcatttcgggtttggctgatctcgatgctgctgtttgcctttgcactgctattaaagctaatgtgtcggggggttaccttaaacgttcctgtttcaattgcctttgctcctcaaattcctgcgaaaaagcaaatgcctgctggttacaaatgtgcttaggctcatttcccccgtttcctcaacatggttggggtttttctttcacgggttctttttttttct

SEQ ID NO: 11136 - DNA, 529 bp, Gossypium hirsutum
  unsure (1)..(529): unsure at all n locations
  Clone ID: uC-gsflmaxxa070f08b1
cccactcgtccgggagagagtgcaagagattgctaatggctcgaaagaaacaatcccggaagaattcattagaacaacgtacgagcagccagcactgactacggttcaggggacggtgctagaggtccccggttatcgatctaagcgaccccgatgaagagaaggttgtacgaaccattgtggacgcgagcagtaattggggaatgttccaagttgtgaaccatggcattccccatgaaaccgtaaggaagctgaaagaggtcggaaaggctttcttcgagctcccaccacaggaaaaggaagcttacgccaagtccccgggatctcaatccattgaaggctatggaacgaagcttcaaagagaagttgaagggaagaaagcttgggttgatcatctcttccataagatctggcctccttctgaaattaactatcaattttggcctaaaaacccaccttcttacagaaagaataacgaggaatacgcaaagcacatgcatggngtgttcgacaagctatttagatgtct

SEQ ID NO: 11137 - DNA, 467 bp, Gossypium hirsutum
  Clone ID: uC-gsflmaxxa070f09b1
gcatttggttttttattttctttttacgaagaattggggaggtcatggctagattattatcgtcaaacgcggtgttgaaggccatcgctactgtcccagctgctctttctagtagaaacgtaattggatccttctacccgagtgggttgaaatactcaacatctgttcccggtgaccctgatacacatgaagattttaaaccaacaaataagattcagagttctgatgtttctttgaaggatgttgttgagcaggatgtcaaggaaaatcctgtgatgatttacatgaaaggggtacctgattttcctcaatgtggattcagttcattggcagtaagagtgttgaaacactacaatgttcctttaagtgcaagaaatattctggaagatcctgagctgaaaagtgctgttaaagcctttagccattggcccacatttcctcagatatttattaagggagagttcatt

SEQ ID NO: 11138 - DNA, 481 bp, Gossypium hirsutum
  Clone ID: uC-gsflmaxxa070f10b1
cccactcgtccgcccacgcgtccggcgagaagtgagaaactattgtaaacctctcataatattctgagcttttttctctttttgtttcctataattttgatctgagccaaggttgataatcgagtttttataagcggctgatcctggcattccaaaatttgaattgtgtggctgaatgatctatggagactaagggagggaaaaagaagtctagtagtagtaagtcattattctacgaagctcctctcggttacagcattgaagacgttcgaccaaacggtggaatcaagaagttcagatctgctgcttactccaactgcgctcgcaaaccatcctgatattcgtaacgcaagtgcccccttctgaccactgctaaagtggtcaatttatttttatttgctttattacttagtattaaaatctatcttcggccggcttcctccccctctttccttgcaactgttttctttggatctaccat

SEQ ID NO: 11139 - DNA, 439 bp, Gossypium hirsutum
  Clone ID: uC-gsflmaxxa070f11b1
gatgaaccaaccttcagcacacgacattttcgtgggggactggaaaccaaccaagaatgacacagaggaaaaacggggtcctacttttggctccaccatgaacgttctctacggagattacacttgcgggcaaggcgatatcgatcccatgaacatcatcatctcccattaccttcattaccttgacttactaggtgttgggcgagaggaagcagggccacacgaggagctaagctgtgccgagcagaaagcattcaacccaaccccagctccacctgctgccagtgcttcctgatctttggttcagccaatttcattgttaaaatgcagttgtcaatgaagggtaatttaataagagagctgggcaattaggctgctggaaaatcatggtctatgtcggtgtgagaaaagggcccatcaatttcatgatattatatat

SEQ ID NO: 11140 - DNA, 528 bp, Gossypium hirsutum
  Clone ID: uC-gsflmaxxa070f12b1
ctttatcagttgcttcacaatggcctctacaaccgggggtctttcttccccatcattcgccggtaaggcagtgaagttctccccttccacccctgaaatccggggaactggccgtgtttccatgaggaaaaccaccaagcctgttccttctggtagcccatggtacggtcctgaccgagttttgtacttgggtccactttccggtgagccaccatcttacttgaccggtgagttccctggtgactatggttgggacactgctggactctcagctgatcccgagacctttgctaggaaccgtgagctcgaagtcattcactgcagatgggccatgttgggagctcttgggtgtgttctccctgagctgttggctaggaacggtgtcaagttcggtgaagctgtatggttcacggccgggtcttacatcttcagtgagggtggacttgactacttgggtaacccaagcttgatccatgctcaaagcattttggccatctgggcttgcccagctatcttgatgggagccgc

SEQ ID NO: 11141 - DNA, 294 bp, Gossypium hirsutum
  Clone ID: uC-gsflmaxxa070g01b1
cttctcggatttgatcttccatggcttccagtggggcttctactgaacagggagttagggatgtgacggagaacagtttggaaaagatcaaacggcagctggcctctggctcttggaggaactttctacaaggtccacttctcaagcgatctgaaaccttgaggaaatggaatgaacgttgggtgatattagaccccacaacagggaaaatggaatacctgactaggaggaatgagccaactgttaagggaatcatgacctttaatgaatacagacccattgccatatcttctg

SEQ ID NO: 11142 - DNA, 413 bp, Gossypium hirsutum
  Clone ID: uC-gsflmaxxa070g05b1
ctttttctttcctttactctctaaaaccctaatttggggggaattaccttcgagatctccgagcttagacaccccaaaatggccacgacacgcagatcccttcctcttctgagaaccctcatagccggaaaaacccacacccgaaacgtgacgtacatgccccgaccaggagatggagccccaagacccgcaacgttaattcccggagacgggatcggacctttggtgacgaacgcggtggaacaagggatggaagcgatgcacgctccggtttacttcgagaagtacgatggtcactgcgacctgaaacgggtacccacaagaagcgttggactcgataaagaagaacaaggtttggctgaaaggagggctaagaacacccatgggaggtggagtcagttcattgaatatgc

SEQ ID NO: 11143 - DNA, 125 bp, Gossypium hirsutum
  Clone ID: uC-gsflmaxxa070g06b1
gcaactcgttgacgaagcctggaagattgctctaacagggggtgatctctagcccagaaaatgttaccagccacctgaactatcacgttaacaaggattttgaaaaacctcatttcacccacccc

SEQ ID NO: 11144 - DNA, 435 bp, Gossypium hirsutum
  Clone ID: uC-gsflmaxxa070g09b1
gcagtccctaggaacaattaaaaagaacggaggaaattacacagattaagacagaagcatggccagccagctcgtaggaacaaagagagcttgtgtcgtgggtggcagcggattcgttgcctcattgctggtcaagttgttgctcgagaagggttacgccgttaacactacagtcagggaccctgacaaccagaagaagatctctcaccttgtaacactacaagagttgggagacttgaagatctttcaggcggatttaactgatgaagggagctttgatgcccctattgctggttgtgaccttgtcttccatgttgcgacacccgttaactttgcttctgaagatccagagaatgacatgatcaaaccagcgactcaaggagtggtgaacgttttgaaagcttgtgccaaagcataaacagttaaacgagtcgt

SEQ ID NO: 11145 - DNA, 532 bp, Gossypium hirsutum
  Clone ID: uC-gsflmaxxa070g12b1
ggcatttccttgattcctttcctttctcaagaattgtggaaaatcatatttttggaggttctgagaatggagacgcagaagctagacagtcatatgcaatcagctgcagcttttgtgcaagggggaatcctggatgccaatgacgattcttgtagcatatgccttgaggagttttctgctagtgatccttctacggtgactaattgtaagcatgagtttcacctccaatgtattcttgaatggtgccagagaagctcacaatgtccaatgtgctggcaagccattagcttgaaggaccctgcaagtcaagaattgcttcaagcagtagaaacggaaaggagcattagggttactgcaccaagaaatactgccatattttaccatcccgcccttggtggttttgaattgcaacatttgccggttggtgtaaatgaccctgaacttgaagagcgtataattcaacacttggctgctgctgctgcaatgggaaggacccaccacgctagtaggagggagggccagagaagatctg

SEQ ID NO: 11146 - DNA, 457 bp, Gossypium hirsutum
  unsure (1)..(457): unsure at all n locations
  Clone ID: uC-gsflmaxxa070h01b1
caattattttaaaaaaaaaaaccaaaggtagcctaaggaaactatgatgaagtgggcgatcccttccgttttggttcttctttgccttctcagtctcctatcagatcatgggagaaaagtacaagcaaatgccnaggaaggagctgtagatcctcctaaagtcgaggaaaagatcggcgctgtgcctaatggcttacaaactgattctgatgtagttaaaagggaatcggaatccatctcttcgagatcgcttcgcaataatgcggagaagtttgagttccaagctgaagtgtcttggcttatgggatatattaacaatttttctttatagcaacaaggatatcttcctcaggggagttgatctccaatgcttctgatgcactgggcaagatttaggttcctttcactcacagacaaagaagttttgggtgaaggcgacccttccaagctggatttc

SEQ ID NO: 11147 - DNA, 218 bp, Gossypium hirsutum
  Clone ID: uC-gsflmaxxa070h03b1
ccccagacacaaaatttgaaaattttgagatgagatttttagaggaaaaaaaccatgctgactgttctgttttggctatggagatgcattcaagcgcaaacgactgcgatttggctatgcctacctcaattctgcaatacttactcacctattcattctaccttctactaactgcttccactgactttacctcggctccccccatgttctgcaggacc

SEQ ID NO: 11148 - DNA, 222 bp, Gossypium hirsutum
  Clone ID: uC-gsflmaxxa070h04b1
acagcttgagatcggagatcaaaggccctgtttttcattggggttttttgtttgaagctctttggttgtaaacctgattttttttaaaataatacttgatttttagcttttgggtgaattttgaatgtaataataatatatctctttttgattattttggggtaaattcttcgttagttatttttgggtcttcggaattggaatttttggggaatggaggtt

SEQ ID NO: 11149 - DNA, 116 bp, Gossypium hirsutum
  unsure (1)..(116): unsure at all n locations
  Clone ID: uC-gsflmaxxa070h07b1
gttcatactaggcggcgacgaacattgagacgggaagtnggacattggagcaaacgggccccatgatcacgcccgacggcggccagaggggctcgccccacccccgcggggggggg

SEQ ID NO: 11150 - DNA, 524 bp, Gossypium hirsutum
  Clone ID: uC-gsflmaxxa070h12b1
cccacttcgtccgcgtacgggtttttcacttgaagatgcgacagggctggccataaaaggagatgtggacattcattcagtttatgcaacctctcttcccacctctcatccaagtttttccccccaaagagtactggaaatgtcaccaaaatggaaagcttctcccttgcctaagagatcaattcgactttttattgggattctctctgctactaatcactttgcagaacgcatggcagttagacaaacttggatgcaatcttcagccatcaagtctttagatgtagcggtccgtttctttgttgcactgaatcctaagaaggaggtgaatggagtgctgaagaaggaggcagcttattttggcgatattgtaattctgccatttatggaccgctatgagcttgtggctcttaaaactattgcaatttgtgaatttggggtgcagaatgtgactgctgcttacatcatgaaatgtgatgatgacacatttgttagagctgacagggtcttgaaacaaattgatc

SEQ ID NO: 11151 - DNA, 60 bp, Gossypium hirsutum
  Clone ID: uC-gsflmaxxa074a10b1
atttattgtattgaaaaaagaaaaaacgcgagagggaggggtcagatttaaaagacacaa

SEQ ID NO: 11152 - DNA, 290 bp, Gossypium hirsutum
  Clone ID: uC-gsflmaxxa074b01b1
gcttaattttctatatagtgtgaagacataatccgaacctcttaaggctttatgggcggaagtcggctacccgttatctacgcgtcacttttcttatgttcggaatgtaacacacactcaggaggatttacagccgtctcttgtagcctcttattggcgctatgtacagaacacactccgcatatagctatgtgccacttctgatcgtatccttgctaacgggactccgctgtaagtgactcatgcactcgtgcacttgtctgcgaattcttaattcatgtctacagtag

SEQ ID NO: 11153 - DNA, 113 bp, Gossypium hirsutum
  Clone ID: uC-gsflmaxxa074b02b1
gtttcgctttcggtgtagaaagaaactacaagcggtaggaagctataatggagaggcgagcagcgagatgaagttatgttcatatccctgttctatggggaaggatgaagccc

SEQ ID NO: 11154 - DNA, 149 bp, Gossypium hirsutum
  Clone ID: uC-gsflmaxxa074b11b1
gtttcgtttttggagaaaaaacaaaccttctaggggagcgggctatttaataaatccttgcagggggctgaacggtacacaaaagttgcataagaagagtgatggatcaagggagaaatgcattattgtggccatggattgggtcgcct

SEQ ID NO: 11155 - DNA, 163 bp, Gossypium hirsutum
  Clone ID: uC-gsflmaxxa074c01b1
ctctatagtgtgaagactctaacgggagctatatagtatctaaaggcgtacatcgtaaaaccgttatgtacgtgttccatttcttatatgttgaatgaaatccatactcaggatgatttacactattctcttggtctcgataatttgcactttctacagaaac

SEQ ID NO: 11156 - DNA, 109 bp, Gossypium hirsutum
  Clone ID: uC-gsflmaxxa074c03b1
gtttttcgtgttgtaaaaagagtcgacctctatgagagccgtattatttatgaacccacgctgataataaacaggaaaatcgggagccgcaatagattaagattaatga

SEQ ID NO: 11157 - DNA, 213 bp, Gossypium hirsutum
  Clone ID: uC-gsflmaxxa074c11b1
gctacgcgtgggtcacaacaagtagcgcttccggagatgggcaagggttatggaagcccataaacctgacagcgcaacgctggagggaccggttatgaatgcaagcgaagctttaatggaaggagctgaagttcacagtggaatgaacctttaattttttgctgattgtaggcaagatgatggcactagcaattaagctccatgggataacac

SEQ ID NO: 11158 - DNA, 59 bp, Gossypium hirsutum
  Clone ID: uC-gsflmaxxa074d06b1
tcggttactagaccaccagaccaagcggaccggcaggggaaagttaaaaaaccaaaccg

SEQ ID NO: 11159 - DNA, 188 bp, Gossypium hirsutum
  Clone ID: uC-gsflmaxxa074d09b1
tcggctacacgtgcgacaaaacaagtaatactccaggagatatgatagtcacattaatccacataaagtttaaatggcaaggctgacgggaccgtttatggatataattgaagttttagtggaaacagctgaaatacaggaagcacgaatggagtctttttttactgatttttggcatgatgatggta

SEQ ID NO: 11160 - DNA, 326 bp, Gossypium hirsutum
  Clone ID: uC-gsflmaxxa074d12b1
ttggctataagatcgacagagcaagtgggccttgagggtattgtatggttacataaatgcacacatgatgtacaatgatgatgtccagggaacagctggggttgcaattgatggttttctgggagctgtaagagcacagggtaggccaatgattgactttcctaaggaaaagattgttgatgatggtgctggatgtgcaggaataggggttgataatgtctgaaggaatacaatggcaaggatgttaggaaaatgctgagcatgcttttgatagtgcaaagaagcaattatgggttgttgatgctaatggtcttattagtgacgaa

SEQ ID NO: 11161 - DNA, 154 bp, Gossypium hirsutum
  Clone ID: uC-gsflmaxxa074f03b1
gttacactgttgatcaagagacacaacctctaggggaggggaagcttaaaagaacctactcagaattaaagggggatgtgggaagctgcagacaataaggagagttctggtagaaagggtaggactttatcaccagtgagggttgacaggatat

SEQ ID NO: 11162 - DNA, 74 bp, Gossypium hirsutum
  Clone ID: uC-gsflmaxxa074f06b1
gataaagagaataaacctttaggagaggggttgattatatgaaactatggcagttttatgaaggaatatgagga

SEQ ID NO: 11163 - DNA, 441 bp, Gossypium hirsutum
  Clone ID: uC-gsflmaxxa074g01b1
cctacgctgttcgcccacgcgtccggaaatttaccggcaattttgtgaacttagaagaggagatacttatgtttgtggcgaagaaggttaccgacaagatgaggaatcacaaagagctaagtactcgagggacagattgaatcacctcttaaagatggtggagtcaaggatgcacacaaggactgccatctttgatgaacttcacaagctcatgttacaactagacttgacggtggacttttctgaattctcatgcttctatgattttgttttcttcatgtgccgagaaaatggtcaaaagaatattactataagcagggcagttgctgcatggagattagtgttggctggcagatttcgactacttgacaaatggtgcaacttttgtgaggaatataagcgcacaatatttcagaggatacatggcagcaagttttagca

SEQ ID NO: 11164 - DNA, 87 bp, Gossypium hirsutum
  Clone ID: uC-gsflmaxxa074g03b1
ctttcacgtgtgataaagagacaaaacctctaggggagggggtgattaaatgaacccacgccgttattaagaggcaggtcgggagag

SEQ ID NO: 11165 - DNA, 262 bp, Gossypium hirsutum
  Clone ID: uC-gsflmaxxa074g04b1
gtttcactttttataaaaaaaatcatactcaaggagcgctgctggttaagtgaacccttgcaaagctgcggaggcatgggaggagaggaagccactatcgatagaacaagtggaagtggcaccactccaaaaccatgaagctcgtattgaaatagtgcccactgctgtatgacacactgatggatacgactggaagagtaagggctacactcgtatgtcctctagttcctaggtcctgatgcccaaggtatcgtggagagtg

SEQ ID NO: 11166 - DNA, 125 bp, Gossypium hirsutum
  Clone ID: uC-gsflmaxxa074g06b1
gttttgcgttggataaagagaggaaacctttaggggagccgtagattatatgaacccatgcagttctaaagaggaatgtgaggagaggaagtctatgaggatcatgaagaaagaaagggtaggat

SEQ ID NO: 11167 - DNA, 141 bp, Gossypium hirsutum
  Clone ID: uC-gsflmaxxa074g07b1
tcgctttcacgtacgataaagaaaatcatctgctatgggcgctgttgcataactgaaccttctcagatctgcggtggaatgtgattcgatgatgtctttattgatagatcagttagataaggtaagattttatatgcatga

SEQ ID NO: 11168 - DNA, 75 bp, Gossypium hirsutum
  Clone ID: uC-gsflmaxxa074g12b1
cttttgcgtgcgccaatatggtcaatcggcgagacaccaatatccttggcgaagcttctgctatgtctagttggg

SEQ ID NO: 11169 - DNA, 218 bp, Gossypium hirsutum
  Clone ID: uC-gsflmaxxa074h03b1
ctttcgcgtatgctaaagagacaaaacctcaaggggaggggtagatttaaagaacctatgccgcttaacacaggaagatgtgaaggggcagtcaatagggacgaataagggcgagaagtttccgagagacaaacaaaaaagcacttctcgaaaaggcaccccagaagatcagagagtgcgattgcacagagaatggtgaaagaacatttcaagaggct

SEQ ID NO: 11170 - DNA, 84 bp, Gossypium hirsutum
  Clone ID: uC-gsflmaxxa074h05b1
gtttcattgttgataaagagactcaacctctaggggaggtgtagatttaatgaagccacgcagtcttacggaggaaaatgagga

SEQ ID NO: 11171 - DNA, 142 bp, Gossypium hirsutum
  Clone ID: uC-gsflmaxxa074h06b1
gttactctttcgataaagagattaatcttctaggggagatattgattatatgaagcctcgcagttttacaggggaatatgaggagcggatgtctctatggacagagaaaaaagacagggtatgatttaaacacggacaaggt

SEQ ID NO: 11172 - DNA, 372 bp, Gossypium hirsutum
  Clone ID: uC-gsflmaxxa074h07b1
tcgcttacgcgtccgattgttttttccttttgttctgtgcattcatacaaaccttaccatatttaggttattcgagtgatggaatcggaagacgatatgattgatgactcggtttgcatgggagatgatttttacagctgcgatttgagctattgttacgacgacgaccctagtgattacgataacgattattacttggacgatgacaatgattacggcttacttgaagatgacgatgatgatgatcaagatggcattgtttgtcgtcgccctcaactaagttatactgatttgagggatgcagatataatacagctacacgaggatgatatttctaaggtttctactggtctttcaatatcaagagttgat

SEQ ID NO: 11173 - DNA, 418 bp, Gossypium hirsutum
  Clone ID: uC-gsflmaxxa074h09b1
tcgcctacgcgtccggttgaaacttggtctcgcccgtttagatgaaaagcatttgttggcagttatatttttcggatctcaggtcttgctcacttccataaacatttggttgccctctttcttttgagggaaaatctgattgcctcgtttggttgtttgggaaaagaaatcaaggaaaatggtttatcactctagttttgttggtgaggaaggaattactaaagcttgtggcttccctttacttcctttgaaaagccatataaagggtcctgctcctgtttcagatcaaggtaaaactgatattgttgatgaagcgatcacattctttcgtgccaatgtgttctttagaaactttgatgttaagagccctgcagataagctccttatatatttgactttctacataaaagtggctttg

SEQ ID NO: 11174 - DNA, 86 bp, Gossypium hirsutum
  Clone ID: uC-gsflmaxxa074h11b1
gtttttcgtgtgaaaaacaaaagaaaccccaagggggggggttgattttaagaagccattgctgtacttccgagggatatcaggag

SEQ ID NO: 11175 - DNA, 531 bp, Gossypium hirsutum
  Clone ID: uC-gsflmaxxa076a07b1
ttccaaaacaaaattcacgtctttttcctctttgtcactctctctattccccccatgtcattcgcatacttagggttagggtttttattgtgattttagatatttccttatttactctcttcaagttagatatttaatttggattccgtttcgacttatctaggagttctcatcaatccgtgggttttaattttttttctttgttctatcggaagtttcaattatccctttttcctttatcgaattctgatatttcagtcgttaggtttctaaacaatgcctcctagaaccgtgaagagaggagccggggccggtggtccaaagagaacgccgaggtccactagaggggcatccaaatccgagaatccaccagcggagcctgtacaagaggccgtgaatacaaaggaggccttcagttccagctgaggagctcgcggaggccgctaggccgttgagaaaccaactccggagcaaaaattggtgatcgtggagaaggggctgtgaggaggaaaacaccgtttaaatttgaat

SEQ ID NO: 11176 - DNA, 287 bp, Gossypium hirsutum
  Clone ID: uC-gsflmaxxa076a09b1
tttagaatattgatgctactatcgcaatatcatttattttgaagatgatgggttcaccctgtgagggtatcctgttctttcttattcgtgtgaggtttctcaaattatgcctatggaataaatttagtcatgtttgcttgtcatttttttgttgttagaaatgcttgtcttttacttatgatgctccataagaacatgaatagccttacaagctattgttctgtttttcatgttgtaagatttgtctaatgcctttttatgctatcaacggagtgatatttatattt

SEQ ID NO: 11177 - DNA, 464 bp, Gossypium hirsutum
  unsure (1)..(464): unsure at all n locations
  Clone ID: uC-gsflmaxxa076a10b1
ttttcaacattcaaatagagaacatttcaaccccatgtatgaaacgtcaggcaatcaatcccctctgtcaacaaaacaaagtgaagggattgaacatcctgctggatatcccatcaggaaaaattctagctcgatagaaagctccaaaacttcagttttttgggatccagaagctggacgctttgtctcttcctcatccagaaatgcaggctctttgcaggctcctggatcagagcttttgtatagtggtcaatcgatattttttggcagtcctcttatgaatgaactggctaaccgaggaacgaggagtactagttcaatgtctgtcgggttgggtaggggttctacattgagtcatcattatcatcagcagggtagattgcagagaggagcccaactacctgtgtttgttcctactgattctncctctcaaccaaagcaattttcatgagcaccaaaataag

SEQ ID NO: 11178 - DNA, 498 bp, Gossypium hirsutum
  Clone ID: uC-gsflmaxxa076a11b1
tccaaacgctcgctttaatctgcgatcaactatgtcatcaaccactcaagggtgtagaaaagggcggagaacaaggctatggaacaggatgtccaacacaatggaacagacatgggaacaggagtggttagggctgaagatgcagcagaagatgcaccacctggtatggttggtagcatcttggacagcgctataaagaccggtatggtgcatgaagtggcacatgaaggtgcctatgctgatgctgaaagcggactatattgagggctctacccaataaaacacggaaaagactacggcatctgaggcctttttaaaaaaaagttcatatttaaggacaagctatgttacttgaactttttactattttttcaagtaccctgtgtctggcacaagaatatagacgaactccaataatcccccaaatacatggaaaaaacttagaaaagactaaacttacttgtgtcgagtacatacttgaatctaacactcaatacc

SEQ ID NO: 11179 - DNA, 529 bp, Gossypium hirsutum
  Clone ID: uC-gsflmaxxa076b03b1
ggtgaaccagggctggaatggtggaacaaagagggggggaatggtggaacaagtggaggtggagccaagacttggaatcaatccactgctgatcaaggaggccaatcctctagttggagtcaatctggtgggtggaacaaaggctctagctcaactaatgaaggaggtgggagtcaagataacaaccggaagtcttcgaattcatctgatggttacaaatggtctagctggaaccagtcaagtggcagcaaggaagttactgaaagtaacaatcaaggaaatgggtggggaaagagttcaactacttctgctggagggtggggtaaccaaggatcgggctcgggagatcaatcttagtcaaaaactgctgatgaagccccatcttctgtgtggaacatgttaaaggatggaggtgaaaatagcagaaaccaagatccatggggtaaggcatcatcaacaagtacttggggacaagggagtggtggtagcagggaggatggtaattttaccttcttttaccgacaaggtt

SEQ ID NO: 11180 - DNA, 401 bp, Gossypium hirsutum
  Clone ID: uC-gsflmaxxa076b04b1
tttttgaacagcataggaggaagaaacaaggcaaaggtaatgaaaatcgatggtgaaaccatcaaattaaagacaccaattcgggtttgggatgttctaaaagattatccaacaggtcatgttttattagattcacaaactgtgaagcattatgggatccgtgctaagccattagagccacaagagagcttgaaacccaagaaaatatacttcttggtggagctgccgaagcttgccgatgatgaagttcataaggcgccgaggagggtgcggtcaggggggattcatatgagtgctaaagataggttagagtgtttgatgttgtcgagaaggacggtgtcggacctttctatggttcgaccgtcgtcgacgagcatggtgtccgatggggttcgactagg

SEQ ID NO: 11181 - DNA, 426 bp, Gossypium hirsutum
  Clone ID: uC-gsflmaxxa076b08b1
ttcaaacaaactttttagttctcaactctctcaaattcaccatggctgacaagtgtggcaactgcgattgcgctgacaagagccagtgtgtgaagaaaggaaacagcttggtcattgagactgaggagagctacatcagcaccgtagtggtcgagcctctggcagagaacgatggcaagtgcaagtgcggaactagctgcagctgcacaaactgcacatgtggcagtcactaagcagacatatagaatgatgaagtttgggacctaaaaagaataaaagttgggttgaataatttgtgtcttttgttgtagtttgagtgtgttttcttgtctatctgtccgatgattgtctatgtctctcattttatacaatgatggaatgaccatgtcaatggcctttgtctgattaatgaactattattagtat

SEQ ID NO: 11182 - DNA, 537 bp, Gossypium hirsutum
  Clone ID: uC-gsflmaxxa076b09b1
tgtgctgatggtgcttttgaagggagtatcagcgctatccatgctaaggtcacgtgttaaacagcattccagtctcagcaactctgttagatggcttcaaatgcagccctcttccgatcttgatcttcattcgcagttgaaggaattgattcctgaacaacaggagcgcctgaagaaactgagggcagaacatggaaaagtgcaacttgggaatattactgttgatatggtcattggtggactgagaggaatgacagggttgctttgggaaacctcattacttgacccagatgagggaattcgctttagggcttgtcaattcccgaatgtcaaaaactattaccagctgcaaagcctgatggagagcctttacctgagggtcttttatggctttttttgactggaaagatgccaagcaaagctcaggttgatgctttatcttaggaattgcgtgaccgtgctgtttgttccagattacgtcctcaaggccattgatgctttacctgttttagctcatccaatgacttaatttgcaac

SEQ ID NO: 11183 - DNA, 440 bp, Gossypium hirsutum
  Clone ID: uC-gsflmaxxa076b10b1
ttcgatggtgcttttgaagggagtatcagcgctatccaggctaaggtcacgtgttaaacagcattccagtctcagcaactctgttagatggctccaaatgcagtcctcttccgatcttgatcttcattcgcagtcgaaggaattgattcctgaacaacaggagcgcctgaagaaactgagggcagaacatggaaaagggcaccttgggaatattactgttgatatggacattggtggaatgagaggactgacagggttgctttgggaaacctcattacttgacccagatgagggaattcgctttagggcttgccaattcccgaatgtcaaaaactattaccagctgcaaagcctgatggagagcctttacctgagggtcttttatggcttcttttgactggaaagatgccaagccaagcctcaagttgatgctttatctc

SEQ ID NO: 11184 - DNA, 553 bp, Gossypium hirsutum
  Clone ID: uC-gsflmaxxa076b11b1
tttggaactcattggcttacgaatcggactctcccaccagggaaaaaagtttcatcttttagataaaagaaaatgcgtgatcatctcgtagtatgtgttgaccgccttacgaaatccgaaagtttgaaaccagtgaatgaacccgaggttgcaggaccttcgggtgaaggttcttttatagttgctgacccacatgtttgtgctattgatgttgaagaagtggaagaacacagttcatgtgatgaagaagaaccgcttatccaaacggttgaatgccgaatctgccaggatgaagacaacattaacaatttggagacaccttgctcatgcagcggcagtttgaagtttgctcataggaaatgtgttcaaaggctggtgcaacgagaaaggagacataacgtgtgagatatgtcatcagccttatcaaccaggatatactgcaccaccacctcccccttgccagaggttgctacaattgatatcagtgagtggatggtcgctggtgctcctttggtttacacgaccacggatttagcagtagcagcagaacacc

SEQ ID NO: 11185 - DNA, 557 bp, Gossypium hirsutum
  Clone ID: uC-gsflmaxxa076c01b1
gttcactctctctttatcttgatctcaaaggcttctgttttgagctggaaattaagtagatcggagagtgataagtggttgccgtgttgtttacagatgaaatgagggaaaaactggaaacatgaatgcaggtcttgaattgtagtacaagttaaggttataaaatgagaacggagaggaaaccgcatttgataaagaagcctgctgatgcaaaacgtcaaagggttgatgaatcccttggccctggcttgaaagatgaagcaactgaggttgagcatttacttgtggaacccaaaagtgaacatgtctcggtagacagagtcttttgttttgggaaggagaatatagaaaaacacttgaaaatggaggacttctcttgtgcttttgattatggctggaaaattggttctggtggggctggattctatccacggtcaaggaggagatgatttgaagtttgaaagttcttgatggattgctgatgaagttgataagtggatgattttagcagacatgatctctcagtgcatgtgagatttttttggaatgatttcaga

SEQ ID NO: 11186 - DNA, 507 bp, Gossypium hirsutum
  unsure (1)..(507): unsure at all n locations
  Clone ID: uC-gsflmaxxa076c02b1
ttcacgcgtccggcaatcttcatcccttttctctcgccgcctaactctaaggttttgattgttaagtgtaatttgaagacaagtcaagatggtgaagtttacagctgaggagcttcgtgctatcatggaccggaagcacaacatccgtaatatgtctgttattgcccatgtggatcatgggaaatctactcttactgattcacttgtggctgctgctggtatcattgcacaagaagttgctggtgatgttcgtatgacagatacccgtgccgatgaggctgagcgtgggatcacaattaagtctactggtatctctctgtattatgaaatgagtgatgattctttgaagagctacaaaggagagaggcaagggaatgagtacctcatcaatcttattgattcccctgggcacgttgacttttatctgaggtcacagctgcactttgattactgatggtngccttgtggctcgtgactgtatgacagtgtctgtgtccaaaagagact

SEQ ID NO: 11187 - DNA, 505 bp, Gossypium hirsutum
  Clone ID: uC-gsflmaxxa076c03b1
ttctaatggaaactttgttttggaattggattttgagcccttcaactcatcattcccccgcccaactctttcaaaatccgttggtaatggtgtggagttcctaaatcgtcacctttcggcaaaattgttccatgacaaggagagcatgcaccctttgctcgaattcctcagagtccattgccacaagggcaagaacatgatgttgaatgacagaattcagaacttgaatgctcttcaacatgttttgaggaaagcagaggagtatcttggtaccctacctcctgagacaccatgtgccggattcgaacaccggttccaggaaatcggtttggaaagaggttggggtgacaccgcacaacgcgtgctcgagatgatccaactccttttggatcttcttgaggcacctgatccttgcacccttgagaagttccttgggagaatcccatggtgttcaatgttgtgattctcactccccacggatacttcgctcagacaatgtttgggg

SEQ ID NO: 11188 - DNA, 449 bp, Gossypium hirsutum
  Clone ID: uC-gsflmaxxa076c04b1
ttttcgcgtccgcctaggcatgatagtgctgagactattaaacgggcacttgaacttggcatcagtgttaagatgatcaccggtgaccagctcgccattggcaaagagactggtcggagacttgggatgggaactgatatgtatccctcttctgccttacttggagagtgtggggatgaggatattgctgctattcctattgatgacctcattgagaaagctgatggatttgcaggagtcttccctgaacataagtacgaaattgttggaagacttcaagaaaggaagcatatatgtggtatgacaggagatggtgtgaacgatgccgcagcacttaaaaaggcagatatgggctttgcagtggccgattcaactgacgcggctaggggtgctttggacatagggttgactgagccagggctgagtgtgatagtgagcgcggtattgac

SEQ ID NO: 11189 - DNA, 477 bp, Gossypium hirsutum
  Clone ID: uC-gsflmaxxa076c05b1
gttcaccaaattgcttggtcgcatttattaccacaaagcaggctcttctacccctggttattcgcttcgtaccttctcaggacattctggtaacgttatgtcacttgacttccacccaactaaggatgaccttatttgctcttgtgatggtgatggcgaaattagatactggagtatcaaccacgggagctgtgcaagagttttcaagggtggtactgctcctggtacggcccagttaagatttcaacctcgctttggaaagtatcttgctttagctgcggagaatgttgtatcaatattggatgccgaaactcaaacttgtcgacactcattacagggacatacaaagctaatcattatccttttttctcccttgattttttttttttttggttattctgagtttgtgtcctgtatcagtgtcgtattgcaaaaatgtatgagaattttgctatatatattaatggcactcgaagt

SEQ ID NO: 11190 - DNA, 520 bp, Gossypium hirsutum
  unsure (1)..(520): unsure at all n locations
  Clone ID: uC-gsflmaxxa076c06b1
atttcctttcaattttcctcccctttcttctcatttccttccttcaatggctaacgttctacagacttctttccttccttctacttcttcccttcgccggccctccatttccggttccaaagggaagtctcaatcccttcaagtgaaggccaagatacgagagattttcatgcccgcactcagctctacaatgacggaaggtaagatcgcgtcttggatgaagtcggaaggggacaagttgtctaaaggggagagcgttgttgttgcggaatccgacaaggctgacatggacgtcgagagtttccancgagggattcctcgccgctatatggtggaggaaggcggcgttgctcccgtcggttctgcaatcgccctcttggctgagactgaagacgagatctctgaagccaaagctaattcgcagtcttcttcgagtagcactcctcaggtagtagaagaaaagccaaagcacattggagaggcggctccggatgttccggctgctgctgctgctccatca

SEQ ID NO: 11191 - DNA, 509 bp, Gossypium hirsutum
  Clone ID: uC-gsflmaxxa076c07b1
tctagaaggacgagaaatctgagaaattgaaggtcaagaaggccatcgagaaaggtaacatggacggagctcgtatctacgccgagaacgctattcggaagcgcactgagcagatgaactacctccgcctcgcgtcacgcctcgatgctgtggttgccaggctcgatacccaggctaagatgaccaccattaataaatccatggctaatatcgtcaagtctctcgaatcttccttgaacacaggcaatttgcagaagatgtcagagacaatggatcaatttgagaagcagtttgtgaatatggaggtccaggcagaatttatggagagtgctatggctggttccacttcattgtccacaccagaaggtgaggtcaacagcttgatgccacaagttgctgatgactatgctttggaggtctctgttgggttgccacaacctgggctatgctgtgtcgaccaacacagaggacaaggctgatgagatgatttgtcgaggcggcttgcaagc

SEQ ID NO: 11192 - DNA, 555 bp, Gossypium hirsutum
  unsure (1)..(555): unsure at all n locations
  Clone ID: uC-gsflmaxxa076c08b1
tttcagattttggttcacccgattgaaccgtcaggtccaggttttttcaaccatgctgttctgctgttctccgtttcccagtttttgataatcgaatcggtgaaggaagcttcttttgtttttgatcgtcgactgagtttgtgcgtccttagaatctaaaacattctgaccccaaaaatgttgaagctctcttcttcttcttcgtcgtcatcatcatcatcatcatcttcaagaattgcctgctgttctgaggttctcaaaagtttttcaattctccatctccttcaaaaagttttcttcccaatggcttcaatttgcaacagattcatcaccaccaccaccactgcgtgaacccccatctgagcccagaacctttgaagaaggatttcaatattccctaccctttaattctcacggcggacgaaaatgagcgcctcgagattcantaagtgcgtcaccgtcggcgatggagccgtcggaaagacctgcttgctgatttctacccagaacactttccctacgactatgtncgactgtttcgacatttcaggcaat

SEQ ID NO: 11193 - DNA, 532 bp, Gossypium hirsutum
  Clone ID: uC-gsflmaxxa076c09b1
tgtttggcaagattcaagttcattcacaaatatatttgatgtggatcactttatcaatgtccttcaagatgaagtttctatagttaaagagttgcctagagaatattcttggagctcacgggaatattatgctacaggtataagagctactagaatcaaaacagcacctattcatgcttcagctgactggtatctggaaaatgtgttgcctgttatgcgaagttatgggattgctgctatatcgccattctcccatcggctagcgtttgacaagttgcctgtggaaatccaactttacgttgtaaacttcaagcatcaggcactgaggttctacgagagagaacagatgatacagagaaagagagagctggaagtttgttgtattacatcttcgctttgacaaagacatggctgctcattcagcttgcgattttggtggaggcaaagctgagaaactggccctagctaaatatcgcccagtttatggcggacaggggtttaactctcaatcactgatatgagctgagaatca

SEQ ID NO: 11194 - DNA, 475 bp, Gossypium hirsutum
  unsure (1)..(475): unsure at all n locations
  Clone ID: uC-gsflmaxxa076c10b1
tcttcttcttcttcttcttccagtgttcgtcaacaatggctatctctttgctttccaaattctccactcaaaccctactcattgcatccattttcgtagtttcagctctgggtcacgatttctctatcgtgggctattcgccggaagatttgggttctgccgataaactcatcgagctcttcgagtcatggatatcgaagcacggaaaaatctacgagtccattgaggagaagctaatgaggttcgaggtttttaaggataatcttaaacatatcgataagaggaacaaggaaatcagtagctactggctggggttgaatgagttcgctgatttgagtcatgacgagttcaagaaaatgtatttgggactcagaccagatgttagacgaagatcccagtcgactaaagactttagttatggcgatgtggttgagttgcccaaatccgtgattggnaaagaaaggagctgtcactc

SEQ ID NO: 11195 - DNA, 514 bp, Gossypium hirsutum
  Clone ID: uC-gsflmaxxa076c11b1
tgtcacgcgtccgatttgattgaagaactttggaaacaaagtctttttgattaaattgaggaaattcagggggaatcggtcatggagggcaaatgtgcaatcaagaaagatgttactgaattaataggtaatacccctatggtatatctgaaccatatcgtcgatggctgcggtgctcgaattgctgccaagctcgagctgatggaaccttgctccagtgttaaagacaggattgcatacagtatgattaaagatgcagaagataagggcttgattacaccagggaagagtgtccttatcgagcctaccagtggtaataccggcattggattggctttcattggagcagctaggggttataaagttattgtcacaatgccagcttctgtgagcatcgagaggagaatagttcttcgagcttttggagctgaagtatgcctcaaaacccagccagggctttagggggtattagacaaggctgacgagaactgagaacacaccaacggttcatgct

SEQ ID NO: 11196 - DNA, 526 bp, Gossypium hirsutum
  Clone ID: uC-gsflmaxxa076d01b1
gttctctctcttcagtctttacttttcgagaagctttgacccaaacccttttcctttctcctacattcttaaacacaggggttataataaaagaaggaagctatgtgggctgtttcaaggcgaagagtttcttcttcttcagttttgggccaatcatttcgaattactcgaccttcacgttgttacagttcttcctcaaatgaggcctatgcaaagactttagtttctagaaaagggacatcacaagttgcagggattgtgggttctctagggtttccatttggcccaaggcctctaagggacgttatttcatttgttcaaagatatcctccaatatttgtccgcactaggtcattttctgctgatagtgatgatccaaatagaggcctcatggcatcagggaactctagtgtttgggaggagtttgtgagggatgaacaaaccggatcagagtacaagctttgttcttcgcattgtgctggtgcttggcatcgcttggatgaccctgcttatatttaactcttgc

SEQ ID NO: 11197 - DNA, 481 bp, Gossypium hirsutum
  Clone ID: uC-gsflmaxxa076d03b1
atttaacctcttgtattcttttatctttctttttctttttgtaggattttaaagatttccaagaaacaggagatttattgagattaaagtatgttagagcagttgctgatatttaccagaggagggttaatcctctggacttgtaaagagcttggaaatgctcttaaagggtcaccaattgacaccttgatccggtcctgtcttttggaggaacggtctggtgcagcatcatatagctatgatgccccaggagcttcttataccctcaagtggacattccataatgagcttggccttgtattcgttgctgtgtatcaacgtattctccatcttttgtatgtggatgagcttcttgcaatggtcagacgtgagttttcagagatttatgatccaaaaaggatggtctataatgacttcaatgaaacttttaggcagcttaggagggaggcagaagctggggctgaggaggtaaaggaatcaa

SEQ ID NO: 11198 - DNA, 146 bp, Gossypium hirsutum
  Clone ID: uC-gsflmaxxa076d07b1
tttaaaatgtgtttggatttgacttcagtctcacatgacggtgagacgggaattgaggagatataagaggttcttgtaatatgcattaagtataaaattattttattgtagtcaaaatgcaaatttatagctttttttccttcttc

SEQ ID NO: 11199 - DNA, 544 bp, Gossypium hirsutum
  unsure (1)..(544): unsure at all n locations
  Clone ID: uC-gsflmaxxa076d12b1
ttccacgcgtccgttcctcttcctcttcttcacttcatttctgctctgcttctcagtggaaaaaaaaaaattcatagagcagagcaatggtgcccattttcgcttctttctctcttttactcatttctgctctcttcattgttgcagactgtggttctattggagtaaactacggaagaatcgccaacaaccttccttcagctaccaaagtagtggaactacttatatcccatggtttaaaccgtgtcaaagtctacgacactgacccggctgttctccatgcattatctggatccggaatcaaggtcaccgtcgacctcccaaacgagcaactcttcgccgctgctaaaagcacttcctttgctaactcttgggtccagcgaaacgtcgccgcttactaccctcacactgaaatagaagccattgccgtcggtaacgaagtcttcgtggacccccacaatacngactaagttcctcgtacccggcatgaagaatatccaccaagctttgttaagtccaaccttcactcggatattaaaatctc

SEQ ID NO: 11200 - DNA, 546 bp, Gossypium hirsutum
  Clone ID: uC-gsflmaxxa076e02b1
ttctcgcgtccggtgcatttcatgcggcttctatgttcaaacccgacaatcctttctgcaggattatattgcgaccttcttatgtatacaagggagtacttctccatttgccccgttgctttgctcggagatatctgaacggagttgacggggtcatcatgcttcagataccggaagggaaaaagtggccggttcaatgcgtttattgtaacgacaatttgaagttcagcaaaggatgggccgaattcgtcctggataataatttggatgaaggagacgtttgtatattcgagttgattaatacgaaggagatcgtactgaaagttaccattttccgtgctcttcgagactgaaatcaggatagcattgaacccgaatataaccgagtcttccgttcttcaactaaataatactctcaggtacatctttcatgtaggatatggcatggagtttatgactgccttagcttaaatttgatatatagttatactcttgctatgtatattccaattcttttttttaagatttcatgtattggaggatttt

SEQ ID NO: 11201 - DNA, 520 bp, Gossypium hirsutum
  unsure (1)..(520): unsure at all n locations
  Clone ID: uC-gsflmaxxa076e04b1
tttacgcgtccggtcgaaacagcagatttacctacacggtgacttggatttaaccattgttgaagccaggagattgcccaacatggattttatggtcaatcatctccgcagttgcttaacctgtgagccttgcaagtctcccgcacagactgctgctaaagaaggggactccaaaatccgcggccaccgtaagatcatcaccagcgatccctacgtcaccgtttgcctcccccaagccaccgtggctcgcacacgcgtcttgaaaaactcccagaatcccaagtggaacgagcatttcattatccctttggctcatcctgtcactgagctcgatattaacgtcaaagacaacgacctcttcggncgctgacgcaatcggcactgccaaaatccctgcctcgaggatcgccacgggggagcatatcaccggatggttcccgctcattggcccctcggngaagcctcctaagccggactcggcgatctacctcgattgaaattacgccctggagataacccc

SEQ ID NO: 11202 - DNA, 399 bp, Gossypium hirsutum
  Clone ID: uC-gsflmaxxa076e08b1
gatggaaagaccgtggttctaccatcagaagataacccacaacctgatgcagcagaggctaaagcgggcggcggttgttgttgatgcttcagaaaatataaaccctatgctcctccggtcctgtcagttaggcctcaagttgcggataatttcttcttcatcttcttccctaccggtaaaatgttaataaatacttgttttgacatgtccatgataatcttatggtggttgatacatggattagctaaagatgtaaatgaaagtgaaggtgaagggggcattaaaaggggaaaagaaaagcaaatgatataagataatatatttagaatgccagtgtaatttcctctgttttatttgactgtgattttacatattcaaaatgattaaaaaaaaccaagc

SEQ ID NO: 11203 - DNA, 439 bp, Gossypium hirsutum
  Clone ID: uC-gsflmaxxa076e09b1
ttctcactgaacgattattagcaatggaagaagaaacaaagatgctgaaagaagctttggcaaagcgtaacagtgaactactggcttctaggaatctgtgtgctaagacatctagcaagcttcaaactttagaagcacaacttgccatcagcaaccagcaaagaagcccctcaaaagctagcaattcaccaagtgtgacttctgtgtctgaagatggaattgatgatgaaaaaagttgtgccgactcatgggcaactggtatgatctccgagctctctcaattcaaaaaggaaaagagcattgaaaagttgaataaaactgaaaatgtgaagcacctgcatcttatggacgactttcttgagggcgagaagttggcgtgttctttaaatgattcaactgcaaatggtgcaatcactaatgcaggttgttcaaacaataa

SEQ ID NO: 11204 - DNA, 559 bp, Gossypium hirsutum
  unsure (1)..(559): unsure at all n locations
  Clone ID: uC-gsflmaxxa076e12b1
ttatccatggcaaagagtgatgccgaagtgaaagttttgggcacatgggcgagtccattcgtgatgagggtaaggattgccctgaacatcaagtctgtggcctatgaatttcttcaggagaggttatgggaaggcaaaagcgagcttctcctcaaatcaaacccagttcacagaaaggtccctgtcctcattcatggtgatgacaccatctgtgagtctctcattattgtccaatacatcgatgagngtttggccttctgctcccattcttccttctgatccccatgaacgtgccaccgctcgtttttgggctgcttatcttgacgacaagtggttcccttccttgagagctattggtatggctgaaggagaggatgcaaggaaagcagccatagggcaagtggaggaaagggctgatgctgttagaggaggcatttggcaatgcagccagggcaggcattctttggaaaggatcaaattggatatcttgacataacatttggtgcttttggggtggctaaagtgacagagagatgagtggatcagctgttaatgaaat

SEQ ID NO: 11205 - DNA, 573 bp, Gossypium hirsutum
  Clone ID: uC-gsflmaxxa076f03b1
cttactcgtccgagtatctggagttggagcgccaactctgacaggtaggcggtggttacaccgccagattcaaaatctccgttcgatcaataggatgaatcttatggttagtaggactgaaggaatatcagctgccaatatgggcattgatcttgttaattctcacattgatcaaagtagggaaccaatggttcaacaagctaggacagaagatgcgggaactcagcctcaaacactgtttgcggagaggttacaggacaatccctcttcttcactgcaaggtagggacttcctttcttcaaggttgagccacttgagaaggcaagcagttcaagattcaactaccacttcgtttggtacatctgtcaatttgacgttatggcctgaacttgctggtattagttcaaatgagcaactccatcattgcagcaatggatcaaacattaggcccgatggctgtgatttgcctttttctgttagagatgacgataatattttgatggccaaggaacaattgcaggcaatggttgtaagccatttatagcctttccacggtattgatagactttcaag

SEQ ID NO: 11206 - DNA, 553 bp, Gossypium hirsutum
  unsure (1)..(553): unsure at all n locations
  Clone ID: uC-gsflmaxxa076f06b1
ttataactgacacccaaattcccgcattttctgtaaaaagaaaaacctccccgtcctttgagaaaccctagatgtcaacgtcaagccaaactcagttccgctatacccagacaccatcgaaggtcctgcatctccgtaatctcccatgggagtgtacggaagaggaactcgttgagctttgtaaaccctttgggaagatcgttaacactaagtgcaatgtcggcgccaatcggaaccaagcttttgttgaatttgtagacttaaatcaggctatttcgatggtttcatactatgcttcgtcatcggagccggcacaggttcgtggaaaaacagtatatattcaatattcaaacagacatganaattgtcaacaacaaaagtcctggagataccccaggaaatgttttgctggttaccattgagggtgtggaagctaatgatgtgaccattgagacaattcacttggtattttctgcatttggttttgtgcataaaatcgctacttttgaaaggctgcgggattccaggcattaatccaattcactgatgctga

SEQ ID NO: 11207 - DNA, 486 bp, Gossypium hirsutum
  unsure (1)..(486): unsure at all n locations
  Clone ID: uC-gsflmaxxa076f07b1
ttaggaacggagacttctacttctcacccttctttttctcgatcaaacaccgaccgtgtggccagaaaaagtcttttgctcgattcgattctctctctatctcgccgatctttcatcaatggcttcttgctcaggtattttttttcctatttcctctcttgattactttttttttctatttttatgtactatttccgattaatttccttgattctatcattttttttggtaagtgagaaaatttgaaaaaataaaaataaagcggaaagattagaaaggaaaaagaaaaaaaaggaaaagtgatgttggtcgtagtttcagttttgtgtattgataaaacgaaaaagaaaaggaaatcttacccgaattaatttttttaggttttaattactcttttcttggtaggctattagatatttactagaagcctggtttgntgatttcgattttcttttcaatcagaagatagcagaattttagatttta

SEQ ID NO: 11208 - DNA, 258 bp, Gossypium hirsutum
  Clone ID: uC-gsflmaxxa076f08b1
tttttcaaggacaacgagggattactttgtgttcgtaagacattttggcgtcccacggaagaagaacctataaagtctgctattgtttgaacatgatgctcacataactgtaacattccatggccctagaatataatctgagatgttatagtttaccgtagatctagtcatccttctaatgcaaaatcatacctacttatgacaatttcaatttttgggccaaaatttccagattgaattaaaatgcataatttcgat

SEQ ID NO: 11209 - DNA, 380 bp, Gossypium hirsutum
  Clone ID: uC-gsflmaxxa076f09b1
tggcaggttcatgtatgtgacgatacttgtcgagaagtcattttggatcccaacaatgagcttttggtctgcacaatttcaggccactgttttgataggttactgtcaccatccgaaatggaattggatgctgaacagcagcaagctggtggcacagatgaagcagaaccattcttgggatctggtcgctttgcacgagcttacttattaggatacaactgcgaggatgaaaaggagctggaagctgctttgaggttttgttgatccaaatcttttattactttcttttaggtgggtattagtcaaatgtctcagtttgagattgatatgtggatgctcttaagtttttcttttattggtcctatagtttacacaagata

SEQ ID NO: 11210 - DNA, 365 bp, Gossypium hirsutum
  Clone ID: uC-gsflmaxxa076f10b1
tcttgcaggttcatgtatgtgacgatacttgtcgagaagtcattttggatcccaacaatgagcttttggtctgcacaatttcaggccactgttttgataggttactgtcaccatccgaaatggaattggatgctgaacagcagcaagctggtggcacagatgaagcagaaccattcttgggatctggtcgctttgcacgagcttacttattaggatacaactgcgaggatgaaaaggagctggaagctgctttgaggttttgttgatccaaatcttttattactttcttttaggtgggtattagtaaatgtcttagtttgagattgatatgtggatgctcttaagttttctttttactgattcta

SEQ ID NO: 11211 - DNA, 374 bp, Gossypium hirsutum
  Clone ID: uC-gsflmaxxa076f12b1
tccacgcgtccgcagaacgatctaaagagggtctgtttacccgtggtcttcccctccgtattgtgatgattggaactctaactggagctcagtggggtatctatgatgctttcaaagtgtttgtggggctgccaactactggtggtgttgctcctgctcctgcggctgtggagcttgccaaggcatagaatgttggaaatcctgttgtcatgggggacaagtaaacataggattgctggaatggtttgtcaagctggtggaaggatattctttattgcgttgagaacatttttatcaagtctgctctgttctgaaaaaaactgttggttctaggagaggatggtttttgattcatatttcaattttcatacact

SEQ ID NO: 11212 - DNA, 492 bp, Gossypium hirsutum
  Clone ID: uC-gsflmaxxa076g01b1
attttccacttccttgccttgcttaaccttttcatctcacattccatttccaaggagaatattgtgacaatgacgagtgatacctcatattacgatatattgggtgtcaaggttagtgcatccgcagctgaaatcaagaaggcttattacctcaaagcaaggcaagttcatcccgataaaaaccccggagatccaaaagccgatgaaaaatttgctgcactctccgaggcttatcaggtattaagtgatcctgacaaacgtgaacactatgacaagaatggaaaggatggaatcataccaggctccatgttggatccttcagctgtatttgggatggctttcggaagtgactacttcgatgaatacgtaggcacactagcaatggctactttggcatctcttgaagttgaatttgaagaaagttcagtagataaggaagctcgtcccaaaaaatagggaaaagtggaggtattgcaaaaaggaagggaagac

SEQ ID NO: 11213 - DNA, 534 bp, Gossypium hirsutum
  Clone ID: uC-gsflmaxxa076g03b1
tttgatgcctccactgtttcctctcccaacaatggtggcatcaaacttctctcttgctttgacactcgctgccattatatctgtctgggtggccgctgatgccgcccaccaccaccacacggcgtcggctccttccccttcctcttcctcttcctccgtggactgctcctccctcatcttgaacatggccgactgtttgtccttcgtatctagcgggagtgaagtgttgaagcctgaaggaacttgttgttctggcttgaaaactgtgctgaaaaccgacgctgagtgcttgtgtgaggcttataagagcagtgcttctctgggtgctactctgaatgtcaccaaggccatgactttgcctgctctttgcaaagtctctgctccttctaccactaactgcgcaatatctctcacacccgctggtgcaccaggaatgcaaccatcaacatcggccagtgcgcccacagcatctgccagaaggagcaaatgaagtagcccctgcgccagctcctgctaggtcaggctccccattgc

SEQ ID NO: 11214 - DNA, 433 bp, Gossypium hirsutum
  Clone ID: uC-gsflmaxxa076g04b1
ttttcgcgtgggcggacgcgtgggcggacgcgtggggtaagttcgggccaattaagagcttgagctgactctggtatttgtaacgctgtatttgtttaacgagccatggagatttggttggtattttagaagacaaatcccataaggatgacaatatacgagcaactaaaccaaataagccggtggggagactcattcaatcgtggtgatagtccaaatacaggatcatccacaattgtagagggggatgttaggctagagaacaaggctggatatatttcttgtgatcaagttgaaccttcaagaagtgatcaagaaacaaacaagcccattgataagacacagagacgtctggcacataatcgagaagctgctcgtaaagtcgtctacggaaaaaggcctatggtcaacaatttgaaatcaagtcgtttgc

SEQ ID NO: 11215 - DNA, 498 bp, Gossypium hirsutum
  Clone ID: uC-gsflmaxxa076g06b1
tttatttgatccccccttttctgttgctggtactgagagtcccagatccaattaaaaaaaatgaaggtgatagataagatccagtctttgtcacaggaccaagggaaagtggttttttcctttgagttcttccctccaaagactgaggatggagtggacaacctgtttgagagaatggatcgaatggtggctcataatccatctttttgtgacatcacatggggtgctggtggttccactgcggatctcactttggacattgctaacaagatgcaaaacatgatatgtgtggaaacaatgatgcatctcacttgcaccaacatgcctgttgagaaaattgaccatgctcttgagaccattaagtctaatggcattcaaaatgttcttgcccttaggggtgaccctcctcttggtcaggacaagtttgttcaagtcgaaggcggcttctcttgtgccctcgatttagtgaaacatattagagctaaatatggtgacttc

SEQ ID NO: 11216 - DNA, 442 bp, Gossypium hirsutum
  Clone ID: uC-gsflmaxxa076g09b1
tccacgcgtccgggacctattttagagccaacatggcctaatttttaatttatttatatattgcttttctgccctttctcgacagtgttccagaatcggttggttaaggcaatggctaccctcagaatagctcttcgtaacgtccaccgcatcgttaatacctccgccgtttccggccgtacaacaaccgttttcaggccacagtatggttgggtttcaacatatttttcaactaatattagtaacactcagccattaaacatcgatctttctaacgaagaaagcaaaaggcgtctttataacagattgttgcataggagcaaacaaagaggatttctggagctggatttggttttgggaaaatgggtctgaagaacatattccttccatggatgaaaatggaattaaagctcttgttaatgtcccccgatttggaataccc

SEQ ID NO: 11217 - DNA, 343 bp, Gossypium hirsutum
  Clone ID: uC-gsflmaxxa076h01b1
ttagtatattactcccaattcgtttctttccccatctacacttggcaagaaaaatcaaggacagttgaggtagaggaggaagaaaaaccaaaagaaggagaagaagaaaagccagagggtgagaagaaaaagaagacaactaaaactgagaaatattaggactgggaattagcaaatgaagcaaaaccaatatggctgagtttgttgttctgtcacctctataaatatgcgaaatccaaaggatgttgaaaagggtgagtacaatgaattctacaagaagactttcaatgaattcttggatcctcttggatacactcacttcactacagagggtgaggtggag

SEQ ID NO: 11218 - DNA, 479 bp, Gossypium hirsutum
  Clone ID: uC-gsflmaxxa076h04b1
gctactcgctttaatcctcgcttttctctgccatcaaccacttcctcgttttctcaaggctgtagaagacggcagagggcgaggatatccaaccccttgcttgcgacaatggaacaggaatggttaaggctggatttgctggggatgatgcaccacgagctgtgtttcctagcatcgtcggtcggcctcggcacaccggtgtaatggttggtatgggccaaaaagatgcatatgttggtgatgaagctcaatcaaaaagaggtattttgacattgaaataccctattgaacatggtattgttaacaactgggatgatatggaaaagatttggcatcatactttttataacgagcttcgcgttgccccggaagaacaccccattttacttaccgaagcccctcttaaccctaaagcaaatcgtgagaagatgacccaaattatgtttgagacctttaacgcacctggcttgtatgtcgcc

SEQ ID NO: 11219 - DNA, 654 bp, Gossypium hirsutum
  Clone ID: uC-gsflmaxxa076h06b1
tgtacgcgtggggtttttatttgtgatgaagactgtccataaaacaaaatttccctgtgatttcctttggtcctgttgagtgtacatttctttaggaaaaaattatgatttcaaatccaattttttaaaatagaaattttatattttaatatctttaaaatggtaaaatttttgcattaataaaataataaaaattgtattttagttaatattatttggatcgatttggattggaaattaattaaggtattagtccgaaggaaatcattggaccaatcaacttgggaatctatatgaacaggttgaaccaaaaaaaaaactaattggattgggcaatcaaatcgaaatttttaataattgatttaattaatcggatgaattcgtcaaaccaattagacttataaatcgataacttaacgagttgaattttgaaaaccttaaatttagcttgttaaaaatttacaatttcaaataagaaatggggtaaattacagcaacaatcactcactttggggtagctggaaaacagtcttttaccattttgtgggttataaagtaaaggttttatactagatggtggggaattattgcctctattctggtgtagtccttcgttattatttttaattttaaatttaaaatatttaaaaccat

SEQ ID NO: 11220 - DNA, 503 bp, Gossypium hirsutum
  unsure (1)..(503): unsure at all n locations
  Clone ID: uC-gsflmaxxa076h07b1
tgttcctttccaaaatgccttcaattccagaagagccactgctggccgcgaacccagaccgattctgtatgtttccgatccaatacccagaagtatgggaaatgtacaagaaagccgaagcgtcgttttggaccgcagaggaagtcgatctgtcttccgatcttcgtcactgggaaactctcaccgccgatgagcatcacttcattagtcacgttctcgcctttttcgccgcctccgatggcatagtccttgagaaccttgctgttcggttcatgaaagaggtccagatctccgaggcgcgtgctttttaatggtttccaaatcgctatcgaaaatatccactccgagatgtacagtctccttcttgagacttacttaaaagattncgatgaaaagaaccgtcttttccgcgccatcgagacggtgcccgtgtgtggctaaaaagccgagtgggtataaatggatcgaggcggagaaactttcgcgaacggtaatgcttttgt

SEQ ID NO: 11221 - DNA, 454 bp, Gossypium hirsutum
  Clone ID: uC-gsflmaxxa076h08b1
tttcccactgcttgtaacaccgtaagcatggagatcaaaatactcctggtattataccgctggcaataaaggatgtattcagcattatccaagatactccagggcgagaattcttactccgtgtgtcatatcttgaaatctacaatgaggttataaatgatttgcttgatcccactggtcaaaatttgcgcgttagagaagatgctcagggaacttacatcgagggtgtaaaggaagaagtgtctttgtcgcctgggcatgccctatcttttattgctgcaggggaagagcatcgtcatgttggttcaaataacttcaatctctttagcagccgaagtcacactatattcacattgatgattgagagtagtgcccgtggtgatgaatatatggaagtgatcttctctcaacttaatttgattgatttagcttggtctgagagctaaaaactgat

SEQ ID NO: 11222 - DNA, 478 bp, Gossypium hirsutum
  Clone ID: uC-gsflmaxxa076h09b1
gtaagaaggaaaaaataaaaaacaagaaccctctgctagggtttttctttaccccttttgcgccgccgttcgcctgcaccaacgctccgatcgtgaacggagatggcaacactccggcgtgttcgacgaaagaggtaagatcccttttctcttttctttatatattaagcaaaaataaataaaaaagagaaactatataaaaagaatcaaatatatatatgtataaatgaaaaataaaagattgataatccacaatgaagtaaaacagagagagaaaaaagaaaagaaaacctttgtatttcaaaaaagaaaatttcctatttgtgtttgtatttctttcggtctctcttttcgtaaaaaaaaatcttccccctattttcggtcctttttacagaattttcacggctttaaatagccgaaatggaaaaagaaaaaacaaaattaaaagaaatctattctgttttttttgttggcatat

SEQ ID NO: 11223 - DNA, 512 bp, Gossypium hirsutum
  Clone ID: uC-gsflmaxxa076h10b1
ttcacgcgtccgcccacgcgtccggtggagatcaatcataactttcattctcttcgcctttcttttcttccctatttcagcgacgaagataacactctacaacaaatgctcacatccagtatggccagggattcaacccagcgccggcaagccaattttagcccgcggtgggttcaaactcccaccaaacaaagcctactccatgaatctacctccgttatggtccggtcggttctggggtcgacacggttgttcctttgacgcctcgggtcacggccgttgcgcgacaggtgactgcggcggttccttattctgcaacggactcggcggaaccccacccgctacgttagcggaaatcaccctcggccaacaacaagatttctacgacgtcagtttggtggatggctataacatcgctatgtccattacacctttaaaggcgccggtaaatgtagctacgccgggtgtgttagtgacttgaattaatgggccccgcgcgtacagtgagggat

SEQ ID NO: 11224 - DNA, 385 bp, Gossypium hirsutum
  Clone ID: uC-gsflmaxxa076h12b1
tgtggaagtgcaaaccccaccatcaacagccagggtaacagatatgcagctccaacaaacccatttgcaaaggaggttaccaagagagtagatacagctgaagggcagtggaagagctggaattggaggtccgaaggagacttgttactgaacggtgcctacttcacaccatctggagctggagcctcagccagctatgccagggcctcaagcttgggagccaagtcctcttccatggttggagccatgacttccaatgctggtgctcttccttgccgcagaggcaagcaatgctagtattatccatcttttccccaatcaattaaattggctgaaaatcagcctttttacaatctgtttgatttttcccctctttcatgatttt

SEQ ID NO: 11225 - DNA, 221 bp, Gossypium hirsutum
  Clone ID: uC-gsflmaxxa088a02b1
ggtttttgcccagcctccatcctagatgaagcgggggggttttttaaaatttatgcggctgtgcacacccaacgccgtggactgcactccgcacccagaagccgaggcgtgagtcgctagagcgaattgtgaagctattgagaaaccaagccgccgacgtggagagctctcggcgccactggtgggagggactcggggggcatataagggcacatgaactc

SEQ ID NO: 11226 - DNA, 611 bp, Gossypium hirsutum
  unsure (1)..(611): unsure at all n locations
  Clone ID: uC-gsflmaxxa088a03b1
cccactcgtccgaaattttccattcatataaccaacccttatagaacatcaccaccccatttctttttaattactgcttcttgttctcttccttcacacgtaccccaccaatatcaataatggcacgccaaagctttgttcttgctttggtcttaatcgctcttgtcgggttggtttccgccgccaatacggcttctaaagcaccatctgcagtcccagtacccgatgatgataccatcggcaacactgatgatggagcaggtgcatcctcccctggtgcttctaatgacgctgttgctgcccctcttggcagtgagcaggaagctaaaagtatggctcctgctccttctagtgatgcaactaccacaggtgtctccgccgttggggcagctgctctcactggggcagctgccattgctacatacttcgtcttctaaattagcttcgtctcaatctaagtagtaaacctcgaaaaagggtcttattatccataatttgtacttctacattaatttcttagtctggtaaaattgaggatgcaaaggcagctgcttgtatttgtttatgaataaaaactatgaatatatttacataaatnggaaacttatatg

SEQ ID NO: 11227 - DNA, 266 bp, Gossypium hirsutum
  Clone ID: uC-gsflmaxxa088a04b1
ggttatgccccagtcctggacagtcacaccttttacagtgctgtcaaatttttcgaactgttgaccaagattgacatattttgtggtatggtgctcttacacgaactaaagttcttgaacaacggtgatgcatgtatggtaaagatgattcctgatatactcctgtgaagttgtgacctttatgtgaatacccaccacttggacgttttggtgaccgtgacatcttcttgtctatgctggctacaagtgttatcagtgttgctatc

SEQ ID NO: 11228 - DNA, 452 bp, Gossypium hirsutum
  Clone ID: uC-gsflmaxxa088a05b1
cccacgcgtccgcccacgcgtccgtaaaaatccgtactgaccaaaaaaaaacagagcatatagttctttctttcaattaagagctcaagctggcgatctcttatgtatcatcatggttgcagctatgcaccatgtggaccgtattcacctgcagcttccccagttccgactctggggaatgatggtcaattgtatggtccacaacactaccagtgtgcttcctggttgcagccgatgactctaaccagtggtccgttcacgccaaaccctgctgcttcataccatggtgagcttttgacctctgctgctgctgatcagaagccgtacctgttgaaaccccgaactcaaattccatggaagtgccaatggtggcagtgtgaaggggaataatggtccaggcgcaataaaaccatcataccccagctcatttaataccaataattcttatggaa

SEQ ID NO: 11229 - DNA, 497 bp, Gossypium hirsutum
  Clone ID: uC-gsflmaxxa088a06b1
aagggttaatatcaatttcttatgatattttatatatgtatgtcatattcatgtttcatgattgtgttagaattacataaataaaaaataattaaacaaggttaataatttatctttttatcatttaagtgtagtccttttgtatgtttattgggctgttttttggtgcgtatcatgttagtagttgtaaagaagtataaaagtctagcatggcaattatcagtgttgctcaactcactgaacacggtaaaacacccctgtgcgagcagcgagtttaagttacggctgcatcatgctagagagcttctttttcacaaaacaaggagattttcatccgcaagaagctgacccaattacacttctgtcgggccccccttccaggtaaaattcttgtcccagacaagtctccttgtaattacgtcgaacatatagtaggctacacgtaaaacgcgtaaccagtactaatcactctcaactctttacccatatcattctta

SEQ ID NO: 11230 - DNA, 516 bp, Gossypium hirsutum
  Clone ID: uC-gsflmaxxa088a09b1
gtttcgatccgatcgacgctgctgttgttcctggtgcctattactgataaaggagaaatgccatcgcagaagattgaaactggccaccaggacacggtccatgatgtggccatggatttttatggtaagcgtattgctaccgtctcatcagacagcacaattaagatagttggggtgagcaacaacacacatcagcatttagcgactctgacaggtcaccagggaccagtatggcaggtggcttgggctcatccaaagtttggctctttacttgcttcttgttgttatgatggacgtgtgattatttggaaggaaggcaatcagaatgattgggctcaggctcatgtatttgatgaccataagtcatctgttaattcaattgcttgggctcctcatgaactgggactctgtttggcatgtggctcttctgatggaaatatatcggttttcacagcaagggcagacggtggctgggatgtatcaaggattgatcaggctcacccagtgggggtaaca

SEQ ID NO: 11231 - DNA, 522 bp, Gossypium hirsutum
  Clone ID: uC-gsflmaxxa088b02b1
cggactcgtgggcggacgcgtgggtttaaaagcgaagtggaaaattgttatatattttttcccatctctgaaatcccagaattcaatcatttttagctcaaaaccccacttttttccccctttccttttaatatatagtctttacctgagaaactacaaggttcatcagcccccccacattgaaaatgacggagacgccgttctcaaaactctccgacgacgtcggtcttaacatcttctccaagctcgaacatcaccccaagagctgggcttgtctcgcttgtgtctgcaccaaattctcttctctcattcacaacacctgcttcaaacaaaaatgcttcataaccatccccgtcgtttgcgccggtctcctctcctgttcctgcgtccctcccggcggttggtcctccctccataagctctccgtctgctgccctggcctccatcacgctggcgtccttctcgaccactccgattttggcttcgcacgtgagattggccccgaggtgaaatatcccaagc

SEQ ID NO: 11232 - DNA, 556 bp, Gossypium hirsutum
  Clone ID: uC-gsflmaxxa088b04b1
caatttcgaatatatccatggcagttcccagctgtaccataaaatccagaccctattcaacaaaacaacacctttattccttcttcttcataatcatattttccttcctctttttaccctcttctttttcatcctcttctccttcaatccacgatcttctcgtttccagagggttaccggcaggtttgctcccaaaagaagtgaaatcttataccctttcagacaatggaaccctggaagtgttgttggacgaaccctgcttgacaaagtacgagaatagggtgttcttcgacagtgtagtgagggctaaccttagctatggaagcttgatcggggttgtcgggttaagccaagaagaactgttcctctggttgcctgttaaagacatcatcgttaatgacccgacatctggtctcatcttgtttgacataggacttgctcacaaacagctttcgttgtctcttttcgaagacccttctctgtgtcaacctcaaggaatatcgaagataatgtgaggaagagaatagatttgagggttttagataggaaaaggaga

SEQ ID NO: 11233 - DNA, 504 bp, Gossypium hirsutum
  Clone ID: uC-gsflmaxxa088b06b1
gatctccccactttcactatcaatggcgaagccaaggctttcgcgcgttccggcccggaaatcttcatcgtcaaccatgtttctaactctgctcatcatgttcaccttcctggttttgattcttttggcgctcgggatcctttcaattcccagcagtaactcccgcagttcgcacaaacccaacgatttgagctcgattgtgcataacgtcgtcgacaaaaacgattatgatgagggggtaggagagcaatgggttgaagtcatctcctgggagcctagagcttttatctatcacaatttcttgtccaaggaggaatgtgaatacctaattgaccttgccaagcctcatatggaaaaatcaaccgttgttgatactgaaactggcaagagtaaagatagcagggtgcggacaagttctggaacatttctgcctagaggacgtgacaaaattattaggaacattgagcagagaattgcagattttaccttcatacctgtagagca

SEQ ID NO: 11234 - DNA, 532 bp, Gossypium hirsutum
  Clone ID: uC-gsflmaxxa088b07b1
aaatccattagcgagtctaggccctaccttggagaaaagttaggttgcagcgtgctttcctggtcttaccaggaaagataaaatctctgaatgctcgaaggacgcaacaaagaagaagcaggttgtggttcaacaggcttcccaaccgctatctactggtaccttgaagcatggccctgctttcatattccctttgagtcagtatcaaacaactgcaaatccatctgggccttctaaatctgctacctcaactggcaaagcatccttgactgataattcaacacttggaatttcgactagctctacggtgttaccaggagtagcaggagctgtgagctttaattacccaaatttggctgctaaccaggctccgtacttgactatattacagaacaatggttatcctttttctatctctgcaccagtcggaaacccatcagcaattagaggaggaacccccagtcagtcgttgcctttctttaatgggcctttccattcttctcagatgttccatcctcaacttcaacagcag

SEQ ID NO: 11235 - DNA, 583 bp, Gossypium hirsutum
  unsure (1)..(583): unsure at all n locations
  Clone ID: uC-gsflmaxxa088b08b1
tccatcgcgtccgcccacgcgtccgattggagctaccgggaagtgacgttgtgtcagatgaggaagctgagagtgatgatgaagtactttacagacgcacagtttctctgtagtaaagtttttcattacattaatgaattaactttgttttgaactgtaatttctctagcccatctttcttatctttaggcctctacttatgttctcagtttttgttatatttggattttctccctatattcattgttacaactacagtgcttgctcatgcacatccagacttgcctgcacttgcatggacggtcatatagtgcatattcaaaattgcatctgggagctatcttttttgctgttaattacccggtttgtttatagtattgggttttataagtttctccttagaattaaagctttgatcaattaaatcagaaatcagcgaggagtatttgtggacacctaggtgagcttccttgaattcttgaggacttttctatagcaaacttacattttagtgaaatctttntatgcttcttttactttgccatatgtttcgacttcaattcttgaatattttactggtttt

SEQ ID NO: 11236 - DNA, 407 bp, Gossypium hirsutum
  Clone ID: uC-gsflmaxxa088b10b1
gcctcaaccttttacatatgggttttgctttctgggatattttatcacctatacaaccaatcatcttatcaggcacttgatgagattagccctttgacattttcagttgggaacaccatgaagagagttgtggttatagtgtcaacttttttggtgtttaggaatccagtgaggcctttgaatgcacttggatctgggattgccattcttggaactttcttgtattctcaagcaacagctaagaaggtctctgctcctgaaaaaaaaagctaaggattcagtaatctcttcaaagttttaaactttttttttggggggtctttccttttgatcagatgatatttgcattttgttcccttttcccccttactataaatgtcaataaatgaccttaatattttgcttgc

SEQ ID NO: 11237 - DNA, 521 bp, Gossypium hirsutum
  unsure (1)..(521): unsure at all n locations
  Clone ID: uC-gsflmaxxa088b11b1
ttttaaatgacgtaaatttgaagaaggaaacgttgaaattcgaagctgatgagctgaatcctgggaagttcttggtttctttcacgtttgatgctactgttgctggaaggattactgttattttctttgcaaaagaaggtgaagactgcaatctgacggcaatgaaggaaagtattctacccccagtaattgtgcctttcgaacaaggtctaggacagaagtttagactgccgtctggaacagggatcgatttctctatgtttgaggagtcggaattactgaaaatagatgaagtggatatctatcatctggctgtgaaagcagaggcattgcctcttaaccaaaatgtgtcagatggaaaccaggagtcaggagccatgaattctcagataactcangcggtgtttgagaaggagaagggtgaataccagaccagagtaatgaaacagattctgtgggtgaatgggaagaggtatgagctgcagaaatatatgggatncgaaattcagttgacaatgatg

SEQ ID NO: 11238 - DNA, 532 bp, Gossypium hirsutum
  Clone ID: uC-gsflmaxxa088b12b1
ttcacgcgtccgaaaatccccaaaaaaggaagggaaattataaagatttccacggggagggaaagctcaaagcgaagggtcgaaaactttcagatagattttctttttttctttttgagggagaaaaaggtgtgctgtcgtctttctaatggagctcagcttcagagctagggtttcgtttttctttgcctttttttgaagattttttatgaaggtgttgaggagtgccataatttatcattttcgaatcttttgttgacaattaatatgattttacatgatcagcttgcttggaaggtttccttttagatgctctcttgaagtttcattcctgttctagatggaacaaaaattgtcagtacgttatagagttctctttgtttggtggttttgcatctaaaacgccatgacgcttgaggatttttttaccctggctgagatgaaagatggactcacggtcccttcacgagttgaggagctagtatctgtaatgaaaaaagagaaagaatctgttgtgaaaatatgtgtgatg

SEQ ID NO: 11239 - DNA, 454 bp, Gossypium hirsutum
  Clone ID: uC-gsflmaxxa088c01b1
aattattagagatggcgtctgtaataaaatctggggggttatttttgacggtgtttttatctgtacgcttcagttcgggtgttaggttgctccaggaacagcccaatgatgaccccaaaaacatggacgctattcctcccattgatgcactcaaccctaccgagttgaatggacccggtgttggcattcacgaagatcatgttgtcccaaaaggtgctgaaattggtactcttggttttggttttgaaggtggtcctgataaatgctgttcttctggatgttccggtaattgtaatcctggtggtttcgttctaccatttcctcaaattccagaaatcccaagaattccagaaatcccacaaatcccacagatcccacaaattccacagattccactaatgccacagattccacaaggtccacagatcccacaaggtccaaaaatcccacttat

SEQ ID NO: 11240 - DNA, 529 bp, Gossypium hirsutum
  Clone ID: uC-gsflmaxxa088c04b1
cctttttggaacacgttcctcgccttataaaaaaagggagctctacgatataatttttagtatctttttgtttttttttttcctttttcctttcggctcttgaagaagatgaagatcgtggtttatggttcaataatgatgacaagaaaaagctcgcagttttaattgaataaacagcagttcctggaagtttaattttactactaaacaaaaagccagcagaaagctttcaggatttgttgctttcacctaaagggtcatcgtatccttttctctcactgaatgcagctcttgatcacacaaacaacaatccagatagtatacgatcatgtcttatttaccagcaagaaaagggagacacagacaacggtacgaggataatctgaggcttgttgccgggtgtattccatacagagtggagaaggatgttgaggacagcaggatcagtgttcttatgatatccacaaccgatcgtgatgatcttgttttccctaaggtggatgggaagatgatgagactgttaatgaag

SEQ ID NO: 11241 - DNA, 500 bp, Gossypium hirsutum
  Clone ID: uC-gsflmaxxa088c05b1
gtttcttaagaggaagaggcattctttcactcgggaggtgttttatattcaatcaccccttcgcccaaagaggaagaagggcttggtggactttttggtccagtttcgttgggtttttgttatattttttgtccttcctttttcggctctgtattactttctcatatatcttggagatgtcagatccgagatgaagtcctacaagcagcgtcagaaggaacatgatgaaaatgttaagaaagtagtgaagcgtctcaaacagaggaatccaaaaaaggatggtcttgtatgcacagcccgcaaaccatggattgcggtggggatgcggaatgtagactataagagagctcgccattatgaagttgatttgtctgctttccgtaacattcttgaaattgatagagagagaatgattgctagggttgagccacttgtaaacatggggcagattacacgtgtcacaagtccaatgaatctttcccttgctgtggttgcagagc

SEQ ID NO: 11242 - DNA, 536 bp, Gossypium hirsutum
  Clone ID: uC-gsflmaxxa088c06b1
gttcatctagttggcgtggctttttttctcctatgagggttctgtctgcaaccaacctgttgtttgcaggatttgggctttgattagaccttttccaattttgctttaaaaaaaaaagaagaagataaaaccacgatggctgctcatagttatagcttgtttctcttaatttccttgtcttttgttgtccaaatcccaacccctcaagctcacattgctgaatatgacgattattggaaggcacggaaattggaagccattgagaacctgaacaaggcttatcaccccaatcctgaggaggtggtccaccattacaacgaccaatttgccaaaaccatgattaagcttaatagcaccagaagggtgttgaagggaacgaaagaaaatggtccatgtgaaataaccaaccccgttgatagctgctggcggtgtgatcctaactgggaataaaacaagaagaggctggccgattgtgcccctggatttgctcgtggtactaccggtggaaaggagggtgagttttacgtggtcactga

SEQ ID NO: 11243 - DNA, 571 bp, Gossypium hirsutum
  unsure (1)..(571): unsure at all n locations
  Clone ID: uC-gsflmaxxa088c07b1
cccacgcgtccgatatcctgaagtttctgccattccaagagcaacctgtcacaataattttgccatattaatccatctgaaggctccccatccaagtgggggaagaaatgaaactatgttttcccctacaactcaaaattctcgggcaccagttgaccttgtcacagttcttgatgttagtggaagcatggctggtaccaagattgcgttactaaagcgagctatggggtttgttatacagcatcttgggccatctgaccggctctctgttattgcattctcctccacagcccgtcgcctctttcctcttcgccggatgactgaaacaggccaacaggaagcattgcaggctgtaaattctcttacttcaaatggtgggactaatattgctgaagggcttaggaaagctgccaaggtaataggagaccgaaagtggaagaacccagttggaagcattatttcgttatcagatgggcaggatacctataccgtcacaagtcctagcngagctcattcccgaacagattacagatcacttctccctgcaggtccctgtatcctgtgcatgcct

SEQ ID NO: 11244 - DNA, 113 bp, Gossypium hirsutum
  Clone ID: uC-gsflmaxxa088c08b1
ttatttcgccgccccatgatcggcaattctggggggggtttttaacactttgttgtgcttcaaccccatggacagaacaagggcctgcctcgtccctgcgggacacagcggga

SEQ ID NO: 11245 - DNA, 505 bp, Gossypium hirsutum
  unsure (1)..(505): unsure at all n locations
  Clone ID: uC-gsflmaxxa088c10b1
caccttgtcagtggcttttgctggagatagtgacatggcgctgaaatatgtgctcgagggctgcccacagttgcagaagcttgagattagagatagcccatttggggatgcagctctgcgttctggtttgcatcactactacaacatgaggttcctttggatgtcgtcatgcaggctaacgcgccatggttgccaggagattgctcgtgctatgcctcgcctggtagttgaagtgattaggtctgctgatgaggaggagatggatgatgttgttggaacattatacatgtatcggtctcttgaaggaccaagaactgatgcaccaaaattcgtcaccatcttgtaggtaaatgtggtgcaggaagctgtttcaattgttctcatgatagatacaaagcaagttttaaactgtttcacggngaatattgatacggaaggcatcttttaaatagctcccgtgttaaagttccagcaatccaaaccaagcaaaagttgagtaaataac

SEQ ID NO: 11246 - DNA, 533 bp, Gossypium hirsutum
  unsure (1)..(533): unsure at all n locations
  Clone ID: uC-gsflmaxxa088c11b1
gcattctctgaggtcaaagctggcatttttattgttcttttatattgcctttgttttttttcttttcccctcacccccttcccttatttactactcttcccaatccttccttttctctcattttctcatccttatttattagtgaaaagaaaaaaaatgtgcagcattctttgagagcaagccaaaataaaaacaggttcatggttgattgagttttggttcttcttcaacaaaacaaaaaacacaatccaaccccaatggctgtttctccttgtttgagtgttaatgatcaaaagaaacactggtggcttagcaatcgaaaggttgtggataagtacattaaagatgcgaggagtctgattgcaacccatgaacaaagcgagattgtttcggctttgaatctactcgatgcagcattggctatttcgcctcgttttgaggttgcccttgagctcaaagctagatctttgctgtacttgagacgatntaaggacgtcgccaatttgctccaagactatatacctagtcttaaa

SEQ ID NO: 11247 - DNA, 311 bp, Gossypium hirsutum
  Clone ID: uC-gsflmaxxa088d02b1
ccccggttaatagccgcgccggagcgacagatacgggagcggaatttgaaaacggttttccagtgacagccccacaaaaaagcgaagatgcaatccagcagccccaaccagaaaccaaggcactcagagaaaaaacaaaaacaccgacgaagaaggggggaaaaagaagaagaaaaagaagcaaaaaggaaatgagacagatgacaccaacggtcaaccgggagacgaagccaacacgaagcagaggtcccgctagcactagcaaacctgcacacgcccgggaatacccaccgcgaccccaaaccccgaaa

SEQ ID NO: 11248 - DNA, 520 bp, Gossypium hirsutum
  unsure (1)..(520): unsure at all n locations
  Clone ID: uC-gsflmaxxa088d06b1
gttcaatctgtaattggtcccatgcaattctattgagaaataaattccaggaaaaggataaaagtatgtatagcaatttcaaagaacaagcgatagagtacgtgaagcaagcggtacaagaagataatgcagggaactacagcaaagcgttccctttatacatgaacgcgctcgagtatttcaagacccatttgaaatacgagaagaaccccaaaatcagggaagcaattacccagaaattcaccgagtatttacgacgtgccgaggagatccgtgcagttctcgatgaaggtgggccagggccggcttctaacggggatgctgctgttgccacgcgccccaaaagtaagcccaagaatggtggtggcggaggagaaggcggtgacggngaggatccggaacaggccaagttgagagctgggctcgattcggctattattagggaaaaacctaatgttaagtggaatgatgtggccgggttagaaagcgctaagcaggctttacaagaagctgttatttt

SEQ ID NO: 11249 - DNA, 505 bp, Gossypium hirsutum
  Clone ID: uC-gsflmaxxa088d07b1
ttgattgatttaaaaagaaaaaaagagagatggcgtctgtaataaaatctgcaatcttaattctgtcggtgtttttatctgtacgcttcagttcgggtgttaggttgctccaggaacagcccaatgatgaccccaaaaacatggacgctattcctcccattgatgcactcaaccctaccgagttgaatggacccggtgttggcattcacgaagatcatgttgtcccaaaaggtgctgaaattggtactcttggttttggttttgaaggtggtcctgataaatgttgttcttctggatgttccggtaattgtaatcctggtggtttcgttctaccatttcctcaaattccagaaatcccaagaattccagaaatcccacaaatcccacagatcccacatatcccacaaattccactaatcccacagatcccacaagtcccacagatcccacaagtcccaaaaatcccactaatgccaggacagtcgggatgtgagagtggagagtg

SEQ ID NO: 11250 - DNA, 527 bp, Gossypium hirsutum
  Clone ID: uC-gsflmaxxa088d10b1
tggtacgcgtgggtcaaaaaccagccctaacagaggagctgtacctaacatcatcatcatccatggcggcaccgatctggctatgggctttctctgtagccctaactctggttccgtctgtttttggaaactctgaaggagatgctcttaacacgttgagaaaaagtttgaccgatccagataacatactccagagctgggatccgaaccttgttaatccttgtacttggtttcacatcacttgtaaccaaaataatcgagtcactcgagtagatttaggtaattctaacctgtctggacatttggtacctgagcttgggaagcttgagcatttgcagtatctggagctttacaaaaataagatccagggaaccatcccaactgaacttgggaacttgaagagcctcattagtttggacctatataacaacaacatctcagggaccattccttctttactagggaaattgaagtctcttgtattttacggcttaatgacaacaaataactggaccaatccctaggga

SEQ ID NO: 11251 - DNA, 547 bp, Gossypium hirsutum
  Clone ID: uC-gsflmaxxa088d12b1
agctctactctttttccatggaggccagggtttgttccggggtattaaccaaaattcagtccccctttttaagccctttacatgcaagtaaactccaatcttcaagaaacatgtctattttgcctaatactatacatacccatcaattctcaaatgcttccctttatcttcgctcccatcaattctcaaatgcttccctttatcttcgctcaactttttctagcagaacccatggtttcaaacaggcgattaaagatgattctcgcgagttcgaattatcaacattaaccgcattgtcacctttggatggtcgttattggggtaaagtgaaagacttggctccctatatgagtgaatatgggcttatttactttcgggttcttgttgagattaaatggttgctgatgctttcacaaattcctgaagtcattgaggttccaagctttagtgcagaggctcagtcttatttgctaggactcattgatggatttagcatggatgatgccctgcaagttaaaaaaatagagagagtaactaatcatgatgt

SEQ ID NO: 11252 - DNA, 603 bp, Gossypium hirsutum
  Clone ID: uC-gsflmaxxa088e01b1
cccactcgtccgcggacgcgtgggtggctagcaggtctcatcaagatgcagatcccaatgctatcatagcaaacgagggagattttatatttaaacccaaagcatttaacattgtatggggaaatgacagtcgttattggcgcattcctcgctcacctataccagatgagcaggaagcagcagagctgattcaggtatcttggttggaagtaacgggttcagtgaaactagagcctttaaccagacatgaaatcagctttaaactcagcttcagaagggattcttttggatggagcggggcacctattttcttgatggccaaggtagggaagaaaggtaagtacaagtggaaaaggctcaaggaactagacaacttgcctaaggaccccattatggttccaaccgatgattccttcactatcgaacctattccttcaaacgaacccgacaaaaggctttattttggtttgtatgatgtctggagtgggaaatggaagggaggttgaaagttcatgacgccatcgtcaggaaaataggttacaactgaatccatccaatcagaaggcatttatttgattctgtttatataacatatataatata

SEQ ID NO: 11253 - DNA, 496 bp, Gossypium hirsutum
  Clone ID: uC-gsflmaxxa088e03b1
cttaccttagcacatgtaaaatcccatctgcagatgtatagaactgtgaagaccactgacagagcagcagcatcgtcaggacaaatggatgcatttgaaaatggatcatctggggatacatctgaagatatgatgtttgaaattcaaaacccaagaagatcagagatatcagttcagcagggaagatcgtcatcatcaaatgctcatcaagacaaagagtaccatggactgtggagcaattcgtcaagggaagcttggctgcatggcaaacctaatgattctcctctaaacttaccatctctccagaaggatatggatccaaaatgcttaagctatgagagaatatcagatgtaagctcatcaagcctttcagagacatgctccaagaagcctaatttggaattcacattgggggttccacattgatatagatataaataattttatatattagggtgtgtactgctcattggaaatgatcatatatatctctgac

SEQ ID NO: 11254 - DNA, 516 bp, Gossypium hirsutum
  Clone ID: uC-gsflmaxxa088e04b1
cctacgcgtccgcccacgcgttcggacggagcaaatgtttgaggacgacgagaggcagcaatctcttccgtcggatcttgagttcgtttccaacaaggcgcaaaactgtaacgccacgggatctgactcgggtcacccggagttccagtcgacgtacccggaccaggttctggagaacgtgttagagaacatttttagagtttaaggaacttattctcgtttgctgcgatgggtttggaattagtggccctgctattttcgttaacaagtgcagggcaagatgagttgtctgattatcaatgatattgatgctggtcttggtagatttgatgagcttatgttttactggaacagaaaaccttgaactgtaccaattatgctttaattttcataaatttcctcttgtttaagaagttttaaaagggtacttatatactgatttcgtatcttgaactttatatatttgtcacatcttatctaggtaatactcaaatgacggtcaacaattcagatttt

SEQ ID NO: 11255 - DNA, 489 bp, Gossypium hirsutum
  Clone ID: uC-gsflmaxxa088e05b1
ctttatttagctaaataaacaggaaaaatggacgcgggtgacttagaatttgatccgctaagggagcccgctaaggacagtgttcgtctcgtcaagagatgccacaagcccgatcgcaaagaatttacgaaggtggcgctccgtacagcgatcggattcctggttatgggatttgtaggatttttcgttaagctcatctttatccccattaacaacattattgttggatccggctaggtttgctttcatgttactgactcaacagcacagatcgagagataaattgtctgagatctcgaactaatttcagtatagactttggtttgcctctatattcatatgtgctggattttggtttagtttctagcgatgaaatggatactacttgaagcaaatacaatccttgagttttggtccattgatttatgttttttccttgtatcgatgcttatcttgggtaaaagtattatggatgtccttgtgcttttt

SEQ ID NO: 11256 - DNA, 591 bp, Gossypium hirsutum
  unsure (1)..(591): unsure at all n locations
  Clone ID: uC-gsflmaxxa088e07b1
gctttctgctttgctcttttttgggggtttcaaaaatggttgagaagacatggggaagaaaggaagaggttgttaccagagaatacaccatcaaccttcacaagcgtctccatggctgcacattcaagaagaaagctcccaaggcattaaaagagatcaggagatttgcagaaaaagccatgggaaccaaggatgtgagagttgatgttaaactgaacaagcacatatggagccgagggatccgaagtgtccccagacggattagggttcgcattgctcggaagagaaacgatgatgaagatgcaaaggaggagctttactctctggtatcggttgccgaaatcccagccgaaggactcaaaggtttgggcactaaggtcatcgatgatgatgatgagtaatctccgatctctagtttaagaaaagcattgcattttgtttactgaaaagtttaaacccaggtcttggctagtttaacgattttgttcatcaactgttctttctttgatactcngtttatcgttgtttagacttttaaagcttggngcaatatttgtttcaatggcggaaaaaaaaaaaaaatagggcggc

SEQ ID NO: 11257 - DNA, 497 bp, Gossypium hirsutum
  Clone ID: uC-gsflmaxxa088e09b1
cttgttctagatcgcgagctcacccacatcatagtttctgagaaagagagctagctagggttttataaccctttcagccccacactcccaactccattcattctctctcttttcttttgcttaatacaaatggcattaatggcagatcaccattccttggcagttgcatttggtgtcttaggtaacatcatctcagtccttgtatatctggctccactaccaacattctacagaatatacataaagaaatcaacggaaagtttccaatcactgccttaccaggtggcattgttcagctcaatgctatggctttattacgcgttaatgaaaaagggtgccttccttctcatcaccatcaactcctttgggtgtgttgtagagactatatacatagctatgtacatagcttatgcaaccaagaacagcagggtgtctgctataaaactttttgtagctatgaacgtagcgctcttctcattcatcattattctcacaca

SEQ ID NO: 11258 - DNA, 522 bp, Gossypium hirsutum
  Clone ID: uC-gsflmaxxa088e10b1
cccacgcgtccggaactatattctctttctaaaaatacaacaaaatattaattaggatatatggcaggtgattcagggaagaaggaagagatgtcaaaggtgaaaatcatcagcacaagtcatgtgaagcctggaaagatgataggaagaaaagaatgtcaattggttacttttgatctcccatatttggcattctattataaccagaagctgttgttttacaagtgtggggagtttgaggcgaaggtggaaaaactcaaggatgggctgagagtggttttggaggagttttatcagctagcaggcaagcttggtaaagatgagaatggggttttcagggtggaatacgacgatgatatggacggtgtagaggtggtggaagccaccgccatggagatcggcatagaggaactggcgactgaagacggcactgcctctttcaaggacttgataccctacaatggtgttttgaacttggagggccttcacagacccctcttgtctgtgcaggtaaccaagttg

SEQ ID NO: 11259 - DNA, 255 bp, Gossypium hirsutum
  Clone ID: uC-gsflmaxxa088e11b1
atttgcatcttcttagatcaatgtatttcacctggtctagtgctgcggtgggttcaagtttcatcgacgttttcaaggactgggaacatcttagcgttttatgttttgggtatctttcagcagcaaatcgctaggccttgattaggacttgagcaccatttgcgtgccgcagcaccagtaactagtaaaagttcttatgatggaattctctcctaaaactagttttgaccagtgatttcactcggcatttattcg

SEQ ID NO: 11260 - DNA, 466 bp, Gossypium hirsutum
  Clone ID: uC-gsflmaxxa088f01b1
atctttctctttccaatttcttcttcgatccttgcccgacttaatgatcaaccccctgtggcgttttctcgatcgccatcatcattgagtcagtcaataaaaccaactcgggggtgagtttaccctcattgaaaaagcctttcttttttcaatttgaaaaaattccgtcctatctttttatcgatggcatgcgaggttataaattcatggacattcaatggcctagcgggtgctttccttgatcttttcattgcttatatattgctttgtggatcatctattgcttatttggcttcaaaacttctgggtttatttggactgcccttgcctctgccttggaatggattgtgtgggtacccaaacaagaacatttgtgtccaagccatgttagttaatgacccatcatttaaaatctcttctgttcaatcttctgcaatgaagaagctcccttttgattcactctgga

SEQ ID NO: 11261 - DNA, 336 bp, Gossypium hirsutum
  Clone ID: uC-gsflmaxxa088f02b1
ggccgacgcgtggatggaggcgggcgagagtgctgggcggaatatcgtgatctgtacttggaagccatccgagcgccaagcttcagatgaggaactccgaagatggattgactcgtgaaacaatacattaaccgtgtccgatgtgggagctcgggctatgaacgtcgtcagttccgatggccttattatgggcaacatgcagctcatgttccctgacagacatgccttagcctttgagactacattaactggattccacgttagtatgacggccttaatgggggaggtatgaaacgctactggcaactcaacaagataagaagagtctgtggggga

SEQ ID NO: 11262 - DNA, 504 bp, Gossypium hirsutum
  Clone ID: uC-gsflmaxxa088f04b1
aaaaacacaataaattttgtttttttcatcacatcaggtctctttactctcactaacctttattcttcaataccatggacatgaagaagatctcatgcgccgtcattgtcgccgccgcctctatgagcgaggtcctggctgctggcgccgctccagctccatctccagcttcagctccagctgcagctgcagcttcagcttcagcttcagcatctgccccaggcccagattccagcgtcgcaatctcaacaatgcctgttattgagtccttggttggagctacactcgtttctttctttgcctactttttacagtaagccacagcaaaaaaatggatgaaaccatgaagtattgaagaatcaaaaaaagaaatggcggattaataaatgtaaaaatattacttggcgttcattccattgaagatgctttctttcttttttttcattggtgaagatggctttcttcactttacttgtttgtacgtttatgatacatgtttgaatt

SEQ ID NO: 11263 - DNA, 500 bp, Gossypium hirsutum
  Clone ID: uC-gsflmaxxa088f05b1
cggacgcgtgggttaaagtgccagaagctttggtgacagaaattctatctaaacttccacgaactgatggaaacgccgacatcccttatttctctcaactttcagaagaaaaaggttgccatttggaacccatcaactagagaatttaaaatccttcctccatcctcagtccaacgacctacttacccaggccttacctttggtgttcttgtttacccggtggaaggaattgacaagtcttttgatttatgggttatgaatggagaagaatggactaaacaattcagtattgaatctattcctggagttgtcgacccattggggttttggaaaaataatgaactatttcttttaaatacaaattatgaagtagtcttgtttgatccctccacccaagagcttaaggtgcttgggatcaattcttacctggatcatcatcgagagtatgtctccctcttttttacgttgagagcctggtttcaatcagtggaatacaagag

SEQ ID NO: 11264 - DNA, 509 bp, Gossypium hirsutum
  unsure (1)..(509): unsure at all n locations
  Clone ID: uC-gsflmaxxa088f06b1
ctttcttcaaaatctctgctcccctctctttatgtggggttttttgacatccaaacgctccctccacactttaaaattttgatactcttttgcagtttgctccttataaaatctccctatctttctatgtatccaatgacaagttactatattgaacactaagcttttttttctaatttcctgaaacattttccaatggaaaatgacgataacagaggcgacaagaagagagcccgggaagagtttgagaattttgagtcagaggctaactcggttcccttcttaaaactctctcgagtccactcgcccgagtccactcgtgtggaatccggccttgattacgtggacgttcagttgccggagacaaagcatatccaggaggatttgctgaactttctggacgattccgacccggacattggacctgggctggggattcaaggacttgacttggttctcaaaagtttcgaagaagagattgtagttccgactcangcgacgctaccggt

SEQ ID NO: 11265 - DNA, 601 bp, Gossypium hirsutum
  Clone ID: uC-gsflmaxxa088f07b1
tccacgcgtccgatcttttcctatcttattggtttctttctctttcaaaactcaaagctcagcaagctaaggattccttaataataagaccatgaagagagaagagatagttgggtgtgacattggtttttacacttactttgcattcagcatttagcctctcagatagaatcaagatttcttaatctagtacctatagcaacatagaagtcgagaaccaagatacaccaatgcaagcatcccagcaacatagaagttcagtcatggccagcagattgtttcctcgagtaaaggaagaagtcgagccttgcagcttccctcaattcccagctattgatcgctctttctgctataccgacagcagccacggatcccatttcttagtcaagaattcccatgagccttattgcaccttggaatcatcttctgcatgtggcagttatagagtctacaattcttcatcaaatggaagcccaatgtcacagcaggaatcacagtctaatatgtctgacctgcatcactcttccgataatacctatagctctctcattagcgttctgcatactgatgatgtagtgatctgaaggtagctgagagagct

SEQ ID NO: 11266 - DNA, 489 bp, Gossypium hirsutum
  Clone ID: uC-gsflmaxxa088f10b1
ctttcatctttatttcagaatttgcttcctttccttcttccattattttctctcgtcaaagttctcaacttttaactctttttcaggatgggcagtactgatggaaccagctatggtgcttacacctatgatgctctggagagggagccttactggccatctcagaaactccggatttccatcactggtgccggtgggttcattgcttcccacattgctcgacgtctgaagagtgaaggccattacatcattgcttctgactggaagaagaacgagcacatgacagaagatatgttttgtaatgaattccacctcgttgatcttcgagtcatggagaattgcttgaaagtttccaaaggagtggaccatgtcttcaacctcgctgccgatatgggtgggatgggtttcattcagtcaaaccactctgtcattatgtacaacaacactatgatcagtttcaacatgcttgaggctgctaggattagtgga

SEQ ID NO: 11267 - DNA, 426 bp, Gossypium hirsutum
  Clone ID: uC-gsflmaxxa088g01b1
gctttttaagaaccggaggtgtctccgaaatggggatagaaatgaaagtgagtgttacgatgatgatgatgatggtgaagagagtaaagaaatcgaagaatttaatttattagggcatactatgtgcctcaaaaggggaagagacggctgttcttcttcttcgtcgtcaaagcgaatgacgccggagcccgatctcgagacgagaaaagcggccgtgaaatcatggggcaatcaaccactcagtgtagcggatcccgacgtgttcgacatgatggaacatgagaaaaagaggcaattcatgggaattgagttgatagcttccgaaaatttcgtttgccgggccgtcatggaagcactcggaagccatttaaccaacaaatactgcgaagggatgccgggagcaaggtactatggagggaatcaata

SEQ ID NO: 11268 - DNA, 367 bp, Gossypium hirsutum
  Clone ID: uC-gsflmaxxa088g03b1
ctttcttgtccgcccacgcgttcgcgcctttcgggtgcacataacactagaaaatatctctcttcactttcttctcttttcaacgcacagtgaatggcggggaggccgtagacaatctctcttgcgctcttctcgtagaatggatcagattcaacatccatctgtcatgccgaaggtagctggccagctcctttcttctagcatttcccgagattttcaagggtatgatgggtctttcaggaggcctgctatataccatggacattttgcatatgggaattattccaatgctggaaggcactatcctattgttgcatcaacagctaccgccatttgtgttcaagcccctgcacagaaaggatttacc

SEQ ID NO: 11269 - DNA, 573 bp, Gossypium hirsutum
  unsure (1)..(573): unsure at all n locations
  Clone ID: uC-gsflmaxxa088g04b1
cccacgcgtccgctccatcgtaagggcgaagcatacaaattattttggcctaatcaaccagaatttgtgagattcgcagcacaatttggggcaaccattgtaccattcggggctgtaggagaagatgatatggcaaaagttgtctttgattactatgactatatgaaaatccctatgcttaatgatagaatcaaagaagtcattcggaacggtggtgtacaaataagggataaagcaaagggagaggtggctagccaagagatattcataccgggaatgataccgaaaattccgggtcgattttactatctgtttgggaaaccgataaagctgaaaggaagggaagatttggtggagaatagagaatctgcaaatgaagtatatttgcaggcaaaagctgaagttgaacgctgtattggttacttgttaaagaagcgagaagaagacccttttagaagtatcattaatagactaatctatagaactttctatgctnctttacaccaagttccttctttcaagccctgataacanaaataaaaaatggcactggaatatatccatctttgattc

SEQ ID NO: 11270 - DNA, 486 bp, Gossypium hirsutum
  Clone ID: uC-gsflmaxxa088g06b1
gacacattgtttttcccttcgatcgtattattttttctcaattaacacttcatatttttcttgttctttcaagaacctaactttttgaagcacatgattggtttgcgtcgtttcattttcttcttcttcgaataaaaagaaaaggatgccagatttgaaagggggaattcgacgatcaaagaggatcaatgacaaccaggagacccctgctgtcttagctacaactgctcagcgtggtggtgctaatagaggtcgaggtcgaggtagaggacgcagagcaatgaaccaggatgacaatgcagtgcttgttggccctggtgcttgtggcaggggttgcagtggattaaacttgccagtgaagcacccggttgagaaaactgctgaaagattggttgctgttgaggaagaaggaagcactagtccacttcctgaaagggtacaatttggtaactcttctgtgtacatgttggatagaaagttgggtaa

SEQ ID NO: 11271 - DNA, 509 bp, Gossypium hirsutum
  Clone ID: uC-gsflmaxxa088g07b1
tttattctctcatcccttgttttccttctaagccaaacgaaatctaatcatttttgaaaaatggcaccaaaagctgaaaaaaagccagccgagaagaagcctgcggaggagaagaaagccgtagctgagaaagccccggcagagaagaagcctaaggctgggaaaaagcttcccaaggaaggcggagcggctgccggagacaagaagaagaagagagttaagaagagcgtcgagacctacaagatctacatcttcaaggtcctgaagcaagttcaccctgacatcgggatctctagcaaagctatggggatcatgaacagtttcatcaatgatatcttcgagaagcttgctcaagaagcctctaggctcgcgaggtacaacaagaaacccaccatcacttccagggaaattcagaccgctgttaggcttgtacttcctggtgagcttgccaagcacgccgtttctgaggtaccaaggccgtgaccaagtttacttcatcttgaaaaggc

SEQ ID NO: 11272 - DNA, 436 bp, Gossypium hirsutum
  Clone ID: uC-gsflmaxxa088g08b1
tgtttgctttcatttttattcacttcaagcggtttacacagtttacagccatagaagcaacaacaatgtggagatcaatcataactttcattctcttcgcctttcttttcttccctatttcagcgacgaagataacactctacaacaaatgctcacatccagtatggccagggattcaacccagcgccggcaagccaattttagcccgcggtgggttcaaactcccaccaaacaaagcctactccatgaatctacctgcgttatggtccggtcggttctggggtcgacacggttgttcctttgacgcctcgggtcacggccgttgcgcgacaggtgactgcggcggttccttattctgcaacggactcggcggaacctcaccccgtacgttagcggaaatcacccttcgccaacaacatgatttctacgacgtcag

SEQ ID NO: 11273 - DNA, 471 bp, Gossypium hirsutum
  Clone ID: uC-gsflmaxxa088g10b1
ttctacgcgtccggaagatatggagaagcaggtggaaatagacgatgctgaatttggtgaaggaatccccgaaacctacagacctgcattaatggctggagactcgcagcatcccgaggatttctttgctgaattggatgagatagagacagaccctctgaatctattgttcccacaaggattcggtggtggtgatcaagatgagcagaaagaaaagaaaacaatggatccttttggtctgtttgattggccaccagggaacaacgatgcttccttctgaaagacgccaaaaaagggtttatagcaagaccttgttttagcagcaacaaatttccacactaaacaataattcaaggtcctcctataaaccttattagtggaatattattataacttgaaaaatctctttgggggagtcctaatgttatagttatttaccagaatagttcggagatagaagagggggggggg

SEQ ID NO: 11274 - DNA, 521 bp, Gossypium hirsutum
  Clone ID: uC-gsflmaxxa088g12b1
gatccgtcccaaggagccttccgtggcaaatttcgatccatgcagtgactactatgtatatgcttatctaaacagggttgatgttcaagaggccatgcatgccaatgtaacaaaacttgaccatgattgggaaccctgcagcgacatcatcagaagatggggagatagcccttcaacaatcattccccttctacaagagttaatggctaacggactaagagtgtggattttcagtggggatgcagatggaagaataccagttacttcaacaaagtactccattaagaagatgaagcttgcagttaaaaccaagtggcatccatggtaccttgatggtgaggtgtgaggttatactcaggtatataagggagatttaacatttgctactgtaagagccgccgggcaccaagtgccaagcttccaaccaaagagggcactttcattgatcaagcactttcttgacggctcacctctttccgataccttaaatataactgatttcctctcacgttttagatatc

SEQ ID NO: 11275 - DNA, 413 bp, Gossypium hirsutum
  Clone ID: uC-gsflmaxxa088h01b1
cccacgcgtccggttcccggtgcttcccaatggtgctcgcatttatcctgcgtcaggaagtgcttgcctccttccgatcatgctcaagcctaatgaagatcgtagagtgatcccctccgaggttttgatatgcggtggcgcatcacatgatgcgtataccaaggccgatttgcagcgccctaaggtgttttttctagggaacaccgactgtgctcgccttgatatcaccaaaaggaatggcaaatggaagatcataaacatgccgtcagctcgtctgttgggagatatggtcgttttaccaacgggagatgtgcttattgttaacggtgccaagaccggttcagcaggttgggatgatgctagggagccgaatttgaaccctgttttgtacaaattccaaactgatggaactg

SEQ ID NO: 11276 - DNA, 512 bp, Gossypium hirsutum
  Clone ID: uC-gsflmaxxa088h02b1
gtttctctggtttaaacatgggtatgggtttaaggggtggatttcttttgattttatcttgtgttgttacactttccctctcagtttgggggcgacctgccactttccttgaagattttagaatcacttggtctgattctcatattaggcaaatcgatggagggagagccatccaacttgttctcgaccaaaattcaggctgtggatttgcttctaaaaggcagtatttgttcggacgtgtcagcatgaaaatcaagctcatccccggcgactccgccggaacagtcaccgccttttatatgaattctgatacagatgctgtgcgagatgagctagacttcgagttcttgggaaaccgtaccgggcagccatatacggttcaaaccaatatctatgcccacggaaagggtgacagggaacaaaaggttaacctttggttcgatcctgctgcagatttccatacttactcaatcatgtgggaccatcatcagattgtgttctatgttgatgaa

SEQ ID NO: 11277 - DNA, 494 bp, Gossypium hirsutum
  Clone ID: uC-gsflmaxxa088h03b1
aaaaaatcctctctcgtttcttctgaaacggaagagaggaaaagaaaaattaaaaggaaaaaaaaaatcattgcaatttcctcctccttctctctgtccctgcaacagccgttcaaagatctataaactttctctcctcaggattttagggttttttttttcattttctactgtaaactccaaaatgcataaactgggcagaggccatcgggacaaagtccagcagttcatgactataactggagcgagtgaaaaacttgctcttcaagctttgaaggcgggtgattggcatcttgaaggagcttttgattttttctatggccagcagtctcatattaaaagttataccaatactacacatttggaagaactttataaaagatataaagatccttacacagatatgatactggttgatggtattactcttctatgcaacgacctgcaggtggatccccaagatatcgttatgttagttgtttcatggcacatga

SEQ ID NO: 11278 - DNA, 476 bp, Gossypium hirsutum
  Clone ID: uC-gsflmaxxa088h05b1
gctgagtgtttctttcgttttcttttgttttaagttttggagtaaagagtgtttcaagcttcttagtcctattggctgcttaacgacctaagctagccccgccggatatagttatcaggtgctcatcataaaaaatgactgtcacgccaggaatttccatcaacgatgggaaccttgtggttcatgggaagaccatcctcactggaatgcctgacaacattgttttgaccccaggatccggtgtcgggcttgttgctggtgcttttataggtgctactgcttcggatagcaaaagccttcatgtctttccaataggtgttttagagggcctccggtttatgtgctgtttccgtttcaaactatggtggatgactcagagaatgggaacatgcgggaaagatgtccctttggagactcaattcatgctcgtagagagcatggaagaagatgatcctaatgccccaacgatctacact

SEQ ID NO: 11279 - DNA, 355 bp, Gossypium hirsutum
  Clone ID: uC-gsflmaxxa088h07b1
gtttcagttagtgtaggggttatgaatttggtggggtgttggtttggggcaatgccagtgtgtcatggtgcgggtgggttagctggtcagtataggtttggggcaaggagtggatggtcggtggtatatttggggatagggaagttgataattggcttggtatttgggaactcctttgttaggattttgaatcaggttcctatagggattcttggagttcttttattatttgccggcattgagttggctatggcctcgagggatatgaactcaaaggaggagtcttttgccatgttggattgtgctgctgtatctttgacaggttctagtgctgcattggggttcgtgtgtggga

SEQ ID NO: 11280 - DNA, 469 bp, Gossypium hirsutum
  Clone ID: uC-gsflmaxxa088h08b1
tattacccctaaatgaccatcaagctgatggcaggggacacaatactcacaatgtttgctcttctaatggcagcacacttcaaatcaatatcttcaacaaaccttccaccaaaggacgaccaagatcttcgtctcgccatggaagagatgcaaaaagccaattacttcacctttgtaatgttgctcaacatgttgcccctcgacccaaagttccttgctaacgtaacttttttaatgcccaatgatcggatgttgtcaaaaacggtaataccagagaacgcggtttccaacttcttgcatcgtcattcaatcccttcaccgctaattttcgagcatcttttatatatcccgacgggttcgattcttcccagtttaatgccagagtacttgatgaatgtctcgaatggcggtggtcgaagaagtttcgtcctcaataatggtaaaatcattagcccgaatatatgtacta

SEQ ID NO: 11281 - DNA, 527 bp, Gossypium hirsutum
  Clone ID: uC-gsflmaxxa088h11b1
ttggtttgtggggtatgtgggcatagagctgcgggtttatttgacaaaacgtcgcttcaagtcagtgctttcccctccgtgatattgcctgattttctttatttgggtagctacgataatgcctctcgttctgagcttcttaagactcagggtattactcgtgtcctcaatactgtacctgcttgtcaaaatctctacaagaattcatttacctatcactgcctacaagatgacaaaattttgcaatttgatgatgctgtacaatttttagagcaatgtgagagagataaggctcgagtccttgtgcactgcatgtcaggaaaaaataagtcaccggctattgtaatagcttacttgatgaagtctaaaggatggaggcttcaaccgagctatcagtgggttaaagaacggagatcatctgctgagttaagtcaagatgcgtaccagcaattgcaggaatatgagcacaagctctttggatcatgtgataatagcaatcttgcaggagccccatccttcaactttgg

SEQ ID NO: 11282 - DNA, 369 bp, Gossypium hirsutum
  Clone ID: uC-gsflmaxxa089a01b1
cccactcgtccgaaatttctgaaactttttttggggggaatttttgaccacagtttgcgttcgcaacggtgtcgaacgagttcgccgataagggggacaagatcatttgatggaacccaatccaacgggtacaacccaggattgattgtattgctgggtattggcggacgactgataacattccttggggggaactacatactatactcgtacgctcagaagactcttcctactaggaaaaagaagcccgtatccaagaagaagatgaaacgagagaggctcaatcaaggaccctcagcaccacgggaataggaactcaaggtacgacttttctctgatttggacattgacaaaaaccgacgagctcac

SEQ ID NO: 11283 - DNA, 531 bp, Gossypium hirsutum
  unsure (1)..(531): unsure at all n locations
  Clone ID: uC-gsflmaxxa089a03b1
cggactcgtgggcgaattttgaatccagtaacaaatggattttgttgaacactttcgaaaagttaaggcacgttcagatcgcagtgatggccaatgctgacgtggaagcggtggatttcgagccggaggaagatgacctcatggacgaggacgccgccggcgacgcctcccctcaagctcccatgcctaagctcaagtccgccatcactggcggtgcttcagcctctctttctgcccctaagaaaaccaagggccgtggcttccgcgaggaagatgctgaccgccactcccgtctcgcctctcgcgacttcgagtcccttggcactgatggtggcctcggtccccagagatctattgaaggatggattattttggtcagtggtgtacatgaagaagcccaagaggatgatttgcacaatgcatttggtgaatttggtgagatcaagaatttgcatttaaatcttgatcgccgcactggatttgtcangggatatgcactgattgatacgaaaagttgaagaacaaagaatg

SEQ ID NO: 11284 - DNA, 565 bp, Gossypium hirsutum
  Clone ID: uC-gsflmaxxa089a04b1
ttttgaatctagggatttgcgggtggagaagacgagggctcatctctcttcttcaaagctcctgtccgggtagaattctcttcttcctttgcgttgtgttctttggtggtcaatcgccatggcttcaaagcggattttgaaggaactcaaggatttgcagaaagatccacccacttcttgtagtgctggtccagtagctgaagacatgtttcattggcaagcaacaatcatgggaccctcagatagcccttatgctggaggtgtgtttttagttactatccatttccctccagattatcctttcaagcctcctaaggttgcgtttaggaccaaggtcttccatcccaacatcaacagcaatggaagcatttgtcttgatatcctcaaagaacaatggagccctgcactaaccatttccaaggttctgctctcaatctgctcgttgctgaccgatccaaaccctgatgaccctcttgttcccgagattgctcacatgtataagaccgatccggcccagtatgaagccactgctcgtagctggacccagaagtatgccatgggatga

SEQ ID NO: 11285 - DNA, 575 bp, Gossypium hirsutum
  Clone ID: uC-gsflmaxxa089a05b1
atatttataaaatgaaaaagttagggttttagaatggattgaatgtcggtgctacaactcataatttctcaagaactgtgctgaagtagctgaaagatctaagaaaggttttttttggtttaaactggactgatccgggatggcagagcggggtgtctgccggcaagttaaattcctaaattctcaaggagatagcactgccaaatcgttgcctgcaaaaattgaggaagaatatgatgaagatgataaaaagcatgtgaaaactatgttgatttcatgcccagaagtacggaagagaaaatgcctttcctccaaccaactgagaaaagaaaaagctgcaagatgtgggaaacaaagcttaagtaatggttctaacaagggcaagcaaaacaaacataaaaatactgtagagagatggtctgctgaaaggtataatctagctgaagaatgcatgttagagatcatgaatgctagaggcgctgtgtttgagaatccaatatctcggcctgctttgagaatggcagcccgtaaacttattggtgatactgggctattgggccatctgctgaacacat

SEQ ID NO: 11286 - DNA, 538 bp, Gossypium hirsutum
  Clone ID: uC-gsflmaxxa089a06b1
gttacatgaacagctgccatgtcctcaagagtttatgtgtcctctttctaaaaagcttatgagagatcccgttgttttatcttctggtcagacatatgaaagacccttcatcgagaaatggctgaaagcaggcaatcggacttgccctcaaacccaacaagttctttcccacacagttttaactccgaatcaccttgtgagtgaaatgatatcgcagtggtgtaagagtcaaggaattgaattgccggacccagttcagaaccgtatacaggagggtgtcaccgaagcagagcgtctgcatttcttttctttgctagataagttatctgccgccgcgcttcctcaacagaaggaagcggcgaaggagctgctgttgttgactaagaacatgccttcgttccgctccctttttgaggaatgcgtggacgccattcctaactgctcaccccactctcgggaaccaaatcccgagtggtgttcttacactgatctccaggaagatgggataccacgctgttgaacctttcaatccatgaca

SEQ ID NO: 11287 - DNA, 487 bp, Gossypium hirsutum
  Clone ID: uC-gsflmaxxa089a07b1
cacctctaagagtttaccgatacatatgggtaacatcttcaatctttgttttccaaaattaccatgccaaagccattccatttgttggtcttcttccttgttgctctttgtctatgcaccagttcaaatgccagcagtactaccaatgagttcctagaaactgagtgcttgaaagtaccagcaactgagtttataggttctttgaaaaccaccattgatgctattcgaaaagctacctccgttgtttctcaatttggcggcttttttcatgattttcgtctctctaatgccatttctgattgtcttgatctgcttgactcttctgctgatgaactaagttggaccatgtctgcttcccagaatcctaatgctaaagataacagtactggtgatctaagttctgatttaagaacatggataagtgctgcaatggttaaccaacagacatgcattgatgggtttgaggtacaaatagcatggcaaaact

SEQ ID NO: 11288 - DNA, 512 bp, Gossypium hirsutum
  Clone ID: uC-gsflmaxxa089a08b1
gtgagaaaacgccttcaaaaaagaaaagaaaaaaactgaaaaagaaggaaaaaaaatagtaggaaataattaactttcgatttagaaacattggatttcaaatctcagttcttcaatttctgaaaggaacgggaggttgttggccatggcaaattctaaaggttcaacaaacataaggaactttatggtttctggaaagcatgctttactccctccgaaaagtccatttcccactgtttccccagcatatactgattatatccctaacagtgttattgggtcaaaagcagttcaaaagcctagagaaggaaatatacatcaccaacgcacttgctccgaaagcctccgaatggaggaacagccttcttggcttgacgatctccttaatgaaccagagactcctgtgcgcagaggaggtcatcgacgttcttcaagtgactcttttgcatatattgatgcatctagtgctcctaacctagattatgcagctcaagatgagttcagatttcaaa

SEQ ID NO: 11289 - DNA, 542 bp, Gossypium hirsutum
  unsure (1)..(542): unsure at all n locations
  Clone ID: uC-gsflmaxxa089a09b1
cttataaatgcccacttctttttttctttttttgtcttgcttcgtttaaagggtgtgaggagtatcaaaggaagaacattgggagagaggggagacaagaggaaaggaagtgttggccgttttggctgtcttccttgttgagtgttattgtttctttcttctttgcttacatggtgcgagtcatagagagaagaaataagattaaaaagacagggaaatagataatatttatagacagatagattgcataaaaaacaatagacaatgtcggcttacagagacaaagatccccgtattcatggcatccaatccaagattcgtgttgtccccaatttccccaaaccaggtattatgtttcaagacataactactcttttactggatcctaaagcattcaaggacacagtggatttgttcgttgagagatacaaagggaagaacatttcagttgttgcaagtatagaagctcggngttttatcttcggtactcccattgcattggaaattggagcanagtttgttcccttgagaaaaccaacaag

SEQ ID NO: 11290 - DNA, 556 bp, Gossypium hirsutum
  Clone ID: uC-gsflmaxxa089a10b1
tccacgcgtccgattgaagcttttcaaacttcagtggtccatggcgttgtcaaattccctttcctttccttcttctaacgccgtcgacctccgacgttccacggttcccgattccggcatcgccccttttttcacttcttttgactgttctagattccgctgcaacttttctcagtgcggcattaggcccaatttctctgcaagaaaacgcattgtttctgctgctaacaatggtttcaacacggttaattcaacttcattggggactggccaagataaagatgattatattccaatgccaattgttttgattgatcaagattcagattcagaagcaacagttgtgcagctgagttttggagatcgtttgggtgctctcattgacacgatgagagcattgaaagatttgggattggatgttgcaaagggaactgttgccactgaaggaccagtcaaacaaacaaaattttttatcacacgattagacaatgggcgcatagttgaagatcctgatctgttggagagaattcgactcaccattataaacaatcttttg

SEQ ID NO: 11291 - DNA, 547 bp, Gossypium hirsutum
  Clone ID: uC-gsflmaxxa089a11b1
tttatgcaaatggtggcaacagcagcagccatggatgatcggcctagctgctttaggtaccccagaggcaatggcattggttctattctcccaccaaacaacaaaggaacaccattagagattgggaagggaagagtactaagagaaggaagtggcagggtggccattttggggtatggaacaatcgtacaaagttgtgtgaaagcagctgaacaactacaaatgcatggcatctccgcaacggtggcggatgctcgtttttgtaagccaatcgacggagatttattgaaacaactagctcaagaacacgagatattaatcaccgtggaagaaggatcaatcggagggttcagcacccacgtctcacatttcttgtgcttgaatggactactagatggcaagcttaagtggaggccaatggtgctaccagatagatacattgaccatggatctcaaagtgatcaaattgaagaggcagggctgagctcaaagcatattgctgccacagttctttcactactggggataaactagggaagcaaatgta

SEQ ID NO: 11292 - DNA, 362 bp, Gossypium hirsutum
  Clone ID: uC-gsflmaxxa089a12b1
ctcttagatgtcactgtaagaaaaaaaaggaacgggacatgaataacaacactgatgtaatcgctgctctaacacacaccttgaacttgaagcacatcactccagagagctctacatacgggccgtgaccaacaccaccgaagagccacatgcctgcccacaaaagcccaccgtgagaaccacatcagccatacgctcgaccgagagtttcactgcaactaggcatgagagctaacgccttcagatcaatacacggtgttactggaccgtatgggaccaaatgctgatctcgcatgcttattttgtacaccctcaacactgttgctacgcattagcgctcctactgaagctaacagtgttca

SEQ ID NO: 11293 - DNA, 433 bp, Gossypium hirsutum
  Clone ID: uC-gsflmaxxa089b01b1
gcgcccacttcgtgcgcccacgcgtccggcgttgacaggattgagtttttgatggagcatgggtggccttggcttctagtgggcacttgccgctaaacaaatttcgaggaaaaattggggaaaaccatatttaagacgcgaaacttgtaaggagtaaaatgccttaattggttacttgggatggagataaaaacgtgttaataagatcatctatcgggtttggggctatgtcttgaagtgttggttggaaaaaaaacttggtttactatcctaattatctatccaatgctcatttgcctaagttgctgttaaaagtcagcagccggcagctgaaactaaagtatatgatgtgggctcgacccagttactctgtggatgagctttagaggtgtcgttgacatggttatacaggtatgttgtgcacacagtcgtt

SEQ ID NO: 11294 - DNA, 564 bp, Gossypium hirsutum
  Clone ID: uC-gsflmaxxa089b02b1
gccacaccatgaaattggttgagatggagggttcccacacaatgcagaatgactatgactcccttgatgtgcatgttggacagtgcttcagtgtgcttgttactgcccaccaggaaccaagggattactatgtggtggcctctacccgttttaccagacgtgaggttacagcaactggcatcatccgttacaagaatggtaagggagctgcctcatccgagttgccaccaccacctgttggttgggcttggtcactcaatcaattccgtaccttccgttggaacttgacttctaacgctgctaggcctaaccctcagggctcctacaaatatggttccattaacattacccgcaccatcaagcttgccaacactgcacaaaaagtagatggcaagctccgatatgctcttaatggagtctcctatgtcgaaccaaccactccactaaaacttgcagaatactacggcgtagccgacatggtttttcagtatgataccattcccgatgagccacagagtgacaacactaatgtaactttggcacctatgtgctgacatgacacac

SEQ ID NO: 11295 - DNA, 476 bp, Gossypium hirsutum
  Clone ID: uC-gsflmaxxa089b03b1
aaaaaatatttgagtgtttgattttaatttaagaaagatggggaaattaatttccaaaaggcttggagtgtttgtgatgatatttgtgtttgctataggtatagcagaatgtagaaaacttgagaaggaaacccttggaggtggttttggtggaggcgtctgaggaggggttagtggtggccatggtggtggtttatgtggacacttatgaggtggttattgtgggcccaaaagatgcatatgttggtgatgaggcttaatctaaaagaggtatttttacattttaataccccattgtgcacttgttctttaacaattgtgattatcttcgaaagatttgatgttattcctatttcttctggttgtgtgttgccccaaaagagcaccctgttttacttacctaagcttcccttaaccccttgggctaccgttttaagatgacttcatattatgattgcgaccttttaattacctgc

SEQ ID NO: 11296 - DNA, 272 bp, Gossypium hirsutum
  Clone ID: uC-gsflmaxxa089b04b1
atttttatcgacctgatgccgccacagatgattgggggacattccgatgcgatttgtactgcacagaaaggcacattccgcgccgagtaatccgattctaccactcggcatcactatcatgctttggccttggcttcatggaggatgctcccgggagcggatccactgttctgctgactatgtagagccatagggccagatcaaggcctagcactgaatgagaggcggatcaacaagggatgaggggaatcacctacaccagtcacttcact

SEQ ID NO: 11297 - DNA, 549 bp, Gossypium hirsutum
  Clone ID: uC-gsflmaxxa089b07b1
ttgtgaaatcgccttcaaaagagaaaagaagaaaactgacaaagacggaaaaagaatagttggaaataattaactttcgatttagaaacattggatttcaaatctcagttcttcaatctctgaaaggaacggtaggttgttggccatggcaaattctaaaggctcaacaaacataaggaactttatggtttctggaaagcatgctttactccctccgaaaagtccatttcccactgtttccccagcatatactgattatatccctaacagtgttattgggtcaaaagcagctcacaagcctagagaaggaaatatacatcaccaacgcacttactcctaaagcctccgaatggaggaacagccttcttggcttgactatctccttaatgaaccagagactcctgtgcgcagaggatgtcatagacgttctccaagtgactcttttgcatatattgatgcatctagtgctcctaacctagattatgcagctcaagatgagttcagatttcaccatatgtttaacacaccatcttgggcatctaaagatgc

SEQ ID NO: 11298 - DNA, 539 bp, Gossypium hirsutum
  Clone ID: uC-gsflmaxxa089b08b1
cttttctctctcttatcttcttcttcatctctctagactggttttttaaaagcttttttcagcttttttttgttgttccattcctgccatggattcatatgaagcaacgaggatagtgttttctaggatccaaaatttagaccctgaaaatgcttctaaaatcataggttaccttcttcttcaagaccatggtgacaaagaaatgatacgtttagcttttggacctgaagctttaatccattctttgatctttaaagctaaaacccatctaggtctccccatttctaacccgccttcgccgtctcctcctccgccgttctcttacgccggtgtcgttaatgggtgtgccaaatctttgcatggtgtggccgccgacgacaatggtggattcgtggatgattttcagtttcaagaacatgtttcggattatttgaccggcggtagtgggggatacgccgattcgactttacatcgacggagtttctcggttccgggactgtgtttaaccgtgaagatctgaaaccttgtttgattttgct

SEQ ID NO: 11299 - DNA, 559 bp, Gossypium hirsutum
  unsure (1)..(559): unsure at all n locations
  Clone ID: uC-gsflmaxxa089b09b1
tttccccgctctctcttttatcctcactttctcagccatcaaagacacccttttcttttcttaaggttgtaaaagatggcagatggtgaggatattcagccacttgtttgcgacaatggaactggaatggtgaaggccggatttgccggtgacgatgctccgagagccgtgttccctagcattgttggccggcctcgtcacaccggtgtgatggttggtatgggccaaaaagatgcatatgttggtgatgaggctcaatctaaaagaggtattttgacattgaaatacccaattgagcacggtattgtgaacaattgggatgatatggaaaagatttggcatcatacattttacaacgagcttcgtgttgccccagaagagcacccggttttacttaccgaagctccccttaacccgaaagctaaccgtgagaagatgactcatatcatgttcgagacctttaattcacctgctatgtatgttgccatccaggctgtgctctctctgtatgctagtggtcgtacaaccngtattgtgttggattcgggagatgtgttag

SEQ ID NO: 11300 - DNA, 485 bp, Gossypium hirsutum
  Clone ID: uC-gsflmaxxa089b11b1
gcggtccttgaacaaattatttcctcttcaaaccctagatctggggttttattttatcttctccctctctattttcccctcccttttcaaaattttcattttttgccctattttattgtttttcgacttatcaaaatcacaagtgcaaaaaagaaaatctcatcttttcttgaatctcagagaatgggggaattaaaggacaacgacgcctacgaggaagagtttctcgactacgaagaagaagatgaaaaagcccctgactctgccttcactaaggctgctgattctgctaagaagttagtcattttaatttatacattttttaaggaaaacaatcattctaatttatacatttttttaaggaaaacaatgttctaatataatctgcaagtattagtgtaaagcaatttgattttaatttgtttcatttcttttttatgtggtgtaagtggtatgttccgattcacagttccggattcagtgac

SEQ ID NO: 11301 - DNA, 401 bp, Gossypium hirsutum
  Clone ID: uC-gsflmaxxa089c01b1
aggtcattggcaacaatattgcctgccatgaaacgctggttgccaaagcttaggaatgaggacctcatcattgggcgccatccatacttacgatctgtggggaaagagctcacaaggtctcaggtcatagctgcaatccctggaaccttgttatgcgcatagaacgcttcacagaagcctaggctggctcataatatgctgagtctggcttgcctgattcagggaattgcaatgctttctcttggatctcttaatattggagccatagtcttgactgggctttttgcatatgagataatatagggttctaccactcccgagaggcatagtgttgcaaaggctccagaggcgcctataaagcttccggtgccaacaacagactcttgacgaccgttatccat

SEQ ID NO: 11302 - DNA, 454 bp, Gossypium hirsutum
  Clone ID: uC-gsflmaxxa089c02b1
cttggttatcaaagactgcccttgagccttctcttgtttatgaatatggccttcttttttctcacaatgagcttcagaaggaggatttagcctatttcagccatgaagttctttcagagcatgggaatttcagttgctaagcataggctggagattctcaaggttgctaggaaggaaattggggaaccccctaagagcttgtccaagctcattttagcaattaacaaaacaagaaagtgtttcaacaagtatgtcaacaagttggttcatcatgataacaacgtgattaaaccgttgccagggccagagccggttcgtcatcaagatcagcggagactagcggtggcgttgttacagaaaggtagcaagaacgagagggaggtgaagatagagcagccgatggtgagaacaaccaggaaggtagcaaaatctggtcccttggactatagaggac

SEQ ID NO: 11303 - DNA, 340 bp, Gossypium hirsutum
  Clone ID: uC-gsflmaxxa089c03b1
gctccatagattgaatcaaattctctgcagtttcttttttttttctttttaatttcttgagctgtgtggaacgaagagaagcttaattattgcttggtaattcgagtggaagagttgaaggaagagagaatgtggggatttggggggagatattattgggggaggatggtaagtcagctatggactatacaatgatgaagcgtcctggcagtcatacacacatatttctcgattgtgagacctttgacttccagaaggggaaagtttccctcgatggataggacgattacattgtgggaggaacaagagatttgcctaacttgctggctgacgctttcaa

SEQ ID NO: 11304 - DNA, 284 bp, Gossypium hirsutum
  Clone ID: uC-gsflmaxxa089c04b1
ggatggtgaagcaacatagtttaaaactctttgaggatggtgtgatgcattgctctctacaataggatttaggtttttcttttttaaagttgggatcaagcagctaacatgggaagatatggaaaatggttaccaaaaaatatataatattttccattcccacatgctgaaattcaatgattcaccctggttagttgctgataccctctaaatgtacaagttttttttttttttcaattgtgtgtaatgtggcggcacggtggtggtggcggtggtgggaggag

SEQ ID NO: 11305 - DNA, 553 bp, Gossypium hirsutum
  Clone ID: uC-gsflmaxxa089c05b1
gctgattcccctccttacggcatcgatactcccaggcgtcgtgccagcggtcgcttctcaaatggcaaaaacattcctgattttatcagtgatgcacttggttcagagcccaacattgccctacttgagtccagaactcaagggagataggctacttgttggggccaactttgcgtcagctggcattggaatcctcaatgacaccggagtccaatttataaacatcatcagaatgtacaagcaattaaaatactttcaacaataccagaccaggttggctgatcttgacagattcgaggaagcacagcggattgtaaacgatgcacttgtgctcatgactgtcggcggcaacgatttcgtgaacaactactatttggttccattctttgctagatctcgccagtttagtctaccagattatgttcgatatctcatctgtgagtacaggaaacttctgacgacgctatatgatctaggagctcggaaggttctggtgactgtgaccggaccaatggtttgtgttccagcagaattagccatgatgagcccaagt

SEQ ID NO: 11306 - DNA, 209 bp, Gossypium hirsutum
  Clone ID: uC-gsflmaxxa089c07b1
aaactctaatgttttgtcctactatgtgttatattatgtgcctacttaagctacctttcccggttatcaagagtgcctatatagaactctctctctctcaaaaaaaaaaaaaaagagaaaagagttctttatatggagttttatattatatgctgagagaataaattatcttgtaaaagcttgctttgttaatgaaataaatttctatt

SEQ ID NO: 11307 - DNA, 458 bp, Gossypium hirsutum
  Clone ID: uC-gsflmaxxa089c08b1
gcgtccacgcgtccgggctggcaatgaatcacatgctgccatgactgactatgacaggactgagaaggatattacaccaattggtggattcccccattatggagtggtgaaagaagattatttgatgattaaagggggttgtgttggaccgaagaaacgtgttgtgacattaaggcaatcactgttgaatcaaacatcaagggttgcacttgaagagatcaagctcaagttcattgatacttcatctaagttcggtcatggtcgtttccagacaacacaagaaaaggccaagttctatgggaagcttaaagcttgaccgcatagggatggttttttatggagggattgtttgttccattttctgattgcccacaactttgaattttgttttttcgttaaaccatgatgagttttggacaattatcttttattatatcgattaatgtgtttttatggcc

SEQ ID NO: 11308 - DNA, 532 bp, Gossypium hirsutum
  Clone ID: uC-gsflmaxxa089c09b1
atttaagagaaaaaaaaaactcttaagtccatgaattatcactacaatctctttccccttattttctctccaaagaagccctaaattttctcagcctttcttgctctttcccctcgctttctcgggaaaaaaaaatggcaaacgcggcttcaggaatggctgtgcatgatgattgcaagctgaagtttttagaactgaaggctaaaaggacttaccgcttcatagttttcaagattgaagaaaaacaaaagcaagttgttgtggaaaaggttggtgaacctactgatagctatgaggctttcactgctagccttccagccgatgagtgtcgatacgctgcgtatgactttgattttgtgaccgatgagaactgccagaagagcagaatttttttcattgcctggtctcctgatacatcaaaagtaagaagcaggatgatctatgcgagctcaaaggacaggttcaaaagggaattggatggcatccaggtagagttgcaagctaccgatccttccgagatggatctcgatgt

SEQ ID NO: 11309 - DNA, 506 bp, Gossypium hirsutum
  unsure (1)..(506): unsure at all n locations
  Clone ID: uC-gsflmaxxa089c12b1
ggattaacaaaattcgagttccccaaaaggaaacatcaacaaagccatggctgaaactacttcttcaacatcatcccccaagcatctccagtcgccaaatcccttgttgatggacccttcatcatcggttccgacaccgccaccgtcatcggcggcggcgtcaaatattaacccgacgcagacggcgacgccgctaacagccccatctccgacagcgacaccaacaacaaatccctcaattgatccctcactgcaaaatttgcagcagcagcagcagcaaatctcgcaaatttcgtctccgcctctttcaaatctcgcccaacaacaacaacaacagcaaatcttgcaacaacaaacgcaacaaggtgttgggggtttatcaaattttcaagtgcagcaaaacctttaaagatcgccgtcaatntcacgtattaatcaactccaacaccccaaggaacatggtcatcactgatccccgcccaagttcttctgggtgaattttctga

SEQ ID NO: 11310 - DNA, 662 bp, Gossypium hirsutum
  unsure (1)..(662): unsure at all n locations
  Clone ID: uC-gsflmaxxa089d02b1
aggaaaagaacaaaccagaaattaacccaacccgaagtgtaaaaaacccaaagaaaaaaaaacaacaaaggnngggcgaatttaaaaaaacaaaaacccccgtataaaacacccaaaaaaggacaacaaaaccacaaaacaacacaaaacaaaaaagagaaaccgccaccacaacaaaaacaagcaaaaacccaaaggaaaacaaaaaacagaaaggaaaacacacaaaaaaaacaaacaaaaacacaaaaaacaccgaaaggcacgaagaaagagcaaacaaaaaaaaaaagaaccacagagacaaaaaaaacaaaaacaaaaaacgcacaaaagccaaagaaacaccgaagaaaccaccaaagaagaccacaccagacaaaaagacagaaaaagaaaacaacaaacaagcaagaaaaacagaaccacaaaaaaaagaacaaacaagacaaacaaaaacaaaagaagcccaaaaacaaaaccaacaaaagaaagaacgcacgcaagagggagaaaaacaagcccacaggaaaaaggaaaacagacaccaaaagacaaaaaaacaaagaaaaggaacaaaaacaacagaaaaaaaaccaaaaaacggcagaaaaaaaaacaaaaaaacccagaaagacaaaaaaaaaaaaaccaggcaacaa

SEQ ID NO: 11311 - DNA, 571 bp, Gossypium hirsutum
  Clone ID: uC-gsflmaxxa089d03b1
atagaccaataattattagacaaatgaaagtttttgataggtttaaaattgtagtcatttttaatgattgagctttgagattatatcactcttttttttttttgtatgatgatgcaggagtgaaaattgttgtgtatcagttgaataaagaaaatttggacactgttctctcatggaggcgagtttacaattacagagattttccagttatggttgcttcaaaatcgaaccattattggattcctttccttctgttaaaactacacagtttaccccatggcgtagcaagtgctctgtcatttgtctttcacatagagttactgctagtgctgctgatttttccaagaggagacaaagaaggttgtctaaaggttcaactccaaagggtttcacttcgaaaacacgaatgagtactcagaagagaaaaccacaaaagaataatgaacagaaagaggattctagcattcccaagttgagtgagtttgtagagccatataataaggaaactgaattgaaagtagatgaagttgaaaataaagaaggaaaagaggatttatcatcaattggaaaa

SEQ ID NO: 11312 - DNA, 568 bp, Gossypium hirsutum
  unsure (1)..(568): unsure at all n locations
  Clone ID: uC-gsflmaxxa089d04b1
cccactcgtccgcggacgcgtgggcgaatcgcaaccatcaaggatcatccgcgaaatttcactctatggcacccataaagggcattctttccttgcaaagggcatctttgttaagagcttgcggtgaaaggtggaaactaggcactagatcatttagtactcaaggagcaacaactgctgatgctccacaggcacctcctcctcctccaccgcctgaaaaaacccattttggtggtctaaaagatgaagaccgtattttcaccaacttatatgggttgcatgacccttttctcaaaggtgccatgaaacgtggtgactggtatagaaccaaggatttagtactcaagggtgctgattggattgtgaatgaaatgaagaaatctggacttcgaggacgtggtggtgctggatttccatcgngcctcanatggtcttttatgccaaaagtatctgatggtcgtccttcttatcttggtgtcaatgctgatgaaagtgaacctggaacctgtaaggacagggaaattatgcgggacgatccacacanactatnggagggctgcttgattgc

SEQ ID NO: 11313 - DNA, 372 bp, Gossypium hirsutum
  Clone ID: uC-gsflmaxxa089d05b1
ccctctcgtccgttcagatccgattcttaaacgcatgcccatttaaacccctctttgatttcatcctcattccgatacaaaaacccaagggcttgctctggtttttaggcctctcaattcttcgtatagtcgatctaagtcatagagggagcttaagtgggatttgatgtgccaggcaaggtggaagcaagttcattggaggtttcaagggaacataacacttggagcgtttgtgatagatttgcctacattgcaggatgcagagagtggagcagaagacagttcttttttattcaattgatccaatatttgcttcagaagattgagtgacgatcctcgtgaggttggaaaatggattttgagactgatgca

SEQ ID NO: 11314 - DNA, 562 bp, Gossypium hirsutum
  Clone ID: uC-gsflmaxxa089d09b1
gcgcccacgcgtccgcccacgcgtccgcctgtattgggggacctaagagacctcatgatcgagttcctttgagagaaatgaaggctgattggaattcgtgtcttaataataaaggttggtttcaagggctttgccgtgccaaaagaggcacagggtaaagtagcaaaattttcattccacgggcagccagctgagcttaaacatggtagtgtggtgattgctgcaattacaagctgcaccaatacatcaaaccctagtgtcatgcttggggcaggtcttgttgcaaagaaggcttgtgaacttggtttacaggtcaaaccttggataaagacaagccttgcaccaggttcaggagttgttacaaaatatttacttcagagtgggctgcaagaatatctgaataagcagggatttcatattgttggatatggctgcacaacatgtattggaaattcaggggacttagatgaatcagttgcctctgctatttcagaaaatgacattatagcagctgctgtgctttctgggaaccgcaatttgagggtcgtgtcatgccttaaca

SEQ ID NO: 11315 - DNA, 535 bp, Gossypium hirsutum
  Clone ID: uC-gsflmaxxa089d10b1
gcgcccacgcgtccggaaaatctaatctttaaacccaaaatccaaattcagaacccttattttttcttttcaaaacctttcaaaaaaaaaagaaaacccaagaacaaatgttattattgttattaatattccagcaaaaaaaaaaaacacaagaaataagaaataatgggttgtatctgcaattgcttcgtagggttgctgaacagcgtattgctaacagtagggataggtttcgtcatatctggtgcttacctcaacatcaatggtaacagcgattgcgagaaagttttaaccaccccgttaattgtgatgggtggtcttttgctcatcctttcccttataggaataatgggaacctcatgcagcagcaccttctgcatgtacatttatttgaccctcatgttccttttgatactcggtgtcatcgctttcaccatcttcgttttcatgatcaccaaccaagccgtcgggaaagccatcgccgatagcgagaaagtcattgaacccaaaaaccccatggatttttccaattggt

SEQ ID NO: 11316 - DNA, 509 bp, Gossypium hirsutum
  Clone ID: uC-gsflmaxxa089d11b1
gcggctgccaacgccaagagcgcgacgtcaagcttcgtggacggaacagtagttgccaatgccatcaacactggtacagataatatgaacgtgatattttgaatttgaggtcactgataaaggatgagggaatccgaaattatgttaagtgggcgccaagctaatgagtttacaattgatatgcgagcgagtgacaaaacaggaggaaaggcgtttggggcctttacctatacagttctgaaggtcatcaaggagagggaaggtgcatcaaccaatagacagcttgtggtgagggctaggaatgaaataataaacctaggaattggcaagcagcacccttgcctttattgcaatgatgagaatgctgatacaggttttcttggctaccatcccaattgccaacaccagtacgggtgtgtaagctgtcggctttcattcaagggttatcgatcactagaggtcgaaactctaaactaataataatgtgctcgatcagtgtgcactactac

SEQ ID NO: 11317 - DNA, 496 bp, Gossypium hirsutum
  unsure (1)..(496): unsure at all n locations
  Clone ID: uC-gsflmaxxa089d12b1
gcgtgagtgcgcagacactaatctgaagcatcatcttgtgtttttgtgctcttagattctttgatagtgttcaaagtccacgcaaggtttgagtgatggggaaggactcaaaatcaaaggaagcaaagggaaagggcaaacaagctggaggtggaagcgatgaaagtgcttcaaagggtaaagggaaagctgggaagggagatgtccttggcacctgcacttacgttaaagcaaggcacatcttgtgtgagaagcaagggaagatcaatgaagcatacaagaaactgcaagatggttggcttagcaacggtgataaggtcccaccagctgaatttgcaaaggtagctcaagaatattctgaatgcccttcagggaagaaaggtggagatttaggatggtttccgcggngtaagatggctggtccgtttaggaagttgcctttaacacagtcattggagctaccagtgcacctttcaatctacacatggataccata

SEQ ID NO: 11318 - DNA, 560 bp, Gossypium hirsutum
  Clone ID: uC-gsflmaxxa089e01b1
cggttgggaaccaactgttaccacacagcagcagcagccatggtgaagtactcaagagaaccggacaaccctactaaatcttgcaaagctaggggttctgacctttcggttcattttaagaatacacgagaaactgcctttgcaatccgaaagctacctttgacgaaggcaaaaaggtacttcgaagatgttattgcccacaagcaagcaattccattcaggcgcttctgtggtggagttgggcgaaccgcacaggctaagaatcgccattctaatggacaaggccgttggcctgtgaaatcagcaaaattcattctttactggatcgcccaactcctaggctcaaccgtcgcttgcctgttgcttaagttcgctaccggcgacctggctgtaccagcttttggattgtcatcaggtgtgggcgtgtctaacgcattggttttcgaaatcgtgatgaccttctgattggtgtacacagtgtacgccacagcccgtgatcccaaaagggaagcttgggaacaatcgcaccattggaaattggtttcatcgtgggggccaca

SEQ ID NO: 11319 - DNA, 467 bp, Gossypium hirsutum
  Clone ID: uC-gsflmaxxa089e02b1
gagtgtgtgtttgggggtattgcaaagataatatttttattggggaaaaaaaagaatggggagaggtagctctgagtttgaatagaattgagaacaccattaacaggcccgttcacttttgctaagagaaggaatgggcttttcactaaagcctatgagctttccgttctttgtgatgcagaggttgctctcatcatcttcttcaataggggaaaactgtacgagttttgcagtagttcaagcatgatgaaaacattggagaggttccagaagtgcatccatggagcaccagagacaaatgtttcaactagggaggctctggagctaagcagccagcaggaatatctgcagcttaaagcacgttatgaagccttacaaaggtcccaaaggaattttacttggagaagatctggggcctttgagcaccaagagcttgagttacttgagaggcagcttgattcttcatt

SEQ ID NO: 11320 - DNA, 475 bp, Gossypium hirsutum
  Clone ID: uC-gsflmaxxa089e04b1
ggagtgaatgaatccatggttttcgaggagtgcagggatgttgttggggatgtattgcatgaagatgtgatgaagagcgtgaagtacatggtggagttcttggtggagaatagcatggtactgttgtatcaagggctatatgatttacgggatggtgtggcatcaacagaggcatgggtgaagaccatgaaatgggaagggattgtgaagttcaagacggccgatcgagtgatttggaaagtacaccgagagcttgcagggtacctgcacaaatgggggagcttgaccaatgttgtagcttaaggagcacgccatcttttgcctgctgaccaagctttgaattttcaggctatgactgatgattgggttttggagaagggccaatttggtggaaagcaaagaggatcatcgacaaaatgcatggcaacactctaaactgagatcgctctgaaactagttctacatctggaagcac

SEQ ID NO: 11321 - DNA, 107 bp, Gossypium hirsutum
  Clone ID: uC-gsflmaxxa089e06b1
cccactcgtacggtgacacacacagctctcatgggggggtttttaataaacaattggggactgatctttaatacaacgccactactggcgctctataaggctttgaa

SEQ ID NO: 11322 - DNA, 346 bp, Gossypium hirsutum
  Clone ID: uC-gsflmaxxa089e07b1
ctcacgcgtactctgactcacacaactctcatgggtgcgtttagaataaaccggtggtcactgatgattctaacttacccactactgccgctctataaggactctacagtcaagcttgcgcgtatacattgcatttctcctcctgagatacatggtgtctcacacccaattctactaccgacctgtcagcgcacacttcaaggcatcgtggtgctcggattccgggtgacacgtggatcagatttcatgagatcatattagccacttcgaccttcagtgagaccctattatagatgatagttgaccccgaatttcacattaacagtcaaacatccaggcatgctga

SEQ ID NO: 11323 - DNA, 456 bp, Gossypium hirsutum
  Clone ID: uC-gsflmaxxa089e09b1
ttatatatcttgctcgcactttctatcattgcggcggttgtcagccatgaccggaaagacgatccaaatcacccgaccgctggtgacctctgtgatgttctctgacaccatgtggatacaggtattctaactcgtgcacggcttatatcccgatcttgactatccgatagggcttgtgctaatggcatatctatgagttgggagaccatctttactgtagaggtgcgtatgatgatctacataatggctagctactatgatacccacttgatggtcactctaaaatccgtacgtgctgaacaggaggtaattaccctgtgcctacctatgtggaaccctgactgccgagatctctgcatgactatctcttgtggctgtgatcgtattgacaacggcttcatcaatgcccatgacgaggcctacctactgagatgactcacatgtcgagccatggct

SEQ ID NO: 11324 - DNA, 567 bp, Gossypium hirsutum
  Clone ID: uC-gsflmaxxa089e10b1
gaaactctcccatcccaaatcccaatacatcctgccccaaagcaatctctcattgttttatgaaagaaacgtaatcaggcagccatgttttggtataggaacttgatcaaactatccacacctatcaaatccaaaacccccatcaccaaaaatcttctacaagcttctttatccaacttcagcaccgccaaccaaccccctgcctcggctcaggctcagccatcaggtctcggacccaccaagccacacgacaaaccaagggtggtggtgttaggatctggatgggctggttgcaggctaatgaaaggcttggaccccaagctgtatgacatcgtttgtgtctcgcctaggaaccatatggtatttactcccctattggcttctacttgtgttgggactcttgagttcaggtccgttgccgaacccattgcgaggattcagccctgcatctcttcagcacctggatcttatttttttcttgccaattctactgcagtggatactgaaaaccatgaggtgcattgtgagactgttactgatggaaccgacaccctggacccatggaag

SEQ ID NO: 11325 - DNA, 564 bp, Gossypium hirsutum
  Clone ID: uC-gsflmaxxa089e11b1
cctattcagaaaatcaaaatcccctctcccattgatcttttgatcttctagacacttctcttcctcgttgtgagtctcttggtttgccctggtaatggcgtctgctttagaaaccaaagccaaagaagcatacttcgatgaccactttgaactcgccctcgatctgtactcgcaagccatcggaatcaaccctaaaaaggccgagctctacgctgaccgtgctcaagccaacatcaaactgaacaatctccctgatgctgtggcagatgctaacaaagcaattgagttggatccgtccatgtctaaagcctacttgcgtaaagctactgcgtgtatgaagcttgaggagtatcaaactgctaaggctgcgttggagactggggctgctttggcaccagaagagtcgagattttccaagttgattaaagaatgtgaagagcgcattgcagaggaaaatggtgagttaccgaaggagaccttggaagtggtgccaacatatgttgtacctgtgaaagacgtctcttctgtcaggatgtacctgatcccatgactggtgcagcacca

SEQ ID NO: 11326 - DNA, 576 bp, Gossypium hirsutum
  unsure (1)..(576): unsure at all n locations
  Clone ID: uC-gsflmaxxa089e12b1
gcgattcaaatcaaaccagtactcaacctcaccggatttttctctctcacgggatactccgccgaacttcactccaacgcccaatttctttgctcaaaacgccgtcggttttttttttctgtcattttgtaaccgtctctgcaaattgttctgcagaaaagaaaaggaaatcttttgaaaaacgccaatccaagaaaaaataacagttccatgaaaagcttaactgcaaccaccgtgctccgacgcgacgtcagccgtcgtcattactggaatcttctaattctttcattttattaaataaaaagaaaagcaagttcaattctatgcatcctctctgttgtatttccaccgtatcggatcattccccagtcaaacctttacccgacaacgtggccatgcctgctcatgcacctgtaactaccgtaacgaccttcctcttccggctcttcatttagatccaactcggttcgatctacggtccaaatcctgtgccagtccgatcaaaatcagaacaatcaacatcgccgtagtagtagcgtggatttgaatcngatgagccagagaaatgggacaccg

SEQ ID NO: 11327 - DNA, 489 bp, Gossypium hirsutum
  Clone ID: uC-gsflmaxxa089f02b1
cccacgcgtccgattttgcttctttggtggtgggggaaacataaatttcattgcctataaccaagaatgatagagcatccatagttggagatgctatagactacatcaaggaacttcttggaactgttcgtgagcttcaattactggtggacaaaaagagatgcggccaagacaggagcaaaaggcttaagactgaagatgctgctagtgctgctgatgcaggggatgttgagttcaagtctttaggtgatccagaccaatgctataatacttccttgaggagttcttggcttcaaaggaagtccaaggattctgaggttgatgtacgcatcgttgatgatgaagttaccatcaaacttgttcaaagaaagaagatcaactgcttgctgtttgtgtccagactgcttgatgagcttcagttggacctgctacatgttgctggtggcaacattggtgactattacagctttctcttcacaccaagatata

SEQ ID NO: 11328 - DNA, 455 bp, Gossypium hirsutum
  Clone ID: uC-gsflmaxxa089f05b1
cccactcgtgcgggataatatcatacattcatgtggggatatgtattacacaccttgggtgagatgattaattcataaagattcaagctcacccaaaaatattttaagtgccaggtgcaggtggataatttctaggatcagctcagatgattctctatgttatatacaagaacaggcctgtttcaacaaacccaagcgaggcaattgaagaataagatgaagaagaagaaggcggctcatctcacccagcgagaagaggcatagagatgaattcatgagtcggaaacgtctaaacaatggcaaaagcctgccgagaccacattttaatcaacaatacaacaaaatagagagtccctttaactccatttgagctgcgaccagggtggactcgtgacagtgacgtagaggatccagacaatgatcaccccatgatcttacgacggtagttaagcact

SEQ ID NO: 11329 - DNA, 307 bp, Gossypium hirsutum
  Clone ID: uC-gsflmaxxa089f06b1
cccactcgtactgtgacacacacaactctcatgggggggattttaacaaaccggtgggcactgatgactcatagatacccactactgccgctctataaggttttgaagggcaagcttgcgcgtagacactacaacaaccctccggagatcagtgcctctcacacccaagtctctgccgaccttacaaggtacacatcatggctccgatgttcttggattccggagggcacggttaaacgagctcatgagctcatatgagccacttgcatgacctgtgaggccctatgagagctgatagttcaccctg

SEQ ID NO: 11330 - DNA, 334 bp, Gossypium hirsutum
  Clone ID: uC-gsflmaxxa089f08b1
atctcccaaactgttacacatataggactatggggtgctttcagaaccaacaggggctatgagatgattctcgcaatccaacgtatggtgccctatacggactataaggtcaagaggtcgcgtgcacattacacgaaacttacggagaaatggtctactccattgaaaagcactgatgacatatcaagaaaacataaaaaagccattgcctgcataagttcagaggtagccattggaccgagtttgatggtcttaaaccagagacataaatcttacatgagccactaggaacgatcaatatgaagcccttacttaccatcaatagccaaccatc

SEQ ID NO: 11331 - DNA, 423 bp, Gossypium hirsutum
  Clone ID: uC-gsflmaxxa089f11b1
gcgtactcgttgtatttacccgttcatgcaaaagtgggttccttgaatgccacagtgtccataagccataacaaaaatgcctgcattgttcatttgttccttggttgaagatcagggtgagccactcccagaaatcttgatgcgcaaaagttgtgatccaagatagatttaaaagttgccaaacctctatacttgtggaatattgccgaaaaatatgatgacagtcttcattttcatcaccgtaccggggacatctggcatttgtcactaaccttctttgttgtagattgctcaatataggaatgtaattccatgatatgcgtcagattatgattgtgatcttaggtggtaattgtagtttccatagtttactgaaaaattccttagcttcagcctgtaacaaataattactaggattcagat

SEQ ID NO: 11332 - DNA, 559 bp, Gossypium hirsutum
  Clone ID: uC-gsflmaxxa089f12b1
caaaaataaataaataaataaacactgtcgctgggtcattagccagcttcgaagaatcgcatattactttgatctctccaacgaaatttaagtaataaaaatggtgttcgaggtgatgaaagttccaacgacgacgtttgaaggccagaagccaggcacttctggtcttcgtaagaaggtgaaagtttttgttcagcctcattatttgcagaatttcgttcaagcaacattcaatgcccttacacccgagaaagttaagggtgccacacttgtcgtttctggtgatggtcgttatttctcaaaggatgctgttcagataataatcaagatgtcagctgcaaatggagtaaggcgtgtatgggttggtcaaaacggattactttctactccagctgtatcagctgtaatacgcgaaagggttggtgcagatggatccaaagcaactggtgcctttattttgacagctagtcacaatcccggtggccctaatgaggattttggaattaaatacaacatggaaaatgggggacctgctccagaggccctcactgataagatc

SEQ ID NO: 11333 - DNA, 449 bp, Gossypium hirsutum
  Clone ID: uC-gsflmaxxa089g03b1
cggacgcgtggggcaaatatctcacttgtttttttgtttaattgcaccttttcagccttttcatttcatcaccttggacctctataatcttgacatatttttatagcatttttatcactattaatcctataattttcagttcattgtatactgctcatcttcctccccttgaaaacttgcgctttgatgactttctttgttctcatgctgaaaatctgaaatctttagtgtgttcgaaattattactgtgtcagtccttttgttttttatttccttttgttgcagtcctttttttttcaagctaagtgttgatcatatatggattctcttcagggtattcaaacatcaaatataaacccttcttgcaccaccaatttgaatgcaaattttcctgcaaaccttttcatgaccaccgtgggaaccatgggcggcgttaccaccaacacgaa

SEQ ID NO: 11334 - DNA, 552 bp, Gossypium hirsutum
  Clone ID: uC-gsflmaxxa089g04b1
ctgattaaaaaaaaaaacaaccaaaccaaaacaaacttcaaacaaaagggaattttcttgtcctaattttctgaccaattcatcgatggcaaccaaactgtatattgtatactattccatgtatggacatgtggaaaaactagcagaggagataaagaaaggggcggcatctgttgaaggtgttgaagcgaaactatggcaggtccctgagactctgtcagatgagattcttggaaagatgagtgcaccaccaaaaagtgatgtaccgatcattacaccgcatgaccttgctgaggctgatgggtttatttttggcttcccaacaagatttggcatgatgtctgcccaattcaaagcatttatggatgcaactggaggtctatggagaactcagcaacttgctggaaaacctgctgggatattctatagcactggatctcagggtggcggacaagaaactacaccgttgactgcaatcactcagcttgttcaccacgggatgatatttgttcccattcgatacagctttggtgctggcatgtttgagatgga

SEQ ID NO: 11335 - DNA, 559 bp, Gossypium hirsutum
  unsure (1)..(559): unsure at all n locations
  Clone ID: uC-gsflmaxxa089g05b1
gatggcccaaccaagaccattatcacaaatgacattagtgtcgctaagaatccaccggttaaaacatatcgcactgcaactgttgctgcggatggggctggtttcatggccaaggacattggattcgataactcagcaggacccgaaggtcatcaagcagtggcctttagggccactgctgatagggtcatcatgttcaactgccatttcactgggtaccaagacactctctacgctcacagagagagacagttatatagcaactgtctcatcaccggaacggtagatttcatcttcggggatgcggcgagcattttccagaactgtatgctcgtcgtgaggaagccagggccaggacaaaactgcatggttactgcacaaggaaggaatgatcttggaacaaactcagcaattgtgcttcaaaactgcaccatctcgggcgcccctgattacatcccagtgaaggatacgaacaaggcatactttgggcgtncttggaaacaattcgctaggtccatcataatgcaatctaggatcgacgacatcattcaaccagagg

SEQ ID NO: 11336 - DNA, 421 bp, Gossypium hirsutum
  Clone ID: uC-gsflmaxxa089g06b1
cccacgcgtacgctcacacgtacatggagaatgtgggtggtttacttaacacagccggcgttgaggcatttattccaaacactgggcgtggtctataaggtgctacctgccattgtttgcgccaacactgcagaaaaatgtttgagataaactttgaaaatgaaaagggggaaaagtctatggcatggcagacttcctgggcatatagcactcgtacgattggggtcacggcgatggttcacggtgataacaaatgcttagcgctgactccaaaagtagcagctatgcaggttattgtgaatcctgtgccttacaatgatgcagatacttatgggatatttgatgcctgcgctgccactgtggcaatcctctctgatgctggtattcgagctgaagctgatcttaaagagtactactcacc

SEQ ID NO: 11337 - DNA, 461 bp, Gossypium hirsutum
  unsure (1)..(461): unsure at all n locations
  Clone ID: uC-gsflmaxxa089g08b1
tggaaccagccaaatttacttttctggcctgtgtctccccagagagggaaagctgctatcggttaacctgcttcttccacaaacgagatgtgaaagtttcaattacttctgaacatgggtgttaggaaaggcagtacgaaatttattggaagggctgtttggttgatgatgaatgttcttttatgctagagaccaattttagtgcattcgtccggggtaacctgactgaaaaagcttaacttagctgcgtggcaaccaaaccaccagcgaatgaacatgatggtcaattccttggggagctgtatttaatgaacatagttcctcttcctctcccatttgacttcctaaactgctaatcaatagtcatctgaatatacaatatttattcggagtgactgatatttttgatagctcagataataagatcatctctgatatattttatcgattgangaaaatat

SEQ ID NO: 11338 - DNA, 356 bp, Gossypium hirsutum
  Clone ID: uC-gsflmaxxa089g09b1
cccacgcgtccgcggacgcgtgggtttagaatgtaagaaaacctagaaacttccctctctattcaatgaattggagctttacttgtgtggggaagatagctcattgcaagctcctaaataatcagtcaaaattaggtattttgcattgctctagtgtttaaaagggaaaaactgtaactatagattagggttttgtatttcgtgaattagggattcctaactgaatttggtactaatttgtaatttgtgattgtgaactatgggtctctgctttgtgaggtaagcaaccaaatgatgtatagcatagttttgcacctaatcattgatctttataataggatggcagttagttggat

SEQ ID NO: 11339 - DNA, 392 bp, Gossypium hirsutum
  Clone ID: uC-gsflmaxxa089g10b1
tccacgcgacctgtaggctaacaagcgtgctagacaacccgctaggaacccggaagggcacagggaagatccctggcgggagcactcgcgaccgcacctgataccgagctaaagcttctaataagagcacgcctgacagcacccctaagatgaccaactatacctgaacctatccatgaccgaggcaactccagaggaagctctgatggatgctcacatgcatactgacctgcagactggtctatagactcgaaagactaagcgaaccactaagcaaaccgtctcctcccaagttcccttcaagatagccctaaccataaccgaagcctatagcgagaagtctctgataaaagccatgattagacgcatgcgctgcacatattcctaaacct

SEQ ID NO: 11340 - DNA, 499 bp, Gossypium hirsutum
  Clone ID: uC-gsflmaxxa089h02b1
ctgctgcgcctgctggtgccgccgcggcatacccgggtggacccaccccgccgcttattatgacttcacctctctttatcttttttgagggggatgtatcatcggaaagaagttaaagaaccaatcatgaaacttgacaccacacgactaaaatcggctgcgcctggctcgggtgctcccatcgaactcgttgatgggttttcggctgctccgtggatagatctcccaaacactactgattgtgatgggtttcaaaaagaagctctccagatggtgataacctgattagggtaccaccacgctagctctcatctttaatgaactgagtgatggttgccgctgactctagagctagcatgggaggctatatctcttcacagtcagtgaacaaaactattgagatcaatgcttacatgcttggaacaatcgctggaggagctgctgactgccaattatggcgccgagatttcagcatcaagtgccggctacatgaattagc

SEQ ID NO: 11341 - DNA, 395 bp, Gossypium hirsutum
  Clone ID: uC-gsflmaxxa089h04b1
tttcttcactcactggcccaagtctctcaggtgaacggagatttcaagaaaaggtggcaaggggcttttggcggcgaaaacaaccgtagctgacaaggacactgacaaggataaggacaagaagcgtccgggttctcgatcatctcgtgccagaatccagttcccagtgggtcgtatccaccgtgatctcaagtctaggacatgtgcaaatggtagagccggggccacaggcgtcgtgtacttggcctctattctggaatacctgacagctgacggtctcagagcatggctggagaacgaagcatggatctggaagtgaatagaatcaccccaaggcatatgcagctggctcttaggggggactgaagagctagataccctgatcaagggtgcca

SEQ ID NO: 11342 - DNA, 553 bp, Gossypium hirsutum
  Clone ID: uC-gsflmaxxa089h06b1
ggacaacaaaactggctaataggctaaatgtttgcgggctcatgaactgtcagtatgcaatcacagcttctggtgatgttttcttacttgaggcaaatccccgtgcttcacgtactgtaccatttgtttccaaggcaattgggcacccactggctaagtatgctgctcttgttgtgtcagggaagtcactttatgatctagatttcacaaaagaagtgactccaaaacatgtgtctgttaaggaagctgttcttccatttgagaagtttcaaggctgtgatgtgttgttaggtcctgaaatgaaaagtacaggtgaggtgatgggcattgactttgagtttgcaatagcatttgcaaaagcccagattgctgcagggcagaagcttccactttccggcacggttttcctcagtttaaatgacttgacaaagccctatcttgaaagaatcgcaaaagctttcttggggctgggattccatattatttcaacatctgggacagctcactgtcttgaactaaaaggtatcccagtggaaccggtgctgaaaatgca

SEQ ID NO: 11343 - DNA, 525 bp, Gossypium hirsutum
  Clone ID: uC-gsflmaxxa089h08b1
cccacgcgtgcggcgactttcaactttgaagaggaagacttgttaaaggaaagaagctgtaaaagtgagatagagatgttgaggttcacgttatattattgggtgttaatagttattttaattccatctgcctcctttgtgattgtatcatcatcgaaagaacagctaagttcaaagcaatgtgaggatctgggtttcacgggtttagccctttgttctgattgcaacactttttctgagtatgtcaaggacaaagagttgatatctgactgcttgaaatgttgcacagaagactcagatgattctacaagtaagattacttattcaggtgcaatactggaagtttgcatgaggaaactagtattctatccagaaattgttggtttcattgaagaagagaaggacaagtttccaacagttaaagttcaatatcttttcaattctcctcccaagttgatcatgttggatgatgagggccaacataaggaaaccataagaattggacattggaacgtgaacacatgc

SEQ ID NO: 11344 - DNA, 566 bp, Gossypium hirsutum
  unsure (1)..(566): unsure at all n locations
  Clone ID: uC-gsflmaxxa089h09b1
atttcctttaaatccaagcctggtgctcttcctacttttgttttggtcgatcgtggagattgcttctttgctttaaaggtctggaatgtacagcaagctggtgcttctgcagtgcttgttgctgatgatattcaagaagcattaataaccatggatacacctgaagaggataggttagctgccaaatacattgaaaatataacaattccatccgcccttatcgagaaaaattttggtgaaattcttaagaaagcaataagtggtggggatatggtcaatgttaatcttgattggcgagagtctgttccacaccctgatgatcgtgtggagtatgagctatggaccaacagcaatgatgagtgtggagttaaatgtgatatgctgatggaatttctgaaggatttcaagggtgctgcacagatacttgaaaaaggtggctatactcaattcacaccccattatataacttggtactgccctcaggctttctcgctaagcagacagtgcagatctcagtgcatcaactacngangatactgtgcacctgatcccgaacaagatttagc

SEQ ID NO: 11345 - DNA, 449 bp, Gossypium hirsutum
  Clone ID: uC-gsflmaxxa089h10b1
gctcagcttatttaccagacggctctaatggagagtggtttcaatctacccgatcccaaggattttgcttcacgcatctacagctcggtgaaatctagcctaaatattagtcccgatgcaacaattgaggatgatgatgatgatgtagaagaaaccgagacagaatcggacacaaaagacagtgcagtcaaagatgagttgtagattgcctgaaacctcggggacatgccttttgagttagttttaccctctgatgacaagccgaaggaactgtaacatgcattttcaagtctgaaacttggataaagggaaacattacaaacattacttagtagaatatatgtaaaccgtagtcgactgtgaaattaatctgtctgcaatttttgctcttttaatgcatcgcagtggttttaagaatttcgcgtattaatatatggttgtttcgatct

SEQ ID NO: 11346 - DNA, 537 bp, Gossypium hirsutum
  unsure (1)..(537): unsure at all n locations
  Clone ID: uC-gsflmaxxa089h11b1
aactggagcagtattactgggagtgctaataagcctcacaaaggaaatgatcctaggtggaatgccatcctggctatccgggctcgagatggaattttgggaatgagtcatttcagattgcttaaacggcttggttgtggtgacattggcagtgtatatctctcagagctgagtggtacttcttgttattttgctatgaaagtaatggacaaggcatcacttgcaagtcgtaagaagttgactagggctcagactgaaagggagattctgcagcttctggaccatccatttctgcccactctttatactcattttgagaccgacagattctcatgtctagtcatggaatattgtccagggngggatctacacactttgagacaacggcaacctggaaagcatttcttagagtatgctgcaaggttttacgccgcagaggttctattagcacttgagtatctccacatgcttggtgttgtctatagggacttgaaaccagaaaatgttctagttcgtgatgatggccatataatgctc

SEQ ID NO: 11347 - DNA, 432 bp, Gossypium hirsutum
  Clone ID: uC-gsflmaxxa089h12b1
gcgcgcgagggccgccctattttttttttttttgggggttttttttaatttttttttttttttttttttttttttttttttttgggcaaaaaaacaaaaaccgaaatggagttaatggggataatggaactttgggacccttgtccaaggatttggaaaccaggcccttgaaaaaaaaaaagggcccggaaggccaaaataatggctaacaaaaatttcaaaaagaaaacccaggaaaaggaaacaagggggagaatggtctgaaacaatcaggggcatttgcaaacttgcaaaaagccccctttcaattggcaccgggaaaggggggtcggagcaacctaagggcaggaaccaaggggggggggggcggggggaactctggaaacttgcgaagctgggggccacacgccggggtaacccacaaggaggggg

SEQ ID NO: 11348 - DNA, 476 bp, Gossypium hirsutum
  Clone ID: uC-gsflmaxxa090a01b1
ttgtttcgtgggatggctggtcctctgcttctgggggcatcctgaacctccggctggggctgcaacggtacaactgtctctccgccagaatcgtttcttctccgtgccgtccttggtgcgccgccgcagagccgactgggcaccaggacgaggtatcctcttctgagaagagtagtgtggtgctgaccgtgaaggatccaccgaagtaccataggtgggatgatcctgattacaggaaatggaaggataaggaggaagagatgcttcgagacatcgaacctatcattttgctagttaaagagattcttcactctatgaggcatatggatggggagcgcttaactgttgcagacgaggaaactgtggtagagaagcttcttcgtcatcatccacattctgaagataaaattggatgtggatttgattgcataatgggtgatcgacatcctcaatttagacactcaagatgtctcttt

SEQ ID NO: 11349 - DNA, 130 bp, Gossypium hirsutum
  Clone ID: uC-gsflmaxxa090a02b1
atcctatatgaaaagtatttattttgtgaggagctttttcgacactgggtgcggttaaaacaacggttactcaacactcttactgtaatcaccgcaccttgtgttacgttctctgccactctcagctcat

SEQ ID NO: 11350 - DNA, 441 bp, Gossypium hirsutum
  Clone ID: uC-gsflmaxxa090a03b1
ggtcaagcaagtgatagatcgggagactttaattgggttctttgctgttatgatgggattctcctacatctgatccttcatcaggttctttgcagaaacctcttactacatgcctcactgtttccatgctgctctctgtttttgacttttttttaaataaataaataaaaaaacttaacccttgttgtttaatctttgatcatatgaaaaatatttcagctatacttaaaagaaatcggtcacttactaaagaagagattgaagctctctggagatcaaaaaggaaaacagaggaagagcatcttaatgctatatatggttcaccagatagttgcaatcagcaggtacaaattatttgtttgataatcagtgtagcatggtaattttgtactgaactagtaccatcttttgacatctatataacatgaaactccattgatg

SEQ ID NO: 11351 - DNA, 498 bp, Gossypium hirsutum
  unsure (1)..(498): unsure at all n locations
  Clone ID: uC-gsflmaxxa090a07b1
attattatcatatatgaagagtttttatttttggggggcttagtcgagattggatcggtagaaaagtcgtttactcaacactcttactgtatcgaaggcaacttgtattacgttatctttcaattccagctcagttcttacgaacaaaaaggttataaaaatgtcaaggcctctgcactaggtgcacctgcaatacgggtcacaagcagcagcaatgatcttttggactcccaagtgaaagaacaaacagaaaaggaagaattggatagaaaccaatcttcccacaggtttcctttttggtcacttttttcagataattctcctcttactaaatacgatgccactgacaatggttttgcatctgatcctttcactgttggaaccccaagaagtcgccataggttaacaatgctacttttgaagtcaagtttagttgtgattgtgattcttgctcttaccggttcattttggggacactttccatntcaacatcatcca

SEQ ID NO: 11352 - DNA, 365 bp, Gossypium hirsutum
  unsure (1)..(365): unsure at all n locations
  Clone ID: uC-gsflmaxxa090a10b1
ttattcaaatgggtgcatgtcaacaggaccggatgtcattattaacaatatggcgcatggtgctcctgaggatgaagtacgccatgcgggtgacctgggaaacataattgctaatgctgatggagtggcagaggcaacaattgtggacaatcagataccactaagtggccccaatgcggttgttggaagagcatttgtggttcatgagcttgaggatgatcttggaaagggtggacatgaacttagtctaaccactgggaatgctggcggaagattggcatgtggtgttgttggcttgactccggtataaatcttatcgatgaaaccagtttgngggatgcgctatttgttggttggatttggca

SEQ ID NO: 11353 - DNA, 232 bp, Gossypium hirsutum
  Clone ID: uC-gsflmaxxa090a11b1
atgtttcgtgggcggacgcgagggctagcctgggagggattaaaaatcatagaggtggttatcaaagtggtcattaaatagcatactctcaggggtaccagaattcaagcgggagaacagtgcagccataggcagcgaaaacgctacagcttctagaggagcaagcgccaggcaacaacatgcttattcttatataagaaaagcccaactagaagaatgcaagtatggaatt

SEQ ID NO: 11354 - DNA, 195 bp, Gossypium hirsutum
  unsure (1)..(195): unsure at all n locations
  Clone ID: uC-gsflmaxxa090b02b1
cgcccatctttccggccttagaacttctgctctgaaagcggggtctaagatttagtcgattagtatttctccatctggatttggaccgagctctctctcctttcgtcttaattggattcactatgtcttattatacccctaagaacatcctcataactggngcagatggttatattgcgacacatatagctaacc

SEQ ID NO: 11355 - DNA, 512 bp, Gossypium hirsutum
  Clone ID: uC-gsflmaxxa090b07b1
tttattcgtgcgggagaaccgaagccattttaggggagcccagatctattttcaatgttgaagaagccattacatgaacctctccctgttttaaatcctcatctcgaagtttccgccatgaaagctgcttccttcaacactccccattttccgtccatcatcatgaaaagaacatcaacacagccatgtccaactcgattcgcaagaaccctttttcttaaactccctccgagcttccaaaacaatccctttttttagaccgacggctaattcctctgcttcttctttttcctccgtttcttcttcctccaacgcattcatcgagtcaactgccaacggcacgtatttgggttggaacaaagctccggagattgagatcgatggtggtggacaagctaaggctatggggaacaaagacaaagtcataaccgtggttcttttgggatggcttggggctacaaacaaacatttaagtagatatgtggaatggtataattccaggggaatccatg

SEQ ID NO: 11356 - DNA, 511 bp, Gossypium hirsutum
  Clone ID: uC-gsflmaxxa090b08b1
ctttactctcaacaaaaataggggcatgaactaagtgctgcttggtgtacttatctgtttatgatggagttacttgcttccatccactgttacttttggagtccttcgagaactatttgcttatggatgtctctggtgcttttgctccaatatagtaaaacagtagtctccaaatccgattatttgatcggacttggaagctacgacattactggtcctgcagccgacgttaacatgatgggatatgctaacgcggaacaaattgcctcggggattcacttgaggctgcgagctcgctcattcattgtggctgagccacaggggaaaagagttgtatttgttaacctcgatgcttgcatggcttctcaattagtgacgatcaaagtgattgagagattgaaagcaagatatggggagttatatactgaacagaatgttgctatcagtggtattcatacccatgccggtccaggaggttatctccaatatgtagtgtatcttgtaacatctt

SEQ ID NO: 11357 - DNA, 512 bp, Gossypium hirsutum
  Clone ID: uC-gsflmaxxa090b11b1
cctctcctctcctgggaggtcatttttgtctcaccgtcgagttccgctggttcttttccggatctgacccgtatcccgtgtcggcacaggtactgcaccccaaattgccgagtccgggtaacgaagtttataagtatgttcatctcaggtgaagatgataagaatgaaataggtactgaaaatactgcatttgtgcatgggaaaccacctcaagatgctgctggacctccgaaagttgaatctgatatggaaattgttgatgagaatgaaatagttactgaaaatactgcatttgtgcatggggaaccacctcaagattgtgctggacctccgaaagttgaatctgatatggaaattcttcatgaaaaagtaaaaaagcaaatcattaaggaaggccatggtcaaaagccatcaaagtattcaacatgcttcttgcactacagggcatggactgaaaccactaagcataaatttgatgacacatggcatgaacaacaaccacttgaattggt

SEQ ID NO: 11358 - DNA, 314 bp, Gossypium hirsutum
  Clone ID: uC-gsflmaxxa090b12b1
atatttatggcgtgtacgcacgaccacatctgggagaggttactattgatcttctaatgggtctctatacaagcacatcgacctcgccaaggttaccgctttaaatgaggctaatccaggaagagttaaatcggtgtttaaggcttgggaggagcgattaaattcttctggggaacgcttggaaagtaatgagggtgatcctgagttacttgtttacattccgtttacatcagatgttaagatcaagagtatatcagttgttggtggtgctgatggaacaagtccttccaagctgagagtatttatcaatcgag

SEQ ID NO: 11359 - DNA, 530 bp, Gossypium hirsutum
  Clone ID: uC-gsflmaxxa090c01b1
acccccggggtgccggggcggaattttcgggcggacgcgtgggttcgtgagtattgagaggaagggtaccctttcacccccggggggatccattaattaaaagatttagaagaaaaggccaagaaggaacagtccatcaaaacaatcttggtttcccgatctcgtgactgtgtaggtacttctgatggaagtaaggtgccggtgttcgaacttgaggggaagactgtaagtatatatttctcagcgtcttcaatcaagccatctgctgatattactcagagacttgctgaagtttatagtaagtttaaagaaaatggggagaaattcgaggtggttatgatatcgcttgatgatgatgaggaatccttcaggcaaagctttggggcaccatggttggcattggctttgaaagacaagagctgtgagaaattggctaggtattttgagctcttgacccttaccactggtgtcattatcgggccagatggaaaaactgttcaccctaatgctgctgatgcgattgatgaaca

SEQ ID NO: 11360 - DNA, 459 bp, Gossypium hirsutum
  Clone ID: uC-gsflmaxxa090c03b1
tttaccatagacctgtgccggcaaggagatgatattaataatgcttggcgatggtagacaaggcacagactattaggaccaggaagttcatgaccaacaggcttttttctaggaaggattttatcattgacgttatacatactgcacgacccaatgtttacaaggcggagttgaaggaaaacctctctagaatgtatgaggtgaaggaccccaattcaatctttgtgttcaagtttaggactcattttggaggtggaaaatctactggattcggcttgatttatgattctgtcgagaacgcgaagaagtatgagcccaagtacaggctgatcaggaatggactctataccaaggtagagaaatctagggaacaaatgaatgaaaggaagaacagggcttagaagatccgcggagtaaagaagaccaatgccagtgaagcagcaaataataaatgagagc

SEQ ID NO: 11361 - DNA, 520 bp, Gossypium hirsutum
  Clone ID: uC-gsflmaxxa090c04b1
gtcttatttaaccctgttacacaaggtatctgaggcagatgacatgcttggaataggcaaaacgtttaaaggattatctacagaagcaatgcatcggccagatctgtatgcagttgagaaggagttgtatttgggttctttatgcgaagtttcagacagttcaaagccatggcaattttggatggttatgttgaaaaatggaaactttgatacaaaggccggtttttgtcctgaaaatgggaaacccaaacctccttttactacttcaaagaacttcccttgctttggagaagggtgcatgaatcaacccactttgaaccatcagcctacacaactgttaggtgatggtacaatgaggggatggttcaatggaacttatgatttggatgctgatattgggaaaggtcttacaaatttatccttttatgaagtgatttgggagaaaacgcttggttctggaagttgggtatttaagcataggctcaagacttcaatgaaatatccatggttgatgctttac

SEQ ID NO: 11362 - DNA, 495 bp, Gossypium hirsutum
  Clone ID: uC-gsflmaxxa090c05b1
aaaatattatgaaaaaaaatcatacgcaatgagcactggtggtcaggttatacgttgcaaagctgcggcggcatgggaggcggggaagccactatcgatagaagaagtggaagtggcaccaccccaaaagcatgaagtccgtattaagattctcttcactgctttatgtcacactgatgtatactactgggagtgtaagggttacactcctctgtttcctcgtatacttggtcatgaagcctcagggatcgtggagagtgtgggtgagggtgtgaatgatttgaaacctggagatcatgtgctccctatcttcaccggagaatgcaaagaatgtcgccactgtctgtcagaagacagcaataacatgtgcgaactgcttaggatcaactgctaccgaggtgttatgcttgctgatgggaaaaccagattttccatcaacggcacgcctatttaccactttgttggaccctcaactcttagccaatatactgttcg

SEQ ID NO: 11363 - DNA, 496 bp, Gossypium hirsutum
  Clone ID: uC-gsflmaxxa090c07b1
agctggaccccctgggggcccgggccgcaatatccgggtcgacacaccacgccgcgatgtttcgtgggcggacgcccggttttagagatgtgggttaaattaactgctggtgccgcatatattctcggagattgtccattctgccaaagggttcttgttactttggaggaaaagaatgttgcttacaggcagaacctttgggatctcaatgacaaacctgaatggtgcttggagataagtccagaccgaacggtaccattggtgaagtttgatgacaaatggggggctgattctgatgtgattgttgggattattgaagacaggttgcctgcgccttgtttgaaaacaccccctgaatctgctcatgttggatcgaaaatatttggtacttcaatatcattttagaagagcatggatgcaaacaatggagcaaagcacgattgggttattgagctgaaagcgttgcttgagcatcttaagggaaatgggccgttca

SEQ ID NO: 11364 - DNA, 351 bp, Gossypium hirsutum
  Clone ID: uC-gsflmaxxa090c08b1
ttcgccgacgcctgcgctgacacggggggcatttttaaaatgtacttggagatatacaagatacaactactctaccatagcgggtaaacccatcgatggattccacatcttatggatagattgatactcttttataatagatgcaaacgtaaagtttaaaaggtatttatatactggaagttcagaatacattgaatgtggagattgataccatattactattgatttgcaatactaggattgaaatggcaagagtaattttatttgaaaacaccctgttcaaagtttaatccaggagcgcagagaggtataagcccaagtacaggctgatcaggaatggactatatacca

SEQ ID NO: 11365 - DNA, 483 bp, Gossypium hirsutum
  Clone ID: uC-gsflmaxxa090c10b1
tttgtttaaaatataagaaaaaaaatcatacgcaatgagcactgctggtcaggttattcgttgcaaagctgcggtggcatgggaggcggggaagccactatcgatagaagaagtggaagtggcaccaccccaaaagcatgaagaccgtattaagattctcttcactgctttatgtcacactgatgtatactactgggagcgtaagggttacactcctctgtttcctcgtatacttggtcatgaagcctcagggatcgtggagagtgtgggtgagggtgtgaatgataagaaacctggagatcatgtgctccctatcttcaccggagaatgcaaagaatgtcgccactgtctgtcagaagaaagcaataacatgtgcgaactgcttaggatcaactgcgaccgaggtgtaatgcttgctgatgggaaaaccagattttccatcaacggtaagcctatctaccacttttgttggacctcgacctt

SEQ ID NO: 11366 - DNA, 501 bp, Gossypium hirsutum
  Clone ID: uC-gsflmaxxa090c12b1
atgatcagaggctttttttccttttttaaaatttttcttttttcattttgctgaaaatctaaggctttatttggctttaaaaccatttctttttttctaagtgaagtagatttcaaaaccagcaaaaacaaaggaaataatcgaaacccaaacagctgtttcgaatttcgatccattttacaacatgtcttcttcctcgaataatggtggtggatttgaaatgtcgtcgttgatcgacggtcgagattattcaggggagaatcacgcgcacgatggtggtcacgatggggtttttcgccactcgaacgcggcggctgttaaggttcagaaagtgtataggagttaccggacacggcgtaggttagcagattccgcttttgtagctgaactctggtggcaggctttagattatgctaggcttaagcacagcacaattgtgttcattgataatttaaaacctgaaactgctgcttcaaggcggcatcgcgttcttataaatgc

SEQ ID NO: 11367 - DNA, 415 bp, Gossypium hirsutum
  Clone ID: uC-gsflmaxxa090d05b1
ggggcgggggcggatattggtcgcccaccgccgaggtttgtttaatacttgatctctcagtggggggcgtttttgaagcactacttgttttggcggtttcagtggcagtgcagacccatactacaaatgcacaaagctgcccgaccgagctgacgagcctgaacgtgtgcgcacctttcgtggtgcccggtgcagctgaggctaaccctagcattgactgctgtaacgcactccaatcggagcaccaagaatgcctttgcagcactctaaggatcgattctcgactcccttctcaatgcaatctcccaccactgacttgtgcttgaaagaaaagcactggtgctgcatgcttaattgggtaggaaaatgtaataacgccatggaatatggataccgacctgtatttttctttctt

SEQ ID NO: 11368 - DNA, 484 bp, Gossypium hirsutum
  Clone ID: uC-gsflmaxxa090d07b1
tccttggtcttcccacgcgtccgttttataaacaggataacgctttgcctaaaaagtttggttttttttagactgtttggggttattgcccaagagggacaagtaatcgcctgccacactgttgattcatggaaccagcagctcgagatgggaaaccagtccaagaaactggtggaggtggatttcacagcatcatggtgcgggccatgccgttttatatcaccaatcctggaggatcttgctaagaagctgcccaaacgcatattcttgaaggtggacgtggatgaactgaatactgtggctcaagagtgggctattgaggcgatgccaacttttgtgtttctgaaagaaggcaccataattgacaaggttgtgggtgcaaggaaagaagaattgcaccagaaaattgcctttcattcatctaacccggtgcagacagcatgaatcaacatttaaatgtacttgatgtctggaggtggttatg

SEQ ID NO: 11369 - DNA, 512 bp, Gossypium hirsutum
  Clone ID: uC-gsflmaxxa090d08b1
cagtctttataaaaaatgagtcattttcatacagtgggggttttgcttatgtaattttcccaaataattaattaattttcatcaattaggtaaaaaaaatcaaattttgctgaagcctagctagattctttcagagcttaacagtgttataaaaaataagaggtactttctattgtgtataacaagcagcaattgatatggatttcctgaattggttaatgtactttgttttctacttgatattgtttcaagctttccttttgatcacaagaaggaaattggtaagatcccataagcttccgcccggtccaccaacaattccgatcttcgggaaccttttccaggttggtgataaaccccataggttccttgccaaacttgccaagattcatggggacatcatgactctgaaacttggccacactactaccgtagttttttcatctgcaacaatggccaaagaaatcctccaaagcatgatgccgtatcttgtaccgaaccattcccgatgc

SEQ ID NO: 11370 - DNA, 495 bp, Gossypium hirsutum
  Clone ID: uC-gsflmaxxa090d10b1
gtttgtggaagcataaaaaagaatcctccctggggggctcactggaagttacttaagttcgcaactctcgaggtctctttctaaaccatcatagatacacagttcggtaatgagatcaaacacattagagacaacaagcaataaaacccatcatctttcttcgctaataatttaagcaaactttatctttttgctgggtgatggatccaccagctatgatgagcgatggggggtacaatctagcagagatctggcagtatcccgtgagtgaatctgggttaaggaggggtcagtttgggaatgtgccgccgcctcattacgaccaccccaatccagaggtatcgggtggtatgaggagaaggcgtgatggagaagatgaggcagctaaggttgtctccaccagtagtggcaatggcgtgagttttggtgatggaaagagacttaaagcattaggatgcagagaggagaatgatgattctaaagtttgagcagcag

SEQ ID NO: 11371 - DNA, 501 bp, Gossypium hirsutum
  Clone ID: uC-gsflmaxxa090d12b1
gtcgtgacttcttcagaaactatctttccctcaaaggtggttattttaaggtttcaccagtaccaagtagttggaagggctcacccaacagagagcgatgagcatcccaagatctataggatgaagctctgggccaccaatgaggttcgggccaaatccaagttctggtacttcttgaggaagctgaagaaggttaagaagagcaatggtcaggtccttgccatcaatgagatatttgagaagaaccctaccaagattaagaattatggtatatggctccgctaccaaagccgtaccggttatcataacatgtacaaggaataccgtgacactactctaaacggagctgttgaacagatgtacactgagatggcttctcgccacagagtccggttcccatgtatccagattatcaagactgcaactatcccagccaagctatgcaagagagatagcaccaagcaattccacaactccaaaatcaagttcccattggtgttc

SEQ ID NO: 11372 - DNA, 274 bp, Gossypium hirsutum
  Clone ID: uC-gsflmaxxa090e02b1
gccggcgtttttttctcaagcttttgttagttcttttatgaggggttttaagaaaattgattagtgcggctaccccccaaccatagcaggctgggggctcactaccctccaaagtctctctacccaaccccccgccggtgatcaaattctccaacggctacgaccatcgcctattctccaagcgcaagaatgacgattatgctcttgctttcgaccgcgaccaagacttggaggctcccttagaccctgttagaatgcgaaaagacgaccacca

SEQ ID NO: 11373 - DNA, 229 bp, Gossypium hirsutum
  Clone ID: uC-gsflmaxxa090e05b1
tgattttttctttctcgattttctctttagccaaaagagggggcatatttaagtcaagactctgatcggcaagacgatcactctcgaggacgagagctccgacacgatcgacaacgtgaagaccaaaatccaagataaggaaggcatcccttcaaaccagcagcgtctgatcttcgccggaaaacagcttgaggacggccggaccttggccgatttacaacattcaaaa

SEQ ID NO: 11374 - DNA, 461 bp, Gossypium hirsutum
  Clone ID: uC-gsflmaxxa090e06b1
cttcctgtccctgctttcaatgtcgggagcggttgtttacatgctggtagacaaattggctatgcaggagttcatgattcttcctgtaggagcatcatcctttaaggaggccatgaaaatgggtgttgaagtctatcaccatttgaagtctgtgattaagaagaagtatggtcaagatgcaaccaatgtcggtgatgaaggtggctttgctcctaatatccaggagaacaaggaaggacttgaattgttgaatacagccattgctaaagctggttacactggcaaagttgttattggaatggatgttgccgcgtctgaattttatggaacagataaaacttacgacctgaacttcaaagaagagaacaatgacggtaaacaaaagatcctatgagatgctttgaaaagattatacaagttattcgtagccgagtatccattgtgcaatcgaagatccattt

SEQ ID NO: 11375 - DNA, 514 bp, Gossypium hirsutum
  Clone ID: uC-gsflmaxxa090e08b1
ttcattcgtccggctcactatatttatactcaaggtgccttagctcaacatgattccaccttgtcggcggttctttggagcttaagaggaagaagcattctttcactcccaaaatgtcagatcttcaagcaccccttcgcccaaagaggaagaagggcttggtggactctttggtccagtttcgttggatttttgttatattttttgtccttcctttttcaactctgtattactttctcatatatcttggagatgtcagatccgagatgaagtcctacaagcagcgtcagaaggaacatgatgaaaatgttttgaaagtagtgaagcgtctcaaacagaggaatccaaaaaaggatggtcttgtatgcacagcccgtaaaccatggattgcggtggggatgctgaatgtagactataagagagctcgccattatgaagttgatttgtctgctttccgtaacattcttgaaattgataaacagagaatgattgcaagggttgagccacttgtaac

SEQ ID NO: 11376 - DNA, 514 bp, Gossypium hirsutum
  Clone ID: uC-gsflmaxxa090e09b1
gatatggaggaaagaaccgtaagaggggaaagagtggggtttatgacaagaaacgtgtgcttatcttcaaagaagatggccaagaatacgcccaagtctcacgcatgttgggtaacggccgctgcgaagctatgtgcatcgacggcaccaagcgcctctgccacatccgggggaagatgcacaagaaggtctggatcgccgccggcgacatcatcctcgtcggccttagggattatcaagatgacaaggctgacgtcatcttgaaatacatgcccgatgaagctaggcttctcaaagcttatggtgagctacccgagaataccaggttgaatgaagggattgctggcggcattgatgaggaagatgatggtgcaggcgatgactacatcgagttcgaggatgaggacatcgataagatttaaatttctcttcttcttttttggcatttttgaagttattttaagatatggtggtgatatttgccggatggtcatgctttattaagcacaatgga

SEQ ID NO: 11377 - DNA, 348 bp, Gossypium hirsutum
  Clone ID: uC-gsflmaxxa090e10b1
ctcttcatcttggccaaattttagaaaccccttaggataaaagggagaaaggaattctttaaaatttcttcttttccttaactgtgagaagggaaatctatggtgaaaggaaaggggaaaacttcatattatcttctatattatatatatattatctgtacttttacttttcttttctttttgtggtccgaatggatgaaataaaaaggaaggtcggctgcatggagggagaggccatggatttggcatattaaatagttgtttcttcatatgaagaaacttgacaggtgggagactgttaaagtggctaaggccaggagaaagtttgtgctcacaacagcaattttg

SEQ ID NO: 11378 - DNA, 460 bp, Gossypium hirsutum
  Clone ID: uC-gsflmaxxa090f01b1
gcgcgcacgcgtccgcccactcgttctggtgggtttttaagacgcctttgtgtctcaaaccctattctttttcccaatttctcgaatctagggttttacattctcctttttctctccaaatcaaccttatttcattttttgtcttctcttagaaataatatcgtcaatgagcaacgaattagttaacttcaacatgtgcggtcttggcgatgctcttaatgccgaagcacgagctggtctcgttaacgctctcaagaataaacttcaaagtcttgctggggatcactccgatgtgctggagagcctatcaccgattggcaggaagcgtgtcgaggttcttagggagatccagaggccacatgatgaattggaggctaggttttttgaggagagggctgcacttgaagcttaatatcaaaaactatattaacccttgtatgccaagcgatatgatattgtg

SEQ ID NO: 11379 - DNA, 406 bp, Gossypium hirsutum
  Clone ID: uC-gsflmaxxa090f03b1
gcatgtttggaccttagctctctcctttaaattcaaggggggattttatacataacagtgtttttaaaaaaattaaactttgaacaaatttcaaagattttgattttcttctgcagtttctcatccaccaattgaatcaggttgtgaagtattgagggtgtatattatttgttgtttttctataattacctgatgtctctcgcctctgcttggcgaggaggaggcaggggttcagagcaatgttactttactcggctcttcaggctcaatggaaagtgtgtgccagagtagtgctgaattgaaggaacgggactacatgggctcgtctgattgttcctcagtggatagcatctggttcttccctccctacgaggaaagaaaggctagtttgaatctaaaggccact

SEQ ID NO: 11380 - DNA, 507 bp, Gossypium hirsutum
  unsure (1)..(507): unsure at all n locations
  Clone ID: uC-gsflmaxxa090f05b1
tcagtaggagctgaatatcactcccaaagaccagcggggggtctcttggacactataaactatccaattcatatgaaaaatctctctgtcaaggaactgaaacaactatctgaagaactgcggtctgatgtgattttcaatgtttcaaaaactgggggtcacttgggttcaagccttggtgtggttgaactcactgtggctcttcattatgtcttcaatgcccctagagacaagatattgtgggatgttggtcatcagtcttaccctcacaaaatcttgactgggagaagacataagatgcataccatgaggcaaactaatggattggccggattcacgaaacggtcggagagtgaatacgattgcttcgggactggtcacagttcaaccacaatctctgcangcttggggatggctgtgggaagggatcttaaaggtgaaaggaatcatgttgttgctgtcataggtgaaggtgctatgactgcaggacaagcttaccaagcaatg

SEQ ID NO: 11381 - DNA, 397 bp, Gossypium hirsutum
  Clone ID: uC-gsflmaxxa090f07b1
gtcagcaatagttctctttctgagttgggggtgcttggattcgaattgggttactcgatggagaatccaaattcattggttatgtgggaagctcagtttggtgactttgctcatggtgctcaagtgatatctgatcagtttataagtagtggggaggccaagcggctgcgtcaaactggtctcgaagtgctgcttccccatgggtatgatggacaaggtccagaacattcaagagcacgactagagcgttatcttcagatgagtgaggacaatcctattgtgatacctgagatggatacaactcttcgtaaacaaattcaggagtgcaactggcaggtggttaacgttacaacacctgctaattactaccatgatttgcggcgtcagatacacaggg

SEQ ID NO: 11382 - DNA, 463 bp, Gossypium hirsutum
  Clone ID: uC-gsflmaxxa090f08b1
acccccggggggcgcgggcgcggaatcccgggcgcgccccaccgcgcgcgtagttgtaggcacgaggctcacggcgtttggggcaagggggcctatcactacaaaacatcagccccagtaagctatctatcgtctctcaatcatctttattatcagtcatggctgctgcagctccagagggatctcaatttgatgctcgccagtatgaggctaaaatggatgaacttgaagctgtggggcaagatttctttacctcatatgatgaggcttatgacactttctatgatctgggatagcaagataatcttcttaggggcattgatgcttatggctctgagaagccatctgcagttcagccaagaggacttgtgctcttttgcaagggacttgatggaattcaacaagcacaatccggacaggaaaaaactgcagtttttgctctggaattctacagcggcttgac

SEQ ID NO: 11383 - DNA, 447 bp, Gossypium hirsutum
  Clone ID: uC-gsflmaxxa090f09b1
cccatgcttccgatttgttttctctgttatccgatgggagttctttaaataccaaaaatgctgtttttttgctgctcaaaaaccagagttcggggtgtgaaaatggcttctgatgtgccttgttgtggtgctgaattctcattgtatctgttgatcatagtggggttagtgtgttttgctgggttaatggctggtctaacactgggtctcatgtctctgggtcttgtagaccttgaagtcctcatcatgtctgggccgcctcaagatcgtatccatgctgcaaagatatttcctgtggtgaaaaaccagcaccttctgctatgtactctattgattggaaactctttggcaatggaggctcttcccatttttttggacaagcttgtgcctccatgggctgcaattttggtatcagccactctgatcctcatgtttggagagatattg

SEQ ID NO: 11384 - DNA, 504 bp, Gossypium hirsutum
  Clone ID: uC-gsflmaxxa090f11b1
gcgcaattttatccaccaatcacagccatagagacgaagggggaatttttgagattcggtgctgttacgccgacaccccacccttgtcctcctgctctaagccccaactagccacctacaagccaccgcgggggcggcagtgccggaggactagccccatcgaaatcaacactttacgtctccaacctagactactccctcacaaactccgacctccacactctcttctacaccttcggcaaaatcgcccgcgtaacagtcctcaaagaccgcgccacaaggaattcaaagggggtcgccttcgcccagatagattcccgcgaggacgcgctatccgcggcgagtgttatgcacgggaaaatactcaacggcagaaccctcagcgctaccatcgccgtctataatggacgagccccggagtttattaagaaaagggtttataaggataagtctagatgttatgaatgtggcgctgtggtcatttatcttatgagtgtccaaaga

SEQ ID NO: 11385 - DNA, 468 bp, Gossypium hirsutum
  Clone ID: uC-gsflmaxxa090f12b1
tttattcgtccgcccacgcgtccgtaaatttccggaggagctgtttaactgcgtcgctgtcaccttaaaaatcatatctcgagttccaaaactcgaaaaccagttccgtaaatgtttcctgaaactagactcatatttccatctacaattttttttctagaatttttggtcgagccaattagtacagttttttagttaaattctcccctgtttcagtgttcgactacactgacctttgcgcattacaacttggatatctccctgtacagggcttcaatactgattccgtttgtttctatagaaactagtctcgaaaaggaatctacacatatattgcatgacttctaattatctctggttaatttataatgaatttccaaattcggaatagggaatccagaacccgttctggccctgtttcgcagaaacttaaatatctcacaatattctgtcatatgattgtttcgt

SEQ ID NO: 11386 - DNA, 504 bp, Gossypium hirsutum
  Clone ID: uC-gsflmaxxa090g02b1
aaagtttttataatacttgactagccttttcaagattggtgtcttctatttagttaattttataagtttctctctttcccatgtttttgtttgatggtagaaatagattctttaccatgttttcaatagtcgaaatattccaccaccacctgattctaacattcctaatagtgccttgttggaaaagagaaattttagaggaataaaggttaagaaagatgattagttcctatcagcacgaaaagctatgggatacttgtgcgtctagtatctatgatttctttctatttgaaaatctgcatggcttcacgtgatatgttatcaaattttcaaggaaaatgtgaagttggattgtaagagtaaagtgtttgtggacatgcttctaatatctcaagtgtttcgcattgcaaataaaaagttgaatgattctgataagttcgagagaaaccaaaaacactacatttttatagattcttttcagaatttgagtcaaattttgttact

SEQ ID NO: 11387 - DNA, 476 bp, Gossypium hirsutum
  Clone ID: uC-gsflmaxxa090g03b1
cccatttttccgcccacgcgtccgtcgcggcgcctcgggggactttaaaccaccaaagcaaaagcttcaccaatggggatcgatttagtcgcaggaggtaagagcaagaagacgaagaggacagcccccaaatccgatgatatttacctcagactcctcgtcaagctttaccgtttccttgtaagaagaactggaagcaaattcaatgctgtgatattgaaacgcttgtttatgagcaaagttaacaagcctccactatctctctctaggcttattgaattcatgaagggaaaggaggataagattgctgtggttgtggggacagtgacagatgatattagggtttatgaggttcctgctttgaaggttactgctcttaggtttactgagactgctagagctaggattgagaaagctggtggagaatgcttgacttttgatcagcttgctttgagggctcctttgggtcaaaacac

SEQ ID NO: 11388 - DNA, 498 bp, Gossypium hirsutum
  Clone ID: uC-gsflmaxxa090g04b1
cccatttttccgcaatttttgccttgatttcagttggagggatttatggaggaagacgcgatcaattacatcataggcagaatgatctccgatattcgccttgaaattgaacctgttggtgaataataaaaagtgaccttgaccacctcagaaacacaatgtctgcaatggaagctgtgcttcgaggcgccggagagcgatctgcgaccagcaatttcacagttcggcttacaaatccggaggatgaagagcaacccgtgaccgactattctttccaacgatggcttaaagtgaaaaaaaatttagaaatcatgcccattgattcggcaagaacagcttttccagaagttcgtcggagtaggatgaagatgatggaaaagatgggttatggcatggcaaaaccggagcatcagtctatgtcgaatggaagcaagaaaagatttatgaattttgtttacgaagacttcttgagactagaagcagaacgaaaaaagaaac

SEQ ID NO: 11389 - DNA, 483 bp, Gossypium hirsutum
  Clone ID: uC-gsflmaxxa090g05b1
catgttcttgcaactaagctcggtgcacgtcttacgggtggtattaataatggcacctgcccctggctaaggcctgatggtaaaacccaggtcactgttgagtactacaatgacaatggggccatggttccagttcgtgtgcacactgttctcatctccacccaacatgatgagactgttacaaacgatgaaatcgctgctgacctcaaggagcatgtcatcaagcctgtcatccctgagaagtaccttgatgagaagacaatcttccaccttaacccatctggccgctttgtaattggtggtcctcacggtgatgcaggtctcaccggacgtaagatcattattgacacttatggtggctggggagcccacggtggtggtgctttctctggaaaggacccaaccaaggtggacaggagtggtgcttacattgttaggcaggctgccaagagcattgtagcaaatggacttgcccgcagatgc

SEQ ID NO: 11390 - DNA, 91 bp, Gossypium hirsutum
  Clone ID: uC-gsflmaxxa090g09b1
attctatgatcgcgagcgccgccctatttttttggggtgattttaaggacacttttcgatatcaaaaccaatggggatagccacaaccgcc

SEQ ID NO: 11391 - DNA, 493 bp, Gossypium hirsutum
  Clone ID: uC-gsflmaxxa090g10b1
gtttttcgtccgcagccaaataggcacataaagggagggagtgatagagagaggggtttttatgggacacctcacacgatctgtggaggagaaaaaagagaaggggggaatcatcatcaaatatgccatcaggttctaagaagagaaaagcggctaagaaaaagagggaacaagcaaccaacaacaccaattcatcaactaacaacaacccacatggaaatggggatcaaagaagccaagatgaaagagaaagtgacagtggccaagctggatccatcggatctcaaggcgaccccaatcaccagcatccattcaatcagagggaagaagaaggaaaaagaggggctttacctgttcaatcgcatgtaactgaggacaagtcatttgtagaaggcaatccagatgcagaaagttgtgagatattgagatcggatgatgtttttgctgataaagttgaagatgagtcggtacctacggaggatcttgagaccac

SEQ ID NO: 11392 - DNA, 489 bp, Gossypium hirsutum
  Clone ID: uC-gsflmaxxa090g12b1
gtgtttttattgcaatgtatgctactcttgcaaggggggatgtggaaagatgcttggtgccagagtctcccttttatgttgaaggacctggaggactttttgaatacattgaaaggctacttaaagaaaataggcatatggctcttgagatagcagagggtgcaggacaggagctgctttctgagagcttgcaatcaatgactcataaagatgctataggaaacaagcttctacaggatgttgcgctatggatatcacagaggatcaaggaccacttctcaaaagaaaggaagatgacaataaacttcagatatatagatcctacttatatgagccgtgctattccaagcaatgcatgtgacaatgtttactgcacacttcttggtcaaagtgctgcgcatggagcaatggctgggaacactggcttcacaagctgacttgtgaatggaaggcatacatacataccattctatcggattactgagacac

SEQ ID NO: 11393 - DNA, 468 bp, Gossypium hirsutum
  Clone ID: uC-gsflmaxxa090h03b1
cgcctacgttgattcgtggccttcagaaaacatcacctgaagggggtccaagattaaagaagcttgggtttataatactctgccccttaaactagcacagcctgatctgctgataatcgactaaagaaaaattgatggggactaatcagtcgctgagatggtttgcagtcttcttctttttgttgggtttctctgcttgcagttcgatttctgatggtgtttttgactctttcacttctactggaaggcacctacttcaagctaagaaagcttgccctgttaactttgagtatctgaactacacaattatcacaagccactgcacaggaccaaagtctccacctgaaagttgttgttctgcattcaaggaatttgcttgtccttatgcagaacagatcaacgacttgacgaccgaatgcgcttcaaccatgttcagctacattaatccttacgggaaataccctcctg

SEQ ID NO: 11394 - DNA, 444 bp, Gossypium hirsutum
  Clone ID: uC-gsflmaxxa090h05b1
gcgttattgggagaagacaaaaaagaagaagagaaggggaagatgataacccagaggtggtgctaaaagttgatatgcactgtgaagcttgtgctagaaaagttgcaagaaccctaaaggatttgaaggagtgggggatgttgcgactgatagcaaggcaaataaggtggtggtgaaaggaaagacggccaatcccgtcaaggttcacgaaaggctattaaagaaatacggtagaaaagtggagttagtctcgccgttgccggaaccaccgccactcgaagagaacaaggaagaaaacaaagaagctaaacccaaagaagaagaacagaaacaagagcctcctgcagtgataacggtagttttgaaggttggcatgcattgtgaagcatgcgctcaagcattgcgtaagcgaataaggaagatccaaggcgtaaagacagtgga

SEQ ID NO: 11395 - DNA, 490 bp, Gossypium hirsutum
  Clone ID: uC-gsflmaxxa090h06b1
ccaaataacgtaagtgggggtcatatttacttccaaatccaaataacataaaagtcgaatgagttgcttccaagggaaaatcagtagcaaactgtgcatcaaaacaagggaaaaagtaacataactttacacaacacctaacctttaatcaaaacagggaaaagtatgggtgaaggatctctctccaatttcccatcacaaaaatgaagctttttcatcttctcttcacaccaaaacaactgctctttacttatccttcccatccgaagaacccttgatattattttaatgtcaataagcccaaacaacaacggaacatcctcgtgcgatatcggccacatattctttttccatcctttccgtttcttacgcagctccttcagctttgcgcctttcttctctaacaatgattgaacttgaagaggggtagccattgggttctggtttccgaacaagttacgaaaactaccatgttttttattggccattt

SEQ ID NO: 11396 - DNA, 521 bp, Gossypium hirsutum
  unsure (1)..(521): unsure at all n locations
  Clone ID: uC-gsflmaxxa090h11b1
cacaccaccgcctccgtttattcgtccgctcagacgtgaaaaaaatggggggggcttttactcaagctattcagccggttatttgccaaaaaggagatgcgtatactgatggatgggcttgatgctgctggtaaaaccaccattctttacangctgaagttgggagagattgtcactaccattcccaccatcggttacaatgttgagaccgttgaatacaagaacatcagcttcactgttagggatgttgatggccaggacaagatccgaccattgtggagacactatttccaaaacatgcaaggacttattttcgtggttgatagcaatgatcgagaccgtgtggctgaagctagagatgagttgcacaggatgttgaatgaggatgagttgagggatgctgngcttctagtatttgcaaacaagcaagatcttcaaaatgctatgaatgctgctgagattaccgacaagcttggtcttcattctctccgccagcgtcactggtctatccagagtacatg

SEQ ID NO: 11397 - DNA, 485 bp, Gossypium hirsutum
  Clone ID: uC-gsflmaxxa091a01b1
caaatttttgacggagcagatctttcccaccaaatggggctttcagtaccacaaatgcctcagcccaacaacttacagttcaatgctcataggctacctcagaaagtgcagcaacttgatcaagttccaaagctaccatctacaatgaactcactgggatccattattcagccgcaacagctgaatgacatgactcagcagtcaaggcaaaatttggttgctcggactctaccctctagtcaagttttgcagcctcaagcccttgtccgaagtaacaatatccttcatcagcagcaaacatctaatccaactcatcaactccctctaagtcttcctcaaaacctgcagcagcagcagcagcagcatcttgtgggcccaaatcatccgcaaaacttaatgcattcccagctgcctgatccactcaaccagcatttacaagtgcctgacaaccaggtccagtttcaactgatgcagaaactttagca

SEQ ID NO: 11398 - DNA, 473 bp, Gossypium hirsutum
  Clone ID: uC-gsflmaxxa091a02b1
cccacgtgatcgcagagtttcagtgagagagctaaagaggaggaaaattacacacaacactttgtctgctattaagacacaaacaagatagaagagagagaaactgtaaagaaagaaaacccaagaagaagaagaagagggtttcaagatctggtcagatcaagtcaagctacataaacatcggaatggggagggaactcacggatgtggacatggacggtaagccaaatggtgtggtgaattcaaatggcaacctaacagtttcagaaggctccgagtctaataattatgaggtcaaggaatgcactgcaaaaaactcgggtggacaatggtcatgagaagcaagaagcgctgggtgttaaaagcataaattttggtactgacattcctgaagatcagaagtgcatggacaatgacgagcttagcgcgactgcatcgaaacccattggtgctggacaagctcaccatgctac

SEQ ID NO: 11399 - DNA, 480 bp, Gossypium hirsutum
  Clone ID: uC-gsflmaxxa091a03b1
ctcctatattctctttcctctgcacctgaccctatcagggggacctatttaaccatcttgctaccagacgaccatgttttgaactccttcttcatcgttttctctacttccccttcttcttctgctctccaatggctatccccgccacaaacgtttaacaaaaaaacacccttttgtttatgcccaatgccagtgtatccacgcgcgttccattttcccatgtcaaaacactcccgcggcgggaatccgctactctgctctgctttgctcaatgtccattttgggtcctaaggcttcttgtatctctttcaaggattctacttgtaggtgctttgggtacatggtttccaagaagaaatacatctataccattgatgatgactgctttgtaagctcaaccctcgtctcttccctcttctattttttatttttgaattttgcgttttagtgggtttcccaaaaaaaggctttcatttaaag

SEQ ID NO: 11400 - DNA, 530 bp, Gossypium hirsutum
  Clone ID: uC-gsflmaxxa091a04b1
ttcttagttgcttaaacgctgaaccaatattcccagggatggtttaaatccctctcagaaatctgctttcactcatccaaaaacgcttccttcatacccaccctaccctttcttctatttcaaagccccgcccttcaagctccgctcttccactctccaaacgcctcataataccccgagatccgcccctgaatccttatccctcttcaaaaatttggaatcttacggattcaacactacccaaatcgccacattggtcgaaaaatgccccgaaatcttgcattccagatttaactcaaagtttaagcccaggctcgagtatctaatcgaaaagggttttaaaggtataaaaaaaaaagagtctggaaacccttcaacaatttttttttgaatcataatctacactcctttatacccctttgagggaattttcacgttttcaaaaaaaaaattatcccatctattattgtttctttcttcttttggattcgggatttaaaaaaaagagaaattaacaaaaattcggaatt

SEQ ID NO: 11401 - DNA, 461 bp, Gossypium hirsutum
  Clone ID: uC-gsflmaxxa091a06b1
atccaaacagagaaaagacccagggaagccaacttaccggaaacctgaaacgatggcgtttcgtttgagcaacaacttagttggaatcctcaacttgattaccttcctcctctcgatccccatccttggcgccggtatctggctgagacgagaaggcgtaacagaatgcgaacagttcttggacacgcccgttatcataatcggagtcttcctcatgttggtctcgctcgcgggactaattggcgcgtgctgtcgcgtgacttggctactctggctctacctggtcgtcatgttcctcctcatcgtcctcggcatagccttcaccatcttcgctttcgtagtgacgaacaaaggtgcgggacaagtattatccgggaaaggttataaagaataccgacttggagattactcaaactggttgcagaaaagagttaatgataacaagaactggaataagatta

SEQ ID NO: 11402 - DNA, 374 bp, Gossypium hirsutum
  Clone ID: uC-gsflmaxxa091a10b1
gctttttcgggttcctagaggtctctaatcaacccggagtttctttggctgcctcttgaccttatctctctcccggcgagattggatctaagcgctctgacatatatctatttttactgcaacctcacttggtgcctgcaaaccggaagagaaaccccaatttattaacttccgaggggatgccagttaggggtgtactggatctaccactattggaatatttgggacttggataatatgtgatatttacgggtatgggcagctactgatactattggaggggtgatatgtgttagatatatggagctccgggttagtttaaaagggaagactttgaatagccaatgccatatatgggtaattggaatgagaaa

SEQ ID NO: 11403 - DNA, 103 bp, Gossypium hirsutum
  Clone ID: uC-gsflmaxxa091a11b1
aaaataaaaaaaaaaaaaaaaaaaaaaaaaaagggcgggtggatattttaaaaaaccagcggcgcgtacacacccaagcaacaaaaaaactcggctaaaggga

SEQ ID NO: 11404 - DNA, 339 bp, Gossypium hirsutum
  unsure (1)..(339): unsure at all n locations
  Clone ID: uC-gsflmaxxa091b04b1
ttatttaagctgttgaatctttgataacttcactttggagcctaaattagggtttccacggacaatatattatggcaactgctaaagtttccaaggcttccaaatggttctctaacaagagccttaggttaagccttcaacgtcgtggatcaaagtctagatcaacatccttaagctcttctcctggaccatcatcaacaccaatatctcctcgcacaattcctaatatgagaaccaaaaggcctgaagaagacgagatgaagcaagtctttggctatttcgacggngatggtgatggcaaaatctctgctcttgaacttagggcgtactttgggttca

SEQ ID NO: 11405 - DNA, 563 bp, Gossypium hirsutum
  Clone ID: uC-gsflmaxxa091b05b1
gtctttttttttttaaactaagttcaagctggcgatcgagaatcaagaatccactgtccgtgaaatcaagcctaagaacagaagaatcatgggaggtggtggacctgatgaagaagacaacaataacgagaagtggccgccatggttgaaacctttattgaaagaacaattctttgttcaatgcaagcttcatattgagtctcataagagtgaatgcaatatgtattgcttggattgtatgaatggttctctttgttctttttgccttgcttatcacagggatcataattacattcagataaggagatcttcgtaccatgatgtaataagggtatctgagatacaaaaatatttggacatatctggtgttcaaacttatgtaataaacagtgctaaggtagtcttcctcaatgaaaggcctcaaccaaggcctggtaaaggtgttatcaatacttgtgaagtctgtgatcgtaggcttgttgataactttcggttttgctcccttggttgcaagattgttgggacgtcaaaggattttcaaaagaagaaaaggcaactagcga

SEQ ID NO: 11406 - DNA, 302 bp, Gossypium hirsutum
  Clone ID: uC-gsflmaxxa091b06b1
gttctatgtgaacggcacttgcacatgggttagtcgatcctaagagacgggggaagcccgtccgacagcgcgtccagcgcgagcttcgaaagggaatcgggttaaaattcctgaaccgggacgcggcggctgacggcaacgttagggagtccggagacgtcggcgggggcctcgggaagagttatcttttctgtttaacggcctgcccaccctggaaacggctcagccggaggtagggtccagcggccggaagagcaccgcacgtcgcgtggtgtccggtgcgcccccggcggcccttggaa

SEQ ID NO: 11407 - DNA, 534 bp, Gossypium hirsutum
  Clone ID: uC-gsflmaxxa091b07b1
gtttttgcagctgctggagatgttgacggcgatcggtgttgtttggtgcagagtgatagtaatgtaccacgatctgctattatacctggatggtcgtcagatttggtcagtgagtcttcattgccaagctctcaagatgaaaaacttgatgaaatcaaggatgccgaaatgatgctgtgtcgtgtagcttcgcggagggatatggcgacgcaaatgagcccggacaacagtagcagccactcatctactagagagaggtcttcattcggccactcacctccccctatccttcctcttcctgctgtggacaacaatgatcatccttctaaactggacatcagggaagtgcagatagacaagcgagccactgttactaaccggtcaaaaaggcatggatcgagaagaatcaagaaaggcgagccggattttgaaggcttctaccgaaacagcgccccaacttctgctttatctctggatatcgcagaggcagcaacaagcatttaaaagttcaaagagaggatgcaaagatcagtg

SEQ ID NO: 11408 - DNA, 392 bp, Gossypium hirsutum
  Clone ID: uC-gsflmaxxa091b10b1
ggtgtttgtaataaaatctgcaatcttaattctgtcggggtttttatctgtaagcttcagttcgggtgctaggttgctccaggaacagcccaatgatgacctcaaaaacatggaagctattcctcccattgatgcactcaaccctaccgagttcaatggacccggtgttggcattcacgaagatcatgttgtcccaaaaggttccgaaattggtactcttggttctggttctgaaggtggacctgaaaaatgttgttcttctggatgttccggtaattgaaatcctggtggttacgatctaccatatgctcaaattccagaaatcccaagaatttcacagatcccccagatcccacaaatcccacaaattccactaatcccacagatcccac

SEQ ID NO: 11409 - DNA, 550 bp, Gossypium hirsutum
  Clone ID: uC-gsflmaxxa091b11b1
ctatatagttgagccaactgacacaaggaggcctttgggtgctttttttgatgtatggctgatcaggacaaccactggcaatcgtgtttttggtgctctaaagggagccttggatgctggtttggatattcctcatagcgacaagaggtttgctgggttctccaaggacaacaagcagctcgatgctgaggttcacagcaagtacatatatggtggccatgttgctgcatatatgaggactttgatggaagatgaacccgagaagtatcaatctcacttcagcgagtatattaagaggggaattgaggctgataacattgagtccttgtacaagaaagttcatgctgctatccgagctgatccaactgcaaagaagactgaaaaggagccttctaagcagcacaaaaggttcaacttgaagaaactaacatacgaggaaaggaaagctaagttgattgaacggttacacacccttaatgccgctggtggtgattcagaagaagaggattgaatgtaggaatgctcatttcaaagcactaaaattattaca

SEQ ID NO: 11410 - DNA, 516 bp, Gossypium hirsutum
  unsure (1)..(516): unsure at all n locations
  Clone ID: uC-gsflmaxxa091c02b1
cttcttactgctgtatttatgttaatgcatttcctaatgatacgtaagcaaggcatttctggtcctttatagagaatatagaccatagctatattgtaaccaataatttatcttattacttgggggaggaacaatagtatttcattgctacaaatatggattattgaaaaaaaaaataagacatgtatttggatatttcctttcaactacaacaatattctagtatttatttgatatgacatgaatagttgaagggaattccccgaagagaaaatggattatgggagtaacaaaaaaacctgacttgaacgatcctgtattaagagctaaattagctaaaggtatgggtcataattattatggggaacccgcatggcccaatgatcttttatatatttttccagtagtaattctcggtactattgcttgtaacgtgngcttagcggttctagaaccttcaatgattggtgaacccgcggatccatntgcaactcctttggaaatattacctgaatg

SEQ ID NO: 11411 - DNA, 587 bp, Gossypium hirsutum
  Clone ID: uC-gsflmaxxa091c03b1
cccactctttcggaaagatggaaaggaaaaaaaaaggggggggactatttagaccttagtaaccaagcaatcgaccataaagcaaactcttaataactaaacggcagtgataaacagtcattcattagtttggatcactgatcctttcttcaacaaaattccattcaccccccattccatcttctcccgtaatagccatttcccaccagaaccaaagaatagtaatgcagagcctccaccgaataaagaaaaaaacataaccttccattcttgcccttcaccactctccctcagcaaacacctcaagccaccacacccccatccctgtctcctcgtttccgttcgattattttcatcccacgatagagtttttgattttgagctttgaatcagttacagagtttttgagcatgaaaaagaaaaagaaaacagagataggggagatgaggaaatcgttcaaggattctcataaagttcttgaagcttacattcatttcaccaaattcctaaagcaagggattttaatttcaggttgggattgattttacaaggatacaataattttctatcggtaattactctaacag

SEQ ID NO: 11412 - DNA, 500 bp, Gossypium hirsutum
  Clone ID: uC-gsflmaxxa091c07b1
ccgtatatgtccactggagtgtgcaccatccggtggttttgaaccgcaggccccattccaccccactctttcaggcttcaaaaatattcgcactacagtgctgaacggtgcatggccattcttcctaggatctgcaaacctcgcggctgacacaagatgggaaaccctcgaagctctaagatgcgctctcctttggctcgatctagcatacaatggcgtcctattcgtagaatccctaatgagatggcaggattagttactccccttcattattgatgtcttatttatcctaaaaaactgctgcacctgaccctagtgtgtgtatgtgatgcacacatgaagaacgctgggcctatgtcaaaagtaacaaattattctatgaactcctgccacacgttcagccttctaaagatcttatctagcgctaacgaccattagcataaaattctagcatggattccttacatcttacatgcaggtgctgccccatgcaccaccct

SEQ ID NO: 11413 - DNA, 552 bp, Gossypium hirsutum
  Clone ID: uC-gsflmaxxa091c09b1
cttgttcctaaaaaatctcactcatataatttaaagtcgaagtttttgctacaccaaaggtaaatcacaaaacccatttctcttccttacatcttttctttccttttcaacaattgcatcttttgctttcgatcccaaattctgggtttcctcttctgtccatcagtcaattcatactagttactcgaattcgttaattttaagtcgaagaaaaatgggaggtggtagggaaggcgaatcaagtgacaaagggctgttttctcatcttgctggctatgccgccggacattatcctccgcctggatcctaccctccacaaggatatcctcctcaaggatatcccccacaaggatacccaccggctggatatcctccaccagcgggatatcctccacatggcggatacccacctgcagggtattcttctcatggaggataccctcatccacctcatggtggatattcaccagctggttatcctggacacggttcgcatggacctgtgatgggaggattattagcctgcgcctgggcttgcgttgctgttcttta

SEQ ID NO: 11414 - DNA, 359 bp, Gossypium hirsutum
  unsure (1)..(359): unsure at all n locations
  Clone ID: uC-gsflmaxxa091c12b1
gatatgtttctagacactgaccgcgaaacaganaaatgcgtggtttaaaaaaacattaacggtcaccgccccacctgaaancccagacactgagcagcagccggcggcagcagaggagccaaagcccgctggaaagcctgagaaggagaagagacccaaagctccaaaggagaaaaagcctaaacaacccaaatccacagcacgccctccttattatcagatgatcaaggaggcgacccaggctatgaaagagaagagtggttcaagacacgacgctcaagccaaatacatggaagagaagcacacggacggtgcctccagcgaatgccaggaaaaccttagggcatcagctgaaaaac

SEQ ID NO: 11415 - DNA, 420 bp, Gossypium hirsutum
  Clone ID: uC-gsflmaxxa091d03b1
ctcatttttacgcccacgcgtacggttttactagtgtgggatagcttgaagtggcggtcatgacaaacgctggaacttacgaaaagtaaattacattggtttgctggcttgaaagaaaggtacactgcatacataaccgaggaagcaaaacacttgtactgtctttgacactaacaatgaactgaactggcttcagctgagctggaggcaaagtgttattggaaggtagcttagagggatgtactatgcctctgcatcagttcctgccttacatgctaatagggggctgatgaggttgacaaagaccagacagatcatcatgttatagatgctcacgaacggtgaagaccgtacaatacctcaaacactgattggaatattctttgaggagatcagacatgctggtgctggtgggctgag

SEQ ID NO: 11416 - DNA, 257 bp, Gossypium hirsutum
  Clone ID: uC-gsflmaxxa091d04b1
ctttattgagcgaccctaatccaattattggccccatcactctacttcacccacgacgcgagcctttcgagcatggcctcttacctatccagaagctcattttcaccgaccccctgcaagccctaatccctctcaaacaaaaactcgcttcttcttcttcttcttcctctactcaccgagtcaactcggatgcccttgctgatgcgctccagatctcatccgaacatgcgcgtctcatccttgatactctcgcctcg

SEQ ID NO: 11417 - DNA, 333 bp, Gossypium hirsutum
  Clone ID: uC-gsflmaxxa091d07b1
agaagtatagttttagaggtgttgatttggatgctatgcttgatatgttcattgatgagcttgtcaagcttttttctgccgagcttgcagaaggttcaagagtggtataaagagaaagcccatggcttaaatcaagaaacttctgaaggcgaaaagggaggctctaccaggtgagaagttagaaccagataaaacttatctttgaaatatgatcattagactccgaaatgattggtagaattatttggtgtgtacaatggcaatacattaatttatgttgagatcaagtctgaaatgatcagccataaactttgttagttcttatattatata

SEQ ID NO: 11418 - DNA, 500 bp, Gossypium hirsutum
  unsure (1)..(500): unsure at all n locations
  Clone ID: uC-gsflmaxxa091d08b1
ngaatagttccaccgttacgtatggtggcgctaatgtgtgttttattatactncatccaaaacaaggaggcgcggaacccctgggattacctttgaagaaagcaaagaagctaacacagctacaggtcaagcaagccaccggcattcaaggggacttcatgacaagggtcatacggatacgagaaagctgaaattggaaggtagggtggaaacaatgcaagcctcgcacaattcgaatgaagatgagctttctggttttgaagaagctcggaatggaaatgctagaaagcatatgcctggctggcctggaagctctaatgtccatgatacaacagggacaagtagggggcagaatgggcaagcaagtcatggaggatgggcactttcttttaccgagcgatcatagctgtcgggaaaagcaatgatggatgccaaagacagtgaagggccataacgcggccagaattctacaaagggcaaaggtctgtgagcccttaaag

SEQ ID NO: 11419 - DNA, 552 bp, Gossypium hirsutum
  Clone ID: uC-gsflmaxxa091e02b1
gcgttgggtcatgtatattattatatcctccaccatttgtaaggaggaaaacagtagacaattctttctgagttccttccctatctcacctttcttctgagatagcgactggaactcggtgtttgtcttcccttgaatcttctcatcctttcttttctaaaaggaagatggcatttagtgggacgacagataaatgcacgatttgtgataagactgttcatttcattgatttattaactgctgatgggattccttatcataagacctgcttcaaatgcacccattgcaatggcttactcgtgatgagcaactattgttcaatggaaggagtgctctattgcaagcctcactttgaacagctcttcaaagaaactggcacttataccaagaatttccaatccaaaaaatccgacaggccaaatgggcagacaaagactccgaacagacttgcagccttcttctcaggcacacaagataaatgcggagtctgtaacaaaaccgcgtaccccttagagaaggtgacagtggagggagaaaactaccacaaatcct

SEQ ID NO: 11420 - DNA, 530 bp, Gossypium hirsutum
  Clone ID: uC-gsflmaxxa091e03b1
ggaatttagagacgagtttcaccaaaccatggggtcggtccccaattctggcgagttgaccgagttaacccagccgagtttcgatgagttccagcgtcaaacgtctctgatgaccagctgtactctcctctggaaagaactgtcggatcacataaattcacttgagcagaacctgatgaagcagtcggagaccttgaaacgcaaaatcgaggcactggactcggagaccaaggcttcactcgactcactcaagaagcgggaactcagtatcgaggacagtgtcaagatcgcactcagccgagtcgagttcaacaccaaagctgccatgaggacccttggagacgacgttgaagacaatccggacggtgaggtcgacgacggagacggacttttgcaacacttgaaatcaacgtgcttgaaaatggaagctaaagagttctggagcttcgtgatcggaaaaaagaaagaaatcgatttgttaagagagaaaatccctgcagttttatcggaatgcatcgatccggcgaggt

SEQ ID NO: 11421 - DNA, 200 bp, Gossypium hirsutum
  unsure (1)..(200): unsure at all n locations
  Clone ID: uC-gsflmaxxa091e04b1
caattttattgaagagatttttggacaagacacctgggataagtgcagatagttgctcttgaaaagtccagaatcttctcagtcaagaaggctatgattttggttatttaattatttatttttcttttattactcccttgtaaattcatctactaaatgtaatttgcttcagcatgttaaaaagtgatcttaatnngatc

SEQ ID NO: 11422 - DNA, 280 bp, Gossypium hirsutum
  Clone ID: uC-gsflmaxxa091e07b1
ggaccctctttcaaaaccccaaaaccagacacttttaaactactactactatacaaggccccccctcgacgtaaaacaaagcaagctctcgcttctttctttttgcttgctttgatttctgactttaggggttcaaagaggagggatcatttcttgctgtcttgggtgtgattttggggtattcaagttatgggagaaaattttgagaaaagagtgaaaatttataatataaagctatgcttgagttttgccgttctggtgaatgtattggcgtttgccg

SEQ ID NO: 11423 - DNA, 592 bp, Gossypium hirsutum
  Clone ID: uC-gsflmaxxa091e08b1
cctattcgtccgggcatttcctcttcgctttttgtagacatccatctcgtctccagttggcctctgaaattccacaccctaatttgtttctttagggtttcttttttcaagatccaaaaatccattttttttcttgttatttagagaatctgaatcgaaatcaagttcataaaacatctgaaaaacaaattttggattcaattattccaggtattttagattcctttaaagtttgatccgacgttggttatcagatggcggatcaacaagaagaagaggatcttagaatggctctacggatgagcatgcaaaactcgccgccagagccgaagaggagcaagccgagagaagccgcgaacttagcgacgacgacgccggaagagagtcgccggttgcagcgtgaactaatggcagctgcagctgagaaacggatgctggcgacgggaaaaagcgttccggcttctggttcccctctgaaaagtgatagtggcggagatataggaaccaaagagatggaaataaagccaaagaagtgaaattggtgtatgaattgtcggagaaagaagcttatcagttattttttatggttttt

SEQ ID NO: 11424 - DNA, 404 bp, Gossypium hirsutum
  Clone ID: uC-gsflmaxxa091e10b1
cttatatgggggagattgttgatgctaacacctggtggtggaattttaaggccttattgcaaggaacaaagcattagctcttataatggaacagatactgggaatgaagtaaaagctctttatgatctgactaagagggtaagcagctccataaatgacgatggttttatccacaaggagggataccagcatgcggtctttagaaacagcagcaagcaaaatctctttgcagatagagtgagtttattaatttattcataaattattattatctaaataaagctgcaattaggttttgttatatcgcatgaattcgactaattcgattgtaaacacaatgggggtaataggatttggagaggggggacctaatttaaagcgatttcatcccaaccctccaatag

SEQ ID NO: 11425 - DNA, 436 bp, Gossypium hirsutum
  Clone ID: uC-gsflmaxxa091e11b1
gtctttgtccgttataattaactaataatccgggaatcttttttacgcattttcgtttatttctttagcctttttttttttttgatttctagaatttgggcacaatgttcgcagaggctgatagctttccgagatccaagattggaaacattatgcattccgatcctaacatgtccatacctggttctgggagtgaagatgatatgtacgtgcggtatagcagtgcatccacttccggccctgcctacgaagcccataggacgagtctagaaggctcgcccataaccatgtcaccgtggaaccaaaccacttctttcatgaaaccttcaactgtcatttccgataatgatgttccagctaacagccttattcggttcgcttaacacgtgaagagggtcatattttattccttggcagtcacaaaggatctccttta

SEQ ID NO: 11426 - DNA, 506 bp, Gossypium hirsutum
  Clone ID: uC-gsflmaxxa091f01b1
ggaagtattaatgatgggcactcacctccaggtaggagtggtttgtaaggtgtaccctggaaagatttctcccaaggtggttttagacttgggaaggagggttctttgatgggaaagacatctggaaagaatgcctctggtaaacaaggagaccatgccggcacggttcgtaaaaacaagcgggcccctaagagacgtctacttgatggggaattcagtgaagatgacaatgatgatgagatccgttacttggaaaaacttaaaacttcgaagattagtccagcatataaggaagatgatgatgaaccaggcaagaaacagaaaaaactctccagggtttccatcatagaaaactttggcacttcaagttctgccaaagatgagaaaaggaagcatagatcggatagggtttttgaggataccgattatgaggaggaagatgaaccagtaactgatagtgagcttggaggtaagaagaaaaggaaacaaaggaaagaatctgttga

SEQ ID NO: 11427 - DNA, 561 bp, Gossypium hirsutum
  unsure (1)..(561): unsure at all n locations
  Clone ID: uC-gsflmaxxa091f04b1
cggttgtgtgggatttcaaaaaggaaaagaaaagggggcatatttttgaatttcgtggatctcatcgcatcgnattttgcaaaaatatcacagcatctaatttccttttgaataacatattaataatttatttttcttatattcaattcctccgccttcttcaaggaattttaactctcaattcgatagctcatcaaagaattggaattggttcctagttgaaggtggtgaaatcggatatgcagagccagcttatctgtactgggtgtcggagcattcttctttatcctagaggtgctaccagtgtttgctgtgcattatgcaatacaattactccccctgggatggaaatggctcaactcatatgtggaggttgtcgaacattatccaatagtatactttataacattcatttcttttagaattaagattatggtatttcaacttatattggattacttgggagttgaaacatgagtgtctggatctgtccttagccgccacaggatctgctgtgctattagtttaaaataataaaacatttaccattttattttaaaa

SEQ ID NO: 11428 - DNA, 598 bp, Gossypium hirsutum
  Clone ID: uC-gsflmaxxa091f05b1
cccatttgtccggttccgttccattcatctaatttggcggctcatgttctagtaaactgcaattggacggttttcatttctaaacctttcccccccaaatttctgatacttgtaccggtgaaaatggaggcattgggcggtaattgcgcgttttggggttggaaacttccggagataagaaacacaaagaggccgtttccgtcaaagtcaaaatcctcggattcatccgcagagtcaacgggcagtcgaggctaccgtttcccgttgaagcaagcggtgacagcttcctcactcgctctcacgggcgatactattgctcaactaagctcccattggagaaaacggaaagattccatttctggttccagtgatacaagtaaggatatcatgccaagcgtcatttcagatcatgattggcttcgtgccttgaggatgacttcttatggtttccttttatatggtcctggctcatatgcttggtataaatatctggatcactgttcgccacattagacacccaaaaatataatgttgagggtttactaaaccagatagtgctttggcccttgggtaattggcgttgcctttgcatggaaca

SEQ ID NO: 11429 - DNA, 556 bp, Gossypium hirsutum
  Clone ID: uC-gsflmaxxa091f07b1
ctctttatccgattactccctcccacctctgttctgtgtttctttccatatttctcctctccaaatttctcgtctcttttttttctcaaagacaaacccacattcccctcgaaatgtcgttcgatgaagaagactctattgaacacaccctcctcgtagttcgcgaagtctccgtcttcaaaatcccgccccgctccacctccggcggttacaaatgcggggagtggctccaatccgacaagatctggtctggtcgattccgggttgtctcctgcaaggaccgttgtgagatccggttagaggatcccaactcgggtgagctttttgccgcttgtttcatccacccgggacagcgcgagagttccgtcgagccggctctcgattcatctcgatacttcgtgctcaagatcgaggatggcaatggaaaacacgcgtttattgggctcggttttaatgaacggaacgaggcgtttgatttcaacgtggcgttgtcagatcacgagaagcatgttagatgagagaacgagaaagagactgtcgagacgagtgacagtga

SEQ ID NO: 11430 - DNA, 459 bp, Gossypium hirsutum
  Clone ID: uC-gsflmaxxa091f12b1
cctattcgtccgggctaatctctatttcatcaagggtgcttcctattgacatgaatcttctaaagcgacccgctgaagaggcccaaggccatcgaaccccagagtcccccacgcaacagcaatcatcagtagcttttcagagcttcaggaatcaaagtcagctaaatccatcaagctcaattgcacagtcatctgtatcatccaacgtttctgtgtctgatagtagtgtcgagtactcgagccctaacttaatgcagagaagaagtacaaaagttcaagaagcagagctttctcaataaaagttagtcttccggtgtagaatgtataccaagttagttcaagttctacctcatgcaacttaaaatcttctttgggatgaaaaatggggatatataatatatggagagagagtcttttacataagtaacgaaggatgcacgattaggatgtgctctatat

SEQ ID NO: 11431 - DNA, 454 bp, Gossypium hirsutum
  Clone ID: uC-gsflmaxxa091g01b1
aaggattttaagattctaaaatttttggggtttatgtggagagtccactgtcatgggtgatggaagctgctgcaatcatggccattgctttggctaatggtgatggaaagcccccagattggcaagactttgttggtattgtttgtttgttggtaattaactctaccatcagtttcattgaagaaaacaatgctggcaatgctgccgccgctcttatggctggtcttgcccccaaaaccaaggtgcttagggatggcaaatggagtgaacaagaagcagcgattctggttcctggagacatcattagtattaaattgggagatattatccctgccgatgctcgtcttcttgaaggtgaacccttgaagattgatcaatctgctcttactggtgaatcactcccggtgaccaagaaccccggggatgaagtcttcttttgttcaacttgcaaaca

SEQ ID NO: 11432 - DNA, 481 bp, Gossypium hirsutum
  Clone ID: uC-gsflmaxxa091g02b1
gtcatttgtgtgtgggatgcttatgaagctacaaagggtgctcatgtaatatgtattctaactgagtgggatgaattcaagaatcttgacttcaagaggatatatgacaacatgcaaaagccagcttttgtctttgatggccggaacattgtaaacgtggaccagctgagggagattggtttcatagtgtactcaattggcaagccacttgatgcatggctcaaggacatgcctgcagtggcataaatgatgcatgcagaggttatcgatgcgcgtcaatgtcagtttgattctttactacctatctttttgacaagttttattgtttccttgcttttcctttcccatggtagccaagcatttgaaggccagaaacggctttttgttgtgccacacattgtattcaataatatttaccatctacttctgttggttggtagaaaacttgatatttattttggatttcatcttatttcataat

SEQ ID NO: 11433 - DNA, 553 bp, Gossypium hirsutum
  Clone ID: uC-gsflmaxxa091g03b1
ggggatttcaatgagtatttcagtgaggcaacagatgttgatgctgttgtttatttaatgctggccaattctctgataaataacatcttgccagatgcgactgtaattgctgaagatgtttctggtatgcctggacttggtaggccagtctctgaagggggaattgggtttgactaccgcctggctatggccatccctgacaagtggattgattacttgaagaataagaatgatgaagagtggtcaatgatggacttatcctgtagcttgacaaataggagatacactgagaagtgtatatcctatgctgagagtcacgatcagtctatcgtaggtgacaagacaatagcatttttcctaatggataaagaaatgtactctggcatgtcatgtttaacagatgcttcttcctaccaatgaccgagggattgcactttacaagatgatacattttattactatggcattaggaggagagggctaccttaattttatgggaaatgagtttgaccatcttaaaggattgactttcaagagaaggcattggtggagt

SEQ ID NO: 11434 - DNA, 528 bp, Gossypium hirsutum
  Clone ID: uC-gsflmaxxa091g06b1
accagttttaaaatttagttaaaacaaggaaaaaatgccactgggattgatattaggaattggaaggacgtttcgaaggaagcgtacctcatcgctcgatattctctcgtctaaacgagcaccaagagattattacaaggggaaaaattgcaagtctactggtttccacactcgcaaaggtggatatgttgtgatgcaggagaagttgccaaactatgtggttcctgatttgactgacttcaagctcaaaccatatgtatcccagtgcccaactgaagtcaaaaccgcagaggctgctgaatcagctaaataatcagcagatggagtgagtatagttgtttgatcatgtatttcatcatctaacctcagccttgttaaattagaacatagtcttttggggtgcactgccttaggtcaaggtcttgcgagttctttatttttggcctacattctaaactattaacaattgcctgtaatgtctgaggtctgattgcttaaatgtacaacacctttacctgattagctgat

SEQ ID NO: 11435 - DNA, 511 bp, Gossypium hirsutum
  Clone ID: uC-gsflmaxxa091g07b1
cttttatttttttctctttgttgacctaaatctcttggatttgcttctttcaccatgaccaagcagcaggctaactggtctccttacgacaacaatggaggatcttgcgttgcgatcgctggagctgattactgtgttatcgccgccgatactcgaatgtcaaccggttacaatatactgacccgagattactccaaaatatgtaaacttgcagataaatgtgtcatggcatcctcaggatttcaagctgacgtgagggctttacaaaagcaactggcagctaggcacttgatttatcagcatcagcacaacaagctgactttgaaagataccttgaagccgattttgataccctgctacgatctctgttccaacgcgccattcttgttttcccgcgctgatgcattggaaatggacggctatgatttcaagatgaaagacgtgtgctacgcaacgtcggctgatccgacggttgtgggagcagtgcgaatgaagtcagtggatgagagga

SEQ ID NO: 11436 - DNA, 512 bp, Gossypium hirsutum
  unsure (1)..(512): unsure at all n locations
  Clone ID: uC-gsflmaxxa091g09b1
gttgttaagggtcgactttaagaccaggagctcgcccgtcaagccccaaaccaccaggcttgttgctgatttgaagtttcgaatgtcgaacgccacattgaactggatcgttattctcgatatgtccttctgacctctgtgattcttgtttgtgttgaaaggattcggagtttctctcaccccttcattttctgccatatacctctgtattcgatgagcaagttctctacctgtcttttccttcctctcgtgaatgagttgatttctagaaaaccagattagccataaagcaatacaaaaaaggcaacattgttccccagttcctctcttgaaaacctagggcattgacgaaaaaaataaggactgtttcaacctaagaacggcaacagggacatctgtcacttgtagaaactcttcggtatctgagattagctagatgaaggatgaaatcccaagagattcgccaaataattatagtgattttngaaggaagcttgaaaccccataatttt

SEQ ID NO: 11437 - DNA, 519 bp, Gossypium hirsutum
  Clone ID: uC-gsflmaxxa091g10b1
gatttttccaagaggagtacatttccgacgggctgggccacgtttaaagatattttgaggaacggtgtcatctacatggataaaataatacacacgtttatggagtatgtaaaagaacatatactatcataatgtcattaatgagtgcatctagcatcaaaatatggggattatttgaggaacattttacttggacgcttggttctgcatctgatgaccctgtggttatgttcttgaagatgtccctcacttatcggattacatccctgatcttcctgtttattcgaatccgttgcaagacaatcctgcatactcagttgttaagcaatattttgtccatgtagatgacaccgttcctcaaaagattgttgttcacaagaatagtccaagaggagtacatttccgacgggctggaccacgtcaaaagatatttttcgactctgatgacgttcatgcctgtattggaacgtgtggtggtctttgccctggactcaacaccgtgattagagagatagtatg

SEQ ID NO: 11438 - DNA, 454 bp, Gossypium hirsutum
  Clone ID: uC-gsflmaxxa091g11b1
aatcttaagagcaaaaaaaaaaaagaaaaaaaaaaaggagagaatgaaacactcttttttgcctattcccattccccccactctttttcttttgccctttttgggattctggaaatcccaatcaatgttcttccatttcatttgaccttttttcataaaattgttttagcttctgtttttttcttttgttgttgttaagctgatactgctggtggttgctgtcagaaacaaaacatgggtgctatcagtcttgaagagatcaagaacgagactgttgatctggaaaaaatcccaatagaggaagtgtttgagcagctgaaatgtagcagagaaggattgagttcagaggagggagccaacaggcttcagatttttggaccaaacaagttagaggagaagaaggaaagtaagatttttaaatttttggggtttaatgggaatccactgtcatggg

SEQ ID NO: 11439 - DNA, 359 bp, Gossypium hirsutum
  Clone ID: uC-gsflmaxxa091h01b1
caacatttggatcattgatggtccttgctcatatgattggagttagcattaatctcctctcgctcacaacaggtgtttcctgaagatcttcttgttcaactgatgaaagcaatgttgcatcccaatgttgaggtccgtatgggagcacaccacatattttcagctcttcttattccaagttctagtcatcctcgacatgaagttgcatctctgcgttccggttttgtctatgaaccaagaagatggcgttccaccaatgcttctgcatttgcatccatatcagcgttgcttgaaaagctccgaaaggaaaaggatggcatcaaattggagaagaatggttgtaatattcatgaagattt

SEQ ID NO: 11440 - DNA, 358 bp, Gossypium hirsutum
  unsure (1)..(358): unsure at all n locations
  Clone ID: uC-gsflmaxxa091h02b1
cccactttttcgtccgcttctctagaggtctggncactgaagactttgaactccctcttagcaaccaaagactcagatccgctcggatttctttggcccagaactagaatggagacctttctattcacatcagagtccgtaaacgagggacaccctgacaagctttgcgaccaggtctctgatgctgttctcgatgcctgccttgcccaggaccctgacagcaaggttgctgttgcaatgtgagccagggctgttagggttccctttctcagaatactgggcctatcgggctagtaattgataatggggcctgggcattgtaaatttggggttaaaattagggtatgtaacttggact

SEQ ID NO: 11441 - DNA, 438 bp, Gossypium hirsutum
  Clone ID: uC-gsflmaxxa091h04b1
cccatttgtccgatcttttttagttccgacaaaagaaggcgaaaaatttagaagaaatacagtcgttttctttttgaagtcgggttttagtttttggggagaaaaaaatgttgggagtatttagcagtgcgatagtgtctccgccggacgagctggtggcggccggttgccgaactccatcacctaagataacggcggatgctctggtgaaacggttccttgagacgaactcctccggcgtgtccatgcagatcggagaccatgtccaattcgcttattctcaccataaagagtctcctttacggcccagatcatttgctgtgaaagatgaaatcttctgcttgtttgagggagcccttgataacttggggagtttaaagcagcaatatggtctggcaaagtcggcaaatgaagtgattttggtcattgaagcttaca

SEQ ID NO: 11442 - DNA, 520 bp, Gossypium hirsutum
  Clone ID: uC-gsflmaxxa091h06b1
cccatttttccgaaaaaaaaaaacaccattgaagaggtgcgtttttttgtcaaaaaaaaaggacccagattctcaaactgggtttttagctttcatttttccaatgtataaaccttgaacactcctttcatccacaagagctctcttttatgattttgtttttcattttgtgtgtgaaaactagcaatgggtaaaaatgtatcagctttgtgtgtgatagctcctttgcttcttcttggagctgtctcttcagctcccactacttcttcacctgcaaggattcttaatgggtttttctctaatgctttatctgcttcactgaaatggttatggtcactcaaaaccactaccaaaacagctattactgggcgtccaatggtgaaatttgaaggtggatacactatagagactgtgttcgatggaaagaaacttgggattgagcctcacacttgtgaggttttgcctaatggggagcttttgattttggattctgctaatagcaacctttataggatttcag

SEQ ID NO: 11443 - DNA, 442 bp, Gossypium hirsutum
  Clone ID: uC-gsflmaxxa091h07b1
cccacgtgtccggtcgacctaagtctcttttatttgggtgtttttttatgaccaagcagcaggctaactgctctccttacgacaacaatggaggatcttgcgttgcgatcgctggagctgattactgtgttatcgccgccgatactcgaatgtcaaccggttacaatatactgacccgagagtactccaaaatctgtaaacttgcagataaatgtgtcatggcatcctcaggatttcaagctgacgtgagggctttacaaaagcaactggcagctaggcacttgatttatcagcatcagcacaacaagcaaatgagctgccctgcaatggctcaattgctttccaacacactttattacaagcgtttctttccttattattcttttaatgttttgggtggccttgataacgaaggaaagggttgtgtcttcacatatgatgc

SEQ ID NO: 11444 - DNA, 493 bp, Gossypium hirsutum
  Clone ID: uC-gsflmaxxa091h08b1
gcagtacaatgaaatccttggaaaagggggttcatttacagattatagagcatttgatgagtatgaagggattgaagttgcttggaaccaagtcaaactttatgattttcttcaaagccctgaagatcttgaaagactgtattgtgagattcatctccttaagacattgaagcacaagaatattatgaagttctatacttcttgggttgacaccgcccgtttttgggctgcttatcttgacgacaagtggttcccttccttgagagctattggtatggctgaaggagaggatgcaaggaaagcagccatagggcaagtggaggaagggctgatgctgttagaggaggcatttgacaagtgcagccaagggcaggcattctttgggaaggatcaaattggatatctcgacataacatttgggtgctttttggggtggctaaaagtgacagaaaagatgagccggatcaagctgcttaatgaaatcaacactcct

SEQ ID NO: 11445 - DNA, 358 bp, Gossypium hirsutum
  unsure (1)..(358): unsure at all n locations
  Clone ID: uC-gsflmaxxa091h09b1
attttatacagaaacaccctcacttctaaatatctgcgtgtctttttacctttttaccaattcccagctcttttttttttccatttctgtcttaagtctcaccatctcttacaaagtaactcaatccttgcaattagctgtaacagatctgtttagagctgaagctttcttcataagaagcagtgaattgcagatctgttagtctggttttggatttttaagttgtgggctattatcttgacttcaatcagtgaagagcaaggaaaagaaaaagagggaaaaataaaaatcaaaacataccctttnttgtgtgtgatatatttattggggtgtggctgccatttttcaggtttttttt

SEQ ID NO: 11446 - DNA, 496 bp, Gossypium hirsutum
  Clone ID: uC-gsflmaxxa091h10b1
cctccaaaaacttgggttgggtgtcatttacatccaagtcctaaaataccccaaaaatttcataaaaaaagtgttcctaaaagctcaaaagaattcataaaaatagaaatggaaactgggttttattcagcatgggagaatggttctttattagaagaagatggtgatgatgaactgatccctcagccattaacaccaacggagccaatggagtttttatcaagatcatggagtttatctacatcagaaatctctaaagctcttgcccagaaacacaatcactttgaatttgatcatcataataatgataataagaatcaaagttcattgttttcagaatcctttgatgcaccacaaattgcagggaaagtgatgaactccattaatggtcgaagaacaggcacaatcagcaaatggtttaatcatcacaaagaaataggaaccaacacagtgaagaagaaagacaaaatacgtgcagaaaacgctcgggttcact

SEQ ID NO: 11447 - DNA, 536 bp, Gossypium hirsutum
  unsure (1)..(536): unsure at all n locations
  Clone ID: uC-gsflmaxxa092a04b1
cccacgcgtccgcccacgcgttcgcccacgcgtccgcccacgcgtccgcgagcctcgaacggaacccctcgggtcggacttttccgtcattcgaaccctaaattaggggaacagcttncttacttcatnctctcttctcttcgtggccccgctcaatccgccagagatttcgatagagtttggccgatttttgactcagcgcaatctcgtgattttcgaaaggttgtgcaagggataattactgagctggaagcacaaggagctctaccgaggagtaattcgagggtttcttcgcttgctacttgctgtggaccgagatttgttgagcttttgtggcaactttcattgcatgcattgagagagtttcatagaaggaattttgcggcagatgttgcttctaacccattgcctgcaccattgactgatgttgcattttcacatgcggccacactacttnctgtaacataggctagaatagcacttgaaaggaggagatttttgataaattcttgaacagcagtgcagagacaggctat

SEQ ID NO: 11448 - DNA, 404 bp, Gossypium hirsutum
  Clone ID: uC-gsflmaxxa092a05b1
cgaaatcttcttcattctcattctctctccactgaactcttgctaaacggtatcgttttagtcagtctttcatcaatggcgaaagaaccagttcgcgtcctcgttactggagctgcaggacaaatcgggtatgctcttgtacccatgattgctaggggagtcatgttgggtgctgaccagcccgtgatccttcacatgcttgatatcccacctgctgcggaggctttgaatggtgtcaaaatggagttggtggatgctgcatttcctcttctaagggtgttgttgctacaactgatgctgttgaggcatgcactggagtcaatgttgctgtcatggctggtggtttcccaaggaaggaaggaatggagaggaaagatgttatgtcaaagaatgtgtctatttac

SEQ ID NO: 11449 - DNA, 467 bp, Gossypium hirsutum
  unsure (1)..(467): unsure at all n locations
  Clone ID: uC-gsflmaxxa092a10b1
gatttggtcaatgttcttaactcggagataaaaactggtgatgattgtgtttcaattggggatggttccaaaaatttggttatcaatggagtaacttgtggaccaggacatggtatcagtattggtagtctcggattatttaaaaatgaagaaccagttgatggagttacagtaaaaaattgcaccatgactaatacttccaatggtgttagaatcaaaacttggccaggtgctgaacctggcacttgttcgaacattcactttgaggatattaccgtgaccaatgtcagttctcctattataattgatcagaaatattgcccatggaacaaatgcaaaataaatgaagaatcgaaagttaaactaagcaacattagtttcaaaaacattcacggcacttctgcgcgtncagaagctgtcaagattatttgtagtgctactttgccttgtgaaaatgtagaacttgc

SEQ ID NO: 11450 - DNA, 472 bp, Gossypium hirsutum
  Clone ID: uC-gsflmaxxa092a11b1
tcgctcttataaattgtggggagcgcagactgagagagcgttacataattttgaaattgggggagagcgtgaacggatgcctgaacctattattcgggcctttggtgttctcaagaaatgtgctgccaaggttaacatggaatatggtcttgatccaaccattgggaaagccataatgcaagcagctgaagaagtagccgtaggaatactcaacgatcactatccgattgtcgtttggcaaactggtagtggcacccacagtaacatgaatgccaatgaggtaattgctaatagagcagctgagatccttggacatcagcgtggtgaaaagtttgtgcacccaaatgatcatgtgaacagatctcaatcttctaacgacacattccccactgtaatgcacattgcagctgctatggaaataaactcaagattaataccaaaattgaaaattttgcattctactttacattca

SEQ ID NO: 11451 - DNA, 473 bp, Gossypium hirsutum
  Clone ID: uC-gsflmaxxa092b06b1
ccctcgcgtccggaaacaatggagtccaacaccaaaatgtcagctcttcttttgatttgcatgcttttcatttcttcagtgacaccaattcttgggtgtggttcatgtgggaaagcacacaagcatcgaaagcctaagggaaagtcccctaaaggtcccatcactttgcctccccttgtgaaacctccaatcaagttgccaccggttgttcctccaatagttaagccacccattgacctccctccggttacggtccctccaattaaccttcccccagggacggttcctccagtaactaagccaccaagtgggaaaccctgcccaacaccaccaaccaaggacacttgccccattgacacactgaaattgggtgcttgtgtggatctgctgggagggttggtgcacattggactaggtgacccggttgtgaaccaatgttgtccggttctttcaggactcgccgagctcgaagc

SEQ ID NO: 11452 - DNA, 481 bp, Gossypium hirsutum
  unsure (1)..(481): unsure at all n locations
  Clone ID: uC-gsflmaxxa092b11b1
cggtcgcgtgggaaaaaaatctttccagtttctatgttctaaaaacaaaactgaaaatgtcttgctgcggaggaaactgtggctgcagctctggttgcaagtgtggcaatggctgtggaggatgcaagatgttccctgacataatagagaagactacaactgagactattgttcttggtgtgacaactcagaaaatgcactttgagggatctgagatgggagttggggttgagaatggatgcaagtgtggagacaactgcacttgcaacccttgcaattgtaaataagagggggggaaaatgaacaacaaagagaagcagagaggcctttgtctttttaactaaataaattctattactttagtatgtatcagcaaatcttcatgaggatttggctcttaattatgtgtaatgtgggcttttctgctatgtcagaatgtattatgatatttaagaaagttngttttcaattgaaagatggc

SEQ ID NO: 11453 - DNA, 479 bp, Gossypium hirsutum
  Clone ID: uC-gsflmaxxa092c06b1
gtttaggagctctagtgccactgtgctaaagcctggtaggaataaaatcacctttcctttaccacctcaaaaacctggatcatatgtcctcggagttcttactggacacattggacacttgacttttagatctcacagattctccaaggcaggtccagcagatagtgatgatttcatgagctatgagaaaacaacccggcctgtcttgaaggtttccaaaccaagacctctggttgatctatctgctgctatatcatctgccttgctgattaaagaagctcagtggattggaattatagcgcaaccaataaactactccttgaatggtgctgtcatgcatattgatactggtccaggtctgaagattgaagatgcgcattccatcgagatggagacctacataaatgctgctcaaatttccactgatatggcagactctggcgatgctaggaaagatggtaataaaaactctgagcagc

SEQ ID NO: 11454 - DNA, 411 bp, Gossypium hirsutum
  unsure (1)..(411): unsure at all n locations
  Clone ID: uC-gsflmaxxa092c11b1
cccacgcgtccggtttgctgccatgggaggaggagaagaatacgaagaggaagcaccggtgctacaatcgaagccccgaggccgccacataaagaaaagagctctcaaaaacaaagcactctccgtctctttcaacgagaaggatctcagggattacgtttctgggtttcacaagaggaagaagaagcgaagaaaggaagcccataagaagcaagagcaggctgaacgacgcatgcgtattgaacagcgcaaaaagagaaagttagaaaaagaatttgccctatatgggggagcacttcccaagacatgctcgggacctgatggaattgatgagaacaacgaatatgatgaacaaagagagccagtngcatcagtttctgggacaactatgtatgatggtgggaacatgac

SEQ ID NO: 11455 - DNA, 164 bp, Gossypium hirsutum
  Clone ID: uC-gsflmaxxa092e02b1
gtagccattgttatgaactgtaagaagctcactcgtcttgctgtttctggtttactgacagataaagcttttgactatattggacgatatgggaaactggtacgcacattatcagtggctcttgctggagatagtgacatggcgcttaatatgtactcgagggg

SEQ ID NO: 11456 - DNA, 399 bp, Gossypium hirsutum
  Clone ID: uC-gsflmaxxa092e03b1
ctccgcttctcatgtctctcaagtctcaagatggactcgagctctggagaagagtcagatcttaacgagtctgagatcaatgaatacaaagaatagccatgtgatgagattaggaccggggaagtacaaagtagaggccttaaatggtagcttaagatgcccctttcgtgctgggaagaagaaacaagactacatgtacaaggatctgcttcaacatgcttctggtgtgggtaaaggatccgccaacagaagtgcataacagagagcataccacctggccttggcacaatatttgggaactgacctagccagtgtagcagatgagacctgccgaccaactgtaccacatgctgtggacgagactccagagcaaactgagctttatgtctggccatggat

SEQ ID NO: 11457 - DNA, 241 bp, Gossypium hirsutum
  Clone ID: uC-gsflmaxxa092e07b1
tcgcggtcgcgtgggttgagatcacaaagaaaatcagaacccaaaaggcaaaatagcaaagaaactatgaaccacatgcatggaaaatgtttgattcaaggggagttacatagagaagtgttcggatcaaagaggaggttgggttgggtgaatctgagccgcaaggcattggagcatgatgagtgtctgatttgcttagaaaggttcaaggctggtgacaccctggttcgacccccatgtg

SEQ ID NO: 11458 - DNA, 520 bp, Gossypium hirsutum
  unsure (1)..(520): unsure at all n locations
  Clone ID: uC-gsflmaxxa092e08b1
cgatatatttcctcgctctctcttttatgctcactttctcagccatcaaagacaccctttttttcttaaggttgtaaaagatggcagatggtgaggatattcagccacttgtttgcgacaatggaactggaatggtgaaggccggatttgccggtgacgatgctccgagagccgtgttccctagcattgttggccggcctcgtcacaccggtgtgatggttggtatgggccaaaaagatgcatatgttggtgatgaggctcaatctaaaagaggtattttgacattgaaataccctattgagcacggtatggagaccattcggaaagataggaaaaagtattgattatacactttacaacacgagcttcgtgttgccccggaagagcacccggttttacttaccgaagctncccttaacccgaaagctaaccgtgagaagatgactcatatcatgttcgagacctttaatgcacctgctatgtattgtgccatccaggctgtgctctctctgtatgctag

SEQ ID NO: 11459 - DNA, 389 bp, Gossypium hirsutum
  Clone ID: uC-gsflmaxxa092f01b1
cctgccggcaccgggcccatttccaggtccgacccaggcgtccgccctcgcgttctcccacgcgtccgcttaacgctgaaggttcttgttatattttcattcactatcgaacatgaagaggactttcatgcacgataacccatgggtcatatctcaagaaagcgttggtggttgcttaatacgttattgccgaaacaaaagcctagggacagattcttcaacaaatcaattaccaaatggaagaatattcaaaaggaaccctagaggtagaggactcccagaatgaacaagtgcatgaagaagaaaacaaggaagaatttggtgtcgcttatgggggcgaaagatgattccaattcaagtagtagcagttcggacaaggaggataattc

SEQ ID NO: 11460 - DNA, 349 bp, Gossypium hirsutum
  Clone ID: uC-gsflmaxxa092f02b1
ggagatttgaacaaatccttgtgatagcgtggcaaacaaaacacattgtgtatcatggtccaagtgttgtaaagaacagatctcattgttcggagttgaaaaatcttttcttttccgccgttgccaaatcgagacatagatgggtatatatctcagcacccccaaaactgagaaatttcagaagacggcgagaatgtaagggtagatattggctatcatccttcaagattggctgcaaccctggaaatacctgaaggtaccaatggaaccctggaattttttttaattttctaagcatttggaccttatattattgcattctactagataagttccagcaatgagtttt

SEQ ID NO: 11461 - DNA, 279 bp, Gossypium hirsutum
  Clone ID: uC-gsflmaxxa092f03b1
ggcggtgcatatggtgcttgaggtgcaaatgagggaggatatggaaatggtggcaaagccggaggtggtgaaggtggtcactattagccttgaaagtaccttgtcacctttaccatatattaagagtattaatgttgttacaactggtactaaaaaaaataagagtaatttgatacgtaatccaaaatacttaaaaatatcgtatgaaacttatagaatccaaatagatgatgttaaaagttatatcatatgataatattgaaatgaatctatcatttt

SEQ ID NO: 11462 - DNA, 370 bp, Gossypium hirsutum
  Clone ID: uC-gsflmaxxa092f07b1
ccctcgcgtccgatcaccatcaacctggacctcaagagaggtggcaatagtcggttcttgaagacagctgcttacggacactttggaagggacgacccagacttcacctgggaagctgtgaagcccctcaagtgggacaagccccaatcttaagttcagctctgctgcctgtctcagtgcctgcttattcatagtactgaataatattgccttgctgctcacctatactctctattttcatccccagaaggctgttaatctaatcaatattagtgccctaatcattatccttttttctcccttgattttttttttttttgggtattctgagtttgtgtcctgtatcagtgtcggtattgaaaaatgtatg

SEQ ID NO: 11463 - DNA, 356 bp, Gossypium hirsutum
  Clone ID: uC-gsflmaxxa092f09b1
atacttcactctaacgttccctttgaggttgtaggaaaacagcagagaaattaaggaatggagaccttcctatttacctcggagtctgtgaacgagggacatcccgacaagctgtgtgatcagatctctgatgcagtcctcgatgcctgtttggcacaggatcctgagagcaaggtggcttgcgagacctgcagcaagacaaacatggtgatggtgtttggtgagatcactaccaaagccgacgtagactacgagaagattgtgcgtgacacctgccgtggcatcggtttcacatctgacgatgtgggtctggatgccgacaactgcaaagtgctggttaacatagagcaacaaag

SEQ ID NO: 11464 - DNA, 443 bp, Gossypium hirsutum
  Clone ID: uC-gsflmaxxa092g02b1
gccacgcgttcgttaaaagagaaacaaagaacagatgattcgggaggccaaatacaaaaaaaaacaatggcagcagagacagcgctaagagtatcgcgttcgagttctactgtgtgcaatctaaatgggtttcaaaggagaccaacccctttatcttcttcaactcgttttctgggtcttcgtcctcgagcttcttcttcttgaatttgctcttctttatcccagttcatggggaagtgtagaattggcttaagacttcctatttcatcgtaacaaaaggggaagagaaggaacttctctctctttgctatggccgctgatgagtcaaagcgtgctgtacctttgaaagattatcgcaatattggaattatggctcacatagatgccggaaagacaacgacaacagaacgtattctatactacacaggaagaaactataaaat

SEQ ID NO: 11465 - DNA, 335 bp, Gossypium hirsutum
  Clone ID: uC-gsflmaxxa092g07b1
tcgcccacgcgtccgcccacgcgtacggagaagagggttatccctggctcgggtcctgaccaattcaagtttgcctcgttcatgtctgtaactctaagctgcgatcatcgagctattgatggtgcgattggtgctgaatggctgaaagctttcaaagggtacattgagaatccagagtcaatgttgctctaaatcaatggtgtttgcttctttaaactaaacacactttcttgctgtgatcaattttcgagatggcttgaatccaatacatgtattcctgggcaatatccttcgggagtagtatctacatgtgaaaccaattaaaatttttttgg

SEQ ID NO: 11466 - DNA, 295 bp, Gossypium hirsutum
  Clone ID: uC-gsflmaxxa092g08b1
gctaactactttagaaactcaaacaaactttttagttctcaactctctcaaattcaccatggctgacaagtgtggcaactgcgattgcgctgacaagagccagtgtgtgaagaagggaaacagcttggtcattgagactgaggagagctacatcagcaccgtagtggtcgagcctctggcagagaacgatggcaagtgcaagtgcggaactagctgcagctgcacaaactgcacatgtggcagtcactaagcagacatatagaatgatgaaagtttgggacctaaaaagaataaa

SEQ ID NO: 11467 - DNA, 394 bp, Gossypium hirsutum
  Clone ID: uC-gsflmaxxa092g09b1
agatattccaacgaaaaccaggaaaaaaaatgtcttggaaattctctgtctctcactctctcccgctcttcttactcctcttcctttattcctttcctttaatctcaactcaaccaaaatgatgatccaacatttaaaaccatgcatgatttctctgggtacccagttgataaatcatcatacacttttacaccatcaaattcaagctcactttcagttgatattcaagctctgcaaaaacagattgatgagctatcaactttctcggatacacctgccccatcagtgactaggattctctacactgagaatgatgtattggctccgcaggtacggccaaaaatttattgggactcactgggctttctgttacagaggatgttgtcggaaacat

SEQ ID NO: 11468 - DNA, 257 bp, Gossypium hirsutum
  Clone ID: uC-gsflmaxxa092h07b1
tcgggattctttctcaaacatgctatcttatggctctcgatacttgctacaaatatttctgtcacaagtacgagaaactagagggcaaacagttccctctttctgatgctgcggtacttcatattccattctactcataacaagctcgtgcagaaaagcacatatcgttagttgttcaatgacttctcgaggaatgccagctctgtcgatgaaattaccaaggaaaaactggctccattttcaactttgaccggtga

SEQ ID NO: 11469 - DNA, 355 bp, Gossypium hirsutum
  Clone ID: uC-gsflmaxxa092h08b1
tcgggagctttcggcactcgctccgagcagcatgaagagcaaggttgtcgctccacctgagcgaaagtacagtgtctggatcggaggctcgatcttggcttccctcagcacccttccaacaaatgtggattgcaaaggccgagtatgatgaatcaggtccagcgatcgtccacaggaaatgcttctaaatgttattggtatggggataggatgaaagagagaagtactgtttcattgtttcttgatgcagcttggaactttgctttgttctaatggctttgttatccttctgtgtgttttcatgttggagtgaaacaatgaactttgagaaagccagtgatttaatttttgttcc

SEQ ID NO: 11470 - DNA, 226 bp, Gossypium hirsutum
  Clone ID: uC-gsflmaxxa092h09b1
ccaaagccatttgcagctagctgaccagaccatggcttctaaaccaggaattctcacagactggccatggacacctcttgaaagctttaagtacataatccctggtccttgggttacggagaccatatactcaattatggttaaggatccaaaggaatgggacctgaccaacttttcggtaatcccattcatgatatggagaatgttgcacaaccagctatggatt

SEQ ID NO: 11471 - DNA, 62 bp, Gossypium hirsutum
  Clone ID: uC-gsflmaxxa093a02b1
acgctggtttttttacatagcgttctcctgaattggcgactgggtgatttttataaagtttt

SEQ ID NO: 11472 - DNA, 135 bp, Gossypium hirsutum
  Clone ID: uC-gsflmaxxa093a03b1
cccgcgcttgcttcattttctcagatctgtgttatagtagaaaaaatctgctgctatcattgactttggctaacggcgaagctcatcaagtgactaacaatggcgatataagcaaacccttcaaaatctttgtcg

SEQ ID NO: 11473 - DNA, 130 bp, Gossypium hirsutum
  Clone ID: uC-gsflmaxxa093a04b1
cccacgtgttcgaagcacagagcctccaaaaaacacttcaaccgtgtagccatgacattctcgcgttggaatgccgaccctagcaaagatgcacggtcgagtggatctatgatcgattaactggtagtgg

SEQ ID NO: 11474 - DNA, 244 bp, Gossypium hirsutum
  Clone ID: uC-gsflmaxxa093a05b1
gcgcatttttgtttactatcactcccttcgctttgccgaacagaatgggatcaaatctttctttgtccatgtccctctctgcttgaccatagatgaggagacccaaatgaaatttgccgcttccttgttggtggtactcgcttctctatgtcagtaacatactgcatccactcatctttatgtccagaaattgatatggttggacggttgtatgtgagtggcggatcgaaggatccatgttttt

SEQ ID NO: 11475 - DNA, 210 bp, Gossypium hirsutum
  unsure (1)..(210): unsure at all n locations
  Clone ID: uC-gsflmaxxa093a06b1
tttatatgngagtggttctaaggtacatcatcatcatctgggtgaactccgataatctcatcccaatttcctccccagcatcactctgttttgtttcttggtcagttcccgctattaaacaatggaaaagaatcagcacagccatgtccatgcgcgaggattaaagcttcacgttccccaaagtggaacaggtcctatggtggcgctttt

SEQ ID NO: 11476 - DNA, 132 bp, Gossypium hirsutum
  Clone ID: uC-gsflmaxxa093a10b1
aattggtggtcttatttttttgtttcttttcgtaaaaatttaattaaaaatataatttcttcttgagatttcgatgctagtgttgagcaatggtcgagtggatctttgtttggattaaatggaagtgaggag

SEQ ID NO: 11477 - DNA, 211 bp, Gossypium hirsutum
  unsure (1)..(211): unsure at all n locations
  Clone ID: uC-gsflmaxxa093a11b1
tttaagtgngagtggttctaaggtacatcatcatcatgtgggtgaactccgataatctcatcccaatttcctccccagcatcactctgttttgtttcttggtcagtttccgctattaaacaatggaaaagaatcagcacagccatgttcaagcgcgaggattaaagcttcaccgtagcccaaagtggaacaggtcctaaggtggtgctttt

SEQ ID NO: 11478 - DNA, 210 bp, Gossypium hirsutum; identical to SEQ ID NO: 11475
  unsure (1)..(210): unsure at all n locations
  Clone ID: uC-gsflmaxxa093a12b1

SEQ ID NO: 11479 - DNA, 473 bp, Gossypium hirsutum
  Clone ID: uC-gsflmaxxa093b02b1
cccacgcgttcgtttgtgacatctccttcttgtaatgaaaaaatgagacaaaaaaatcaaaagaaaaaaaaacaagagaagataatgcaagaaaatgaacggattttgaaagaaatcgagaaaaaaaaagagaagaaattgaaaaagaaaaagagtgtgaagagaaagaaaaagaaatcgagaagaaaaaagagaaacttgaaaaagagagtgagcttaaagaaacacaagaaacgagtgttgtggaagaagagagaggatttgaaaaagagtttgaaaaagaaatgagagaaaaagaaatgagtgaacagaacgagagagagcaagataacacaggtggtttaactaaccatactacaaggttcttttatgaaggttttttttattcaggtttttgaagattcccgagacatgtttcaacttcaattcttacttgtcgagagacacttttatttgactgaaaagggtaaggt

SEQ ID NO: 11480 - DNA, 125 bp, Gossypium hirsutum
  Clone ID: uC-gsflmaxxa093b04b1
gccgtcttgtgttgactcactgcactgatttcattctgcatatggatattttgaggtttttcttccgaaaacgccctccaggctatagagcgatgtatcagccttgaccggcaatccctcgccac

SEQ ID NO: 11481 - DNA, 149 bp, Gossypium hirsutum
  Clone ID: uC-gsflmaxxa093b06b1
cttgatactcccaacattacaaacataccgccgtttaaaactgttaacttcatgccgattgctatctttttttcctcaaccccaattcttaaacgcccaattttgggaagctattttttctttctttggagaactttcctggtacacat

SEQ ID NO: 11482 - DNA, 64 bp, Gossypium hirsutum
  Clone ID: uC-gsflmaxxa093b08b1
gatgtagagatccaaagaggaagctccgattgctgtaaaacaatgtctgattaccatttcgttt

SEQ ID NO: 11483 - DNA, 85 bp, Gossypium hirsutum
  Clone ID: uC-gsflmaxxa093b09b1
cccaaaccctaaatcccctttgaaactgccaattttccatcccctatcaccatgtaacccactaagactgtagagaacacctttc

SEQ ID NO: 11484 - DNA, 90 bp, Gossypium hirsutum
  Clone ID: uC-gsflmaxxa093b11b1
cccactcgaccgaggaaagcatcttcaagtttcaagctttgggtttctttacttttttcttcttctttctccctctctctaaacacttta

SEQ ID NO: 11485 - DNA, 116 bp, Gossypium hirsutum
  Clone ID: uC-gsflmaxxa093b12b1
cccacgctaccgaatggcgttagggaagataacccttgtgcagggtttagccttggtcatggcaactttgccaaggactggaaccatggatcaatcagactgcaccagtgtgataa

SEQ ID NO: 11486 - DNA, 120 bp, Gossypium hirsutum
  Clone ID: uC-gsflmaxxa093c03b1
gaattttcagtcgccttctcttttagtcctctcgatcccaaagcaagctctcgattccttatctctcccagaagatgcagattctctgtgaaaaccctcactggataatcctacaccctc

SEQ ID NO: 11487 - DNA, 117 bp, Gossypium hirsutum
  Clone ID: uC-gsflmaxxa093c04b1
ctgtattgttttctccataacattcgtctctcagatcctttgctcttagatcatcaaattcattccttttttccaccaaaacatgagggaaatcataagcattcatataggccaagc

SEQ ID NO: 11488 - DNA, 101 bp, Gossypium hirsutum
  Clone ID: uC-gsflmaxxa093c06b1
gaaaatcttatttctccctctgactcatactcacagcagaggcattttattgaaaacatatttgcaaagaagaacgatttgtgatcaagatattcagtcat

SEQ ID NO: 11489 - DNA, 284 bp, Gossypium hirsutum
  Clone ID: uC-gsflmaxxa093c07b1
aaaaagttccatcttgcagaactccaagggataaatattccttttctttcttccccattcttcccctctctatccatccatttcttctctctttttttttttcttcagtttcaaaattaacttctttgagctttggggaataagccaaattctgggtgtgtgtttttttttccttcctggttaacttaagccttagttattgggttatttctagaaggaaaggtggtgtcgctgatcctgagattccctcaagttttagactcatttcggagaccgatctgatc

SEQ ID NO: 11490 - DNA, 443 bp, Gossypium hirsutum
  Clone ID: uC-gsflmaxxa093c12b1
cccacgcttgcgattcatcccccattccatcttatctcgtgaaagccattctccaccagaaccaaagaatagcaatgcagaacctccaccaaataaaataaaaaaaaagcataaccttccattcttgtgcttgaccactctgcctcagcaaacatttcaagccaccacaccccatccctatctcctcgttcaaggatgagctattaatctgtaatttcaccaagaaaaagaaaatagggataggggagatgaggaaatcgttcaaggattctctcaaggctcttgaagctaacaattatttcaccaataccttattgcaagggatttcaatttcaaggtgggattggatctattaagacctacaatatttttctattcgctaatggctctatcaaggcatcagggattcccctttggatttttctcttgattgggggtttctt

SEQ ID NO: 11491 - DNA, 181 bp, Gossypium hirsutum
  Clone ID: uC-gsflmaxxa093d06b1
ctcgttttctctccataaatctctctctcaacgcagagcgaataggctgagacttccattgattctatcgcatcagctaatcacgctccaaagaatggatcaggttcaacacccatctgtcatgcagaaggtagcaggccagctccttcgttctagccattctcaagattttcaaggttac

SEQ ID NO: 11492 - DNA, 442 bp, Gossypium hirsutum
  Clone ID: uC-gsflmaxxa093d10b1
tcctcttcttcacttcatttctgctctgcttctcagtgggaaaaaaaaaattcatagagcagagcaatggtgcccattttcgcttctttctctcttttactcatttctgctctcttcattgttgcagactgtggttctattggagtaaactacggaagaatcgccaacaaccttccttcagctaccaaagtagtggaactacttatatcccatggtttaaaccgtgtcaaagtctacgacactgacccggctgttctccatgcattatctggatccggaatcaaggtcaccgtcgacctcccaaacgagcaactcttcgccgctgcttaaagcacttcctttgctaactctctgggtcagggaaacgtcgccgcttactaccctgacactgaatttgaagccattgcccgtcggttacaatatttttcgctgtcccccccat

SEQ ID NO: 11493 - DNA, 113 bp, Gossypium hirsutum
  Clone ID: uC-gsflmaxxa093e03b1
ctgaagctactaccccataacattcgcctctcagatcctgggctcttagaacatcaaatctcacccctaatcccccaccaaaacaagagggaaagcataagcccacatacagg

SEQ ID NO: 11494 - DNA, 53 bp, Gossypium hirsutum
  Clone ID: uC-gsflmaxxa093e09b1
ttaataacagcccagacggactaagaaatgcgagagcggaacttttaaaagct

SEQ ID NO: 11495 - DNA, 133 bp, Gossypium hirsutum
  Clone ID: uC-gsflmaxxa093e11b1
gctattcctcaccaaagtccttacgcagcagattatggcgcatactccaatgattttcagaggcaattattggatgaggtagagataagagagttgctcatcgatcatatcggtcatcgatgttgttggggga

SEQ ID NO: 11496 - DNA, 277 bp, Gossypium hirsutum
  Clone ID: uC-gsflmaxxa093e12b1
gaaaaaaacgcaaagaaaagagaaatggctactttgggtggaattagccaggtcgatggaagcgccaatagtttggagattgaaaacctcgctcgttttgctgttgatgaacacaacaagaaagggaatacgatgctgcagtttaagaaggtgacgaatgtaaaacaacaagtggtttctgggactatgtattacataacattggaggcgatggatggtgacaagacgaaagtatatgaagccaaggtgtgggaccaagtcatgtatgaattttaag

SEQ ID NO: 11497 - DNA, 134 bp, Gossypium hirsutum
  Clone ID: uC-gsflmaxxa093f02b1
tcgccgggcagatgttaggggacacatcagagaccacgccactggaggaggattcatgactgctaattctagctacactcaccgagagaaccatctcgagttcttgagcaggcatggagcagacactaaggaca

SEQ ID NO: 11498 - DNA, 75 bp, Gossypium hirsutum
  Clone ID: uC-gsflmaxxa093f05b1
gggagtatatgggcgaaattgaaataccactacttttaacgggattttactaattccttttcttcggatgccccc

SEQ ID NO: 11499 - DNA, 201 bp, Gossypium hirsutum
  Clone ID: uC-gsflmaxxa093f06b1
cccacgctatcgcggacgcgtggggccaaaatgcaaacccatggtatctttttcctttgaaaattaaagtgaaaaaaaaaacgtattcatgcctttcaagtttcaatggtctatttaaaagaaggcaaagcttttgggcaattgtgctccttagagcatcggtctatgtcccacactttctctttccaccaatatttgttg

SEQ ID NO: 11500 - DNA, 512 bp, Gossypium hirsutum
  unsure (1)..(512): unsure at all n locations
  Clone ID: uC-gsflmaxxa093f12b1
gtggttcttgggaaagtccttatggtgatttctttctttcttggtactcaagccagctcatagctcatggagatcgcctactctcacttgcctcttcggttttcagtgatagtgcagtgaacattttcgggaaagtcccgttgatgcactcttggcacggaacccgttcacatccttccgagctcacagctggcttctacaacactgccacgagaaaaggctacgaagaagttgcagagatgtttgcaaggaattcatgcaaaatcatcttgcctgggatggaccagtcagataagtaccagcttaaggaatctctctcaagccctgaatcattacttgctgaaattggaacagcttgcaacaaacacggggtcggaatttccggccagaactcgactatcggagctcctgatggtcttaagcagatcaagaagaacatgttgagtgagaatcttaatgactncgtcattttccagaggattggagctcaattcttcgcaccgggagcattt

SEQ ID NO: 11501 - DNA, 256 bp, Gossypium hirsutum
  Clone ID: uC-gsflmaxxa093g07b1
gcctcttgatttcaacacattgagccctttttttctctcttccttaaaaggaaaatgggaaaacagtttcacccaataacaatttcagtagtaaacaaagcaaaaagcaaacccccaaaattagttgaaaagaaaatgcctacactaccggacaccatcaaaaccttgaaattagagagatacaacaattatctccaaaaaactcacagcaccaaactcatcactgctttttctaaactatctctctcgtgcaacc

SEQ ID NO: 11502 - DNA, 104 bp, Gossypium hirsutum
  Clone ID: uC-gsflmaxxa093g09b1
cgtgacttgtgggccaaaaaatacatcctttacgacagcgcctcctaactcagaaatctgatctctcatatcaaacctaaaataccagcaaaactaacaacaaa

SEQ ID NO: 11503 - DNA, 395 bp, Gossypium hirsutum
  Clone ID: uC-gsflmaxxa093g10b1
gtgaattgggtgattgtatttattgcaggattttgtttaaagagagatccaaaaatggcagggaaaatatcggctgcatcagctcgggctcacactagaaaatctaagcaaaacacttccttcaagcttctctcagggatattcacaaagacactattggtcttgtttgtgggagctttggcatgggcttatcaggccattcagccgccgccgcccaagacttgtggctctcctgatggtccacccgtcaccgcgtctagaataaagctcagggatggacggcacttggcctacaaagagcatggtgttccactaggggcagcaaagcataaacatcgccaagtccatggatctgattcttgtaggcttgatgctgcttctctgtccccggaact

SEQ ID NO: 11504 - DNA, 339 bp, Gossypium hirsutum
  Clone ID: uC-gsflmaxxa093g11b1
ggatgatgttcgtctcctccttaggcaggatcccaagtgttggaaatacagaccattatctgagctcatggtccgtgcagctgcagatgatgtccgctttcttctatacatctaccacatgatgatgaagaaactgaatgaacgatccttgtggcaccttgcagttcgtggagctctgtattgccgatgtttctgcatcaacgataataactatgctgattggccatctattcctcctattccagataacgtgatggtggagcggggatgccattgtctatgaaatacgtttaggctcctatgatctcacctgtaagaatggtggctataactgctatt

SEQ ID NO: 11505 - DNA, 428 bp, Gossypium hirsutum
  Clone ID: uC-gsflmaxxa093h07b1
cccactcttccgggaaaagttgcgaaaggtgatgggaaggatgatctctctgtttactatggaggcaggcaaaacgtacaagtacaggatttgcaatacgggtatcaagacatctctgaacgtcaggttccaaggccacaccatgaaattggttgagatggagggttcccacacaatgcagaatgactatgactcccttgatgtgcatgttggacagtgcttcagtgtgcttgttacttccaatcaggaaccaagggattactatgtggtggcctctacccgttttaccagacgtgaggttacagcaactggcatcatcggttacaagaatggcaagggagctgcctcatccgagttgccaccaccacctgttggttgggcttggtcactcaatcaatttcgtaccttccgttggaacttgactttta

SEQ ID NO: 11506 - DNA, 403 bp, Gossypium hirsutum
  Clone ID: uC-gsflmaxxa093h08b1
cccacttcttccgcaaatgagagattaccagacaagaaaggaagtgtttggtctaacatcatgtggtggaacgcatgtgcttgcagcagaatctgctgagaaaggatggtttttgaataattcccattggtggtttcatgttcataacgagttaaatgaaaatgacattgcatttggttttaaaggaaatcgaaaggtgattgtttttcgaggaagaaaactaggatttgagattaatgatggcaagaagctgaaaaatgaagagcatttcatgaccgctgttgaattctccatggaatatccttatggaaaagctatagctttgttcaaccttaaatctgctattatagagatcagtgaagaagaaccgcttgtagtccctatgattatattggcttttcta

SEQ ID NO: 11507 - DNA, 225 bp, Gossypium hirsutum
  Clone ID: uC-gsflmaxxa093h09b1
catgttttcgagggcaaaggaaaaggaattctgcaacaccatcaaattattctagagtttgaagctatccctgaagagaacagaaagaagctcgctgatggtgcattttttgaagtattgaaggctagtcaggaagcgatcgtgttgcctccatgggttgcacttgctgttatcccaagtacaggtgtaagtgatttttctcccgtgattctctcttactttctt

SEQ ID NO: 11508 - DNA, 273 bp, Gossypium hirsutum
  Clone ID: uC-gsflmaxxa093h10b1
aaaatatcacaaatcttcttctccttctcagaaatcttagtatcatcactatggcctcaaatcccaaggtcttctttgacatgacgatcggtggtcagcccgctggtcggattgtgatggagcttttcgcagattgcactcctcgcactgcggagaacttccgtgccctctgtactggcgagaaaggcgtcggccgcagcggtaagcccctccactacataagctcttctttccatcgtgtgatccctaactttatgtgccaaggtggtgact

SEQ ID NO: 11509 - DNA, 58 bp, Gossypium hirsutum
  Clone ID: uC-gsflmaxxa093h11b1
ggaatatcttgttttttaggaatattggtaacaatatccctgtgtcttcagatgtttg

SEQ ID NO: 11510 - DNA, 221 bp, Gossypium hirsutum
  Clone ID: uC-gsflmaxxa093h12b1
ccctcgtgtccgtactatgctaaggtggatgctgtggttgaccttgtagatgcctatgatcaagagaggatcgcagaatcgaagaaggaactcgatgcgctgctttcagacgaggcccttgctaatgtcccgtttcttatcctaggaaacaagattgatataccatacgctgcctcggaggatgaattacgataccatcctcggtctcacatactttacca

SEQ ID NO: 11511 - DNA, 101 bp, Gossypium hirsutum
  Clone ID: uC-gsflmaxxa094a01b1
cctatctgctgtccgtaatctccttggtccaaaacgggtgcgcagtaataaaacaatggcggcctgcaccccccccactgccctagacagcgtcgagaacg

SEQ ID NO: 11512 - DNA, 190 bp, Gossypium hirsutum
  Clone ID: uC-gsflmaxxa094a02b1
cattcatatccgcaaacctaaagaacctccctgggggccataatataaaacactcagccggagagacacagagaaccaacatagacaaaactccgacccaccaccaagggacccccaacccccaacccccacccccaacacacacacaacgccacacacctgacccaccaacccccaccccccacaccac

SEQ ID NO: 11513 - DNA, 138 bp, Gossypium hirsutum
  Clone ID: uC-gsflmaxxa094b01b1
aaagttgctagtgttgagctatattacaaggctggccacttttacttgcaagagcatcctgatctcatcaatgatatgctgaatgtgcttgcgcttcgtgtggatcatactcgtgtcgctgacattatgagaaaggcc

SEQ ID NO: 11514 - DNA, 94 bp, Gossypium hirsutum
  Clone ID: uC-gsflmaxxa094b02b1
gttgtaggtcaagatttgctatgtgtcagacagaactattcctctgcaattcctccttctgagctcagggggtatttggaggatcttggagatg

SEQ ID NO: 11515 - DNA, 54 bp, Gossypium hirsutum
  Clone ID: uC-gsflmaxxa094b04b1
ctcctacaaaacgcggggagcgcacacacagagagggggcctattaaaacgaaa

SEQ ID NO: 11516 - DNA, 368 bp, Gossypium hirsutum
  Clone ID: uC-gsflmaxxa094b06b1
cggtctcgtgggcggacgcgtgggatcaatggtgcgcaatatctgagacgtcacgtttgtcagaccctttcccatgtgagccctaactctaatcctacctcgtatttctctttagctagacctttctcttcggccaccgacaccattcgagccactctcttccccggcgatggcatcggccccgagatcgctgagtccgtcaaacaggtttttagaactgctgaagtgccaattgaatgggaagaacattatgttggggaccaagttgatccaagaactcaaagttttctaacttgggaaagtctcgaatcagtaagaaagaatcgggtcggcttgaaaggtcccatggctactcctattggtaaagg

SEQ ID NO: 11517 - DNA, 77 bp, Gossypium hirsutum
  Clone ID: uC-gsflmaxxa094c01b1
cccgcaggaaccagcacctgaaaacccgggacgacccacgcaaccggaacttaaaactacaaagactatcccggacc

SEQ ID NO: 11518 - DNA, 90 bp, Gossypium hirsutum
  Clone ID: uC-gsflmaxxa094c06b1
caatacactcaacaaaaataggggcatgaactaagtgctgttaggtgtacttatctgtgtatgatggagctactcgcttacatctactgt

SEQ ID NO: 11519 - DNA, 489 bp, Gossypium hirsutum
  Clone ID: uC-gsflmaxxa094c09b1
tgttttatgattccaggcatgatttctttcctgggctttttcctttattcttattatttattaaaaccgattttgtagaagcatggaacaaataaaaaaagaaaataaaaagaaacggaaaacagaggaaaaaaggggaaacaatcagattttcccttttcaaatatttgttctgccttttttattcactagtgcgcgttcgtaaaaagaagaagaagattacaaaggtgaaatttcggcttttatagccgatctaaacaactcttgatgtctatttttttgttgctttgcgatttggctgcttctttctgttgcgtgtctattgctctttgcaggtgacagaggtgtcagagcatgcggaggagaggcggctaggagcggtgacagccaggcatggcagaggaggcgaaacggcgctgggggcatgcggcgccaaatagggttagggaaccctagggttcttttttgacttgtttaatttttgggctt

SEQ ID NO: 11520 - DNA, 261 bp, Gossypium hirsutum
  Clone ID: uC-gsflmaxxa094c12b1
ctcacgcgtccggttggacgtagccaagattacgtgtgtgtattgcaaaaattatctgttaggaaaaaaaatggagataactaatgtcactgaatatgaggccattgcaaaaaagaagttacccaagatggtttatgactactatgcatcaggtgcagaggaccagtggactctcaaggagaattgaaatgcattttccaggatttcgtcttcatctcctatttttattgacgttcgtactgaatttactctgatcactac

SEQ ID NO: 11521 - DNA, 355 bp, Gossypium hirsutum
  Clone ID: uC-gsflmaxxa094d03b1
agatatcaatggctcttcttactgctgagtttggtgggatcttaaagaagcttgggatcctgaaggaagacctgcccaagtatgaagaacaactggagctaaaaattgccaaggcgcaattggaggagctgaagaaggatgctcttgaagcaatggaaacacaaaagaagcgggaggaattcaaggatgaggcaatgcctgatgtgaagtcattggacatccggaacttcatctgaaactcgaaattcgcctttggtggttccagtttgagggtgaacacgtataactgttcaacaatcgcttaaaacctttctttttcattttgctacaatcatatgataaataattatactgg

SEQ ID NO: 11522 - DNA, 103 bp, Gossypium hirsutum
  Clone ID: uC-gsflmaxxa094d05b1
cgctctcaatgtagaaaaccctaggcctggtgttatcatttacaatcctcatggcgatgatgttcataagggagccccgaaggactatactggagaagatctt

SEQ ID NO: 11523 - DNA, 419 bp, Gossypium hirsutum
  Clone ID: uC-gsflmaxxa094d08b1
tatgatacagttaactgggaaacgtgatgataggaaccatcatactgctgtttgatctggaaaccccgctgccgtgtctgaaatattgaaaaacactgggccggatgaacttaaagaactgttgcctaaacagaaccaatccggcgaaaccgccttatatgtcgccgctgaatacggctatgtcgatttggtcgaggagatgattaactattatgatcttacagatgctgcgatcaaagctagaaatggttttgatgcttttcacattgctgctaaacaaggagatttagagattttgaaactgctgctgggggtgcatccggaattggcaatgacggttgatttatcaaacactactgcattgcacacagctgcaacacatggccatatagagattgcgaatcttttattagaggcag

SEQ ID NO: 11524 - DNA, 148 bp, Gossypium hirsutum
  Clone ID: uC-gsflmaxxa094e01b1
cggatgcgtgggcggacgcgagggctgaaaagaagaaactatgaagaatatatgttcttatcacaccagtactgctgcatggcagaaagataatttatatgctacagctcttgaatccagactgataagacagcatgggaagcagggg

SEQ ID NO: 11525 - DNA, 211 bp, Gossypium hirsutum
  Clone ID: uC-gsflmaxxa094e03b1
cccatgcgtccgcccacgcgtccgcttttctctggcgccataataatattccttgatttcttaccaaatacttccatttttttgattttttttaagtgaaggaacagtgaaaagcaacaggaaatggcaaatatagatatcgatgggatcttgaaggagcttcccaatgatgggcgtatccctgaaaccaagaacgttgggcctacggggc

SEQ ID NO: 11526 - DNA, 132 bp, Gossypium hirsutum
  Clone ID: uC-gsflmaxxa094e04b1
tcggtaaccttcttctgtacagcaggcgcttgcaagcacctgtagagcactcaatcatgttcccgccggcgtgaaagatgcgagcgataaaaagattctagctgatatgctgcttcgggcagtagataatcc

SEQ ID NO: 11527 - DNA, 501 bp, Gossypium hirsutum
  Clone ID: uC-gsflmaxxa094e05b1
aatttttagacaagaatgagcatgaaatctggtgcggtcatttttcatctccttcttcttctcctacttgtcatggtaatatatttatccattaaaatttaaggagtttaagatgttttatgtttagaacttactccgttgacctttctgcagcatggcgatggaagtggaaccgaggagatggctgatgatttaatctccaaagggaccagtgttctgaggctccatagcatggatcatgatcggcaaactgaagatgatggcactacagttcaatcaagggtagatccattatctcacatggatcacatggatctatcagtgatggtgtttctcaccttgaaagatctcaaagttgggaactcaatgccgatctattttcgaagaaagactcttcaaaatcccctcggtttttgcctaaacaagaagccgacttcattggtttctcattgaaagaacttcctaacctgcttcgattatttcttttctcgcgagactctc

SEQ ID NO: 11528 - DNA, 468 bp, Gossypium hirsutum
  Clone ID: uC-gsflmaxxa094e06b1
ctgttctcgtgggatgatttgcacgaaagacagaggggggatttttatgaagattttggttttttcaacccggctacaaaatagaaaatttaccagaacgcttagtggaattgcagaaaacagaaaattaaccagaatacttagtggaactgaaaggattggtttgagctggccagagcctccactaaactttcttcctcagaatgttttggagagaccaggttctttcaaaccaagaaaatcttttagagcaataaagtcttttaaaacatataattccttcaagtccataaatgatatgggccatatggtatctgtgatagctttgcttgctgaacttgaccttgaatccctcatgaagaggaaaagaagatcatcatatgtcagaatagtaagcaagcagatggcaggaattttcctcactatatgggtctcgaggagttcgcgcaggcatattcagattctgaa

SEQ ID NO: 11529 - DNA, 334 bp, Gossypium hirsutum
  Clone ID: uC-gsflmaxxa094e07b1
tttagtgcttcgatattgacgccaacggcatgggaaatgtataagccgaagacaaatcaaccggccaaaagaacaaaatcaccatcacgaacgataaaggaagactttcgaaagaagagatcgaaaagatggttcaagaagctgagaaatacaaatctgaagacgaagaacacaagaagaaagttgaatcaaagaacgcattggagaattacgcttacaacatgagaaacacagtgaaagatgaaaagattggctcaaagctctcaccagatgataagaaaaagattgaagatgctatcgaagaagctatccaatggctggatagtcaccagtt

SEQ ID NO: 11530 - DNA, 164 bp, Gossypium hirsutum
  unsure (1)..(164): unsure at all n locations
  Clone ID: uC-gsflmaxxa094e09b1
ataaactatccttcatggctttcaaccacanagcncaagtaaaaagctaagattgtttatagcaccccgaaaccaaatgctngcgtggctaaggatggtagcggccaattcaagaccattgctgaagctctcgctgcctaccccaagaacttcctaaacagaca

SEQ ID NO: 11531 - DNA, 102 bp, Gossypium hirsutum
  Clone ID: uC-gsflmaxxa094e11b1
atcaatatccatttgaacaacttcaagataatgaaggcataaaaacagcactgcagaatatgcccggcggctctaaacttagcaactgcataaactggggtg

SEQ ID NO: 11532 - DNA, 433 bp, Gossypium hirsutum
  Clone ID: uC-gsflmaxxa094e12b1
tgagtttagatggattgaattgcttgcagatggaggacttttctgaagatgtaggagattcaatcaggctacaaaatagaaaatttaccagaacgcttagtggaattgcagaaaacagaaaattaaccagaatacttagtggaactgaaaggattggtttgagctggccagagcctccactaaactttcttcctcagaatgttttggagagaccaggttctttcaaaccaagaaaatcttttagagcaataaagtcttttaaaacatataattccttcaagtccataaatgatatgggccatatggtatctgtgatagctttgcttgctgaacttgaccttgaatccctcatgaagaggaaaagaagatcatcatatgtaagaatagtaagcaagcagatggtaggaatttttctcactatatgggttcgtag

SEQ ID NO: 11533 - DNA, 198 bp, Gossypium hirsutum
  Clone ID: uC-gsflmaxxa094f04b1
cccatgcgtccggacaaatggagggtccttagctttgtctctctctccaaaaaaaatataaaaagaaaacgaaaaaaagtttcgcttctttgctttctttcgagtaaaaatcaaacgaaaaacaacttaaataatattaaaagattttgattttgatcatcaaattttctgtttctgatccaccagtccagtcagagt

SEQ ID NO: 11534 - DNA, 496 bp, Gossypium hirsutum
  Clone ID: uC-gsflmaxxa094f05b1
gcttctgcttcttccacacaagctgaaatttcctgcatacagaccactctcagtcacaggtacttttcattctccatattccctctctcacctataaacttcaccactaaccgtctcttgtaaccttctcacatcctcttctccaaactttgagcaaaacccaaaaagcaaacagaaaaagaaatgaagattttttcttcttttaattttctttttgatttaacaacatagtgaatttggttttcttcctggcttatgtatgttttttactttgatctcttttgatatgttctcttgattctgtttttgacaaaatcattcttttctgctttcccatctgttttgctttatcccctttgctttgctttatctcaaaaatcttatgctctctttggtttgagaaaactaaaaaattacaacttcttctcttggtggtttcctctgtttgacattctttatttcaaacttcatcagccttagtttcctttttttcttt

SEQ ID NO: 11535 - DNA, 74 bp, Gossypium hirsutum
  Clone ID: uC-gsflmaxxa094f07b1
tataaggctgctgccccggccaagaagaaacaggagaagtgagaaaatcctctgtttttcaaacccccaaagca

SEQ ID NO: 11536 - DNA, 476 bp, Gossypium hirsutum
  Clone ID: uC-gsflmaxxa094f08b1
ttttatctctctgtatctctttgagtgactggtgtgtatttatatctccggttccacttccgcacacttcgaaaaatggcctctcacattggtggatatccccgcatgggacctaagagagagcttaaatttgctttggaatctttctgggacaacaagagcagtgccgaggatttgcaaaaggttgcagctgatctcaggtcatccatctggcaacaaatggctgctgctgggatcaagtacatcccgagcaacactttctcttattacgaccaggtgctcgatgcaacatcgatgcttggagctgttccacctagatatggctggaacggcggagagatcggatttgacacttacttctcaatggccagaggaaatgcctctgtgcctgccatggaaatgaccaagtggtttgacaccaactaccacttcattgttccagaattgggccctgatgtcaacttctctatgcatct

SEQ ID NO: 11537 - DNA, 279 bp, Gossypium hirsutum
  Clone ID: uC-gsflmaxxa094g01b1
aaatattaaagggaaaggcaaccagctcgcgtgtagaaattgtttaatcacctggcacatttttgtcgaccaacaaaaaagaaccaaactcagatttcagctctctaacacacagctgcgatggccattttcttcttttccaactacctcacaggcctcatttgtcttggtttcttctccaaaatcttagctgcagagcacagttcttccttttctttcaaaagttttggtaaagatccaaaattcgagtccaatattggtttatatggggatgcacat

SEQ ID NO: 11538 - DNA, 98 bp, Gossypium hirsutum
  Clone ID: uC-gsflmaxxa094g04b1
ctcatgcgaccgaagtcttaaaaaccgaacgcgggggggacttagaacacaatggagcgcttctaccccagacactggcagagagagaggaaaccccg

SEQ ID NO: 11539 - DNA, 133 bp, Gossypium hirsutum
  Clone ID: uC-gsflmaxxa094g06b1
ggctaagcgatttgcaatctcaactcaccgtttgggacgattggattctccttaacatcatggctgctcagattagcaagaagcgcacgtctgctgcggatggagtgttccccccggagctaactgagggtct

SEQ ID NO: 11540 - DNA, 124 bp, Gossypium hirsutum
  Clone ID: uC-gsflmaxxa094g10b1
tgctcacgcgtccgcttccgtctccatgcaacctggccacttcttggctacaaccagggcttctgggctgaaattggcttcatttgtgaaccaggaaagaaccaaccctatcttttcaggttgc

SEQ ID NO: 11541 - DNA, 354 bp, Gossypium hirsutum
  Clone ID: uC-gsflmaxxa094h01b1
cgcccgcagtaccgccccggcatacccggcgcgacccacgcggccggcttatgatggagcaagcaaacaaacaaaaaaagagtggatttttaacagctcaatcacggttacacccaacgattacattcacatcgtaaaggtcccattcatggctcatggccctcccatcccattcttagcctcagcaaagcaaatccatcaccaaactggcttcaacatcgccattgctaatacccctcttaacatccaatacctccgttcaaccctccgaggaaaccccattcccggcatccattcattggagccccaactcaacagtcccgaccatgggccaccacccaacacagagaatac

SEQ ID NO: 11542 - DNA, 413 bp, Gossypium hirsutum
  unsure (1)..(413): unsure at all n locations
  Clone ID: uC-gsflmaxxa094h03b1
cacagtcgacatttcatactctcaaggacaacattttagagtcaatggcttatgtaacaccccctctctctctctctttcctcatcttttccctcattccagggggaactttgatgatggcaaatggacagaaaagccggcgcgcggctaagccatcatcggatcaggcaactctactggcaaccataatttcgcttgttctcaagtggattgccgcgtaatgcaaaangggttgcccttgtcccaacccctgataatctgatgaaccatgcttccattgctatgaatctttactaccaagccaagggtagaaacaagtggaactgtgattccagaggctcaagccttattgccatcactaatccaagttatgctgactgcatttatgactagcctaagcctatgactggaca

SEQ ID NO: 11543 - DNA, 462 bp, Gossypium hirsutum
  Clone ID: uC-gsflmaxxa094h06b1
cttctactcaagaggagcagcagcttcactttgtggtgttttccttcatgtctcaaggccatatggcccctatgattgacattgctagattgctggcacagcgaggcgtgatcgtaaccatcattacaacgcctcaaaaggcagctaggttcaaggcaaccctcgatcgtgccatggaatcggggctcttcatccgtctacttgaggtacagtttccatgtgctgaatttggattgccagaagggtgcgagagcttcgacatgctgccttcctttagcttagcctggaatttctaccaagctaccgacgcgcttgaaacgccagttaaaaaactgttacctgagctaacgccaagccccaactgtatcctttctgatgtgttgtttgcgttcacactcgacattgccaaccagtttcagattccgaggatcgtgttccatggagtttgttgctttcgtcttg

SEQ ID NO: 11544 - DNA, 352 bp, Gossypium hirsutum
  Clone ID: uC-gsflmaxxa094h08b1
tctacgcgtccgcccacgcgtccgcccacgcgtgcgctgatgcgtgggggatcttcttaatcaacgcagacaagtgagtttatctccccgttcagaacagttgatttcaccagctagaaaagccatacatacagctccttcacctctgttgaaaatgggtatatctctttgtatagaacattctgaaggcttaatgtccttctttcgttttcgtggtgaattttctgactgcacacttagaagctcccctttgatcatgatgaaggaataatgagtgtatcaagttaaaacctttgtatagtagagaaacataatgtatgttcaatatcattaagctcttggctgcctatat

SEQ ID NO: 11545 - DNA, 491 bp, Gossypium hirsutum
  unsure (1)..(491): unsure at all n locations
  Clone ID: uC-gsflmaxxa094h09b1
gcttttcacagtcgtcatttcatattctcaagtgcaacagcaggtgtcaatggctaaagtagcagcagctctctctctctctttcctcatcttttccttcattccaggtggaactttgatgatggtaaatggacagaaaagttggtgtgtggctaagccatcatcggatcaggcaactctactggcaaacattaatttcgcttgttctcaagtggattgccgcgtaatgcaaaagggttgtccttgtttcagccctgataatctgatgaaccatgcttccattgctatgaatctttactaccaagccaagggtagaaacaagtggaactgtgatttcagaggctcaggtcttattgtcatcactaatccaagttatgctgactgcatttatgactagcctaagcttatgactggacattggtgggnttaagccgctttacatattgtaattccttcgagaaaaagggaatctngtagcttaaattatcatc

SEQ ID NO: 11546 - DNA, 532 bp, Gossypium hirsutum
  Clone ID: uC-gsflmaxxa094h10b1
tgtaaacacagaagaattttggttagatcaacgatgcatcttggagattacagctcctattatcaatatccttacctttcaaaccccaactccaaccccaaccctaaccctaaccccaaccccaatccagtaccctccgaatttcaccaagcaccttacgcatctgcaccaccttttagctccggttatgcctcctctgattactccgtttatcccccaaattaccctccgtattcccaaaatcttgatgctgcccctcccactgcttccgcttatactcctccgccctcagccacaaccactccaccggctccggccatagctccacaatcgtctttcaatcaacaacccatggcgccaccctcggcgaccgcggctccttcttttccgccatatgattcacatgttccctatcagcctccggcctcccagcctccttatttccagcagtatgatcagcatcagacggcttccagctacggtcctgctcctccaaacccaaccctaaccccacgcctaatccgtcttacta

SEQ ID NO: 11547 - DNA, 476 bp, Gossypium hirsutum
  Clone ID: uC-gsflmaxxa095a01b1
gtgctttctacttcatctcaactatcaaacccagaaaggtcaaaggaaaaaaaagatggctttggagatctgtgtcaaggctgctgttggtgcccctaatgttcttggagactgtccattctcccagagagctcttcttactttggaggaaaagaagatttcctacaacatgcaccttatcaatatcagtgacaaacctcaatggtttttggagataagtccagaagggaaagtaccagtggtgaagtttgatgacaaatgggtggctgattctgatgtaattgttggaatccttgaagaaaaataccctcagccttgtctcaaaacccctcctcaatttgcctctgttggatcaaacatatttggaacttttgtcacatttttgaagagcaaagacgctaatgatggatctgagcaggctttgcttaatgaactcaaggcattggatgaacatcttaaggcacatggcccattca

SEQ ID NO: 11548 - DNA, 231 bp, Gossypium hirsutum
  Clone ID: uC-gsflmaxxa095a07b1
gcggtactggctgctttcaccgacgaacgagtctttgcggatttaagtgttctgtggagcataaaggactatggaattcagaaacttgaaaggatgataacagtacggtttatgatttgttttattttatctatagtttctcttagttgttcctttattactttaactttttttattttatatttattttttttttttaattctttttttcttaattttttatatattttc

SEQ ID NO: 11549 - DNA, 233 bp, Gossypium hirsutum
  Clone ID: uC-gsflmaxxa095a09b1
gtcatcattctaaagagattattgtaaattcgagtagagagcttttacacaagatgagagccaagtggaagaagaagcgtatgaggaggctgcataggaagctccgacagatgagacagtgatccaagtagatgcgccttggactgaaatagttttgctctgaccatccattgttttaacaattatcatgtacctatatctatatgtctaatatagtacatgaactttgatca

SEQ ID NO: 11550 - DNA, 435 bp, Gossypium hirsutum
  unsure (1)..(435): unsure at all n locations
  Clone ID: uC-gsflmaxxa095a11b1
cccactcgtccgcggacgcgtgggccgagccggcgcaggcgaaaaaagaaagaaaagttacgatgtggaggtccaagatggtagtagttggattgaactgctgaaatctcataggcttgctcaagtatcgttattccaaaagccaataaacaagattaaattggcggatttaatggtggcaacgaacaatttcgatgcggagaacgcagttatttcgaccaggactggagtttcctacatggcggtgttgccggacggctctgccttggcgattaagaggttaagcacttgtaagcttagtgagaaacagtttaggtcagaaatgaataggttaggacaacttaggcatccaaatttggttccgctcttagggtattgcgttgngtgagatgagaggcttttagtttataagcatttgcctaatgtgacattgta

SEQ ID NO: 11551 - DNA, 105 bp, Gossypium hirsutum
  Clone ID: uC-gsflmaxxa095b05b1
cgcccacttgtccgcaaaaaaagaaacctccaacccaaaggcttccttagacggcatttgggggcaaaaaaaaaaaaaaagaagatcaaattgaagaatgcctgc

SEQ ID NO: 11552 - DNA, 174 bp, Gossypium hirsutum
  unsure (1)..(174): unsure at all n locations
  Clone ID: uC-gsflmaxxa095b06b1
ccctctcgtccgcttaccttatgtaggcttagagcaggggtgcttttataagattcttgtgtgccgtttcggaagaaacctcgnaaaagttcaagggattgcccggggttctttgggtgttaccggatttatacatagacgtcaaaaacaaattatattgaggtgataaatatg

SEQ ID NO: 11553 - DNA, 93 bp, Gossypium hirsutum
  Clone ID: uC-gsflmaxxa095b08b1
cccatgcgtccgagaacatgtacgctgttagcacgagtacatatacgggattccaatgtaccgtttcggaagaaacctcggaaaagctcaagg

SEQ ID NO: 11554 - DNA, 160 bp, Gossypium hirsutum
  unsure (1)..(160): unsure at all n locations
  Clone ID: uC-gsflmaxxa095b09b1
ngtttctgagccactgaccagggctcgctttgagggggggaactttgatctgttcagatggaccatggcacctgtgaagaaagcaatggaagatgctggtttggagaagcgtcaaattgatgatgattgttctagtagtggtatgctaccagtattttcc

SEQ ID NO: 11555 - DNA, 142 bp, Gossypium hirsutum
  Clone ID: uC-gsflmaxxa095b10b1
gcatactctctctctttattttctgtcaggtttcggggttctttttaaaaaatctgtgggatccaatagactctccgctcctctgatcttttcttcgacttggtctatgagctcgaaggagaaacccactcttggcggcacc

SEQ ID NO: 11556 - DNA, 174 bp, Gossypium hirsutum
  Clone ID: uC-gsflmaxxa095c03b1
cccacgtgaccgtttcctttccacgtcttccccttttgtttttcctgttcccgtgacaggcgagacttatgacgacgcatggcgagaccgctgcaacgagcacgcccgatgcacgtgcattgcaggaagggatagcggagttctactaccagacgtctgggcttagggaagaca

SEQ ID NO: 11557 - DNA, 108 bp, Gossypium hirsutum
  Clone ID: uC-gsflmaxxa095c04b1
cccacgctaccgaaatgccaaaggtactagcatcattacgcgatcttttaaccctagaccgagccgaaagagacgatggcgaagcataccgccgttggttggggttat

SEQ ID NO: 11558 - DNA, 153 bp, Gossypium hirsutum
  Clone ID: uC-gsflmaxxa095c06b1
tcgccccgttctggtgctcaagatagggccgatctacctaggggaggagtgctgcactatttgtgggtgcacacatcaggagcgggagaacctttaggtgggtgaagcttgaagattcagtagaccccaaagcttcttgtgtcactcccaggc

SEQ ID NO: 11559 - DNA, 508 bp, Gossypium hirsutum
  Clone ID: uC-gsflmaxxa095c07b1
gaaactctgaatatgagcaattcgaatctggtcatggacgcaagccggatttcggacgacccggatccgaatttgaatctgattatggccgaagacctgaattcgagcagcctcctgaggagtttggatctgggcatggccggaggccggcatatgagcattcacatcaaccggatttcggatccggccggagatcagaatttgagcagcctccgccgcctgagtttggatctgggtatcgacggagacccgaatttgagcagcctccgcctcctgaatttgaatctgggtatggccggagacccgaatatggcgaacaagagtccgagtacagatctgagtatagtaggaaaccagagcacggtgaatatggatccgaatatgggaggagacccagctatggtgaacccgaatctgaatacggatctgggtatggcccaaggcagaatatgaaggaggcggatccgaatatggaaccggataccggcagaggactgagggcgagttt

SEQ ID NO: 11560 - DNA, 175 bp, Gossypium hirsutum
  Clone ID: uC-gsflmaxxa095c10b1
cggataggagatggagctttctccacctgtttcattgactgctcctattattcttctcacacttgctattgttttcgctggcacctttgcactaagacccaaacccaaatcgagtctcgccaaagagcctccaccagggagcttagggtggccaatcgccggcgaaactctcgag

SEQ ID NO: 11561 - DNA, 514 bp, Gossypium hirsutum
  Clone ID: uC-gsflmaxxa095c12b1
catcatgcgatcaagatacaaagggctattcttaggcgagggagtgctgcaataacaaagagtgggtgcatcaggagtgggagaaagtttaggtgggtgaagcttgaagattcagtagatacaaagctgttgggtcacccccaggccctcaccaagttctgttactttctaatggatgccttgaaggagaaaggagctaagttgaagcctttgctttgtgcttgcatgttgcaagagccatctaaggtgttgattgttggggtctgcggaaagcctcgtcttggagcacttcaagggaatgcgttcggtcttgcattcaggaatgctgccgaggaaaccggagctgaattcttccatgagcttttcgaatcttcatggattgtgttggatgctgtcgttgttaattccttcatggtcaaactaactgaaaggctttgatgtaaagctttggattatgagtgacggtaattgtaactttggtttttcttttttttttaatgaaaacatttgttca

SEQ ID NO: 11562 - DNA, 125 bp, Gossypium hirsutum
  Clone ID: uC-gsflmaxxa095d04b1
ctagcatgaaaggaccaaaagggtttaatctgctgtggtggttgtttttaaccacccaaactttaacaatggccgtcggtaagaacaagaggattttcaagggaaagaagggaggaaagaagaaa

SEQ ID NO: 11563 - DNA, 161 bp, Gossypium hirsutum
  Clone ID: uC-gsflmaxxa095d08b1
ccccggactaaaatccacctcccctaatccctcaatttggggcaaatttaaaggcatctcatgctatccaacacccacccacccgaaaacaccacccccacccaacccaccacaccacacccccacaacacacaacaccccaacccaccataaaccaccac

SEQ ID NO: 11564 - DNA, 207 bp, Gossypium hirsutum
  Clone ID: uC-gsflmaxxa095d09b1
atagtaaccaaccctatcgatcaatgctggcgatgtgaccgcttctgggaaaggatcaggaaaaagctggctgattgcgcacttggatttggccgtggtactactggtggaatggatggtcttatttacttttttcttattccacactttttatttttccttttatatttattcctcattttttttctctctttttttcatattttt

SEQ ID NO: 11565 - DNA, 184 bp, Gossypium hirsutum
  Clone ID: uC-gsflmaxxa095d10b1
gcatgtatcaggcaacaggtctcgcggcaaaactgtggcaccataaggagcagtaaaaggatcatccgaaggacacaaaacaatcaaagaaactcatgaactatgctagtgggaagaggaacccactgctagatccttcttctaccattcctggaatgcctagtgagcgtcaaagattaaaact

SEQ ID NO: 11566 - DNA, 186 bp, Gossypium hirsutum
  Clone ID: uC-gsflmaxxa095d11b1
cccatgcgtccgtttggttaattcagatccctcgactctacaatgtttacaaagagatggggattgttacttcatttcagaacattcttgacaacatttttatacctctgtttgaggttacctgtttttccgattcactttctcatctaccttttttctttatctctttcttttctcctgttcctc

SEQ ID NO: 11567 - DNA, 142 bp, Gossypium hirsutum
  Clone ID: uC-gsflmaxxa095e08b1
cttttcttacctcctagcccaaaaaaaaaaaaccgggtttcctttctctcgatctttctcccgatcaaccacgtcttgcttcattagcaaacatgccgatgagttggcaaaaaacagagctcacattggaactcctgtaaag

SEQ ID NO: 11568 - DNA, 231 bp, Gossypium hirsutum
  Clone ID: uC-gsflmaxxa095e10b1
atttctctaacaacttgctcagaagctgaaacaggaaaactacaaaaccaaaaaagctcactcagaatttaccctttcttttgcttatcaaccatcatgcgtgttaaagataaagagcaggtcaccccagaaatagacgaccttgatgacaactactacaccaaaacgtcttgctctttgctttcttggggtgatttcttgtgtacatagatggttgtattgtactcattt

SEQ ID NO: 11569 - DNA, 513 bp, Gossypium hirsutum
  Clone ID: uC-gsflmaxxa095e12b1
ggaattgacaccgctcttagcctcgttttcttcacgcagccctactactgctccgatggcatccaccaccaccaccgcctattcgtcggcagaagaaaaccctaagaagaccctggacgctgcctcaccttctatggataagtcagatcctcctagcgcttcaacactttccgatgctgaagtttccgtaaaggagggcgagggtttgaagaccaccgggaatgctgcgggcttggccgctggggaaagaagctgtcccgccgacgatacccagaagaagattcgacgagctgagcgattcggcctgcccatccagttatctgagcaagaaaagcgtaattctagggccgaaaggtttggcactgcacccagctcaaagggatcggaagaatctaagcaattggaggagctgaagaggaaggctagagcagagaggtttggaattgctgcacccactacagctactgatgaggatgcaaagaagaaagctcgtcttgctagatttgcaccata

SEQ ID NO: 11570 - DNA, 176 bp, Gossypium hirsutum
  Clone ID: uC-gsflmaxxa095f03b1
gaagcatcaacgccaaagagataaataacacgatgattgggttatattagatgagcaattaggatcaaacccatctaaaatgcggggatggagaaactctgttcaagaaactgctgccttaaaacccctctttctaaccattatcccaccgaaattcctgttacagtggttacttt

SEQ ID NO: 11571 - DNA, 163 bp, Gossypium hirsutum
  unsure (1)..(163): unsure at all n locations
  Clone ID: uC-gsflmaxxa095f07b1
ataatantctaaggatttaatctccaaaccttcttgcgatttcttcattacattgttcaagaaaaaagaagcaaaaaaacatggccaaagttctgttgttcattgcactatgtgtgctcccagctttggttagtgctacacgcattctgaataatcaaattgg

SEQ ID NO: 11572 - DNA, 90 bp, Gossypium hirsutum
  Clone ID: uC-gsflmaxxa095f09b1
cccactcgtccggaaaaaaagagagatggcgtctgtggtaaaatctgcaatcttaattctgtcggtgcccccatccgcccgcttcagttc

SEQ ID NO: 11573 - DNA, 355 bp, Gossypium hirsutum
  Clone ID: uC-gsflmaxxa095f10b1
ggtgctactcttcagagacctttcgctcggccactcagagagagagtcaactccactgccattgcaaacgaaacctcgaatgctaccgagcaagcttacctcaaccgatctccaatctccactcggacaactcgcttctcaactcaccgactccgacctccgactcactgcttatgacgtcttcctcgccgtatgccgtacctcctcttcgaaacctctctcctcttccgcttccgcttccgcttccgcttccaattctgattcgctgggttacaactcgcctagtcaaaacaacaaccactcacctaattcgcccgcgttgcaacgctcgcttacgtcagctgccgctagtaag

SEQ ID NO: 11574 - DNA, 362 bp, Gossypium hirsutum
  Clone ID: uC-gsflmaxxa095f11b1
cagataaaaaagaaaaagaaaaaacctctctcgttgggtccatatggaaaatcgattcaagctaagaatctctcgcatgtttcgatcctcgtttgcctcttgtcggacccggaacatgtcggacgttattgagaaacctgttttttcacctgaaaaacacaacggcttccatttggtcgaaccattttcgtcgtcgccaccacccaagtctcgacccttccctttcgcttctaaacccagagacgccatcaatgctcctaaagaatctcttcccagacgtaaatcgtcagctcgttatccttcttatatagtctccgtcgcctattttgacggccgaacgggtccgccgcctgctcctccta

SEQ ID NO: 11575 - DNA, 95 bp, Gossypium hirsutum
  Clone ID: uC-gsflmaxxa095g02b1
cttcacatactcctctgtgcgttccattggtttcatgaggggcccattttctcacaacgaggagctcatccaaaccgctaagctcgttcaagggc

SEQ ID NO: 11576 - DNA, 380 bp, Gossypium hirsutum
  Clone ID: uC-gsflmaxxa095g03b1
ctcaaattgcaaatgcgaacctggaacctacgagcagtggaagcctaggtggctctgtaaattctagtagaaaaggtaatgtgctgcagatatctcgctctttttctgttcccttaaatgacaaggacggaacaacattaaggagaatggattcatttttccgagtagttccctcaactccacgagtaaaggaaggagaaataagttcaaattcttccgtgggacctgatgctgaaaatggcgatcctgatggtgaggacataccagaagacgaggctgtttgtaggatttgcctggttgaattgggtgaaggaggtgaaacacttaaaatggaatgcagctgcaaaggcgaacttgctttggcacacaaagactgcgcc

SEQ ID NO: 11577 - DNA, 155 bp, Gossypium hirsutum
  Clone ID: uC-gsflmaxxa095g05b1
ggcacctactaaataatggaaacggagaagacaaaaaccagcacttgctagaagcaatcaagtatcggagatggaagaagacaccacaacatcaaaaatggattcccccaccaatccccagcaaaccacttctgacgacgataagatagactatt

SEQ ID NO: 11578 - DNA, 107 bp, Gossypium hirsutum
  Clone ID: uC-gsflmaxxa095g06b1
aatggcatcactcacacgcgaagggaggcgccccgcccgggtgatcttgaaaagtccaatgggggctcaccaaccctcccctaccgaccccactcacgaatatcagg

SEQ ID NO: 11579 - DNA, 518 bp, Gossypium hirsutum
  Clone ID: uC-gsflmaxxa095h04b1
caacatttctcttgtcttctttccttgttgtttcatcaggtgaaatctcgagcaagattggtataaactacggtcgaataggaaacaatttgccatcaccatatcgaaccatcgagaccatgaaatcgatgaatgccgggcgtattaagctctatgattccgaccctgaaatactgaaacttttatcaggtaccaacattcatgtatctgttatggtacaaaacaatgacataatccgtatcgcttcgagccaagctgttgccgaacaatgggtacaagacaatgtcttggcttattaccccgacacgatgattcggttcgtgttggttggtaacgaagtccttagccaccaagatcgaagaatttggattagtcttgtccctgccatgcgtaggatcaagaactcgttgaacacgcacgatatcaagaacattaaggtcagtacgccattggctatggacgtaatgcaatcaacttttccaccgtcgagcggtaggtttaggcccgatattactgat

SEQ ID NO: 11580 - DNA, 170 bp, Gossypium hirsutum
  Clone ID: uC-gsflmaxxa095h05b1
ggcatttttgagttgtagattgcctgaaacctcggggagtgtattgcctgaaacctcggggatatatactctttgagtttgttttaccctctgtagacattcacgattgaactgaaacatgcattttcaagtctgaaactaggataaaaagaaaatttacgtagttcttt

SEQ ID NO: 11581 - DNA, 433 bp, Gossypium hirsutum
  Clone ID: uC-gsflmaxxa095h06b1
ccaagacagacctagagagctgacacatccaggcgagaccgtccccatcatgacaacgcctcaaaaggcatgtaggcacaaggcaaccctctaccgccccatagccaccgaggctaggacacccgactacgggaggcacaacaccatgcgccatacaccgcattgccagaacggagcgagagctacgacaagctgcctaccttgagctgacccaggcaagtctaccaaactacccacgcgcttgaaacgccagttaaaaaactgccacctgagctaacgccaagccccaactgaatcccctctgatgagtcgattgcgttcacactcgacattgccaaccagtttcagattccgaggatcgtgttccatggagctcgacgctcccgcctgattgactccataaattacgcatctccaacgtccttgaccacgt

SEQ ID NO: 11582 - DNA, 115 bp, Gossypium hirsutum
  Clone ID: uC-gsflmaxxa095h07b1
ccgataaaagcttcagaattgcaaatggagattcgtggcaactttgatcttctttgtgggctttgaatcccaacgctccattgtttgttccgttagcgtatcggacggtggagga

SEQ ID NO: 11583 - DNA, 532 bp, Gossypium hirsutum
  unsure (1)..(532): unsure at all n locations
  Clone ID: uC-gsflmaxxa095h09b1
cccattcgtccgagccattatcacagatcagctgagggggaaaactataactgaaaaggtgctaactgtcgttcgccgtcgcgcacaacctcctcaaccaccgcagcttccgtcggccaatgacttcgtctctaggcaccaccgcctcttctcgaatcttagcatcttcctcccccggagttcgactatctctccatccncccacctttttttctctcctttctttctcttcctctgttaggccctgcgctatctctccatcttctcattactcttcccaccagaggagatcggcagttaatgtgtcgagtagcagaggattctgcacaggtgcaagtccgaaatgtgcagcttcgaatcctgatcagttgaagagtgctagagaagatctcaagcaacttctcaactctcagttctgccatcctattctgggtcgcctaggatggcatgatgctggtacctacaacaggaacattgaggaatggccacacaggggtggagcgaatggaagtcttaggtttgaagtagagct

SEQ ID NO: 11584 - DNA, 434 bp, Gossypium hirsutum
  Clone ID: uC-gsflmaxxa095h12b1
gtttggtttttgcggagaaaatatgagagagtatatggggtgtttggataacgtggaagcgattaagaggcttaaatcgacggagagaggggagagatttgaacgacattgcccggagaaagggaaaggattgaattgcttggttccagctccaaaaggatatcgacctccgatcccctggcctaggagccgcgatgaggtatggttcaacaatgttcctcatacacgtctagtagaagacataggtggccaaaattggatttctagaaaagggaaggataaatccaaggttcctggaggtggcacacagttcatacatggggcagatcaatacctgaatcagatctctaagatggtccctgatattacatttggacatcatattcgggttgttctggatgctggatgtggtgtcgcatgttttgttgcctatt

SEQ ID NO: 11585 - DNA, 530 bp, Gossypium hirsutum
  Clone ID: uC-gsflmaxxa096a01b1
ctctttttgaggtctctgctgcccgagaagaagtacggggaagtcgtggatatcctgggtacatgtatacagatttggccacaatatacgagcgtgctggacgaattgaagggagaaagggttctatcacacagattccaattcttactatgccaaatgatgatattacacatcccactccggatcttactggatatatcacagaggggcaaatatacattgacagacagctccataatagacagatatacccaccaatcaatgtgcttccatcgctgtctcgtttgatgaagagtgccattggtgagggcatgacacgcagggatcatgctgatgtgtctaaccagctgtatgcaaattatgctatcggtaaggatgtgcaggccatgaaagctgtggtcggagaagaagcactttcttctgaggatctgctatacttggagttcttggataaattgagaggaagtttgttacccaaggagcatatgacacccgcaacatctttcagtcactcgatctggcgtggactc

SEQ ID NO: 11586 - DNA, 552 bp, Gossypium hirsutum
  Clone ID: uC-gsflmaxxa096a03b1
tctcttttagaaaaaaaagggttgctcctaaagaaatggggtttcttcaatggagcctagaggtgcttgcagatcaaacaggtcttcatttgagaaatgggtggcaattgtattgacctttctagctgtggtttcacctctctatgtcaaccaaaagccaacagaactggagcttgaagagcaatccatggactccacctcatggttatgtctcctgtttgtgctactgctcttagcctttgctttctggctttacctgaaccagagctttactaggtttgaccgtcattggattaggccgagcaggtattcgtcatatgaaagactggttgcaataggcttgatagtcttaggtggtctttctcctctttatatcaacaagggcacgagtgagttcgcacctgacgagcagcccatcaactttgcttcgtggttgcctcttctgctattgatattaaccttggccatcgttacattgcttttctgtgatagaagctctacgaagttcgatcctaactggattcacagagttggtggttcttcttgctggat

SEQ ID NO: 11587 - DNA, 430 bp, Gossypium hirsutum
  Clone ID: uC-gsflmaxxa096a04b1
cggtctcgtgggcggacgcgtgggttcgaatccttgggttctatatatgagaataatctaaactaatgaaaaacagataaaatacgatcaaagaaagaattaagacatggctcgccacattattgttgttgcccttgttttcatagctattgttggggcatttgctgctgatatatcaccgtcacaagccccatcaagagctaccaagacttttgctccttatgggtcgccatcttcatcctccaatactatcagcgctagcccaagcgagagccctagcccaagcgggagccctgaggaaagcagcaaaggaccctctggtgactctcccgattcagattctgatgaagataccgatgaagatgaagaagctgaaggaccagattctgatgatgacagtgactacagtgcataattaaattcaatgatg

SEQ ID NO: 11588 - DNA, 262 bp, Gossypium hirsutum
  Clone ID: uC-gsflmaxxa096a06b1
gcactgttctgcttttaagcaaactaggacatcatgggggggtttatgtgaagaagttggtagtagacaccggtgctgaactgtaacttgtttcggtaacacgggatttgatctctgagctcgcctgcatgccaatgtttcgctaacatgaattactgcatgtacgtacttttttgagatggtgaaacgaaactgatgtaaatatgatgggttcgtccttaattacaagatatgcggatcaagccgctatggcaaaaactat

SEQ ID NO: 11589 - DNA, 495 bp, Gossypium hirsutum
  Clone ID: uC-gsflmaxxa096a07b1
cccacgcgtccgctcaaatgccaccatttttattcatctttccatttattcatattccattccttcttcttcttcttcttcttcttcacgcttctgtactcttcctttaaaaccaacttccatgctttcccttccttgattttatttctcccctacacttaccaattttcttttttattttttctataattattggaatttctttttgtttttcccttttttccttttttggttgcaatgtacagtgcggatcgttgcttgttcgttgattcgatcagggtctcacgacaagatggcttgtttctcagtgacaaaacaggtccttcctcgtttgtttcatccatttcactaaagacccagaaatgttttgtcgataaaaacgaaaatgtgtgtttggtttcgtgttctttgggtggtcaaaccctgggtcctgtgaagtcgaggagaagtggtggcaaagggggatgggttctatcggtgagtttgtcgagggag

SEQ ID NO: 11590 - DNA, 546 bp, Gossypium hirsutum
  unsure (1)..(546): unsure at all n locations
  Clone ID: uC-gsflmaxxa096a09b1
tgaaatctcaactggggaaatagagaggggagccttttaaagtagataaatattaaataatcgcagtagttgacattttgagtagcaatggctcctggaggcaacgcttgcaaagaagtcattgagtctcattcccctgttgcagattatgacatagcttcagcaaaatctgagagtaataatgccactagtactactacaactgcaacaatgaaaacttctgttaatttagttggaaaacatggaattcattcaaacaacggtgtttatgagctccttgagtgtcctgtatgcacgaatttgatgtatccaccaattcaccagtgcccaaatggacacactttgtgttcgaactgcaagattagagtgcacaactgttgcccaacatgccgctatgatcttggaaatataaggtgcttagctttggagaaagttgcagaatccttggaactcccttgtaaataccagaatctaggtgacatccccacccttgtttcacatctcaaggatgatcacanagtcgacatgcatgatggatgtaccttc

SEQ ID NO: 11591 - DNA, 531 bp, Gossypium hirsutum
  Clone ID: uC-gsflmaxxa096a10b1
gtttatagttcggcaggttgctatacaatctgatgcggattccttatacatcatatcctgaatacatcctggccaatttggttcatgctcttgctcatcattcatgtccgaacacagatgaatgcaaagatgtcaaagcatttgaattaatattccggcaattgtacttgactatttctatgttggtgaaaaaagagaggaaatattagattatagatttgaggctcgttacccccgccccccaaaataaaaaaccttgacccctgttaccaagggaatgtccactcttattgaagaggagattgaggtgagaaaagggccatggaccacggaagaggatacgctcctaacccattacattggtcgtcatggggtaggtccttggaatatgctgacagctgaaagtagatcagcagctgtactttgccaacttgatactgttttatttttggacttgcaatgtttgcttaggatttaaagacttgcccatgaaaaatgttagcaatttttagctgtaatttaattttagac

SEQ ID NO: 11592 - DNA, 439 bp, Gossypium hirsutum
  Clone ID: uC-gsflmaxxa096b02b1
cccactcgtccgaaaaagaagagagaacaccccttctgtctccccatgttctctgttagggtttcaagaacccattttgcgctgtcgccatgcctgccgatcgagagaagagagtttctcccctccccttttgggtttgatttcggcgacagagaaagggtctccggcgacacgaccatgggagatttcggtctctttttgcaggtgatgtgaacagccagacgcatgcgaggaggcgtgcgactgccaagggtgaaaggggcatgcggcggctgaagcttgaaggggctagggttgctgaaatgttttgtgtagttgggctagggtttctagacttttaggcttgttgggcttgttgggtttagatagtttaggcctaggtttaatatgtaaatgggcatttattggactgtaaaaatatttggaatttggtttattt

SEQ ID NO: 11593 - DNA, 550 bp, Gossypium hirsutum
  unsure (1)..(550): unsure at all n locations
  Clone ID: uC-gsflmaxxa096b04b1
acactctctctgtcccttcgcattggactgttgattggccgtcaatggcggctccagaggcctcaaccgccgccgtaccgactctatataccaataacaccttgcgaaatgctttcggcggtgttctctctttcttcatcctcctcctgatcggagttctcgctttctcgatccgtcttttctctgttataaaatacgagagtgttattcatgagttcgatccttactttaattacagagtcactcagtttcttacaaagaagggaatttataaacaaatacaacactttgtcctcaactttctagtgttaactgcggaaatgcttgtggagcaatctgtaatatatggatctatgaattattcatttgcgccagagggtgccgttataatatgcttcacgtcaggaactactgggaggccaaagggagttgtcataagccatacagctntaattgtacaatccctggcaaaagttgctcatggctgtactcattcgaatggctattctatatnctcttctttctcaatgagcaaatatcctgtgatttc

SEQ ID NO: 11594 - DNA, 567 bp, Gossypium hirsutum
  unsure (1)..(567): unsure at all n locations
  Clone ID: uC-gsflmaxxa096b05b1
gctatccggtgcacgttagcatcaccaccaaccaaaagcaacgaccagcgccaccaccactgccgtcgcagctaccatcatggctactcactctcgacctccgccaccaagaccacttgacctcgacttgacgatcgtgtcagccaagcatctaaagaacgtcaactggcctaacggcgatctaaaaccctacgcaaccttctgggttgatccagaccgacatttatcaaccgggtcggacgattctggctcaactcgacccgtctggaatgagcgtttcacccttccccttgatgttcctccacacgaaaccgttttgaccctcgagatctttcattccaaaccctctgaaactccgaagcctttggtggctactctccgggttgagctcaaggaattacccgacctggatgatggttccaagatccgaaccttttctttgctccgaccctcgggtcgtccccaggtaagatccggatgaaacttgggatccgggaacgtcctcttncaccacctcatgattaccattgtgcccctccgtctagctattattacacagatgcccct

SEQ ID NO: 11595 - DNA, 560 bp, Gossypium hirsutum
  unsure (1)..(560): unsure at all n locations
  Clone ID: uC-gsflmaxxa096b06b1
gaaattctctgggctagcctgcaacgcctgcaacagagagttcctttacgaggcctttcggtagctccattacaagtccgattggcaccgctacaatctcaagcgcaaggtagctggggttccaggggtgacggaagctttgtttctggcaaggcaaacagcacttgctgaagagaaagataagcagaatgaaacccccatgctttacagttgtggtctttgtggcaagggctatcgaagttccaaggcttactctcagcatcttaagtcacgggctcatattgcacagacttctcaacaccctgaagaggggaaggcagccattatcaagccatttatacgtcgtgctgtaaataagcctccacaaccaagggatacgaatgatgaggaaaatgacgataattgggtggaggttgatccagatgaggacttggcgtctggtgatgaaatgcatattgataatggtgaagaaacaggacgagaggaattagatccatgttgtngttctatgtgcgatcttgagcatgacaccattgaaagctgcatggntcacatgcata

SEQ ID NO: 11596 - DNA, 483 bp, Gossypium hirsutum
  Clone ID: uC-gsflmaxxa096b08b1
cggacgcgtgggcgaggcttgtctcctcttgtccgagtcctgtttgcaaatcattcatacagtttgcaggacttcggtcttgaaaaaaaccattcattttaatatttttttttctccaacagaatcgaataggaaatccgaacacagaaagaagctaaaagaaacaatggccggagtgggaaatagaagttttagcttgattttgtatttcctgtgcttgggggttataatccctagcctcgaggctcacatcgcacaatatgatgactattggagggaaagggaattgcaagctaaagaaaacctggagaaggcttacaatcctaacccagaggaagtcacccagcatttcaacgaccatgtggtcagaaacttgatggggtttcgcaccaattccacagggaggatgttgcagaagcgctagggaggtccttgtgaagcaaccaagcctatcgaccaatgctggcgatgtgaccgcaactg

SEQ ID NO: 11597 - DNA, 454 bp, Gossypium hirsutum
  Clone ID: uC-gsflmaxxa096b09b1
cccacgcgtccgcggacgcgtgggtagatcgcgacggccgcccttatttttttttttttttttaaacaccggccgaaaagaaagcttgcctggtttaactaacattttcatatctaggcgttctgacttaaaaaacttttatcatgaaaaaaataataataaagttcgaaactttgtttaaaaacggggtaacattacaatcaccaaccatggaagtagcggccgagttcttgctttttaacttaactatcctctctgtagtctgggttttctttcaaaataacatgcccctccaggatgggtgaaaggggaatatacttttcggaagccaggtctgctctatcaccggcagcaagaagaaccggagtggaatgagcttggaagccagtgatagtcttgggtcgaccagcctgtccaacaacatcaacagcttgacctacacggactgggaccg

SEQ ID NO: 11598 - DNA, 554 bp, Gossypium hirsutum
  Clone ID: uC-gsflmaxxa096b10b1
cggacgcgtgggccctttcaaaaatgaaggtgtggattgctgtgttgattgtatcatgggcttattggatatccatagtttgcatccagatggtttccgaagctgcgcgaatgagaaacatccagcaacaaatacttgcagttgcagagcctcacgcggatggaacttatggaacgtttaatccagatggcataatgatggagtacgaaaccagctgggaggacatttcctccgccattcaatctgcaacagatggaatcttcgcaagggcagttcgtttagtatatgatgctcaagaattggttttaagcaccctgaggcaagttattttcatcattgcattaatgccaatggaatgtaacccaagagctaatttgcagcttttgcgcatgccaacctcaacttcttctttgagatccagtgcttggtagataacagtgacacttgtgaaagagtgttagcaccaacctcacatattactggacaaaatggtttctgcgttgatgtataccaggggagctaccacgatggaaacaaagtaatcttatgggaat

SEQ ID NO: 11599 - DNA, 468 bp, Gossypium hirsutum
  Clone ID: uC-gsflmaxxa096b12b1
ctttctcgtccggaaatattcagtctctgtgcaggggcaactcttagaaaaaatggcttcggaactaccaaaaccggcaaccgaagacgtaaagttagatttgtttgaagatgatgatgagtttgaagaatctgagattgatgaagagtgggagttaaaggaagaaggaaaggagattacacagcaatgggaagatgactgggatgatgatgatgtcactgacgatttctctttacaactgaggagggaacttgagaataacactgagaacaacaactaagctggacttatgcattcctctgcactgaacttgtctgaatcggggttattttttttgtttgattttcttttccatgcaaagcgaatgaaggaatcagctgtaactctttatgcttgggtgtactggtagaaacttaaaatgcagaaactggtttgatgggtctctaaaatatagacatttgatttaaa

SEQ ID NO: 11600 - DNA, 540 bp, Gossypium hirsutum
  Clone ID: uC-gsflmaxxa096c02b1
cgcgcgagaatctagaggggcagaatcacgctatcccttgctgttctctcgcaaaaaattctcaaacttgattttaacgaccgctgaataccatcgctcatatcttcccttaaagccctaatcgataactgaagccatttaatcatgtttgggcgtgttccaaaaaaatctgataacactaagttttacgaagtacttggggttcccaaaagtgcaagcccggatgaattaaagaaggctcataagaaagctgcaattaagaatcatccggataaaggtggagaccccgagaagttcaaggaactggctcatgcttatgaagtacttagtgacccagagaagagagaaatatatgatcaatatggtgaagatgctcttaaagagggaatgggaggaggcggttcttctcacaacccatttgacatatttgagtcatttttcggcggtggagcctacagaggcggtggtagctcgagaggaagaaggcagaagcgaggtgaagatgtagtgcatgctcttaaagtttctctggaagaattg

SEQ ID NO: 11601 - DNA, 545 bp, Gossypium hirsutum
  Clone ID: uC-gsflmaxxa096c04b1
gaaccctttcgatctcttggacgatgatactgaagaccgaaattttgttattgccgctgctgagcagcagaagcttgaaaagcccaagaaagctcctgcttccgccccagctcaagctcagccggctaagcctgctaagttcccttccaagccatctcctcctgctcaagctgtgagagaggcaaggaatgatcctggacgaggaggtcgtggtgctggacgtggaggaggccggggatatggtggaagagggttcaatcgtgattccaatgtcaatgataactccaatgcatttttaggagggtacagaccttctgaagagggagaagaaaggaagcaaactgaaaggcgtggaggatatggtgggcctcgaggttctttccgtggaggacgacgcggtggctttaatgatggagaatctggagagggggagcgccctcgcaggatgtatgatcgccgtagtgggactggacgtgggaatgagttcacacgtgatggctctggacgtggcaatctgggtagtcctactgatggaattgctccgg

SEQ ID NO: 11602 - DNA, 468 bp, Gossypium hirsutum
  Clone ID: uC-gsflmaxxa096c06b1
cggactcttgggcggacgcgcgggtcttaagggacagggatcatttttagacatttgtggattctcatgccaacaggaaatatctgaacctgcttgttcatttcgtgattaaatactgcgagaaaagaaaatgcgtccgactgatcatgttactcgaagagccaatcaggatggctacaatcctggagccatcgaaggctagctaatttccgcctttgacgaagatagtgggaactttaagtccaaaatctcgatccattgaagtcatttccggatgccttaaagctggaatgtctgtggctaggatcgattcctcatggcatgatccggagtatcatcaggaaacataagaaaatttgaaggctgccgttaagctcactaagaagctatgtgcggatatgttggatactgcgggagctgagatgcacgaagatctttacattgagaaagctatctcacttgaggcag

SEQ ID NO: 11603 - DNA, 541 bp, Gossypium hirsutum
  Clone ID: uC-gsflmaxxa096c07b1
cttttatcggtgtttgataaaaggtcaattagagtggttgattttcgttgctaatattaaagatcggtgtggtgaagaaagatggatttcgcttgtagttttaagcgtcctatggtatttcatggtggtgaagggagtattagtagctataggatgctggatccgttatgtcctagatttaaatgtaggaatttgagttacagtgttgttgatcccatgattggatccaaaactcggtgtttgaagaaaatgaggaaaagtatggcttatggtggttgtttaagttcgaatttggttttcgggggggaatttaaccgtcatttgtgcagtgcgtactctagtaggtcgttgtgttacggtttgcgtgatgtgtcgaaagtaagagtagttaggctgtgttgtcaaggtaatgattcgctggcttatgctgatgggaatggtcggaatgtggaatttgcagagagtggtgatgggagttcgagtggtactgtatggaatggtctggaagatgaagatagaaatctacatggtgaagcggaac

SEQ ID NO: 11604 - DNA, 552 bp, Gossypium hirsutum
  unsure (1)..(552): unsure at all n locations
  Clone ID: uC-gsflmaxxa096c10b1
caatccaccttgttctcccccctcctctgtctttctggcaacatgggttcaccaccactttggattctgcttctgggtgtgttgtttatggcttctggaacaatcgcagctccccctaggaagcctgtagatgtcccattctccagaaactatatggctacttgggcttttgatcacattaagtatttcaatggtggctctgagattcagctccaccttgacaaatacactggtactggtttccagtccaaaggatcatacttgttcggacacttcagtatgcaaataaagctagtccctggagattctgcggggactgtcactgccttttatttgtcttctcaaaactcagagcatgatgagatagattttgagttcttgggcaacagaacagggcaaccatacattcttcagaccaatgtgttcactggtggcaaaggagacagagaacaaaggatttacctttggtttgacccaacanaagaataccactcctactctgtcctctggaacatgtatcagatagtgctctttgtggacgacataccaatc

SEQ ID NO: 11605 - DNA, 201 bp, Gossypium hirsutum
  Clone ID: uC-gsflmaxxa096c11b1
gcttttccccaccgtactatttaagcaaccatatggggcattttctttttcacatagatatctcaattcggggtaggattctaaatgctagaatctgaatttgaataagtgatttcatgaactaattaagctaaatccgggatcattgtgcaaccgtgaatgttttgagcactttcttatcatgaaaattctcttttattc

SEQ ID NO: 11606 - DNA, 540 bp, Gossypium hirsutum
  Clone ID: uC-gsflmaxxa096c12b1
ccttctcgtccgcccacgcgtccgcttcaatccatgggacccataaagaaaacgcgagaaaaaaaaaaaaagagaatccttccaacaagttatttgtgagaaatactagtgggaagtcaaaatgcaggcttgtaatggagctgcaatgatgggttctttgcttcagcccatatgggtcaaagggaatagaccaatttttcctttaaaagggtatggtcttaagttcaactctgtcaaaccctgtagagctcaacttgaaagcagcttggttactggaaagcctccctcttcggactcattccctgtggtcgaaacccgatttgtggaccatggcctcagtgaagccgatcccgaggttcgtgctattattaacaaggagaaagagaggcaattcaaaagccttgagcttattgcctcagagaactttacatcccgagcagtaatggaggcagttgggtcatgtctcacaaacaagtattccgaaggactacctggtaaaggtactatggtggcaatgagtacattgatgaacttgaatac

SEQ ID NO: 11607 - DNA, 518 bp, Gossypium hirsutum
  Clone ID: uC-gsflmaxxa096d03b1
cttgttgaaatatatttttatatatatatcattaagggatcttgttctgtatgtctttctctggcaattcaacaagaatccatattacaatcagaatcttttttatcttcacagtgttggtgtcttggctccttcttcaaagcttcttttagctgtaaatgtagcttggtttaaccctatccttttgaatggggatgaaaggagggacttcatggttgactgctgtgaaaagggcttttagatctcctactaaagatacccatgaagatgaaaagagagataaacggaggtggatctttaggaaacaaaatacaagtcctgtgaagagtgtaggtaataatggcggtggtggtgcaagtacggcagcagcggagcaaagacatgctattgctgtggcggtggctaatgcagcttcttgagagcggcttgaaggtcaaggaatatgagcctttgaggaggaacttcagtgatactggctgctttggatcggcattcaggagcacatcgatcttggaatc

SEQ ID NO: 11608 - DNA, 562 bp, Gossypium hirsutum
  Clone ID: uC-gsflmaxxa096d04b1
cggactcgtgggaaaagagagccgggaaaggaagctggaagagcttagcgaaaatgaagactatactttcctccgagacaatggacatccccgacggggttagcattaaggtcaaggctaaggtgatcgaggctgaaggtccaaggggtaagcttacccgcaacttcaagcacgtcaaccttgatttccatctcatcaaggacgaagagaccggcaagcgtaagctcaggatcgaggcttggtttggctccaggaagaccagcgccgccatccgtacagctcttagccacgttgagaacctcatcaccggtgtcactaaaggataccgttacaagatgaggttcgtctacgctcactttccgattaatgcctccatcactaatggcaacaagtcgatcgagatccgtaacttccttggcgagaagaaggtccgtaaggtggatatgttggaaggtgtttccattgttcgatccgagaaggttaaggatgagattgttttggatggtaatgacatcgaacttgtatcccgatctgcagctttgataaaccagaaatgccatgt

SEQ ID NO: 11609 - DNA, 518 bp, Gossypium hirsutum
  Clone ID: uC-gsflmaxxa096d08b1
ttttgtttcttagtttccctagaagttaagcatgggtcaatttaagaggattgtgtgtcaactcgagatcaagtcctcagctgataagttctttgatgcctacaagaccaaagcccagcttatgccaaaaatggccaatcaagtcgttagagatgtaaaacttgtcgagggtagcggttgggattccgagggttcggctagacaatggtattttgttgccggaggtaagctcgagacttgtaaggaaatgatggaaaaggtgaatgataaagacaggactattgtttacaaattggtggaaggcgaaatcatgaaagctttcaaaagctggaactccatcctcaacgtgatgccgataggggagggaagtttggtgaaatggactatggaatttgaaaagcaaaatgatgatgtccctgatcctgcaagtacggcgagtttttaactacctgggctaagaatgtcgatacttaccttctaatgtctaattaaataataaggaaactacatatatgaat

SEQ ID NO: 11610 - DNA, 229 bp, Gossypium hirsutum
  Clone ID: uC-gsflmaxxa096d09b1
ttgtctcgtggggaaaacacaaagaaaaacaaggggggaattttaaacagcttcttctttaggcccccccctccaacaccatggacatgaagaagaagaacactcgcgccggcatactcgccgctgcctcaaagagcgcagccatggcagcaagcaccgccccagctcgcaaacgagatggcgccacacaaagctccggcgcaaacggcgcaggaccagaatctgcacc

SEQ ID NO: 11611 - DNA, 562 bp, Gossypium hirsutum
  Clone ID: uC-gsflmaxxa096d12b1
tgggttttgctctccttccagttttggtctcagttggcaccatttagtactctgctgctcaaagcttcaaatgtagctcgagcgacccgagtacatgtcatgcattggtcggctacatcactgttaacaacaccaacctcggcgccattcaatccctttttagcgtcaaaaacctcaggagtctccttggatccaacaacttacctctcaacaccaagcgcagctatgccatacccgcacaacaggtcatcaaagtccccatcaattgtttgtgcaacaacaacactggaacttccagcggtgctcctatctacaccgttcaaccaggtgacgggctctaccacattgcagctgaggtgttctcgcggttactgctttaccagcaaattgcagcagccaataatattagggatgccaatttgataacgattggggacaagctcaaaatccccttgccctgtagctgcgatgaagtggacggccagaaagtggtgcattacgcacatatggtgaagtcagggagttcttcgggggagatcgctcaagagtttggaactaatga

SEQ ID NO: 11612 - DNA, 411 bp, Gossypium hirsutum
  Clone ID: uC-gsflmaxxa096e01b1
cccacgcgtccgcccacgcgtccgctgaaatccgaatggattttcttaaaaatccatctatcatttcaattttcagaaggtttttttttaaaagaaaaagaaaaagggaccgaaagttaaattagtaagctttttttggaaccatttttactttaaagtatttaatgaacatttttaatattaaataatttataaatttattaaataatttataaaaaatatatttacttaataaattgttaaaatacaaaaaaaataaagatttaaaaaaagaataagtggtcttcgtattggggcagtggccagtaaactaaagggctgtggatggcccatacaataaaacaggcgcctctcgaggaggcccaataataatgaacccaaaaaaaaagaataataaataataataaatag

SEQ ID NO: 11613 - DNA, 402 bp, Gossypium hirsutum
  Clone ID: uC-gsflmaxxa096e02b1
ggttctttaggctactatgatatgcattgataactcagagtggttgcgaaacggcgattattctccgtctcgattgcaagcccaagctgatgctgttagtcttatctgtggagctaaaacccagagtaatccggagaatacggtggggattttgactatggcgggcaaaggagtacgtgtattggctactcctactagcgatcttggaaaaatcttgacattgcatgcactgtcttgaaatggggggtgagatgaacctagcagctggaatccagattgctcagttggctctaaagcatctgcaaaacaaaaatcagcagcaaaggattatagtttttgctggaagtcctattaagcatgaaaaaaaggcattgcagatgattgggtagaagctgaaaaaga

SEQ ID NO: 11614 - DNA, 543 bp, Gossypium hirsutum
  Clone ID: uC-gsflmaxxa096e03b1
atggtttccaccatctcaaagatccccactcactccgtcttcatactcctcgttttgtcctcacccaaaccacccgtttcctgcttcatttccaccgccaccgccaccgccaccgtcaccgacaccgctgagaaccggactcagaaactcgaacgcatcgtcgacgagcttttagatcttacaaggctcgaacgctacgactattccatcctcttccgtcttaaactcggcctcaactgctacggacctgccgtatccggcgtatcctccgccgccgcttcgggtccgggaaccggatccagcgcagccgaaacgaaaacggcggaaaagacggcgtttgatataaagctggagaaattcgatgcggcggccaagataaagataataaaagaagtgaggacgttcacggaattgggtttgaaagaagcgaaagatatggtggagaaagttccggttgtggttaaaaagggagtaacacaagaggaagctgaggccattattaagaagctccaagaattgggtgctactgtggtacttgaatga

SEQ ID NO: 11615 - DNA, 558 bp, Gossypium hirsutum
  unsure (1)..(558): unsure at all n locations
  Clone ID: uC-gsflmaxxa096e04b1
cggacgcgtgggtttcagcacaacagatgcgttagctcaccgcccccacctgcgtttctccaatttcagtattggtcatctccctgccgattaatttcctttcagaaaaccctaattccacactctctcttttttttttacattacatcaaaagcagagaaaagcaaagtggaggaggaaagatgttagcaatagcaaggcaaaggatgttggggcaatcatttaagaagattctgcctgcagtgtcagtcttgagaagttactcatctgctgcaaaacagattacagtgagagaggcattaaactctgctcttgatgaggagatgtcggctgatccaaaagtctttttgatgggggaagaagttggagaatatcaaggtgcatacaagataaccaagggacttttggagaagtatggacctgaaagggttcttgatactccaattactgaggctggttttactgggatgggngctggtgctgcttactatggtctgaagccagtagtggagtttatgacatttaacttctccatgcangcaattgaccacattatta

SEQ ID NO: 11616 - DNA, 552 bp, Gossypium hirsutum
  Clone ID: uC-gsflmaxxa096e05b1
aaaaatgtttgtttttgattttaaaatataaacttacgacatctataaatggtgacctcagtgctacctagagtagaaagcttggcaagcagtgggattcagtcaatcccgaaagaatatatcaggcctcaagaagagcttacaagcataggtaacgtgtttgaagaagagaaaaaagaggaagggcctcaggttccgaccatcgatttgacagaaatcgagtcggaggacaaagaggtccaggagagatgtcggcaggagctgaaaaaagctgccatggaatggggtgtgatgcaccttgttaaccatggcatctccgaggagctcatggatcgtgttaggaaagttgggcagaaattctttgaactccctgcggaggagaaagagaagtatgccaacgaccagagctctgggaatgttcagggctatggtagcaagcttgctaataatgctagtgggcagcttgagtgggaggactacttcttccatctaatttttcctgaggataagagagacttgtcaatttggcctaaaatccccagcgagtacact

SEQ ID NO: 11617 - DNA, 445 bp, Gossypium hirsutum
  Clone ID: uC-gsflmaxxa096e06b1
cccacgcgtccggatgaaaagcccaaagaggcagagcaaagtgttgtgcaccttggtatccattactggagcactcattatgaccctttacaagggtcctccagtactttacccaccaatacaaccgtatttacacacattttcttctaccatgataacaacatctaacaattggctcataagtggtcttttcatcgctactgtctctgtgtcactttcagcaaacattgctggtcaggctggggatctgaaagggaatacatcggagataacgtagggtctcttctatagcctctatgggaccatgcaatctgcattggttactaggatcctcgaaagagaccccaacgcttggatgatgagtccagatatcgagctcatctctgtggtctactcagctgtattagcaaatgtggtaacattctgcgtgcaagcatggtgcata

SEQ ID NO: 11618 - DNA, 476 bp, Gossypium hirsutum
  unsure (1)..(476): unsure at all n locations
  Clone ID: uC-gsflmaxxa096e07b1
cttttatgggttctcaccggaaaatcgtacttgggtctcaccggccgcctagaaaaacaaagcaaatatagagcgaaaaccgactatttttcctcatttctttcttgtgttccattttttcaagtgaaatcccaaaatggttgtaaattttagctttgtttttttagtttcggtcctgatattgtgtttgggagtgaactcagagccagttcaagacaagcaagctctccttgcgttcctttcaaggaccagacactcgaaccggatccaatggaactcatcaacttcagcctgcgattgggtcggtgtccaatgcgatgcgaaccgctcttttgtttatactcttaggctcccagctgtgggtctcgttggctcgattccgcctaacaccatcggtcggttaaaccaactccgagttttgagtctccgaactaacggtttattcngtgagatccctgccgacttctccatttgac

SEQ ID NO: 11619 - DNA, 519 bp, Gossypium hirsutum
  Clone ID: uC-gsflmaxxa096e08b1
cggacgcgtgggcgctgccgggtatgcggcgagggagtttgccaaacagggagttcagcctggtgagctagccattatttccaaggaagcggttgctccatatgaacgtcctgctctgagtaaggcgtatctcttccctgagggagctgcaagacttcctggtttccatgtctgtgttggaagtggtggagagagattgcttcctgagtggtacaatgaaaaaggaattcagttgatccttagcactgaaatagtgaaagcagatcttcctgccaagactctagtaagcgcagctggagaaacgttcaaatatcaaattttgatcattgcaactggttccacagttataaggttgacagattttggccgtgaaaggagctgatgccaaaaacattttttacctgagagaaattgatgatgctgataagttgctggaagcaatcaaagcaaagaagaatggaaaggctgttatggttggaggaggctatatggccttgagcttgctgagtgatgaaaatt

SEQ ID NO: 11620 - DNA, 540 bp, Gossypium hirsutum
  Clone ID: uC-gsflmaxxa096e09b1
cccacgcgtccgcccacgcgtccgcgataccgcgtaaaagactaaaagcaaaagaaaaaactaaaataaaagtcggtattggcttcgaagcagagccataaaatcacctgtattaagcaatctcttccttaaatccaaccattaaaaaccctcgtttcttaaacatcagatcggatccttgaagcctccatcgattcatttttggtacggttttcgtagtatcgatcaaacatgagtttcctctttgggaagagaaaaactcccgcagagcttctgcgggagaataagaggatgctggacaaatctattagagagatagagagggagaggcaaggtcttcagaaccaagagaagaaactgattgcagagataaagaaaactgcaaagcaagggcagatgggagctgtaaaggtgatggcgaaagaccttatccgaactcgacatcaaattgaaaagttctataagctgaaatcacagctccaaggcgtatctcttcgaattcaaacattgaaatcaacacaagcaatgggagaagcaatg

SEQ ID NO: 11621 - DNA, 538 bp, Gossypium hirsutum
  Clone ID: uC-gsflmaxxa096e10b1
cggacgcgtgggttttcagcagcaactttttccttttggcagttaagtgaaacgatgccatactactcgaggggtggcgaagatgacgttgacgagttcgacgaattcgatccgacgccttacggtggtggatacaatctcgaactaacttatggtcgtcctttggaaccctccgatgagacttgctacccttccgctacaccctccgatggcgactttgattacgcacgtcccgatttctcttccggttacgcgcacttagcttatgccgacgaagccctcgaaactgaatacagtagctatcttaaacccaagccccgacctggacgattcgaacctgcacctgcttttggtgactatggaaggaaacctgaatatgagcaattcgaatctggtcatggacgcaaaccggagttcggacgacccggctccgaatttgaatctgattctggccgaagacctgaattcgagcagcctcctgaggagctaggatctgggcatggccgggaggccgcatatgagcattcacatcaaccgg

SEQ ID NO: 11622 - DNA, 535 bp, Gossypium hirsutum
  Clone ID: uC-gsflmaxxa096e11b1
ctttttgaaattattatttaaaaaaaaaaaccttttgttcctttctctcctcctttggcgaccgctaaaacgtttcctggtcttaatccaaattccgatcggaagatcaagttagggctttcagtcgattttcaatggaaagaatcagaagagcttcgcatgcaggatcttggtacactgataacccaaaaaaactggcggaagagcttgatggatggatcacggcggctggcttgcctaaatcctctgatgtaagaggtgtaattgctccgcatgcaggttattcatattcaggtcgtgctgcggcctatgctttcggaaatatagacccaacaaacatttctcgggtattccttcttggtccatctcaccattattacactccaaaatgtgctctgtcaactgctacagtatacaagacaccaataggggacctacctattgatttggaagtcatcgaatagctgaaagctacaggaaaatttgaactgatgaatcttcgtgttgatgaagctgagcatagcatggaaatgca

SEQ ID NO: 11623 - DNA, 528 bp, Gossypium hirsutum
  Clone ID: uC-gsflmaxxa096f01b1
gtcaaattattcttctcctatggaagtggaacttgaagcttcctgtttcttacaatgtcttcatgcttatttttgcttcttccttatcttcaccttgattacaattcttccacttttgtctctcttgtttagtttgttacccagaccaaagctgtggtgcacctgtgagatttgtcacacatatctgaatatgagttggtcaaaacaattcgacaatctttgcgattggtacactcacctgctaaagaactcgccagggaacaccatccatatccatgttctgggcaatacaatcacagccaaccctgacaacgtggagtacatgctcaaaaccagatttgagaatttgccaaaagggaaacctttctccttgatcttgggtgactctcttggtcgaggcatattcaatgtggacggcgattcctggaggtttcagacgaagatggcaagcctggagcttgtgaaactctccattaaatctttcgctcttgagatcatcaactgtgagatcaaagacaggcttatccc

SEQ ID NO: 11624 - DNA, 485 bp, Gossypium hirsutum
  unsure (1)..(485): unsure at all n locations
  Clone ID: uC-gsflmaxxa096f02b1
cggatcgatcacagattctcggccccgtcgtttggctgccactccagttgacctctcttgttttcatccccctgtgagaaggtagagagcaaaaccaacccagcaacccacttttactatgtcctattagtaaagcatttactttttgcaaggcttgctgagcttcttcatgtgacagacatcgcaaaagtaatccgtcgaactctcgccgatagagggcatcgttaaagtatacgattttttaaccccgatgggtttcgcagtcgaccatttgatagccctgttcctgaatatacagaactaatagggcttcgatgagccctagatgtaaaggggttaaaatacctctaagcaattagaagagcgcggaatttgacctccctcaaatggatggatctgngattgattgtggaattcgagtagagagaacccggngcgggcaggaagatgccccacaggagataggtgtttgataaagcttgatg

SEQ ID NO: 11625 - DNA, 550 bp, Gossypium hirsutum
  unsure (1)..(550): unsure at all n locations
  Clone ID: uC-gsflmaxxa096f04b1
ggtgagtgcaaatcctaccagcctgccattaacgccttttagcaattaggaattgcccattgcccattcctgcactaaaatcaatcaaaaaaaaggaatcaaaattcaaaaccttgttcttttatccactgctttaaagctctaaatcaaattattacgtgggaacttatagcaatttatccctcttcatgggttgctcttcttctctcccagatcggagttccgggcggtccactggacttaacaacgcggacaatcctgaaggtcccgatgccaaaaatctacgcgtaaagctggtcttgttaggtgattctggagttggaaaaagttgtattgttcttcgctttgttcgtggccagtttgaccctacatctaaggtaactgtaggagcttcattcttgtcacagacaatagctntgcaagattcaactactgttaagtttgaaatatgggacactgctggacaagagaggtatgctgcattggcacctctctactacagaggagcntgaagtgcagttattgtgtatgatataaactagtcagagtc

SEQ ID NO: 11626 - DNA, 549 bp, Gossypium hirsutum
  unsure (1)..(549): unsure at all n locations
  Clone ID: uC-gsflmaxxa096f05b1
cccttagcactccacgacacagatccgaggagttggggaaaaccctcacacaaattctctctctaaatcttaaccgagaaggtctccaaaaaagactaccctttttgcccatttactctccttattcaacaaattcggcatcacatcccccaaaatagtcgcttttttatctcttgctctcttcatctgcttcaagtcatggctggtgtagcacccgaaggatcccaattcgatgctcgtcaatttgatcagaaaatgagtgatttgctccaaacggatggagatgatgttttcacttcttatgatgaagtttatgacagttttgatgcaatgggacttcaagagaaccttctgaggggcatctatgcatatggttttgagaagccctcagcgattcagcaaagaggaattgttccattctgcacgggtctcgatgtgatacaacaggcacagtctgggactggaaagacagcgactntntgctctggaattntgcagcaacttgattacggtatagtccaatgccaggctctggttctgcacccacta

SEQ ID NO: 11627 - DNA, 532 bp, Gossypium hirsutum
  Clone ID: uC-gsflmaxxa096f06b1
atggttccaaagcttctgttttccactttcactatcctaattacatgtttattcagttttggaatcgcccaaccttgcccccgtcctcgaccatgcccttcaatctcgcccccaccacgccctactagaaccgtctcttatgttcgaccccgtccgccactctacgatccttcccttcgtctcttacctcgccagccaaacaacaatcccggtcccttagccaatagagccaggattctcgccattacccaagaactcaaacgaaacattacctttgaccctcaaaactacacccctacttgggttggcaacaactactgcctcttcaaaggcttcatttgcgacactgtaccagacctcaacattactggacttgcaggcattgattttaacggcgcaaggtttggtggtaacttgaatttttatcgtttcattcaaaacttgcctgatattgctatcttccatgccaattcaaacaacttcagtggtgtcatcaaccaaggtcttagtggcttgcgttactcttatgaaa

SEQ ID NO: 11628 - DNA, 422 bp, Gossypium hirsutum
  Clone ID: uC-gsflmaxxa096f07b1
tgaatggctacaagcagggtttctgggttgaaattggtttcatttgtgaaccggggaagaagcagcctctcctttaggttgcgtccagatcgcttgcggatttcatgtgctgtatgtttctcattgaatgatatgatattcgtttctacgcaatgtaacccattagtgaagggcaaaggctatataacagggatttacatttctttttagtgtccattccatcgacaataagggaaataacatggacttgtaaattaaatagagagatgataagataagaatccacttgtggactctcttctaacagtgcatggttttcttatctttgatatttctcgtatgggactgtttgaaatatggctaactgtttgtgctattattttgctaactctaaggagcgcacggaatggttggcaagtcac

SEQ ID NO: 11629 - DNA, 454 bp, Gossypium hirsutum
  unsure (1)..(454): unsure at all n locations
  Clone ID: uC-gsflmaxxa096f09b1
cttgatatctatcagattagggttgagcagatatggccaagtcaaagaaccacaccgctcacaatcagtcttacaaggctcacaagaatggcatcaagaaacccaagagtcaacgccatacttccaccaaagggatggatccaaagttcttgaggaaccagaggtatgcaaggaagcacaacaagaagaatggagagtctgccgctgaggaagagtaaatttaaatggaaaagaaaattatcctttattaaagtttttctagttagggctgttttactatcttctatggaatttagtgttaaatttacgctcctttagtttttatattgctgttttatgggattgctgattatatttgctagaaaagatctgaagttgtgagcttattaatatcatgaacatgttttgagcttcanaaaaaaaaacataaaaaaaaatcatttttctacaaaaa

SEQ ID NO: 11630 - DNA, 553 bp, Gossypium hirsutum
  Clone ID: uC-gsflmaxxa096f10b1
gatggtctcaactcaagatactaccctccctttaatccccacttctcgttgctcctttcttcaacctcggaaatgaagaaaatggcgactcctctgctttttttcgctacctttttggtacttctcaccacggttcacccaaaggtgattgctgtgggacaaccttctgaggtcaagcttaactctcgaatccttcaggattcaattgtcaaactagtaaatgaaaatcccaaggctggatggaaagctgccctgaatcctagattttctaattacactgttggtgagtttaagcacattcttggagtcaaaccaacaccgaagaaggaacttctgggcattcctattataaggcatgacaaatccttaaagatgccggccaattttgatgctagaacagcttggccacaatgtagcacaattggaagaattcttgatcagggtcactgtggttcttgctgggctcttggtgctgtagaatcactatctgatcggttctgtatccattttggcatgaatatatctttgtctgttaatgatcttctcgcgtgct

SEQ ID NO: 11631 - DNA, 523 bp, Gossypium hirsutum
  Clone ID: uC-gsflmaxxa096f12b1
attttgtggcaacctctgtttttcttcacaaattgcggatctattaacttccttcttttctttttccacatctcatagaagagttggcagtttgctctgctgtgtccacagttcgtcaaagtggagggcattaattttgaatcgtcttttatgtctgaacgggcctgtctctttttatcatcaattggtttgctcggtgaatactgtcccacttctagaaaaaaggaaggtatctgcatgcatattgaggtcagtaatacagaaaaatttggttgccattttatgcgacctattccaagtgcaagaaagcagtctggtaaaggatttgttatcacaattggaatcactagtatctgatccctcctttgtgattaagagtttgttccacaagttcgatcgagatggctttgcagaatattggtgcttccaacagtgatgatgcctcttataggtataagatgcccaaaatgataaccaagattgaaggacgaggaaatggcatcaagactaatgtggttaacat

SEQ ID NO: 11632 - DNA, 548 bp, Gossypium hirsutum
  Clone ID: uC-gsflmaxxa096g01b1
gcgttcatagaaaaaaaagatagggttttaattcgaaatcgggttcttttgagattaagctttggctggagaaagggccttgttcaagttccttaagcctgggcaacgtctacagcccgccgacgttcaagctgccgccatgtggggcgtcgctgccactaccggcgctctttggctcattcagccttttgattggttgaagaagacctttctggagaaaccagagtcggattagaagcaaatgggacatcttgcaactcattgcggctttgtttatcgggtttgctgatgaacaaatcatggaaagaataaaaataataatgtagtaagtgtaattttttgtggtttattgctaagagaacaagcctctttgcttttggtatcaattactgggaagttttgaacctttcaccttcagtttgaactgttgtctcatttctacttgagtttatgaattcatgcattcataaagaggtttagttgagattctgattgaatgcaaatcacaaggggcatgaatggtataaataattgactaaacattattg

SEQ ID NO: 11633 - DNA, 152 bp, Gossypium hirsutum
  Clone ID: uC-gsflmaxxa096g03b1
gtttttgttatcaattcatctttggcttttgcactccagctcctttcattctctgtctctctctctctctctggtctctctacaaagctatctctcagctctcatctaacgacacatggtaaaggacaactggcacagacgtacgggcacac

SEQ ID NO: 11634 - DNA, 493 bp, Gossypium hirsutum
  Clone ID: uC-gsflmaxxa096g05b1
gatttattctttcaccatttctctccatcgaaggagatttttataaaaagaagaagaagaaagagtagaaaagtagttattttgaatccaggtaactcacataatcaatctcctttccactttgaacaaaaaggcgaaaatggagagtttcagcgccgaagatctgtcaacaataggaggcatagccaccgtttcccttcttcattccttcattcccacccattggcttcctttctccatcgtcggacgggcccagaaatggaccctttctcgtacccttttcgtcaccgcatttggagcagttttgcatgtaatatctacttcgcttcttggtataactgccatcactatggcgaacacgattgctggagaagaaacagtgcataaacttgcttcacttttgctcatagttcttggtggtagctatatactgctgtttttgtctggaaaaggtgggcacagtcattctcataatcaacctatggagaaaatg

SEQ ID NO: 11635 - DNA, 503 bp, Gossypium hirsutum
  unsure (1)..(503): unsure at all n locations
  Clone ID: uC-gsflmaxxa096g07b1
ctcttcctttcttcaacttccccttccccttccaaagggtcctttataatccacctttgccaataaccctctccagtcccctctctccttaggtccgggccgccatctcgacccctccaatggcgccgcaattcgtcgagcttccatcgtttggttccgcaacgatttacgggtccacgacaacgagtgtctcaacaccgccaacaatgagtccatgtcggttttgccggtttactgttttgaccctcgagattacgggaaatcctcatctgggttcgacaaaaccggtccttacagagccacattcttgattgaatcggtttcggatctccggaagaatctgcaagcacgagggtcggatcttgtagttcggattgggaagccggagagtgttttggttgatttagctaaagctatcggggctgacgctgtctatgctcatagagaagtttctcatgatgaggttaaggctgaggaaaagattgagtcngccatgaaagaag

SEQ ID NO: 11636 - DNA, 558 bp, Gossypium hirsutum
  Clone ID: uC-gsflmaxxa096g09b1
caaacacaaacatattactgctcactatagcctaatagtggaattgttgaaagagaaaacaaaaatggaggtagctttccctgttattgacttgtccaaaatcaatggtgaggagagaggagccaccatggacatgatcaaagatgcttgtgagaattggggtttctttgagctgacgaaccatggaatatctcatgaactgatggacactgtggagaaactgacaaaggagcattacaaaaagtgcatggaggataggttcaaagaaatggtgacaagtaaaggtcttgaagttgttcaatctgagatcactgacatggattgggaaagcactttcttcttgcgccacttgcctgaatcaaacctttatgaaattcctgatcttgaatatgattacaggaaggtgatgaagcaatttgcagtggagttggagaagctggctgagaaacttttggacatactgtgtgagaatcttgggttggaacagggttccctgaagaagtgttttatggttccaaaggccaacttttgtaccaaagtagaactaccctcatgcct

SEQ ID NO: 11637 - DNA, 549 bp, Gossypium hirsutum
  Clone ID: uC-gsflmaxxa096g11b1
catttccaaagatcttttttcttctcttctgatcatcacaattaattgtcttcagaatcttccgagatcctatgccttgccatttcaaggtttcaagtgcaatccaagaaaactactttcttgttcccttaatatgatgggcgggatgaactcgagtaatgtaccgcggagtatggtagttaaggcaattcctggttccacatcaagtgaaaaaactagtaactctgactcagaggggaaaaaatctgagacatatagtcatgatatgacagaagctatgggcgctgttttgacttataggcatgaattgggaatgaactacaactttatccgtccagacctaattgtaggctcatgtctgcagactcctgaagacgttgacaagttacgtaagatcggagttaaaacgatattttgcttgcagcaagacccagatttggaatattttggggttgatattggcgccattcaagattatgccaagaaatgttgtgatattgaacacatacgtgctcaaataagggacttcgatgcatttgattaccgatg

SEQ ID NO: 11638 - DNA, 359 bp, Gossypium hirsutum
  Clone ID: uC-gsflmaxxa096h01b1
cccactctttcgcttcaccatgccaattccttttggggggatcgttttacatttttattccgtggttagacacttcttactcgccgtcgtaaactgctgccactatacccatttggagtgcttcttctccttttatcttcaacccgcgcaataatagatcgagtcgagccgagcccgaaatatacgctctaaacaaagccatgaagggttcagggatcttgatccctacatccaaagcaatcatgtagagcacacttctatgacggctcatgagcacgtagccatgacaaagggcgagcactacgccgacagctgcggcatgaccattgacagctgcgatggtgggcatggggagggag

SEQ ID NO: 11639 - DNA, 419 bp, Gossypium hirsutum
  Clone ID: uC-gsflmaxxa096h02b1
ttcctttcttgtttaacaaaaatgatctcagaaatggggagaaaatttatcaattttatttgattactacagcgtgaagattcaagcttgcaatcgaatgcctcacttgaaactctgtatcagaactgccatacgagaggatacaaaaaagatcattgctgaggatggcttgcaaaggatgcctaaaatgcttgctgaagctggtgcacttcttgatgactctagatggactggcaatggttggatacgggatctacttgagtgttgagtacaaaagagctgctgatgatgccatgcttgtgacacctgtgggcactgaccaaatacagctcggtcggcccatgctcatggccgtgtctctttcgtctagtattttcgataatcttccaaaagcatggtttatatatccggctattggt

SEQ ID NO: 11640 - DNA, 551 bp, Gossypium hirsutum
  unsure (1)..(551): unsure at all n locations
  Clone ID: uC-gsflmaxxa096h04b1
accatattgtcttgtctgctgcaactcttgtctttggggctcatcttatcttcagctgcatcaatccaaaccccgaagcattatgttgtatacatgggaagctcagctggtgaaactgcagaatcagatcatccgcaattactgtccacagtaattccaagggaggaaagagaaaggatttcaattacaaatcattataatcatgcattgagaggattctctgcaatgcttactgatgatgaagcttctgagttgtctggacgaaatggggtggtatcggtttttcccgattcaattcttcagttacatacaacacgatcgtgggatttcttagacgacaactcaaaccctaagttgaatcatggatcatatctgcctcataaatctacttatgatgtcattattggcatgatcgatacaggaatttgggccgagtctccaagtttcaaagatgaaggaatgggagaaatacctaaaagatggaaaggagtctgcatggagggaccagacttcanaaagtctgactgtaataggaagttgataggggcaag

SEQ ID NO: 11641 - DNA, 554 bp, Gossypium hirsutum
  Clone ID: uC-gsflmaxxa096h05b1
cacaatttggaatcgtagcttgtctctccaatcctatgggggtcttgtttgcatccaactagttgtttccaggacctaggctttgatagttaaaataaaaaccactatgggttttgctggttatagttatagttggtttttgttgtcatttttcgccctaatcccaacactaagagctcacatcgctgaatatgatgagtattggaaagcacgagaattggaagccattgagaacctgaacaaggcttatcaccccaatccggaggaggtggtccggcattacaatgaccactttgtcaataccatgcttgagtataataacaccagaagggtgttgaaaggaaagaaaaatggtccctgtgagattactaaccccgttgatagttgttggcgatgtgatcctaactgggtaaagaacaggaagaggttggccgactgtgcccctggatttgctcgtggtactaccggtggaaaggacggaaagttctacgtggtcactgaccctagtgatgatatttctaaccccaagcctggaactttgcgtcatgcagtca

SEQ ID NO: 11642 - DNA, 544 bp, Gossypium hirsutum
  unsure (1)..(544): unsure at all n locations
  Clone ID: uC-gsflmaxxa096h06b1
cccacgcgtccgcccacgcgtccgcaaactgccacgggcggctgttctgaagcaaattctgaagagatgttcaagcttaggcaagaaacatgggtacggcgaagatggactccctcttgacgttcccaaaggtcatttcgccgtttatgttggcgaaaaccgaagcagatacattgtccctatcaccttcttgactcaccctgaattccaatgcttgcttcaacgagctgaagaagagtttggttttaaccacgatatgggccttaccatcccttgtgaagaagtcgtttttcgctctctcacttctatgcttcgataaacattgattaatgtcgtcaaacgatggggcttggcttggagaatgatggccaaaaagaagctttctagcttctctttttttaacgtccttctcttcacccctcttattaggctntactattttgaacccattaacttgggtttttttttttgtgcgtgtttaagtagttagtagtgaatctaacttagcccaagaattataaactttttctgggtttagatgaat

SEQ ID NO: 11643 - DNA, 560 bp, Gossypium hirsutum
  unsure (1)..(560): unsure at all n locations
  Clone ID: uC-gsflmaxxa096h07b1
cacactttcatttcttgttgaagtcaaacaaggaagggaaaattattcagctcagattcatggctacgcttatgacaaatctgctgctcacggcatgcattgctcttttcttggtatcagctgccaccgccgtcggcgactcccccttcatcatcgctcacaagaaggcatcgctcaccagactcaaatccggcgccgagtgcgtctccgtctctatcgacatctacaatcaaggcttctcgacggcatatgatttgagtcttgtggattatagctggccccaagatgcatttgatgttatcagtggaaatatttctcagtcatgggagaaacttgacgctggtggtattctatcacattcatttgaattagaggccaaaaaacaaggcatgttctatggtgccccagcagttatctcttttcgcattcccacaaaggctgctctacaggaggcatattcaacttcaatcttgccgttagatgtcctttcagaaatacctnctgagaagaagtngagtgggctagaggtgcttgctaagtatgatctcaagctctggata

SEQ ID NO: 11644 - DNA, 509 bp, Gossypium hirsutum
  Clone ID: uC-gsflmaxxa096h09b1
cccactcgtccgcggacgcgtgggggacctaaacgtggggaacagttcaacagccatctatgggactctgccaatctctgggattctgcttgagaagatctcactctcatgaaatcccaatctcttcctcatctgagtcttctcctcgtccgtctcatccattccccaaaaccaccccgcaacactttaacccttcttcttctaaagctacttcatcatccggtattggaaccattttgctcaaaccatatgttgatatcaccaccatttatgatcttgacaaagagttgggcagaggtcagtttggcatcacttatctttgcagatgcgtgtgagagacttggagcagattttgaatttactgcggggaaatgttgtcaacgtagtggaatatggatatgaatgggaaatagaggatgaagaatcagatgaggaggacgaggatgaggaagaccgagataaaactagtgctgtttttctttcccgttgactttagtacagtcacatgg

SEQ ID NO: 11645 - DNA, 539 bp, Gossypium hirsutum
  Clone ID: uC-gsflmaxxa096h10b1
gttctgtgtccgcagcacttcggtcatggctctggggtctgttagagaaagggttgtagctcgccttaggcgagatttattcagtcatcttattcatcaggaaatagccttctttgatgttactcgaacaggggaactcctcagcaggctatctgaggacacccagattataaaaaatgcagcaacaactaatctttcagaggcactccggaatctagcaaccgcctctattggtgttgccttcatgttttcttcatcttggaaattaacgttaccggttatttctgttgctatacgaagacttggacgctatctcaaggaactttcacacaaaacacaagcagcagctgcagtagcatcctcaattgctgaggaatcttttggagccattcgaacagttagatcatttgctcaagaaggttttgcaatatcaaattacactgaaaaagttgacgagacactgcagctcggactaaaacaagctaaactagttggtctattctttggaggagtaaatgctgcattcacacttttctgta

SEQ ID NO: 11646 - DNA, 494 bp, Gossypium hirsutum
  Clone ID: uC-gsflmaxxa096h11b1
cccattcgtccggcatcaaatggtgctaggaaagtggggactgctaaagccaagatggtggggacactcacgggggtgatgttggttcccctgcatctcaggatgaccatgatcaccaccatcggttcaatcaccgtgaagaagaaagggaaagagcgccatcgcctgttgaatcgcatgtaaccatggagaagtatgtggataaagtcactagagatgcacaaagcatagagaaatgtggattggatgacgtcaagaacacccatgttgctattcagcatgttgagcatgataagatttctagctgcaccagtagttcagatgactaatctcgagcctataataagaattcaagggaagaagcctatgtttttggtaccgtcatgtctgcaaaagctctgaaagttgctggagatgaaactcatggtactgaaattatccacgaccaattcgggttgaatgaaagtgaagtgaagttattgctctcatcaaat

SEQ ID NO: 11647 - DNA, 549 bp, Gossypium hirsutum
  Clone ID: uC-gsflmaxxa096h12b1
gtggtgtggctccgccaccttccatggcggctggggggtcttttgctcatcagttccagcaacaaccgcagtcgcagccttggatgatgatgtctcaacaacagcagggtggtcagccggttcctccacctaccggttggacgccgcaacctgttcctccgcccactcagatgcagcagtactccgccggttctgctgctgctggctccggtgagattcgatctctttggatcggagatcttcagccgtggatggatgagaattacctcatcaatatctttgctcaaactggagaggtggtttcggctaaggtgattaggaataagcaatctgctttaccggaaggatatgggtttatcgaatttgtgtcccgtgtggcagctgagagggttttgcagtcttataacgggctgccaatgccaaacgctgagcagaattttaggttgaattgggcatcacttggatctggggaaaagaggcaagaagagggtcctgagtacacaatctctgttggggatttagcagctgatgtttcggattacatgttac

SEQ ID NO: 11648 - DNA, 403 bp, Gossypium hirsutum
  Clone ID: uC-gsflmaxxa097a01b1
ctttgttagaggaagaaaagcgtcttttgtcgggcgggaatggatcatcgttggggtcatttcattgctcactctcatggatcaaaaatctatttctaaaaccccactcccatcctttaaattctaacactagagaagacaactgaaacgcaaagcatacatccccctaaatttgctttcttctcaaagttttttctttcatctctgcttcatggctcagtctactgtatcccaggtttctgtagctgttcccgttggaaacgacatttctctgaggagatctgtagctaacaggaacattataagctttggtaacaagtcatgggcttccaccttggcttttgatttgaaatcacgaaatgcacagaagaacaaaccgtacatagtatgcctgtcagtgcaa

SEQ ID NO: 11649 - DNA, 481 bp, Gossypium hirsutum
  Clone ID: uC-gsflmaxxa097a07b1
attgaacctcaaagcataattcagtaagcggggggaaaataaaaaaaaaatggggcaaccattaccaaagagctggagcatccatacccgacccgagatcatcgccaagtaccagatcctggagcgcgtgggttcaggcgcttactccgacgtctacagggcgcgtcgtctctccgacgacctcatcgtcgccctcaaggaagtccacgactaccaatcggcgttccgcgaaatcgaggccttgcaaatgcttcggaactgcccaaacgtcgtcgtcctgcacgagtatttttggcgggaagacgaggacgccgtgctcgtcttggagttcttgaggaccgatttgtcggtggtcatccgcgacgcgaaaaaaaaaaaaggaaggcggggtccgagtcggtgaagttaaaaggtggatgcttcagattttgtgcggtgtcgatgcgtgtcatcggaatatgatcgttcatcgggatttaaa

SEQ ID NO: 11650 - DNA, 478 bp, Gossypium hirsutum
  Clone ID: uC-gsflmaxxa097a08b1
ctcacgcgtccgcgtctctccactctctaatgggcagtttgaagttaagcgggggatgcaaatcctctcctccttacctttcctgttttctcttcttttttttctctctcaaatgcggatagaagctagaaactagctttttcactcatgggctctgtcactgtaaaaccctcattaaatactttctgtttcattcccgagagccccaaaattcgttgtcattcgcctcacttctcattcctcaaactcagaccttcccctgtttctttcccctttaaatctccttctgatccaataaactcatctcccaaatgtaaaattcgaagctttatggttaaccctttattggttttagtcccagttttgagaagcatcagaagcttggctttttcgcattcccaaaaatgggcttcacgtttgcacgattgcattacagaatcggagggaaatttagaccaataccatggcaattgcttgc

SEQ ID NO: 11651 - DNA, 465 bp, Gossypium hirsutum
  Clone ID: uC-gsflmaxxa097a10b1
gaagtacaaggaaatgcttacaaggggacctttcaaaatcgaagtcgggctcgaggacaagcaagaactcgaagactcccgcaaaccctgtcctcctcctccctcaaccgccaacgccacctcttcttgctcccttcttcacctcctcgatcgctcccaccctaacccctcttccaaacttcaacgcatcggcctttccccctaatggaaggcgaaatcaaactccgcctacaggacgcctgcgcccaccgtcaattaacctccatcctttctcctttccactccaaaaccctccatcaagaaaacctcttgttcgacaccccagccaataccctttcctctcaactttccggtcttcggctgcgcttcctcaacaaggacgcccgctgcatcggttccctcaaatccaaacctactctggtagatggtgtcagccgcgtggcggaagatgaggaggaactagat

SEQ ID NO: 11652 - DNA, 428 bp, Gossypium hirsutum
  Clone ID: uC-gsflmaxxa097a11b1
cttgtttaaaatataagaaaaaaaatcatacggggtgagcacaactggtcagggtattcgttgcaaagctgcggtggcatgggaggcggggaagccactatcgatagaagaagtggaagtggcaccaccccaaaagcatgaagtccgtattaagattctcttcactgctttatgtcacactgatgtatactactgggagtgtaagggttacactcctctgtttcctcgtatacttggtcatgaagcctcagggatcgtggagagtgtgggtgagggtgtgaatgatttgaaacctggagatcatgtgctccctatcttcaccggagaatgcaaagaatgtcgccactgtctgtcagaagaaagcaataacatgtgcgaactgcttaggatcaactgcgaccgaagtgttatgcttgctgatgggaaaa

SEQ ID NO: 11653 - DNA, 441 bp, Gossypium hirsutum
  Clone ID: uC-gsflmaxxa097b01b1
gttccttcagttgctactttggcttttgatcggggggctgaaagtggaagtgaccgtggtgttctttcttcaagcagcctctatggatatggaaccctgccaatgggggaaaacggctatgggtccatgccctcatattcatcgaagctctatggaggcttgcctgcatcttcaactcttgaaatattgatcccttcaaatgcagtcggtaaagtgatgggcaaaggagggctcaatttagccaacataagaaagtgatccggggcaatgattgaaatttctgaatccaaatcctctcgaggggaacgtgtggctcttataactggcactccacagcagaagcgtgaagctgaaaacttgattcaagcatttataatggctacttgaatcttaaagatcttggtagttgaaggtgaatagtttagaatcttggaattttct

SEQ ID NO: 11654 - DNA, 449 bp, Gossypium hirsutum
  Clone ID: uC-gsflmaxxa097b02b1
cccattcttacgcttttggtcaagcaagtttggagcatcaacaaaataatgggggctttactgccaggatgggattctcctacatctgatccttcatcagctatacttaaaagaaatcggtcacttactaaagaagagattgaagctttctggagatcaaaaaggaaaacagaggaagagcatcttactgctatatatggttcaccagatagttgcaatcagcagtatggaagggaatatatgagatcaagctccatgcctataccaaatagaaaccagggtttcatagacatggacacagaaaaaagcctggaaaatatcgtaaagcaaagtgggtggtggacaaggagcacttgggcattcttgaatgaaccttccattcttgaccgacctacaaacaattaccaaccacaggttccatgttggccggctctgcttcttcaaagttt

SEQ ID NO: 11655 - DNA, 482 bp, Gossypium hirsutum
  Clone ID: uC-gsflmaxxa097b05b1
ctcacgcgtccgcggacgcgtgggttctaactggctgtgcgctgctctgattctattcaggaaaacttttatcatatgggaactaatagaaagagaaggataaaagcgttagaaccacattcagaaattaatgtgcacgaaggttgtaagggagtcgataaatctagaaagacaagcgttgagcagcagcttcagggagcaacaggaaaaacagaaaaggatgagcattcatcacctagtggttcaggtgaagcatcatcttcaaggtctaaaactacaaaaaccagaattgtggaaggaattacaatatctgcacttgacttgaatacagaagaaagactttatccttccactaagattaagttgcagctctttccgatagatgaaagcactcgtctaggtttagaaaaggatggctttcatccttatttggaactgactttaagtgctagaaagaagatattctctgtacttaagcacct

SEQ ID NO: 11656 - DNA, 517 bp, Gossypium hirsutum
  Clone ID: uC-gsflmaxxa097b06b1
gttattttaaggaaaaatggcagaagaattgacgttggatttgtaagagcttaggcggcttcaaagcatcgcaaagagaccacgcactctatctcttatttcctctgagattcgcaacttggagaagaccttgaaagagaatgaaaatggggcttctcctgttactgctccacaaattccaactcccatttcaacctcagttaagactccagttaaccctgcactgagttatgttacacttgcctccttcagctgggatcaagataacgataaagtcaagatatatgtctctctggaaggagttgaacaggaaaaaattcagacagagttcaagccaatgtcattcgatgttaaattccatgacgttcaaggcaaaaactacagatgtgctgttccaaaattgaacaaggaaattgaaccagagaagtgcaaggtgatggttaagccaacaagagtcatcatcacattgttcacagcttctaaagggaattggactgacctgcactacaaagaggac

SEQ ID NO: 11657 - DNA, 468 bp, Gossypium hirsutum
  Clone ID: uC-gsflmaxxa097b07b1
tttaaatgctgcgagatatgtgatgaggtggcgggctattaaaatccttcaagttagcctttcggatttcaggttcatctcttctttatcacttttattaatttttattattatttaagctattaaaatgcaattagtgtatgccaaatgcaagaactaaatctacttattgtttccatgttcctattcttgtttgcagcaaatatgccatagagatttgaaattagaaaatacctttttagatggaagccctgcacctcgtttgaaaatttgtgatttcggttattgcttgggaataattatatatagtccatcttaaatgtcagttgctttatgattttccaatcattaagttttttttttaacacttggtgtagtcatctctgttgcattcaagacccaaatcaacagttggaactccagcatatatagcactagaagtttctgcgcggctagagtatgatggaa

SEQ ID NO: 11658 - DNA, 498 bp, Gossypium hirsutum
  Clone ID: uC-gsflmaxxa097b08b1
ttcttacgctcgattacctcacgaaaagagagggtgaccaagtgttacccaactgtgagcgaggaataccagaagtcagttgaaaaggctaagaggaagctcagaggtctcatcgctgagaagaactgtgctccactcatgctccgtctagcgtggcactcagctggaacttttgatgttaagaccaagacaggaggtccattcggaaccatgaagcatcctgctgagctcgcacatgctgctaacaacggccttgatatcgccgtcagacttctcgagccgatcaaggagcagttccctaacctcacctacgctgacttctatcagctcgctggtgtcgtcgccgttgagattactggtggacctgaaattcccttccatcccggaagagaggacaagcctcacccaccacctgagggccgtcttcctgatgctaccaagggttctgatcacttgaggcaggtgtttagtgctcaatgggtctcagtgaccaggaca

SEQ ID NO: 11659 - DNA, 483 bp, Gossypium hirsutum
  Clone ID: uC-gsflmaxxa097b09b1
ctcacgcgtccgcggacgcgtgggttttgggcggaatatggcggaaagagcaccgatcgaatccgtacaatgcttcggccgcaagaagacggcggtggcggttacccactgcaagcgaggccgtgggcttatcaagattaacggttgtcctatcgagcttgttgagcccgaaatcctccgtttcaaggccgtcgagccaattcttctcctcggccgccagcgttttgccggcgtcgacatgaggatccgtgttaaaggcggaggccacacttctcagatctacgccatccgtcaaagcattgctaaggccctcgtcgctttctaccagaagtacgtcgatgagcaaagcaagaaggagattaaggatatcttagtcgggtacgataggactttgctggtggctgatccgaggcggtgcgagcccaagaattcggtggaagaggtgctagggcaaggttccagagagttattcgtgataagatt

SEQ ID NO: 11660 - DNA, 489 bp, Gossypium hirsutum
  Clone ID: uC-gsflmaxxa097b10b1
ttggttgtattgacttggaggtcgttattaaggatgtcaagggagtggaaatactactggcttcgccttatcctttatatgatccttacactgtgcattggaacagtattttcaggcttggggcattctttgtcttcagttgtgaaaagagtcgctgcaatttttgtatttgtgtcatttacttcacttttaagcatcgcgggagtacctgcactactcaaagaagtcaagatttatgcgagcgaggagtcaaaccagcattcaggagctttagtctttttgttcggccaacttctgtccagcatcccattcctgttcctcatctccatatcatcgagtctcgtcttctatttcttaataggattgcgagatggattcagcttgctgatgtacttcgtgctgaatttctttatgtgcctctttgttaatgaaggattgctgctggcagttacttctttctggcaaaatattctctggagtatcttaaca

SEQ ID NO: 11661 - DNA, 443 bp, Gossypium hirsutum
  Clone ID: uC-gsflmaxxa097b12b1
tcgtttattgttatggagttgtgtgagggtggaggggtgctttacaagatattgggggaaaaggacagccgctatagtgaaaaagatgcagcatttgttgtacggcagatgctcaaagttgctgccgaatgtcatttacatggcttggttcatcgtgacatgaaacctgagaatttcctatttaagtcaaccaaagaggactcacctctgaaggctacagattttggtttgtcagactttatcagacctgggaagaggtttcaagatattgttggcagtgcctactatgttgctcctgaagtattgaaaagaaagtcagggccggaatcagatgtatggaatattggtgtaattacctacattttgctttgggggaagcggcctttttgggataagaccgaggacggtatatttagggaggttttgaagaacaagcctgattt

SEQ ID NO: 11662 - DNA, 329 bp, Gossypium hirsutum
  Clone ID: uC-gsflmaxxa097c01b1
cccactcgtccgtaagctattgcataatatcgggggggccgtaaacagcctcactgtgagagttgtttagaaaaaaaatgaagtggtaagagatatggcaaaattcccagtgatcaacttggagaaactgtatggggagagagcagcaaccatggatctaatcaaagatgcctgtgagaattggggcttctttgcggtgttgaaccatgggattccctatgaatttatggacagcgtgtaaagcttgacgagggagcattacaagaaatgcatggcgcaaaggtttcaggaactggtggcaagcaaggccctatggggtctacaagctg

SEQ ID NO: 11663 - DNA, 316 bp, Gossypium hirsutum
  Clone ID: uC-gsflmaxxa097c03b1
ttttatatgaagccacacgggacaggtattccggggggctttttaaaatcgatggggggtatcaaccctcacagagtatgatgctctaacaacactatggggcatctcctttccgctgctttactgtgattctcatggatccagagagggtgggttggacatgattacggacctttccaagatatgtcaagcacaaaattcaacaggggtgctcagatccttactgggaattgcctctcatagatcattattgattggtggcaaagggaccacaatgctcaccacattgatcgttacaagctagaaatcgatccag

SEQ ID NO: 11664 - DNA, 500 bp, Gossypium hirsutum
  Clone ID: uC-gsflmaxxa097c08b1
tcggttctcgatcagctccctaatgaaatgcatggggggagaattagagatgagaaaactactggccattatgataaggatgttggatctaatgttattaatggaaatggaacagaagcaggtcaaataattacaactgttgttggtggtcgaggcgggcatccaaaacagacaatctcgtatatggctgagcgtgtggttgggactggttcatttggtgtcgtctttcaggctaaatgcatggagagaggtgaacctgttgctataaagaaggttctgcaggataaaagatacaagaatagggagctgcagattatgcatctacttgatcatcctaatacagtccaattgaagcactatttcttttcaaccaccgaaaagaatgagctctatcttaaccttgttctggaatttgtacctgaaacagttttccgagtttcataacactattgtagaatgaatcgccatatgccctttttttatgtacagctgtatacata

SEQ ID NO: 11665 - DNA, 455 bp, Gossypium hirsutum
  Clone ID: uC-gsflmaxxa097c09b1
cttggatcctgttggtctcttctgtactgggggtcttcttgcctgcggtctttactggttcgtctgccttttagggccggccgagcaaaagggcaagcgagccgtcgatctctccggcggctccatctctgccgagaaagttcaggacaactacaaacagtattggtctttcttccgccaaccaaaggagatcgaaaccgccgaaaaggttccagatttcgtcgatactttttacaacttagtcaccgatatttacgaatggggttggggtcagtccttccacttttctccttccattcgagggaaatctcaccgggacgctacgcgcctccacgaagagatggccgttgatctgatcgaagtcaagcccggagatcgagtcctggacgtcgggtgcggcgtcggggggcccatgcgtgctatcgcggctcattcgcgagccaatgtcgtgggca

SEQ ID NO: 11666 - DNA, 405 bp, Gossypium hirsutum
  Clone ID: uC-gsflmaxxa097c11b1
tcttttagccttgaaagctttgcctggtaatggggggcttttttatacttatttgggggaacaactcgagattgttcgcaggttacctgatgctcaccctcaatatgaaaccctcaacaatacttttgtgagggcgcttgttacaatgcacaatatgcctaggattaggatcatggactcgtcgacgttaactgaacatactttgattactaatacacgtaagacgttcgatagagcactttgagcgtcgcctgtgactcaacatgatcggatttgggaaccttatttggttcttgtgagttaaaggggtatccctactgagacatcactgatggtttataggagatatttgaagtatgatcctaggcatattgaagacatcattgaggtgttggtgaattcaaa

SEQ ID NO: 11667 - DNA, 338 bp, Gossypium hirsutum
  Clone ID: uC-gsflmaxxa097d04b1
tttcccacgaaaaattatgaaaaaaaccgggggggacttataaaacacagggggatttaatggaaatgggtcctgtcttctttgcacactacggaggttctggaccaccctactccactgggtcattcaatggcttaaaacagggacaaaaaatctatctggaggatacaccttctctccccacctgtgatgggacaacctaagcacatacagtggagatagatccagactcccactgctcaagcgggtgctccttaaaacaccatgtgtccctctcctgaagacccttctccaaccaaaagtctattggacacacttgatgtgaaaaatcttaatgc

SEQ ID NO: 11668 - DNA, 364 bp, Gossypium hirsutum
  Clone ID: uC-gsflmaxxa097d05b1
ttattttggtgacaagcgtgatctcattgatgggggcgatatttaactttctcgtcgtggtgacagcttttatacagatgtgctcgatccttttgctcacaacaaggagcctgagccaagatcctgaacatgaaggatcacatgatggagagcccatgtctctccgcttgccaaggcatgggaggtggacttctccgaatctgggactctcaggaaactgatgactccatgaactttacgattgatatgccatggcttggaaaagaggaagacaaagtgtctgtggaacataacactctggtgatcaaaggctaggactaaaaattcaaataggaagaaaatggttacaggaacactcactgga

SEQ ID NO: 11669 - DNA, 308 bp, Gossypium hirsutum
  Clone ID: uC-gsflmaxxa097d07b1
aaaacggccctgcaaagatctccttttggcattaggtactgcatgtggtctgaagagcgatgaaagcctatgcttgcgaggtgatgaacacaagattatcgacattcggagatgcctttggagccattggcttcgataaaggatgatgagcaaattgtggcattccggtttcaaaagaaagagatagggaaaactaggctagtaatctttcatcgatggcaggaaaaggcatagccttttggaactccactggatacttatttggtggcggactcaatcaagtggagctgatattgtagccgctgttt

SEQ ID NO: 11670 - DNA, 364 bp, Gossypium hirsutum
  Clone ID: uC-gsflmaxxa097d10b1
tcgttctcgcgtccggttttgaaggtgacaggggggggcacattacacagcggggcggtttcttgaccttgttcttcttctagttggttccaatggaaaagctggaacacctcaaatctgccgtcgctgctctttctgaaatcagtgaaagtgagaaaaacggattcatcaaccttgtctaccgctatctcagtggagaagctcagcacatagagtggagtaagatccagactccaactgatgaagtgggtggtccttatgacaccttgtctccctctcctgatgatcctgctgaaaccaagaagctcttggacaaacttgttgtcttaaagcttaatggaggtcttggaaccactatgggatg

SEQ ID NO: 11671 - DNA, 415 bp, Gossypium hirsutum
  Clone ID: uC-gsflmaxxa097d12b1
tcgttttaaggaaaaacaaaagcctcttccttgggggactgtttaaacggctagggggtaccgcatctcaaccatgatcatcccagaaaagaaccgccgcgagatctccaagtacctcttccaagagggcgtttgctatgcgaagaaagactataatttggcgaagcaccctgaaattgatgttccaaatcttcaagtaataaagctgatgcaaagcttcaagtcaaaggaatacgtgcgtgaaacttttgcttggatgcattactattggtaccttacaaatgaaggccattggtttttttaaggactacctggacctttcttctgagattgttcctgctactttgaagaaacaagctaaacctgctgggccgcccatgggcccttccggagaccgtccacgcggcccaccacg

SEQ ID NO: 11672 - DNA, 369 bp, Gossypium hirsutum
  Clone ID: uC-gsflmaxxa097e01b1
aaaaatccaaattcatcgcatcgggggggtttttatacgaaattgggtaattaaaaaaaataaaattttgatggaaaagggaaaatctgctcgacaagccgtagaaatctcgttgaagaagctcaatctgaacgctgatcgaaactttaaatcctctcgtttgatatcttctcttcactcatcaaagttacgcattgagaagacgaaacctcctagtttagtgagcttgtgccttggagttattggtcggcatctggaggaaattatcgaggatttaagtgaaattgctgttaattttcccgcggatattaagataccattggcagcaatagcaaggagaagaaaattactgaatgatgatgtcattat

SEQ ID NO: 11673 - DNA, 365 bp, Gossypium hirsutum
  Clone ID: uC-gsflmaxxa097e03b1
cggcgggacccggcccgaatttccgggttgtcccaagccgttttttctcccgtccgggaagactaatttttggggggtttatttaaaggcaaaggctaaacaatggggcgctaattttttggtttgaaggcatggaccaatgccgtaaatggcggaggggacgtttggaacaacgagcacaggttcaagatcgtgaggtatctcggtgaaggtgggttcgcctacgtacacctggagaaggaagtcgtatccgattcctcttcagctttggccagtggcttagccaaaaaagtcaaggacccttcacatctttctgatgatagaacttatgcaattcagaaagttctcattcagaataactgagc

SEQ ID NO: 11674 - DNA, 431 bp, Gossypium hirsutum
  Clone ID: uC-gsflmaxxa097e04b1
ttcactcgtccgcccacgcgtccgttcaactgggtggtacaatatatgaagtgggtgattgggtgaagtttcgaagaagtgtcactacacctacttatgggtggcgagatgcaacccataaaagtgttggctttgtgcaaaatgtggtggacagagacaatcttatcgtgtcattttgttctggagaggctcatgtattggtaaatgaagttgtaaaagtgattcctcttgatagagggcagcacgttaagcttagagaagacgtcaaagagccaaggtttggctggcgtggtcaatcacgtgacagtattggaaccgtcttatgtgttgatgatgatgggattttgcgtgttggctttcctggagcttctaaaggatggaaagctgatcctgcagaaatggaaagagttgaagaattccaggttggggat

SEQ ID NO: 11675 - DNA, 436 bp, Gossypium hirsutum
  Clone ID: uC-gsflmaxxa097e05b1
cccactcgtccgcaaaaaacacaagttttcaggggcgaaaaaaaaaaaaaaactctttgttgggtgttttttttctttgggtttagatttgttcttctacttgcatgaaagagagtttttgtagaatgtcttctggatggtaaattcgggcccaaattggacatgagaatgcttgtgggaacatgcttgagccaagagaagctgatatacctgcattgtttctagtcttggtggtgcttcctctggttacatatttcttgcttgggaaatggagtgaggtttcaaagaaacgagagaaggtaagtttacttgctcatcttgccgctgaagaagctcttagagcagaaacaatggctgctgccagtgttattccagttgtttctgtttcgaagaagggattgcatgtgtgcgctaggtgctttggtccatctacaac

SEQ ID NO: 11676 - DNA, 497 bp, Gossypium hirsutum
  Clone ID: uC-gsflmaxxa097e09b1
tcttttacgcgtccgtgaagatctattttttggggggttttttgaaggcaaaagctaaacaatggggtgctcattttctggtttgaatgcattgtacgatgccgttaatggcggaggggacgtttggatcaacgagaacaggttcaagatcgtgaggcagctcggtgaaggtgggttcgcctacgtttacctggtgaaggaagtcgtatccgattcctcttcagctttggccagtggcttagccaaaaaagtcaaggacccttcacatctttctgatgatagaacttatgcaattaagaaagttcttattcagaataatgagcagttggatttggttcgagaggagaaccgtgtttcatccttgtttagtcatcctaacctgcttccgcttcttgatcactttatcatttctgttaagcctacacaagaaggatcatggaatcatgaagcgtatttactatttcctgttaatttggatggaaccgtacttggacaat

SEQ ID NO: 11677 - DNA, 346 bp, Gossypium hirsutum
  Clone ID: uC-gsflmaxxa097e11b1
ttgattaaaactaaaagaaatcctctgaaagggggggagtcatatgagctccggcccttggacggattgctccggtcatcgggcctacgtgcccaccctcacacgccgacaccgactccgccatacatgacggtgactcgcgaagatttcggtggctgggcttgctgtcatggattcgaatctctgcagatacccatatgaccatgaaagagtctcttttgcggagatctcggcgtcaacggaggtaccaaggtcggagatgaggtctgagatcaccgtgctggacggtcgtgagagggacaagctactacacaacgcattgatggtgcgttagtgagcattgatg

SEQ ID NO: 11678 - DNA, 350 bp, Gossypium hirsutum
  Clone ID: uC-gsflmaxxa097f02b1
tttactcgtgggctgtggtgagcttgcaaaagagggggatattgatggatttctgtggtggtgcttctttgaagggccctgagtttgctacaattgtcaactctgtaacaaccaaaaaggttgctgcttaaatatatataaggtggattcaggtaaatgaataaaaggacgaagagaagctgtttcaggttgaagcttcatggtgattatgagttacagtgttatccaatggggttttgattgcttattgagttccttttccccaaaataacaggaaaaaatatgttcgttctcgtgctataggtcaatttctttaaactgctgtgggaaatatagctaattcactgacc

SEQ ID NO: 11679 - DNA, 503 bp, Gossypium hirsutum
  Clone ID: uC-gsflmaxxa097f03b1
atcagtttgggatccgttccaagaagtcctgcgcgggggtagcagcttggttgcggctgcttcgcccgaatcacggttcgagcttacgaagctagactggaaggaaaccccggaagctcacgtgttcaaagcggaccttccagggctgaagaagaacgaggtgaaggtggaagtagaggaggggcgagttctctgcattcgcggggagaagagcgtggagaaagaagtgagcggcgggacgtggcatcgcgttgaacgcagcagcggtgcgttcgtaaggcgtttcaggttgcctgaggatgccaagcttgataagctgacggcgtgtttggagcggggggtgctcaccgtcacagttcctaagaaagagctcaaacacccccctaaaagaaccattcagatccatgtccagtaatctcgtgttttccttttgctaacaatgacagcagggaatgagaccaggtctttatgaatcatatatatatataatcttatgagtgctt

SEQ ID NO: 11680 - DNA, 474 bp, Gossypium hirsutum
  Clone ID: uC-gsflmaxxa097f04b1
agttcagcttagcatattagcaaataattgaaggggggtggctacagagaccaaaaccaatttagttaaggtgaagaacagtggtcaagatggttcttcaaagccaaaatttgatgctgttatcaacagaaagaagatcgaaacttcaagcaaacagcctgttgattccaaacaaaaatctgtaataacaaaagcagaggtaaaatcgaaaacaaattcaagctcatcaaaaaccactgctactacaaaaactaaagttagggagaaaaaagtttatactttgcctggtcagaaacatgatcctccagaagagagagaaccattacgaatattttatgaatctttgtcaaaacaaataccaacaagtgaaatggcagaattttggatgatggaacatggcttgttgtcccctgagagagctagaaaagcgtatgaaaagaagcagagaaggcagaagcaaattcgggccggcac

SEQ ID NO: 11681 - DNA, 444 bp, Gossypium hirsutum
  Clone ID: uC-gsflmaxxa097f06b1
aataataaaaaaagagtagaaaataatttttgggcggtggtttgggaaaccgaagggggaggaaaacatagagagtgtgtctgcgcgcggggggcaatgactctggaggaatttttgaagcagtgcgagcagtcaggtgatggtgctttcgctgccctcaaatcgcttctggagaagcttgaggatcccaagacccgcactgaagcccgggtcttcctttcggatcttcaatcccgggtcggttcctcagatgattgcttccacaaataccatttccggatacaggacatttacttggatcggtctgaaggctatcagggaaggaagaaactgacaatgatggtgatccctagcatttttatgccagaagactggtcgtttaccttttatgaaggactcaatagacacccagattccattttcaaggaaatgacagttgctgag

SEQ ID NO: 11682 - DNA, 434 bp, Gossypium hirsutum
  Clone ID: uC-gsflmaxxa097f07b1
attaaacatcccagaagaaatccctggaggtgcgcttctctccttgtctgactatccatgtctgctttccttctcctttcccttctttccctctcccatttcttcatcttctcttcttccagtcatcacccacctcataactcccctgtttacgcctctgagtcctctcaaatccgccttgcttgcaaatccactcgcttcccacaaccctgcgaatcctccctttcgcgatcctctcttctccctcctaaatcgacctccctccaattcatccaatccgccatttccgtctcttccgataacctcaaaaccgggcaatccatggtgaaatccatcctcgactcctccaaaggcaaccttaacccgttcaacgccgccgacatctgtctcaacatcctttctaattctgattaccgcataagatcgaccaatga

SEQ ID NO: 11683 - DNA, 493 bp, Gossypium hirsutum
  Clone ID: uC-gsflmaxxa097f08b1
cctcacgcgtccgtctaaccctagccctgtgtggggattcaaacatgaaaggaggtaaatccaagtcggatgccaagagcgccaagctctccgtgaataagaaatcaatcacgaaagctggaaagaaatcggggaaggcagctaaggatccaaacaagccaaagaggcctgctagcgccttcttcgttttcatggaggagttccgcgagcaatacaagaaggagcaccctaaaaacaagtccgttgctgctgttggcaaagctggtggagataaatggaagagcctttctgaagctgaaaagcgaccttatgttgataaggcagagaaacgaaaggtcgagtatgaaaagaacatgaaagcctacaataagagacaggctgagggtccccaagaagatgaggaggaatctgagaagtctgtatctgaggtgaatgatgaagaagaagatgatgatgaaagcagtggaaaccaggaagatgatgagtaggaaaa

SEQ ID NO: 11684 - DNA, 455 bp, Gossypium hirsutum
  Clone ID: uC-gsflmaxxa097f09b1
ttcacgcgtccgggcgaagtcaggttacgggacaaaccatggatgaaaagctgggtaggatggtaactcgtgtagtgcttccacgtgttgtcatgcattcacgacatcactatggggcattctcagaaaattgtactggctcagagctagaagatgggggaggacgtggcacatcatgatctcattgggaaaaaaggcttttgatgaatgagataatgacaggatcacgggatacaagatcagttgtttcaaaaatgacactggcgatgttggaggatagtggatggtatcaagctaactatagcatggcggatcgcatcgattggggacggcaccaaggaacggatatcggtacttctacttgcaatctctggaagggagcatatcattgctatacaaccaaattatctggctgtacatatcaccgggaagctgaaggttactgccctattgaa

SEQ ID NO: 11685 - DNA, 510 bp, Gossypium hirsutum
  Clone ID: uC-gsflmaxxa097f10b1
cccacgcgtccgcccacgcgtccgagagagacggggtgaggatgttgttttgccggggattttctaggatttgtacaactcccagaaagagcttgtttggtttcgttctctctcgtcgagctgacccttctctattccttctttctaatcaatatgtttactctactataaaggttcgtagtggcagagaaactctttcttggagttttccttcattgcttggtcttggacggcaaattcatcagagtagctctctaatagaggttatcctttaattgctcatccttctacaatttgcgaggttttttttgttcatttaccgaatttctttcatatagttttaggacaggagacatggttatccagggataggatgttttctagtgtgttaaattttctaatgttcaaatatgaaacaaatgctactattttggccttaagttgattacttccctttctgttgtgtttgctattgttaattgctggctactagtttgtttatctcctctc

SEQ ID NO: 11686 - DNA, 467 bp, Gossypium hirsutum
  Clone ID: uC-gsflmaxxa097f11b1
ctcacgcgtccgcccacgcgtccgagaagggggtccagttgaaattttctggcggcaaaactgaaaatgtcttgctgttcaggaaaatgtggctgcggcgctgattgcaagtgtggcagtggctgtaacggatgcagtatgttccctgacataatagagaagactacaactgagactattgttcttggtgtggcaactcagaaaatgcactttgagggatctgagatgggagttggggttgagggtggatgcccgtgtggagacaactgcaaatgcaacccttgcacttgcgggaagtgaacaacaaagaggagcagagtggcctttggcattttaactaaataaattctattactttagtatggatcaacaaatctttattagggtttggttcttaattatgtggaatgtggcttttttggtatgcaaaatggattatgatatttaagaaaggttggtttctattg

SEQ ID NO: 11687 - DNA, 306 bp, Gossypium hirsutum
  Clone ID: uC-gsflmaxxa097f12b1
ctcacgcgtccggtgaaattaagaggtgggcgggagttttctagaagaaacttagcaagtttgggtaaaaattctagtattagtactgggaatagtgttaatgatgatgaaatggaagattgggaattggagtttgttggagagattgatccatttagttatcaagcacccaagaagcggaaaaaacaagagaaatctagggttcttaatgatgaagaagggatggattggtgtttaaaggctagaaaaatggcactcaaatctattgaatctaggggattggcgcataaagttgaggatttgatt

SEQ ID NO: 11688 - DNA, 280 bp, Gossypium hirsutum
  Clone ID: uC-gsflmaxxa097g01b1
cccactcgtccgggcttatcttcaaccattgagggtggatattaaggctgctctggcaatattctggcttattccccacccccttgtctctttagataatggtaatgataaggctacttatgtcactactcactatactataaaacactggaaaaattgcaacgaaaagctcagattgaatgaggagataatcaacaaatgctatactactggatttcgttataagcttctgctgcaataagctaacgagactgcacatgtgaagccacctcatgaatat

SEQ ID NO: 11689 - DNA, 510 bp, Gossypium hirsutum
  Clone ID: uC-gsflmaxxa097g04b1
cccattcgtccgtttcagttttggcgggaggatgggggagagtgaactctgcgaagaatccatggcgggcgattcagagatgaacccagagcaggtagaagaagagttcagcgtatggaagaagaacacccctttcctctatgatctcgtcatttctcaccctctcgaatggccttctttgactgtccattgggttccttcttctcccactccttacggatctgaccctacttttaacgttcacaaactcgtcctcggaactcacaccagcggcggcgcccccgattttctaatgatagccgacggagttctccccactctcgcctctgaatccaatatcgctgctaaaaatgatgacccagttatccctaaggttgagataacacagaaaatgcgtgttgatggggaagtcaacagggctagatgtatgcctcaaaacccggttattatcggcgcaaagaccagtggctccgacgtttttcgtgttgattatgccaagcaggctgcagc

SEQ ID NO: 11690 - DNA, 414 bp, Gossypium hirsutum
  Clone ID: uC-gsflmaxxa097g06b1
gcgcttactcgtccggtcttgcattattcctattagggggattgcaataaacattggggggggtttcaactttgcagctatgtatggcattgctgttgctgcccttggaatgctgagcaccatagctactggattggctattgatgcttatggtcccatcagtgataatgctcgaggcattgctgagatggctggcatgagccacagaattcgagagagaactgatgctcttgatgctgcaagaaacaccactgctgctattggaaagggtttcgccattggttcagcagcccttgtgtcccttgccctctttagcgcctatgtgagccgcgctgatatctcaacaggtggatgtttgacccctaaagattgtattgggttgcttgatcgggcaaagctccttactggggctct

SEQ ID NO: 11691 - DNA, 317 bp, Gossypium hirsutum
  unsure (1)..(317): unsure at all n locations
  Clone ID: uC-gsflmaxxa097g07b1
ctttctctctcactgattcctcaacttctgctgactcaagttgctgcaacggtggattcttaacttgttcaagaccgcattgtctcttcgtttttaagcacacttattctttttcatttttttcctgattttatttgtaccgctgaatctgggtttcactctgactactacntgctgttcttttccttttctttaaacccatcacattccattccttactaactttttccatcttctaagaatctctgctagtattgtattctcttcgaagtactacagtgcaaagatatgttcttgaataagcttacaccaacgac

SEQ ID NO: 11692 - DNA, 334 bp, Gossypium hirsutum
  Clone ID: uC-gsflmaxxa097g08b1
tcgcataaaaggaaagatttgaaccaagggatgatggcacaaactgtggatggtggtgtggatatcttaacatcatacattcttgaagagaagtcatgtgatgataaattcttgagagataccattttgaatatgacgcttgcagggagggacaccaccagctctgctcttacttggttcatttggcttgtttcgaggcatccgatagtggaaaacaagatcattgaagagctccaatcgataatacctgcagaggaaaccaaaaagaggcgactgctcaatgctaaggaggtaaagaatctggtttatctacaaggagcattatgtgaggctt

SEQ ID NO: 11693 - DNA, 502 bp, Gossypium hirsutum
  Clone ID: uC-gsflmaxxa097g11b1
ctttgattcgtctgcatccagctcctccaggggggttccatagaccgcggtgcggaagccgaaactccatcaaccccaaacccagatctttggcttcttcgcctttccactgccagggtataggctgcatcattaacagaacgaggaataaaaagctgtttgataactgtcaaagaatccccttctacgaccaggcaccggaaacccatcattcgcgcgaacagtaataacctttcacatgcccttgcttcagcaatgaacgcatcagcaacatcctctatcagataagtttcggctcctctaatttcacctctaaaatctctggctaaaactgctattgtagaagttctagaatctctttgaaaggtagcatcaaaattaatcttgatgaaacccaaaactggaggcctccaatacccttttatcagaaaaccatcagaaccaccgaggttctctttgcaaagatttactttctaaacataaccacgaatgaacccaagca

SEQ ID NO: 11694 - DNA, 505 bp, Gossypium hirsutum
  Clone ID: uC-gsflmaxxa097g12b1
gttacaagtcgtacgattcacgctcttccggggggtccatttaatccgatgcgggctcatccatagacctcagcacttcctcttctgggaaacctaaatcctctttctctcgagcccttgtgaaatcgaaccccttggatgtcgaccagggttgccggagcaagagcaaggccaccaccactcaccacaacttcaccagcatggttaagcgatttgtggacaatcaatccaaaaccaaggcaatgggtcatgctcagcttctcattccatctgatgtcctagccgaggacctcaagaagacggcaagaaagggagctgctttaaccgtcttgcagaggaagctgttcgggaatggatctgccggtaaggacaggggcaaaatggaggtgaaagccttgactgaggttaaagggaacactaggaccttggctatggttttgagaagtgagagggagctgttgagtgcaaataaagagctcgagatggagattgccgagctcaagct

SEQ ID NO: 11695 - DNA, 264 bp, Gossypium hirsutum
  Clone ID: uC-gsflmaxxa097h03b1
ctctctacactttcactttctctgggtgggaaccttctatctaaacaggtgattatattttttttccaaatcctttataaaatcaccagtaactctctgatttgaaaactgaggggttttttttttctgcaatttttttggaactgaaggtttactaatggttatggaggataacgaaggaaataagaagagagcccgggaagagtcagaggctaactcggtgcccaatacaaaactcgctcgagttgactcggacaataataa

SEQ ID NO: 11696 - DNA, 488 bp, Gossypium hirsutum
  unsure (1)..(488): unsure at all n locations
  Clone ID: uC-gsflmaxxa097h04b1
cctttttcttctcttccctttgctctcccgcaggggggagggaatatcttattttggggttcttggctctctatattcccaaatcttaatttttatttttcgatctctttatattcagattcagtgttttacacatcgcttctgtttctgatccgacgacggagattgagtttcttgtcaaaaagaccgaggtatgcagcagggtgatcagatggtgttaagcttaagacctggtggtggtcgagggagcagactctttggtgctccctcttcttcatcctcctcctcttcgttagcctttggttccctttcttctgatcttcccgtctttcgtccccatgctggtgctcctcccgccttttctatcaaggctggagactcacgatttgagggcccggaacgtgtgcagtacactagggaccagcttctaaagcttanggaggctgtagaagtttccgacgagattcttaaaatcaaacgagaaaatg

SEQ ID NO: 11697 - DNA, 503 bp, Gossypium hirsutum
  Clone ID: uC-gsflmaxxa097h06b1
cggagacatttgctgacttccggatggagtgctgtggtaaataagaagaagctgggctctggagatgcggtgctttttctgaggggtgaagatggagaactgaggcttggagtccgaagagctgctcaaattaaagatggctcttcttttccatcttcttgcagccagcagttgaattgcagcaattttgcagatgtggttcatgctgtttctatgaaaagtgtattcagcatttactacaatccaagggccagttcatcggacttcgtaatacccgtgcataaattctggaagtgtcttgatccctcattttctattggaatgaggttcaaaatgcaatttgaagctgaagatgcagcagaaagaagacactcaggagtaataactggaattagtgatataaatcctgttcgatggcctggttcaaaatggagatgtttgatggtaaggggggatgatattgatgccaacaggcatggtagggtttctccctgggaaattga

SEQ ID NO: 11698 - DNA, 242 bp, Gossypium hirsutum
  Clone ID: uC-gsflmaxxa097h07b1
tttctttgcaaacgactcttaaaacaacagggggggggtaaatgaatacacgggggcagacaagactgctatcatgactggtaccattcgtgctccccatggcactggctatcaagggggctacatcgcaatggctgacagatatccagatgggcctccaaatatgacttccaaaacgaaagtcgggaccccagacaggaacccacacagcggggcccaaagcggggctatatgcctggacc

SEQ ID NO: 11699 - DNA, 243 bp, Gossypium hirsutum
  unsure (1)..(243): unsure at all n locations
  Clone ID: uC-gsflmaxxa097h08b1
tcgcctacgcgtccgcttccttctctgaccagggtggggtcaccgaggtaaaggcctgagctcatattgctttcatcgattttcctctgcattttccatcactttctcgggaaaaaaaaagaaagtttcagaagaaatgtactcgggtattcggtcgttatcgttagatggatgtgtgggggattatcaagggtcgcttgatggaaccaacttgcccggtgatgcttgttnggtcctaacaac

SEQ ID NO: 11700 - DNA, 247 bp, Gossypium hirsutum
  Clone ID: uC-gsflmaxxa097h09b1
tctttttcgcgtccgccggcattgaaaagcggggcagatgttacagaaaacgggaggaggcagcgataaacgattgcctagagctttttgatgacaccctggaggagctgaaagtttcccttgctgatctcgcccctaagaaattagcagtctccaggaactaccacgacttgcagacatttctaagcgccgcgatgaccaaccagtatacgtgtcttgatgggttcgcacgtagcaaaggaaatgt

SEQ ID NO: 11701 - DNA, 477 bp, Gossypium hirsutum
  unsure (1)..(477): unsure at all n locations
  Clone ID: uC-gsflmaxxa097h10b1
atttgaacttcaaaaattagggtttcgaggcggggactttaccatagcttgccaattctatttcttcgtcatccctttggtttttaatagaaattaaatttgataatctccttactgtgtttgatttccttcaaaaatggcggaacacttagcctccatcttcggtaccgagaaggaccgtgttaattgtcccttttatttcaagattggagcttgccggcacggtgaccggtgctcacgtctccataaccggccaacgatctccccaaccatccttctttccaacatgtatcagcggccagatatgatcactcccggagtagatccccaaggacagcccatagatcctcgcaagatccaggaacatttcgaggatttctacgaggatatctacgaggaactaagcangttcggtgagatcgagagtctcaacgtttgtgataacctcgccgatcacatgattggaaacgtatatgc

SEQ ID NO: 11702 - DNA, 456 bp, Gossypium hirsutum
  Clone ID: uC-gsflmaxxa097h12b1
gtataaaatcgggcatgcctgagactgggagcggagcaaaacgacatgagggaaagcaatacgacaattcagaaggggaggaggaggaagaagaagaagaagaagaagaagaagaagtggacgagttagaggatgaagaggaagaggaagaggaaggagtgagtcgagttaatgagtcgcacggggctggaacggcgccgtcgagtgatgctgaggtgagagactcgcaattggaaaccctaacaaatgatgatcgttgtgagaggttgcaggaaaatcctacttcggaattgaaggaaggagctgaatctaaggagcaagttaagatagcccaccagaaagctttgcctagtttggctgtccagggtgcagaagctccaaaacaacatctgctccagtcatctgtttctccaacttcttcatcacaaccatcgccaacttttattacacaagata

SEQ ID NO: 11703 - DNA, 482 bp, Gossypium hirsutum
  Clone ID: uC-gsflmaxxa098a01b1
cctttttgtccgcccacgcgtccggggtttttggtggcttattaaaatctgtagtggtatattcaatcaatcaatcatgactggcaaagccaagccaaagaagcacacagccaaggaaatagcatcgaagatcgacgccgccacaaccaatataggcggcggcaaggccggattagctgaccgttcacgtgtggagaaaggtggacatgctaagtacgagtgtcctcattgcaaaataacagctccagatttgaagtcgatgcagattcatcatgatgccaagcatcccaaggttccctttgaagagtcaaagcttgtgaatctacatgctgttcatgtggttgagccttccaagcctcgtcctggtgttaggggtagccttaaaaagtgataataaaaaaacccaaaaaatgtgtttttcgtcaagctttggtgttctgtgatgtttcgaaatatggtttggtcctttttcatcttttaat

SEQ ID NO: 11704 - DNA, 509 bp, Gossypium hirsutum
  Clone ID: uC-gsflmaxxa098a02b1
cgccacgagagaaggtacacttgggggaattttaaaacccaatgggggggtccaaatggtccggttatcaatggcactcctgaatttgttcgttcttcacttgaggctagccttcaacgccttgatgtggattatattgatctttactatataatcagagttgaccacaagactcctatagaagataccatggaagaactgaataagttggtggaagagggaaaaataaagtacattggtatatctgaagctagccccgaaactataaggagggcacacgctgttcatcctcttactgcagtacaacttgagtggaccctctggactcctgatgttgaggaagaaataattcccctttgcagggaacttggaatcgggattgttccatatagtccacttggtcgtggtttctttgccggtagagcgaataaagatacctttaatacccctctgagaatgttcccatgtttagtggagaaaacttggagaaaaataggatcctatattcc

SEQ ID NO: 11705 - DNA, 527 bp, Gossypium hirsutum
  Clone ID: uC-gsflmaxxa098a03b1
gttctccgtctccttctaaatcttgatcgatcgggggcaatgggaaaaaaatagggcttttttcttacaaaagttgggggttcgaagagcataaaacgataatatgccttcgttacctctcagatcgattttgctcccattaatcccttccttaactccttttcatgctggtttaagttcccatcgtttgaagcatcttgaaaagagtgatcggcgtggtaatcttagttaacgttttcccctcaaaatcattagctctcttttgactcctttactttctctccttttttcctctctgttttctgtcttcccctagagtcgtccgtttcttttgaggctattaccgtgcgacacgaaggaatctagtttgctcagaaagaaaaaaaaacctggagatttggttcgatcttgagctggagttgcttttttcagaggttttaagatcttgtattgatttcacttaccgcagctttcttaagaaagttgaagctaggatttcttgtattccttggtagtggaaatggaca

SEQ ID NO: 11706 - DNA, 517 bp, Gossypium hirsutum
  Clone ID: uC-gsflmaxxa098a04b1
ggctacattgcagtgcacttgtcactttcccctgtagcctgcgagcaacctgctgggggtctcttcctcttcgttatacttcaacttatacacatttacttgcatatcttaacaaatccctttgcagcatttttacacagattccatctgggtctttctcattcaatggagaatccacactcacccatttctatcccagaggcttctcctaagccttacaagaaaagctttgttactactctaatggaagccgctagtcttcgctctccttttaaggaagatacctattttacctcccatttgaaagcttcagagaagaaggcgttgcaagagctcaaggacaagctcatggcttcttatggcccggacggtgaatgcaccatgtgggggattcctttacttgctgaagacgaaaaagctgatgtcgttttgttgaagttcttgcgagctagggacttcagggtgttggattccttccgcatgttgcaaaaatgtcttgcttgggagaaagagttta

SEQ ID NO: 11707 - DNA, 540 bp, Gossypium hirsutum
  unsure (1)..(540): unsure at all n locations
  Clone ID: uC-gsflmaxxa098a05b1
cgatttgagggtccttagctttctcctttaaatgggggaaaaaattcacacataggggtgtttttaaaaaaattaaactttgaacaaatttcaaagattttgattttcttctgcaatttctcatccaccaattgaatcaggttgtgaagtattgagggtgtttattatttgttgtttttttataattactgatgtctccgccgctgcttggcgtggaggaggaaggggttcagagcaatgttactttactcggttcttcaggctcaatggaaagtgtgtgccagaatagtgctgaattgaaggaacggaactacatgggcttgtctgattgttcttcagtggatagctctgttttttcccctccctccgaggaaagaaaggctagtttgaatctaaaggcgactgagcttaggctcggacttcctggattgcagtcgcctgaaagaaatccagagctttgcttgntaagttcttctcagcttgatgagaaagccgttttccctttgcatccttcaagtgatggtcactgctttgcatcac

SEQ ID NO: 11708 - DNA, 523 bp, Gossypium hirsutum
  Clone ID: uC-gsflmaxxa098a07b1
ttttcgcgtgggcggacgcgtggggttttggggggctgtatttagcacacatgagttggaagcagttgaaggttgggagcagattgcctccactgcttttgaacattttgaacaggagggcaatagagtaatctcaattgaagaattggcacgggagttgaatgttggcccttcagcgtattcattcctcaaagactggatcagggtctcggatggaaagctaagcttgcttggatataccaaatttttacatggtgtggcgcttcgcagctcaaatacaagacatcattaatctatagccgttgatatataatcttaaaattcatggcatttagaatgacttgtgataattttttttttcaaaaattatttttggtttagggggaaaaaatgtgcataagtgaatattgttagtgagattgtggaggaaaagttacagtgagaggattgattttgctcatgtcccattttttgcttatcgtgcatgtatgaatgtgggtgtcgggcttccagattttgagct

SEQ ID NO: 11709 - DNA, 517 bp, Gossypium hirsutum
  Clone ID: uC-gsflmaxxa098a08b1
tgtgtacgcgtgggcggacgcgtgggttttaaacgggtgctgcaatttatttatatagaactataaaacaaaaacagtttgaaaattgaagttgtctgattttgtttctgtacccaaatcgatccataatctcagtatattaaactactaagagcaaagatgtatgaacatttacttcggtacattaatcattcaccttctataagtcggtaaaataatcacggaaaattggcactaaaactgtacttagttgagtggaaaaatggagagataagaggagagagcggaaagtgggaggaaaacaaatttagattgtgctttgttaagaacaaagcgaggggaaagaaaataggacggtctgctagtttaaaattatgtattttttaattttttttttcatttttcatatttctagttttctacccattttacagtaaagtttaaatgtgtgcttgattgggttgaagtagacatgtccattggccgggccgcgtccaaaaaattttcggtccgactc

SEQ ID NO: 11710 - DNA, 526 bp, Gossypium hirsutum
  Clone ID: uC-gsflmaxxa098a09b1
ttttcgcgtccgcccacgcgtccgctcaactgggtctctatgatatcgctagggggcccggagatgccgctgatgtcagccacatcaactctagatctgaggttgccggatatgtaggtgaagagcagttggggaaagctttggagggatgtgatgttgtcatcattccagccggggtgcctagaaagcccggtatgactcgtgatgatcttttcaacattaatgccggaatcgtcaagggtctatgttctgcaattgctaaatattgccccaatgcacttgtcaatatgatcagcaaccctgtcaattcaactgttcctatcgcagctgaggttttcaagaaggcagggacatatgatgaaagaaagttgtttggtgtaaccacccttgatgtggttcgggctaagactttctatgctgggaaggctaaagtaaatgttgcagatgttaatgtccctgttgttggtggtcatgctggaattaccattctcccactattttctcaagccacaccaaaagccaatta

SEQ ID NO: 11711 - DNA, 534 bp, Gossypium hirsutum
  unsure (1)..(534): unsure at all n locations
  Clone ID: uC-gsflmaxxa098a10b1
tttccgttgatcattctgctccaacacttatggggacgctaggtgtttcaaactcaattctcaagcagtatggagtagaattcgccgcagagcatatcctccctctactcacacctcttcttacggcccaacagttgaatgttcagcagtttgccaaatgcatgctctttgtcaaggatattcttagaaggatagaagaaaaccgtggggttactgtaactgattctggagtcccagatttaaaacctgctaccacttccaacgggcttcagtctcaagtcttgagcaaagcaaatggaactgtggcttctgcaaaaagcagcccagcatgggatgaagactggggtcctactaccagagcagctgccaatgccagtcacactgcccaccagcctcccaaggacaatttatcctttcactttattttggatgataagtcaattcaatcggcacccacacaatctcaatcttccttaatttccactatatctagccagcanacatccaattcttgtcctgcagttgacatagagt

SEQ ID NO: 11712 - DNA, 146 bp, Gossypium hirsutum
  Clone ID: uC-gsflmaxxa098a11b1
tttttattgttttgtattttagttctccactggggagaattttatatcaggatgggggtcttactttctttatctgactacctagtgtgattagtactccgcatcttaaattgtttaaatagcaatggatgaataatttttttctt

SEQ ID NO: 11713 - DNA, 525 bp, Gossypium hirsutum
  Clone ID: uC-gsflmaxxa098b01b1
ccttctcgtccgcccacgcgtccgcaagagaaggggccatagccaaaaaaatgggcgaattattgctgttcattgcactatttgtggttccatgtcttgttagtgctacacgcatggtgaagaacccgttggtggttcaaggtcaagtttactgtgaccattgccgtgctgggtttgaaacaccaaagactagaaacatggctggtgccaaggttaaggtggtatgttccaaccggaagaccggtgatgtcgtgtacgagaaggaaggacacacggattcaaccggacaatacaagatcgctgtctccgaggatcatttggatgagatctgcgacgctgttctcgttaagagctcgcagccggagtgcgctgaaatgtcaccgggacgtgaacgtgcacgcgtggtcttgaccaacttcaacggcatttcatccaacacccgttttgccaacgcaatggggttcatggccaacaaggttgaagctggctgtgctgaagtaatgaaggtgtacctggaggaggatg

SEQ ID NO: 11714 - DNA, 527 bp, Gossypium hirsutum
  Clone ID: uC-gsflmaxxa098b03b1
cgtaatgaaaggtcaaaagaaaaaaaaaaaaaagggtggtttccatggaagaagaggctgaatcacgcgaggaagtcaagccaaacgtcgtcgttaaagagacaaatggagatattgtcggcgataacgatgcaggaaaattgggtaccattgaaacccctgattttctttcccagaaaatattccataactgttccctaccaattctggcatctggagtaattaccacaagccctgctcaatcccaactcaccatcttctatggcggaaaagtttctgtatttgatgcaatttccgctgaaaagatacaagaaattatgcttattgctgctactgtggctgctgctgatgttggctctgttgacatgaagaatgctgcaaccgattatgccaccatttcacctgctcttacaaggtgtccttcacttcaaagtactgcaactgcctcggcttcgccacaggcacagttgtatcctctccccaggacatcttttagcaaactgcaagctgaactaccaattgcaagg

SEQ ID NO: 11715 - DNA, 534 bp, Gossypium hirsutum
  Clone ID: uC-gsflmaxxa098b05b1
cctactcgtccggaaagaacaaaaaaatatcttgaggcccggagatgtcggacgaggagcaccatttcgaatccaaggccgacgccggcgcctctaaaacctttcctcagcaggccggtactatccgcaagaacggctatatcgtcataaaaaaccgcccatgcaaggttgttgaagtttccacctccaagactgggaagcatggtcatgctaagtgtcactttgtcggaatcgacatcttcactggcaagaaactggaagatattgttccatcttcccacaactgtgatgttccacatgtcaatcgtactgattaccagttgattgacatttctgaggacggatttgtgagtttgctgactgaaagtggagacaccaaggatgatttgaggcttccaactgatgacaacttgttgaaacagataaaggaaggttctgctgaggggaaagacctagttgcgtctgtaatgtcggcaatgggtgaagaacagatctgtgctctcaaggacattggtccaaagtaggctttgagat

SEQ ID NO: 11716 - DNA, 537 bp, Gossypium hirsutum
  Clone ID: uC-gsflmaxxa098b06b1
cctactcgtccgcccacgcgtccgagaggttcatatgcaagggagaccattgaactgtgaagctggtagaaaaagccggttctatggggaagatggggagcaatgtggagtagaacagttagctctacagtattatgcaacagaaggtggatggcagggtgtccatacagagagtggtatatggatgactatcttcgggcttctcatgtgggatattttattttcagatgtaccaaatgttttccgcaccagattccagactgctccattggatatggatactgatcatttttatctggcaagaaagagccttatcgagccccaactacaaaaaatccacgatggtttggctgaagagattctcaaaacatcatgggaattgcatatgggaacagcttgtagaggagttaattgggaccaacactccctttccgaccttcgagcagctgtttcatgtatcagaggtccttgcttggcctctctatgtagacatctcgctcaggattaccgcagttggttgagtggaatgcctgattt

SEQ ID NO: 11717 - DNA, 517 bp, Gossypium hirsutum
  Clone ID: uC-gsflmaxxa098b07b1
tttcttcatagaagtcaattgaaatctagagggggccacttggatcctaacccggaactgtttcctctaaggcgtttcaagtggcttatggagttctctatggaccatgaatggtgtgctgtagtgaagaaactcttaaatattcttcttgatggaatagtcagtttaggggaacatccttcccttaaccttgctttaacagagatgggtcttcttcacagagctgttaggaaaaattgtagacctctagtggagctccttttaagatttgtccctgagaagacttcagatagattaggatttgaaaacgagacagtagctgatggtgttcataaaagctacttgtttagacctgatgtcataggtcctgctggtttgacccctcttcacattgcagcgggtaaagatggctccgaggatttgctggatgcattgactgatgatcctggaaaggctggcattgatgcttgaaaaatgctcgagacagcaccggttctacacctgaagattacgctcg

SEQ ID NO: 11718 - DNA, 513 bp, Gossypium hirsutum
  Clone ID: uC-gsflmaxxa098b08b1
ttgtcgcgtgggccagggtacacactcggggggctcaaatggcgcggtgtctaatggatctgattcgagaccgcaaaggtctctgcttcctgcttttgaatctgcagaaatgcgtgcattaggagagagtttaagtagggacatcgttcgagggaatccagatgctaagtgggaaagcatcaagggattagaggatgccaaacgcttacttaaagaggcagttgttatgcctataaaatatcccaagtactttactggtcttctttcaccatggaagggtattctcctttttggccccccagggacaggaaagacaatgctggcaaaggctgtagcaacagaatgcaagaccacattcttcaatatttcagcatcatctgttgtcagcaaatggcgtgcagattctgagaagttaataaaagtactatttgacctagcaagacaccatgcaccgtctaccatttttcttgatgaaattgatgccattataagtccagcgtggtggtgaaggac

SEQ ID NO: 11719 - DNA, 521 bp, Gossypium hirsutum
  Clone ID: uC-gsflmaxxa098b09b1
ttcattttctttggactttctctgaaatccgagggctaggaaagatgcgtgagattcttcatattcaggcagggcagtgcggcaaccagatcggtgccaagttttgggaggtggtttgcgccgagcacggcatagattcaacgggacgctatcaaggggacaatgatttgcaactggagcgcgttaacgtttactacaatgaagcgagttgcgggaggttcgttccacgagccgtccttatggacttggagcctggcactatggatagtgttagatccgggccgtacgggcagattttcaggcctgacaactttgttttcggccagtccggtgcagggaataactgggccaagggtcattacacggaaggggccgagttgatcgactcagtgctagatgtggtgaggaaagaagccgaaaactgtgactgcttgcaaggatttcaagtatgccattcattgggaggaggaactggatcgggcatgggaacacttttgatttccaagatccgagaagaatac

SEQ ID NO: 11720 - DNA, 533 bp, Gossypium hirsutum
  Clone ID: uC-gsflmaxxa098b10b1
gaaaaaaaaaaagagaagaaaaaaatcaccatcaccatcatcgtcagattcagatctgggttttcactcatttatagccaatagtacaccattttagctataaatagccaacctctccactctctaaaattgtgccacttcttcctcttcatctctctgtatctctttgagtgacttctttttagttctctctccggttccacctccgttcacttcgaaaaatggcctctcacattgttggatatccccgcatgggacctaagagagagcttaaatttgctttggaatctttctgggacaacaagagcagtgccgaggatttgcaaaaggttgcagctgatctcaggtcatccatctggcaacaaatggctgctgctgggatcaagtacatcccgagcaacactttctcttattacgaccaggtgctcgatgcaacatcgatgcttggagctgttccacctagatatggctggaacggtggagagatcggatttgacacttacttctcaatggccagaggaaatgcctctgtg

SEQ ID NO: 11721 - DNA, 514 bp, Gossypium hirsutum
  Clone ID: uC-gsflmaxxa098b12b1
ttactaaacgaaagagctcttagagtccagagagggtggtgcacaggagctcaaaggaggacggctcttcttcttcttcggatgaggatgctaaaccctcgtgcatctctcgggtgaagcatagattgcgtcgtcatcgccttcgtcgccgtcgtagaagcgattcttctcataaaaaactctttgccgccgaggatttcgctggcattgctcaccttactctcatcaacgcggagatgaagtttaaggacaaatggctggcatgtgtttcgtttggggagcaaacgtttcgaacaaatgtttctactgaaacagacaagcctgtttggaactgtgagagaaaacttcttttggaaaaaaatggacctcttgttgccagaatctcagtatttgagacgaacagattatcaaaaaataacctcatagggtactgtgagatcaatctacttgactatctgacacaggattcagattctgactttgtacattcgacctgattgatcctggatcatct

SEQ ID NO: 11722 - DNA, 525 bp, Gossypium hirsutum
  Clone ID: uC-gsflmaxxa098c02b1
cctactcgtccggaacaaagctattccattttggtgtacttgaggtgtataaatgttgttaattgagatgttaaagtgctgcaaattaaagtgtttaaatgttgtaaattgaactgttaaagtgctgcaaattgaagtgttaaagtgctgtaaattggagtgtttaagtactgcaaattgaagtgtttagttgctggaaattgagatgttaattgaggtgtataaatgttgttaattgaaatgttaatatgtgtgtgtgtgtgtgtgtgtgtcccttctgttaaattcttcgttatgtatttaataaagtcaattttgtgtctggctacaggcattagtgataataagatatatcattatcacttaaatcttggaggaagtgtttctaccaaaaggctgactaggctaccttcaattcctaagaatgatgcaaagttcagctatacgccataaacatttctctgatcttaagttatacaaaacattatgaccttatttatttgtttatttataaaaaaaactaat

SEQ ID NO: 11723 - DNA, 524 bp, Gossypium hirsutum
  Clone ID: uC-gsflmaxxa098c03b1
cggactcgtgggtttggccgcataaaaaagaagcagctttttccattaatttcggagggaaaaaaacgggggaaaaatctgaaaatgtctctgatgaacaatctatcaacttcaatgatttcttcatcttcatctactttcttggctccaaccagtttcaattcaagaacccagagtgtttcagttccattgaaaaacatcaatatagttaaatgtgttgccactcctcaggaacaacaaaatgcttacaaaactaaagtttctcgcaatgcgaacatagctaagcttcaagctggttacctgtttccagaggttgccaggagaagggctgcacacttgctcaagtacccgaatgcacaagtgataagccttggaatcggtgatactactgaacctattccagatgttattacgtctgcaatgtctaagaggtctcatgcattgtctacgctggagggttacagtggctatggagctgaacaaggtgaaaaggcattgagagctgcacttgcttcaacattcta

SEQ ID NO: 11724 - DNA, 529 bp, Gossypium hirsutum
  Clone ID: uC-gsflmaxxa098c04b1
gatttatctagagatccgtcgacaatggtaggaggggtcgaagtaggcgccgttccgtttaatcctgacggctggggtccgcccgactccaccaccgccaccgcgccgtccaccaccaccactctccctcttcacgttcctttcgctcccttctcccgctctgaaaaactcggccgaatcgccgacttcacccgatcttttgcaaatgccaatccatctaaccgcccttcttcagggaagcctggcgcagcctcctcagagtcccccttcgatttctcgctcgacctcgatactttccctcttgcaaaccccgaagacgattcttcctttcgtttagtcgacgcaaagccgcctactcgacctaaatttggccccaagtggcgcttcaaccaacaccgacctcaacttcctcaacggcgagatgaagaagttgaggcccgtaaaagagaagctgaaaaagaacgagcccgacgtgaccgtctttataatctcaaccgatcgaaccagaaccagcaacgtcgtgaagctg

SEQ ID NO: 11725 - DNA, 534 bp, Gossypium hirsutum
  Clone ID: uC-gsflmaxxa098c06b1
acagttgcacatgatccctcggccccccccccccgtggtttctcttccacatgatctgtcttgttaaataaataccgctttatctcctccccccctctcaaccctccatttctcgcttgcagtgccgcagcaacaatggctatgagaaagtcgtccaaactgccacaaactgctgttctgaagcaaattctgaagagatgttcaagcttaggcaagaaacatgggtacggcgaagatggactccctcttgacgttcccaaaggtcatttcgccgtttatgttggcgaaaaccgaagcagatacattgtccctatcaccttcttgactcaccctgaattccaatgcttgcttcaacgagctgaagaagagtttggttttaaccacgatatgggccttaccatcccttgtgaagaagtcgtttttcgctctctcacttctatgcttcgataaacattgattaatgtcgtcaaacgatggggcttggcttggagaatgatggccaaaaagaagctttctagcttctctttttttacc

SEQ ID NO: 11726 - DNA, 519 bp, Gossypium hirsutum
  Clone ID: uC-gsflmaxxa098c08b1
gataagctctctaaattctcttgccccatccaattcttcagcaactggaccagagcttcatccccatccgttgttttaccgccgtcgttggccaccacgtgcagtggccgaagttaaaaaacctttatttttacaggtacaaaaatgaaattatggcgaacatggagccattggagctgacatgggcgagaggcgacgtaggggaagccgacgtgggcgcgcgaacgtggaggacatgcgtgggaaggcttgcggcggctgcaacagaaaagggtgttagggtttttcttttcttttttttatttagggttaaatatttcggtctaggattaatttagggcttgggtaatttgggcttcaaaattgggttaattttattttgtttttgatttgattttgggtctatttttggtctttgaagtttgtttttggtttaaaaatttaggttttaatggtaaataggcccgggcaaaaattggtacccacaatttacataataaaaaaataagattatttcat

SEQ ID NO: 11727 - DNA, 520 bp, Gossypium hirsutum
  Clone ID: uC-gsflmaxxa098c09b1
tccacgcgtccgcccacgcgtccgggtagaggagatctgtcggtgctcctgcattttccgcccactactcttccaaatcctcatcatgtacggcagagatccgtggggaggtcccctggagataaacgccactgattctgccactgacgacgacaggagcaggaatctgcaggacctggatagggctgcactctctcgccccttggacgagactcagcaaagctggctgcttggccccggggagcaaaagaagaagaagaagtacgtcgatctcggatgtatcattgtgagccgcaagatctttgtatggaccgtggggaccctgctcgtctccgccctcctggccggactcatcaccctcatcgtcaagactgtcccacgtcatcaccaccgccactctccgcccgataactacactctggctcttcacaaggcgctcatgttctttaatgctcagcgttctggaaagctgcccaagcataataatgtgtcgtggagagggaactcgggcctccaagat

SEQ ID NO: 11728 - DNA, 530 bp, Gossypium hirsutum
  Clone ID: uC-gsflmaxxa098c10b1
gattcgtggagttggttaacagaaaaagcacaaagggaacgtgcagagttgaaagcagtgctgattaggtcagtggcgtcgggcgatggcggaagataaggcagagacacaagcgttcactcctggtcccggatatcggcaattcaagggaagagatgaattcccctccaacattttgcacggcacattagcttgtgccatctggattggatctatgcattttaacgtctccctcctccttttctccttcctcttccttcctttctcaaaattccttttggtggttggagtgcttttgattttcgccgttcttcctattgatcataacagtaaatttgggctgagattggccaggtatatatgtcagcacatgtccagttattttccagccactcttcacgttgaggacatcaacgacttccatcctgatcgtgcttacgttctcggttatgccccacattcggtgttgccgatcggagttgttacgttggctgaacgtacaggtttcatgcctcttcccaaactgaaat

SEQ ID NO: 11729 - DNA, 530 bp, Gossypium hirsutum
  Clone ID: uC-gsflmaxxa098c11b1
gtttagggtcttatgaccactgtccattcgattgctgcatcccaaaagaccggtggtggtccatcaatgaaggattggagaggtggtagagctgcctccttcaatatcattcccagcagcactggagctgccaaggctgttggcaaagttttgccagcattgaatggcaagctcactggaatggctttccgtgttcccactgttgatgtctctgtggttgacttaacagtgagacttgaaaaggctgctagttatgaagatattaaggctgccatcaagaaagaatctgaaaccaacttgaagggaattcttggttacgtggatgaagatttggtctcaacagactttgttggagattccaggtctagcattttcgatgctaaggctggaattgctttgagcgacaaatttgtgaagcttgttgcttggtatgataacgagtggggttacagtacccgagtgattgacttgatcagacacatggcttctgttaactgagtgattttcgtgtaacagtcgttacatcatgg

SEQ ID NO: 11730 - DNA, 527 bp, Gossypium hirsutum
  Clone ID: uC-gsflmaxxa098c12b1
cttttctttaagcttacagcttctctccagagtgttataatgggtaaggagaagggtcacatcaacctttgtcattggccatgtcgactctggcaagtcgaccactactggtcatttgatctacaagctaggtggtattgacaagcgtgtgattgacaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactttatcaagaacatgattaccggtacctcacaggctgactgtgctgttctcattattgactcaaccactggtggttttgaagctggtatctctaaagatggtcagactcgtgagcatgctttgcttgcttttaccctcggtgttaggcagatgatttgctgctgcaacaagatggatgcaacaaccccaaagtactcaa

SEQ ID NO: 11731 - DNA, 522 bp, Gossypium hirsutum
  Clone ID: uC-gsflmaxxa098d03b1
atttgttttgtgctttgtgtaagaaaaaagaaggggtgcaactaaaataaacaaggggaagaaagaaaagtagattagcaagaactagggtttcctcaattccaggccaaagaggaaagttaagaaacgtgtgaatggcggacggttactggaatcggcgacagccaactcctccgatgctgtcttccagtggggcgcttaaacgacctcgtactgaatacgatggcccaccttctgggctacatccatctcatgagatgcataattatttggcaagagacagtgatcgtggtggacatctgcctgtaaaggatacaaaaacaattgggtcggcatatgatcgctatctgcagagtgcacaaatttctccttttccttctggagaagcaagaacatttggtgggctgggaaagcctgctggtggtgcaatgcctgctcgtccaatagctgatcctcctgtgatgggtcgtcctggatctgctgctccagatatggcaccaaatggtcgaaatgtaggttatg

SEQ ID NO: 11732 - DNA, 528 bp, Gossypium hirsutum
  Clone ID: uC-gsflmaxxa098d04b1
caatgcaatgcatagtgtttttctcattcgctcatgcttttgaagcttgccatctcaaccgcacccgcagcagccaccatctttaaagctgttcttagcaaaggagtttcactaaacatggcgcacaaacttgttcaagtgactttgtgtttgtgggtttttacaagcttacttctcccctctcccactgctgccctataccgggtcagtttgaagaaacaaagattgaatcttaatagatttaaggctgctagaattgcaatgaatggatggggtatgcttcataactatggaagttcagatggagaagtaatacctctgaaaaactacatggatgcccaatattatggagtgatagccattggctcacctccacaaaacttcaccgtcttatttgacactggcagttccaatctgtgggttccttcttccaagtgctacttctctattgcttgctatttccattcaaagtacaagtctagccggtcaagtacatacacaaagattggaaaaccttgtgaaataaat

SEQ ID NO: 11733 - DNA, 529 bp, Gossypium hirsutum
  Clone ID: uC-gsflmaxxa098d06b1
gaatttaagaggaagaagaagaagaagtttgcattggctttttacaattctaatttgggtttctttcctactccaatggcgtccacactaatttctacaatataaaaattaagaaaaatccaatttttttcaatatttgttatttttcctctataaataatcgtcttcctttgttcacttgctcattaactagcttcacacacactctctctccctctttttctggttcaaagttgggttctcagttgccctgattcagggattaaaaagaaaaaaaagctaagttctatattcgggtgtggcaatggctactaataacaataatagcaagttagagaagttggcttccattgatgcacagctacgtgctttggttcccgctaaagtgagtgaagatgataaattggtggagtatgatgctttgcttttggaccggttcctcgatattcttcatgacttacacggcgaggatcttagggaaacggttcaagaatgttatgaactctctgctgagtatgaagggaacagt

SEQ ID NO: 11734 - DNA, 524 bp, Gossypium hirsutum
  Clone ID: uC-gsflmaxxa098d08b1
tttacgcgtccgaaaaaagaaagtataacaggggtgattctgagactgagaggtcatgaatccagagaaaccctgagaatccaactcccatctccttgttcttttcttcaactccaggaaaccctttctctctccctccctccgccccatcctcctccctcttccctccgtttttacctcaacgacaacgatttgctcctaccgccctcccctcactcttccctccattcccttggcgtcgtcgccggcgaccttctctatttctcctccaaccccaccgctttttccgctgtttcagtaacccaaatggatgaccccaatcgggtgccggacaacaacaacaatcaagagacccaaatgcaagaattgcctcaatttgaagaacccatgtcgcaagatcccgaattttctccagaaactatggacatcgatgcctctgcccttagcgaaaggttgtcggagccctacttcttgaggaaggttttgggggaagagctgggtgataatggctgcattcacaagct

SEQ ID NO: 11735 - DNA, 526 bp, Gossypium hirsutum
  Clone ID: uC-gsflmaxxa098d10b1
ttttatatttcctcgctctctcttttatcctgaggttctcagtcatcaaagacacggtttttttcttaaggttgtaaaagatggcagatggtgaggatattcagccacttgtttgcgacaatggaactggaatggtgaaggccggatttgccggtgacgatgctccgagagccgtgttccctagcattgttggccggcctcgtcacaccggtgtgatggttggtatgggccaaaaagatgcatatgttggtgatgaggctcaatctaaaagaggtattttgacattgaaataccctattgagcacggtattgtgaacaattgggatgatatggaaaagatttggcatcatacattttacaacgagcttcgtgttgccccggaagagcacccggttttacttaccgaagctccccttaacccgaaagctaaccgtgagaagatgactcaaatcatgttcgagacctttaatgcacctgctatgtatgttgccatccaggctgtgctctctctgtatgctagtggtcg

SEQ ID NO: 11736 - DNA, 519 bp, Gossypium hirsutum
  Clone ID: uC-gsflmaxxa098e01b1
cggtcgcgtgggcaaagccggaggaggtgttcggtcccacacctcttcggaaaaaaaaatcatcttcaaaaacgaaaaatattataaaattttctttctaaaattctaaaaaaaaagaaagaaaaaggaatcaatggcgtcgtccgatagcctgagcgacaagaacgcggttttcagaaagctgaaagcaaaatcagaaaacaagatgtgtttcgattgtaatgcgaaaaatccaacatgggcgtcggtcacgtatgggatctttctctgcatcgattgctcagccgttcaccggagcctcggtgtgcacatcagctttgttaggtctacaaatttagactcttggtctcctgaacaattgaaaatgatgatctatggtggaaacaaccgtgcacaagttttctttaagcaacatggttggactgatggaggcaaaattgaagccaaatatacttcaagagctgctgatttatataggcaaatgctatcgaaagaggtggctaaagcatggctgaagat

SEQ ID NO: 11737 - DNA, 400 bp, Gossypium hirsutum
  Clone ID: uC-gsflmaxxa098e02b1
gattaaaatgggagtggagaagaggatcatggtgttgtggatttgtgcaatggtgataagctcaatggtgatggaagagggcgcaaatgcgacaacaattagctacccaggactggaaaaaaaccgtcaagttccatgcaaaattggaggcggtaattgcctcccaccaccatccaacgattatgacagaggatgttcacccctaaaaagatgtcgaagtcatcatacaatgcccatccgtcattaaccacaactagaaaatgcacttcattaacttctccttatttttgctatcaaattatatgaaaaaaaagatcaattaatcatttcatatgtttattcattccttattattgtaacccatgaattccagaattatatacttcaacatttttttaag

SEQ ID NO: 11738 - DNA, 522 bp, Gossypium hirsutum
  Clone ID: uC-gsflmaxxa098e03b1
ctgtctcgtgggtccccctcccccaatcatacagcttagtgttttcttttcgtttgcagcggagccatggaagtgacgccaggcagaaagcagttctatagcaattatatgctattgaaccctaagaaagcctctttctttgatctaatcgccctcttattttctaaaaatttaaagaagagaaaatttatcgaaaccagtatcgaaactgaggacagtttctggtatagacttgttatattcctctctactctgttacagaagtttctgctttccataaagacgccaatggctttggctggccaaacttttgaggatatgctcaaccttttcactaacaatggtggcttgtttggtctcattaaaaaggtcatgacagggaaggtggtgattccaagcagagaagcagcaacctatgtctctgctgttggatatacggacttgagaatggatttagacaaacaaattatatacgggaattctatgtattatccagcacttgcgattatgacttgaaagctg

SEQ ID NO: 11739 - DNA, 525 bp, Gossypium hirsutum
  Clone ID: uC-gsflmaxxa098e04b1
ctttatactgagctttgctgaattttcgtgatcggggagaaagaaaattatgggaaggaaattcttcgttggcggcaattggaaatgcaatggaaccactgaggaagtgaataagattgtgagtactttgaatgctggagaggtgccttctcaggatgttgttgaggttgtggttagccctccatttgtgttccttcctttggtcaaaacttcactgagacccgatttccatgtcgctgcacaaaattgttgggtcaagaaaggaggtgctttcactggtgaagctagtgcagagatgcttgtcaatttgagcattccttgggttattattggtcattctgagaggagacttattttgaaggagtcaaatgagttcgttgcggataaggttgcttatgcacttgctcaaggcttgaaggtgatagcttgtattggggaaacacttgagcaacgtgaagcaggatctactgtggcggttgttgctgaacaaactaaagcaattgcagcaaaaatatcaaactggac

SEQ ID NO: 11740 - DNA, 522 bp, Gossypium hirsutum
  Clone ID: uC-gsflmaxxa098e05b1
gtgataatcaagaaccgaaaggacctttaatctttggaaccaaacacccccccctaatcagaaccctaacttttttttcttctaatctttgattgtagaaaccaaaagcaaacgcgtaaagaaatcatgggttctgaacagaatgaaggaactagcttccctccatcggcgccaaaactttgtgccaacggctgtgggtttttcggcacggcggcgaatatgaacctctgttccaagtgttaccgtgacctccgtgccggggaggagcaagctgccaaggcgaaagctgccatggagaaatccctcagcgttaatacgaagcaggaagatgtcgttgacgagactgtgaagcctgttcttgagcttcctcatgtgggttcctcatcgacggtggtcgagatacaaccggctgctattgtctccgatgataaaccggcggaatccaaggcggcgaacaggtgctttatctgcagaaagaaggttggattgaccgggttcaagtgcaagtgcggaagtacattc

SEQ ID NO: 11741 - DNA, 526 bp, Gossypium hirsutum
  unsure (1)..(526): unsure at all n locations
  Clone ID: uC-gsflmaxxa098e06b1
aaataatcataaaattaattgtgtttttatggtgagaaaaattaattaaactcattgatatgttgaagggtatttatatttctatttgagaatcgaaaagagattataaatagttttaagtattatatcgaaaaaattaatttatttatcattttttatcatttaagtcgatatttattaacagttctactaacgaaatgacatagtaaaagggctttttagactttttgtctagaatatataattagccttaattttacattgttgttaatctacccatgttctatactattcaaatattgtttaattactcattgaaaaataataaatttttaatgattaatttctaagcatgtttaataatttgaaggactagaattttgattgtttagatttgagttttaccatgctcatttaagcacgtgtgggttattttaaaatttatttcagatttaagtctttatcacgtattggtcttattcatttttattctaatatgattnttttgaatatattctattataac

SEQ ID NO: 11742 - DNA, 507 bp, Gossypium hirsutum
  Clone ID: uC-gsflmaxxa098e07b1
ttcatttcaagggagagagtgtatcagtgggggttcccctctttacttaattgctctccgccatggctctctccgtcgagaaaaccgccgccggccgtgagtacaaggtcaaagacatgtctcaggctgacttcggtcgtctcgagatcgagttagctgaggttgaaatgcctggcttaatggcttgtagaaccgagttcggccctgcccaacctttcaaaggagccaaaattactggttctcttcacatgaccatccaaaccgccgttcttattgaaacccttaccgccctcggagctgaagtccgttggtgttcttgcaacattttctctacccaagaccacgctgccgctgccatcgctcgtgactccgccgctgttttcgcttggaaaggggagaccctccaggaatactggtggtgtactgagagagcccttgattggggtcctactggtggacctgatctgatcgtcgatgatggtggtgatgctactttgttgatccacg

SEQ ID NO: 11743 - DNA, 523 bp, Gossypium hirsutum
  Clone ID: uC-gsflmaxxa098e08b1
tccacgcgtccgcccacgcgtccggagcttgaaatatctctccgaattctccacctcttaacatagatttgatttctcttttagtcaagttatgtcagggaagagaccacgtccgatgatggggaaattgtctgaattattggtttccggcaaaaaacccggatttttggatgctgttgttacaagccctaggagtccattagatttgaagacaccatcacctagaagttcgaagagatatgatgttggtggggttggactagggatcgctgttgcactggataacaagtgtagtacccattcctgcaggcatactatttgtagctcaaatgtaattgttgtgaaatctggtgggaagaatttagagatggaaagcttggaggattttacgtatgtgactacccatggatctggcaagtcgtctacaaaggtgttttatgatggaggtgaagaaaggagaaaaagtaactgtgaaaccccagctccagcaccaagatttgtggaagaggttgcttacccaact

SEQ ID NO: 11744 - DNA, 525 bp, Gossypium hirsutum
  Clone ID: uC-gsflmaxxa098e09b1
ttctcacgcgtccgcggacgcgtgggttaaaagagaaaaactcaagaaatgaaaagagaagagactacaaagaatcggcatttcctcgccgataaaagatggtttatgcctattaccatagctggctttattgccgggacgatacttatctcgagcttcataaaaaccgccgattactccatactatgttcgctcgccaaaaccagatccatagccgtagaggaatactcctcctcgccggtccaactccaagctatcatccactacgccacttcatcaatagtcccgcagcagaacttcaaggagatctccgtaacctttgacgtactcaagaaacgctctccttgtaatttcctcgtctttgggctcggctacgactccctcatgtggacctccctcaatcccaatggcaacactattttcctggaagaggatcccaaatgggttcagtctgtgctcaaagacgccccgatcctccaagctcacgcggtaaagtaccgtacggagctcaaggaagctgacgat

SEQ ID NO: 11745 - DNA, 501 bp, Gossypium hirsutum
  Clone ID: uC-gsflmaxxa098e10b1
gtttcaacgtaagaattagggttgtgtttaggagtggcggtggcagcgcgcttgagatccactctccctatctttcacaggcttttgagatccgattccctgccttctcacactcccagagctactcttcaccgaactctactttgccccgagctgtcgaggaaatattctacttctctgaagaaggacgagaatgttaaggtgcctttggctttgtttggtggatctggaaactatgcatctgcactgtaccttgcagccgtaaaaggaaatgctctggacaaggttgagtctgaacttcttgaccttgttcaggcatcaaaaaacagtcaattgttttctcaattcactaaggacttgtcagtacctgcagagacacgggtcaaagccattaatgagatatgtgggcaagctaaattttcagatcttacaaagaactttttagttatactagctgagaatggaaggctaagacatatagaaagcattgcaaagagattt

SEQ ID NO: 11746 - DNA, 294 bp, Gossypium hirsutum
  Clone ID: uC-gsflmaxxa098e12b1
tctctcgcgtccgcccacgcgtccgcccacggggacggtcttgagactaaaagggtggggcaactacatcttggggaagggtttgctgctgaaaatcttaagcaagtgggctattatttgggctagggtttagtaattgggttatttaatgtgtaatgggtctggttttaattttgggctacacatgttgtaaatggacttgaaatttggactttttatttaattatttgggttttgtttgttttaaaccataaattaacattgaagataatctacccatgttctatactaatc

SEQ ID NO: 11747 - DNA, 513 bp, Gossypium hirsutum
  Clone ID: uC-gsflmaxxa098f01b1
ccttgttttccgactcctaggtgcctataagggcggccttccatatcagattccgtgctacaggaggtcaccggaccaatatctccggcatgtgcgctaaatctgttctcatgaatcttgctccttccaggatgaatattggacgtattgcggtatctacatccattctgactgatatacaccctaagaatgggtgtttgaagagggagaaagctataatctagcacattatgttttagcaaacatatcataacaagagatgctgtggcggcataggcacctgcataattgttgacacctgcattctcatactcatgcgccgtagagaagtgaaggactactgaactgccaagtccatcgaaggtgtttacgaaaagtgtcaagctgggatagtggtaggagaccttggagcgtccgatgcatggggtctagaaacggcggcaccgcttcggaaaaattgtaactagtgatgtgactcttacaaggtaatgcttatgtggcatggctgtatgg

SEQ ID NO: 11748 - DNA, 527 bp, Gossypium hirsutum
  Clone ID: uC-gsflmaxxa098f02b1
acaatctgtacattacccaattgtccctctcgcaattctcaagtggactgcacagtctctctctcatatcctatctcttcgtcttgacaaaaatagtaatttttttctctctttatccctccctttctttgcatgtccccagcgtttcatgtaggtgaaagtagagtactaaacaaatttctttttaaaaattggtgggaaggattaaacggtaatttccggatgttctggcggtaattccatcggccttcgaatctctccgttctctgtagcattcaaccttcaaatagactaaaaaacagaggttatctcggtgccatgattgtttgtttgttaattgaataagcaaagcatgccaattgctgtctttcctaagcttttctacttcaaagcatggcaacacgaatccgccgcctcactaccagaagatcaccacctaagcttctttttctcgccctcttgatgcttacgccagtttgcgtgattggcttatataactatggccagaagatatcctactttttccg

SEQ ID NO: 11749 - DNA, 521 bp, Gossypium hirsutum
  Clone ID: uC-gsflmaxxa098f04b1
cggacacctatttttgttcttttttctggaaatgcaaaattcaaacctaacctggaaagcttcgtctcaatctcttttccttaaggtattgttttggcaggaattgttcaacatgtctactacgccaagtgatccacttcttcaagtggaaacaacttgcggaacccttttatatgaacttcagataatctgggatgaagttggggagacagatactgatcgggatgaaatgctgcttgagcttgaacgagaatgcctggaagtatacagaagaaaggtagatcaggcaaatcgctgtagagctcagctaagacagacaattgctgattctgaagccgaacttgctgccatctgttcagcaatgggggagaggccagtgcatattaggcagtcagatcaaaatgctggaagcttgaaggaggaactcagcaaaattcttccacaattggaagaaatgaagaaacggaaaatagaaagaagaaatcaatttgtacaagttttacaacagatacaaattatca

SEQ ID NO: 11750 - DNA, 504 bp, Gossypium hirsutum
  Clone ID: uC-gsflmaxxa098f05b1
ctccatacagatttcttagtgattcaatccgtcgaggaaattagggggaaaaaatgggagggggagagcatgggcatgggcatgggcatggagttcaagatttcagggagaaggtgtggagcatgtcggggggtccgtactgccggcccaagcactggcgccgcaacactgccattgccatgttcggcgttttcctcatttgcatccccattgccatgaaatcaaccgagctcgagcaacgacctcatcagcctgtccgtccgattccttcacagctttggtgcaagaacttcggaaacaaagattattgaagtctgcctggggctgttggagtaccgatggcatatcagagcagcctatgatctgtatttgagaccctttcaccaatttagctttgttcgtgatcaataagttgtgcttgttttgccttcactgtgttattgacaaattttgaagttgatttttttttcaaactgaatcaacttaatatctgtttattccatc

SEQ ID NO: 11751 - DNA, 527 bp, Gossypium hirsutum
  Clone ID: uC-gsflmaxxa098f06b1
ccttgtttcccgccatggaagtcgactcgcaagaacagctgcagagaaaacagtccacttacctctctttagatgagaatttcgagattcagaaggaagtttacagaggccaacagtacagtcaaatttactttgctcgtcttcacatgatgagaactttgctttactccctcgtgcccaactggaaatcccatctccccgtttgtacagttttagagctcaaagaaggcaaagaatgcatcatttttggtactctttacaagcatatgaaactcaaaccttgcattcttgatgaatactctaaggagagatctgttgcccctcttataaaacctcataattttatgcatcaagatgactacttggttttggaagatgaaagcggacgagtgaagcttggtggtactaagctttcaacctcagtttatgtaacaggtgttgctgctgcgttgcatgggaaggaaaccagtgcaggagccttctttggttgagatgttctcgaagctggcttaccacctcagattaaa

SEQ ID NO: 11752 - DNA, 509 bp, Gossypium hirsutum
  Clone ID: uC-gsflmaxxa098f07b1
tgtttcctagagatgcaaggaactcagaatcacggcactccacatcaaattacgtgctacaggaggtaacaaaaccaagacccctggtctgggtgctcagtcagctctcagggctcttgctcgctccaggatgaaaattggccgtatcgaggattttacgcccattctgactgataacacccgaagaaagggtgatagaagagggagaaagctataaactagcacattatgttttagcaaatctatcattttaagtgtttttttggtggcattggcatttggttaattggtaataactgttctttatgagccctttttcatagttttatattggtatattttatattggagttgtagatcataatgaaccgtgaatctagtatggtgatatttttattaaaaatttgtgggttttatcattgctgttcatatcataggtagtccctaaacaaaaattgtaacttgtgatgttacttttaccaagtaatgctcatgtggaatttatttat

SEQ ID NO: 11753 - DNA, 531 bp, Gossypium hirsutum
  Clone ID: uC-gsflmaxxa098f08b1
aatatgttaaatccaaaatttggaatctttcataattagccccacaataaacggaccataagggtccgttaacaaaaatagccaattaaaaataaaaaaaagtttacgtgtccccatttttctcctattattcacaaaaaaatctcttcttccctctatttctctccagttctttccctttttgtctctctttggatttcgtttccttcgaaaatcaaagagctcaagcttctacggtgagacgtgacattgaggaagttgaatgagtatcaagagtgttacaattgttttatgaaaataagttaggaaaagaaaaactaagattcctagttgttcattatgtgtgtgtttgctctgaagattgatagtgttgatgcaaatgctgattaaggtcaatgaggacgagattttctagatttaggtgtttatggaagtattgattatccttccaagcatttaaagctgtgggtacaaagagtttggtagtttagacattgcagcagtatggctattgctggtctacacaaagtt

SEQ ID NO: 11754 - DNA, 524 bp, Gossypium hirsutum
  Clone ID: uC-gsflmaxxa098f09b1
gtcagagttaatgaaatcatactaaaacgcgtcactcaaacttctcttgccagcatttaattccctttttatctaaataaaaactaataagactacatcttaaaaagatactactggaaaatttaagcacttgtgtttaagctctcaaccaaattgccagcgaaatactgtattcctcttgccttatagctcatcatgttgtactgcatcttcctcagcactgtctttgcttgaatctgactcacttccttcaccatcatcagtatcatcgtcgtcgtcctcagcatcggaatccactggctttgtccatatttttacaggtatggaagattgcaacctatttttaccaactgcatcaagatctgaaatatagctatgaacaaatctccctacttcttttccagatttaccatcttttttatgcaatctattgttcctgtctccccagatggcccatactgcaacacaaaagattcgatgttgaggagtcgagctctgtgagaaaaccaggttagccactgtag

SEQ ID NO: 11755 - DNA, 377 bp, Gossypium hirsutum
  Clone ID: uC-gsflmaxxa098g01b1
atgtctgtgacgcaattgatgcaagcatggcttggtgaatttttttaacgaaggcgctgatgatcagatacccaaatcatgatctttggtcgcacaaggtcgacattgcataccgtgaccatgatatgagacaccaaggctgcatttggatgcccaccgacaacgatgaggatgcccacacttgtgaaatagctcatcacccttgcatatggcctttgcaacccaaccctacatatggtgttatactttcattggactttatcctttttctgctttctgcattactctgagtaaagaattaactgtatgacattcttgtataatttataacaaggaacctggaaacaaatattaattaatttccaaacattaatatc

SEQ ID NO: 11756 - DNA, 514 bp, Gossypium hirsutum
  Clone ID: uC-gsflmaxxa098g03b1
cccactcgtccggccttccccgactactgaactgagacaaaaacaagtctgaggctcacagaagtaacaatgtcagctttgaggtttagctcacgctttaacccaatgttatcaaacataatccttgttcaaaccaaatcattattattcagtttctcttccttctcctcatcagtcagaaaaccttgtaagactctttgttgctcttccagctctccactttctgggttagaggatgagttggttggttatatttttgggaagaagaaagcaacagaagtggctcatttggtttggaggcatgtcttgcataaaggggatattgtcatagatgccacatgtgggaatggttatgataccgtagcaatgcttaaaatggttgctgatgaatctggtcatggtcgtgtttatggaatggacattcaaacagaggctttagagaatacttcttccttactggatgaaactgtcactcagaaagagaaagaactagtcaagctctttcccatttgcc

SEQ ID NO: 11757 - DNA, 526 bp, Gossypium hirsutum
  Clone ID: uC-gsflmaxxa098g04b1
aaaaaacaccccttcactgatctttgagtccaccacacaaaaatcaaccatggcagcagcagccagagtgatagccatcgccggcaactccaccgccgccgcgtcttcctgcttgcttatcaaaacaccgttcgctttacaacgctgcagcaacggacttagattcaacaacgtcagacgatcatcgaaaagattgttttcttgcaatgccatttataaccctcaggttcaaatcaaacaagaaggccaacccgaaactctcgactatagagtcttcttcgaggatacttcgggcaaaaagatttctccttggcacgatgttccattgcacttgggagatggtgtttttagcttcattgttgagatacccaaagaatcaagtgctaaaatggaggttgctactgatgaactttacactcccattaaacaggatacaaaaaagggcaagcttcgatattacccctataatataaattggaattatggattgcttccacacacatgggaagacccatctttggcaaac

SEQ ID NO: 11758 - DNA, 483 bp, Gossypium hirsutum
  Clone ID: uC-gsflmaxxa098g06b1
ctcaggtccttgcaaatggcggaagcttctaaagtcattcatgttcgcaacgttggccatgaaatttctgaaaatgatttgcttcaacttttccagccatttggagtgataacaaagcttgtaatgctccgtgcaaagaatcaggctcttctccaaatgcaagatattccttcagccatcaatgcaatgcagttctacactaatgttcaaccaactatcagggggaggaatgtgtatgttcaattctcatcacatcaagaactgacaaccatggatcagaatgctcaaggacgaggtgatgagccgaatcgaatcctcctggtcacaatccatcatatgctttatcctattactgtggaggtgctacaccaggttttctcacctcatggatttgtggagaagatcgtcacatttcagaagtcggctggctttcaagccctgatccagtatcaaggacgccagaatgctatctcagctagaact

SEQ ID NO: 11759 - DNA, 449 bp, Gossypium hirsutum
  Clone ID: uC-gsflmaxxa098g07b1
ctgtagtgaccgaggatactgagaagaactctgcagaacttttaatggaggaactgaagctaagagaagctgaagctttggaaagtcagcgacgggccgacatggcattacttgaggctaagaagatagcatcacagtaccaaaaggaagcagacaagtgcaattcaggtatggaaacatgtgaagaagcaagggagaaagccgaagcagcactggtagctcagaagaaattgacagcaatgtgggaaacacgagctcgtcaaaaagggtggagagaaggggttgccaaatctcatacagactcgtaaggtaacattcaagctgtccaaatgacccgtcattgcctcgtaaaagaatttcaaacaagaattccagagtcaatcctataggtagtcttaagtatagttacccttggtttctacggagccaaacatcgtcatccattaaaa

SEQ ID NO: 11760 - DNA, 532 bp, Gossypium hirsutum
  Clone ID: uC-gsflmaxxa098g09b1
ttgtcgcgtgggcgaagcgaaaggatttgagagaaagaagggaaagactctgatagaaaaatggagaaagcaatcaacagacaacaagttttgcttaatcatttacaaccctcttctcagtctcatcaatcacctgctgctattctatttccttccaactgcgcggcgggggatagcgctgcttatcaccggacggctgcttttggggatgatgttgtgattgttgcggcatgtcgcactgcaatttgcaaagcaaagcgtggaggcttcaaagatacacttgcagatgatttgcttgcccctgttttaaaggctgtgattgatagaacaaagctgaacccaagtgaagtgggggatatagttgttggtacagtgttggcacctggttcacaaagagcatcggagtgtaggatggcagcattctatgctggtttccctgatacggtgcctattagaactgtcaacaggcaatgttcatcgggcctgcaagcagatgccgatgttgctgcttgcataaaagcaggattttatg

SEQ ID NO: 11761 - DNA, 524 bp, Gossypium hirsutum
  Clone ID: uC-gsflmaxxa098g10b1
ttttgagcttggtctcattcttgaggtaggtgggaataacgtgcatagtgtgatggagaagcttagcagtttggatgtttctgctgagttaataggacgagtaaccacctcacctgtgatagagctaaaggttgatggaattactcatttaaatgagaaaacttctctgcttagagatatgtgggaggatacaagcttccagctcgaaaagttgcagagattggcttcttgtgtggaactggagaaagaaggtttgaagtttcgccatgagccttcttggcccttgtctttcaccccttcagttacggatgagaaattttttactacagctttaaaaccaaaagtagccatcattcgtgaggaagggagcaatggagacagagaaatgtcagcagcattttatgctgctggttttgagccttgggatgttgcaatgtcagaccttcttaacggagttatttctttgaatgaattccgtggaattgcatttgttgggggttttagttatgccgatgtgcttgatt

SEQ ID NO: 11762 - DNA, 523 bp, Gossypium hirsutum
  Clone ID: uC-gsflmaxxa098g11b1
ttataatctccaaagctagaatggtttcaaaatggcatgatgtgtactcctcttgggatgatgaattcaaaaaactggtgcaaagcttccccaaagagaaaggctgggcaggatccaatctttatttctatcaaggtttttggtgcccctctcttgttctaaaagcttttatttctttccagaaacattttcaagcatttaattctgatatcatcgttgctacttttccaaaatgtggtactacttggctcaaggccttgactttctccactttgtaccgcaatcagttcccatgggatgaaaatccattgctcacctttggccctcaccaacttgttcgtttcttcgagtatgatctttacttgaacaacccttttcctgatcttcgaaatgtttgtgcttatcagccaaggcttttttccacccacgccccttatgctactttgccaacttccattaaggattctggctgtaagattgtttacatatgtagaaaccccatggatatgttcatttctctttg

SEQ ID NO: 11763 - DNA, 506 bp, Gossypium hirsutum
  Clone ID: uC-gsflmaxxa098h01b1
ccctctcgtccgtatttctcttgttttgacagggagggcatcaaaagtacaggagtgtgggttagttccttttttctggagcttgaagttaagaatcctagtactttttactgtaggcaatgaagaggaccatctatttatgattgatgtggcattcttatgcgtttcacagacaaatccaagtcgggatatgatgtaacttttcatcataatatcgttcctgccaaagccactcatctgacaaatagcatgaagtttttaaatatcaaatcaagagagggaatcaatatagaggcaaccaaaggctccaggttaactttagagcctaagaacatgaggaagacagaaattcaaaggaaggctcctcataatgacttgagtagttggaataaaataaatagtcagggtgtagatggttcaggcattacctcaacaaggatttaagtgcaaggactccctcagcagaaaggctcagagagcccttgccatgccaggcaggaaagagc

SEQ ID NO: 11764 - DNA, 527 bp, Gossypium hirsutum
  Clone ID: uC-gsflmaxxa098h02b1
cctttttctccaaagtccaaactccactagcaacggggagatggagagtggagcagggaaatggggtttccaagggaagcagggcctggaggcagcgtccaccaccaccgtccgaggatatctcaacctattaatgggcaacatcaaccaagataattgccttacagtcgttcctctcggtcatggcgacccctctcattttccaagcttcaggattacccctgctgctgaagatgccatcgctgatgctctacgttcggctaagcataattgttattcgaccactggtggtattcttcccgcaagaagggcacttgcagattacctcaaccgtgaccttccctaccacttatcgcccgatgatgattatctaacaattggatgtactcaaggaatagaagttgttatatcaattctttcccgacccggtgccaatattttgcttcctagaccgggcttcccactctatgaagcttggagtgcttataaccatcttggaatgcgtcattatgatcttcttcctgaaa

SEQ ID NO: 11765 - DNA, 493 bp, Gossypium hirsutum
  Clone ID: uC-gsflmaxxa098h03b1
cccactcgtccgcaacaatcggaaatatgagaaggggtttttcgatgacttcgcttgtgaataagggatctattcaacgaagagtttcaaaaaagtatcttatcaatgcaattcgtccatattcagaggatctatcctccccgaaatctccagggcctctactgcaatatcgcaagttagtggagcacggaaggctgcaacatgatccttaccaagaaagggctgctttggcattggaaaatcttgcttgggaggttggaacagtatgaaaaagagatggaggactatcatattaagctagctgagtgggagaaaaacagggagactgagcgtcggaagcttttgatggaggaagctgagctcaatcaccgaggggacctttggacatcggttaataagcggaagagtgaacttttagaaagatggtcattcaggagaaaatcttgagatatagaacctgcagttggtaagtgggtttcatacctcaatcgtg

SEQ ID NO: 11766 - DNA, 523 bp, Gossypium hirsutum
  Clone ID: uC-gsflmaxxa098h04b1
gttttctaatctttttgggaaatcggtagcaaagaggtgtcgtcgacggggaggaagatcacccttaagagctcggacggcgaatcattcgaggttgatgaagcggtggcgttggagtcgcagacgattaagcatatgatcgaggacgattgcgctgataacgggataccgttgcctaatgttacgagcaagatcttagcgaaggtgatcgagtactgcaagaaacacgtcgaggctcctaagacagacgatcgatccgccgatgacgagctcaagagttgggacgctgactttgtcaaggtcgatcaagccactctctttgatctcattctggcagcgaactatttgaacatcaagggtttgctggatctcacttgccaaactgttgctgacatgatcaagggaaagaccccagaagagatcaggaagactttcaatatcaagaatgacttcaccccggaagaggaagaagaggttcgtcgggagaaccagtgggcattcgaatgaagggtcaatttcgagt

SEQ ID NO: 11767 - DNA, 432 bp, Gossypium hirsutum
  Clone ID: uC-gsflmaxxa098h05b1
ttaataggcttcttctgaatctccatctccttggggggattcttagaaacatgacgtgggattgcataaagagaatgaaagaattgcaagcaagtgagcaatcatctgatcataagatgcttcgattgagtgtagaaactggtggatgttcggggtttcaatacgtgtttgatttggatgacataacaaacccagatgacagagtttttgtgagggaaggggtaaagatggtagtcgatgatatttcctatgatcctgtaaaaggagcaaccatcgattatgtccaggagttaattcgttctgcattcgtggtgactacaaatcctagtgcagttggagggtgcacttgtaaaagttcattcatggtgaaacagcccatgtttcaagcacatcgctcatagcaaatcaaatttttttctttgcataacattt

SEQ ID NO: 11768 - DNA, 523 bp, Gossypium hirsutum
  Clone ID: uC-gsflmaxxa098h06b1
ctttttctcaaaagccctctcgcctctttatctgagggacttgtacaactcaacacaaggtgtctccaaagcttccgcacttcacttcacttcacttcactcaccaataaaaaaaaaaaaaagggagttccaaaacccaatcaacaaatcaaactcaagtttagcatcacaactacaaattaccccaaacggccaaaccttagatccccatgatgagccccaagttttccatgaagactattacagtacctgctctacaccctatgtaagcgctccttcaagccctggccgagcgccaggaccaggacctggctccatcaatggctatggtgggtgctattatagtgcaccagctagtcctatgcattttgcactgacctcagcatcttcttcaatggtagcatcaactcaaccatcttctcctgataataacccagttccccttggatctgagtttgagttctctgcaagatatggggcatcatcagggtcgggtcaaacaggtaccatgagctcagctgat

SEQ ID NO: 11769 - DNA, 434 bp, Gossypium hirsutum
  Clone ID: uC-gsflmaxxa098h07b1
ttttatcgcgtccgcgcttttcagccgcagccatggggaacgtacctaagaccaaggagacctactgcaagagcaaggagtgcaggaaacacactttgcacaaggtcacacagtataagaagggcaaggatagtttggctgcacaggggaagcgtcgttacgaccggaaacaatccggttacggtggtcagaccaaaccagtgttccacaagaaggcaaagaccaccaagaagattgtgctaaggctgcaatgccaaggttgcaagcacgtttcacaacatccgatcaagaggtgcaagcactttgagattggtggagacatgaaggggaaaggaacatctctgttttaaacgtgttattcatgggatcttgttactgttgctttactttatatggagtagtttgaacttacaagacttgtaatggaattttgt

SEQ ID NO: 11770 - DNA, 530 bp, Gossypium hirsutum
  unsure (1)..(530): unsure at all n locations
  Clone ID: uC-gsflmaxxa098h08b1
cccacgcgtccgggaaaacaaagccattttgaggggtttcgctctctctccctctctctagagaagaggcattccctttgtcggagtgcgcttctgctgagtgtttctttcgttttcttttgttttaagttttggagtaaagagtgtttcaagcttcttagtcctattggctgcttaacgacctaagctagccccgccggatatagttatcaggtgctcatcataaaaaatgactgtcacgccaggaatttccatcaacgatgggaaccttgtggttcatgggaagaccatcctcactggaatgcctgacaacattgttttgaccccaggatccggtgtcgggcttgttgctggtgcttttataggtgctactgcttcggatagcaaaagccttcatgtctttccaataggtgttttagagggcctccggtttatgtgctgtttccgtttcaaactatggtggatgactcagagaatgggaacatgcgggaaagatgtccctttggagactcnattcatgctcgtagaga

SEQ ID NO: 11771 - DNA, 532 bp, Gossypium hirsutum
  Clone ID: uC-gsflmaxxa098h09b1
cttgtctttcaagctttccgtttgttaacagaggctttaaaccgaagctgagatcgcttcacagttctttctcttctccagagatctctctccatctcatttggagctcaatatatcaaattcatcagcttaaaaatggcggccgtcgccgttcaccatttcgctcagtgcatcacttgccatgcttggagtcccgatcactccatggtagcattttgcccaaataataatgaggttcacatttataaattggtgaatgacaagtgggagaaagttcatgttcttcagaagcatgatcaaattgtttctgggatagactggagtggaaagtcaaacagaattgtttctgtatctcatgatcggaattcatatgtttggaaccgagaaggaccagagtgggtaccaactcttgttattcttaggctcaatcgtgctgcactttgtgttcggtggagccccaaagaaaacaagtttgctgttggaagtggtgctaaaactgtgtgcgtatgctattatgagcaagagaaatact

SEQ ID NO: 11772 - DNA, 513 bp, Gossypium hirsutum
  Clone ID: uC-gsflmaxxa098h10b1
tttatcgcgtccggtccaatccctccctctatgggcatccccacctgcaacgatgcgtgcatttccagagcaatccaatgtcgttggttgtccacttgatttacctgaacaactctttcacagcgttaagaacgcttgcggcactaagagaaacaatggggtggtgagtgagctccaccgtagtcgctgctgtcctgttctcgctgcatggctttacgccgcttactccgccaccgcccttggtggggttggaagagtagtgccagcggttgcggggcgtaccccatcttatgacatgccattgctgccggatgactcggaaacctgtgtggatgacttagggaaagctctgaaacagagaggcgtggagttggctaaaccgaacgagacatgcgatgcggtgtattgctattgtggcatcaggcttcacccactgacttgccctgatgctttctcagtggaccaaaagggcaaccttgtaggggatgacagtgtggagagattggagagaaa

SEQ ID NO: 11773 - DNA, 527 bp, Gossypium hirsutum
  Clone ID: uC-gsflmaxxa098h11b1
ttgtatttccagatcaaatcacaacatcatcgggggttttaaacacaatccccgtgggtccaaccaacgcttcagaaacctcgatcttcttcaagaagacattaatggtaagaaggagattaaaatcggtttagttaatatcaattccaatgaagaaatccaatatcaactacccggttcagttgttagtaccgtccacgttcgcttcgatcgtgtttccaagaagagaaaatgggaggattttttccccttccggatcgatgaaaaccagcagaattgtccggagattccgatgccagccctggagaagtaccaggatctggacgtggtggtggcgaagctgccatgcaaagggtggagcgggaaaagcgggatgagggatgtgtttttgcttcaagtgaatttggtggtggcgaatatattggtagagagtgggtgggtgactccggaggtaaaaccggcggtgtacgcggtctttgtggggagctgtgggccggtgcaggagatattcagatgcgaagatctgt

SEQ ID NO: 11774 - DNA, 547 bp, Gossypium hirsutum
  Clone ID: uC-gsflmaxxa106a01b1
cgaattcacttataagagagaagaaagggaaaagaaaatgtgttcactttgttcagatccggttcacagaattcatcctgagccgatcgatcacttcgaccgtcttcccgattctcttctccctttagtcttcaacaagatcggtgacgttaaagctctcggccgatgctgtgtcgtttcgcgtcgtttccgttccctcgttcctcaagtcgaaaacgtcgtcgttcgtgtcgattgtgttatctctgacgacgattgttccccttcttcgtcttcctacgataagtcacgcgccgccggtccgatttctaacctcttacgtatccttcttggaggcattgtcaaaccttttcaagctttggttcagtttcttggtccaaaacggcccgttatcaatgaaacccttaacacccaccctgtctcttcctctttatcaggcggtcccggtgccgatgttaatgatggggaaatggagcaaggtggggtgacccatcattcaccgacgcaagtacttagaaatttcaacgagattcgttttctccggatc

SEQ ID NO: 11775 - DNA, 374 bp, Gossypium hirsutum
  Clone ID: uC-gsflmaxxa106a02b1
ggggggggtttcttttgtatgcattaaccctaaaaaaaagtgacttaaatgattttcagcatcatcaatagaggtatttttacagattgaagctatgtttatgggttccttcgtttggatgttggccaatgctcaaaatttttcggaccaaggaaagataggaaggtgaagaagacaacagtgtaaagtgaagcctaaaaaaggtcttttaggctatgggaaatcataattgctttatacccatgcgccattttgaagtaaactattggttaaactcaaaatgatgtgagctgagttgaatttgagacgactcaaaacaaaacattttgaatatagactgatccaaattcaatctaaaattgactcaactttct

SEQ ID NO: 11776 - DNA, 351 bp, Gossypium hirsutum
  Clone ID: uC-gsflmaxxa106a03b1
ccagactcctccaaaaccctcaccacaaaagaaatctcttctatttttccccactctactgcaaaaatgtttcgatccgctgctagatcggccgccggtaagagcctcctccgacgaggatatgcaaccgccgtacctgaacggaaagtcgctgtcttgggcgcagctggagggatcggccaacccttggctctcctcatgaagcttaaccctcttgtttctcaactggctctctatgatatcgctaacactcccggtgttgccgctgatgtcagccacatcaactctagatctgaggttgccggatatgtaggtgaagagcagttggggaaagctttggagggatgtgat

SEQ ID NO: 11777 - DNA, 287 bp, Gossypium hirsutum
  Clone ID: uC-gsflmaxxa106a08b1
accactcgtccgcccacgcgtccggcgaaaccctagccactctctgctacaactcgccaatgggggcttataagtacgtgtcggagctatggaggaagaagcagtcggatgtgatgaggtttttacagagggcgaggtgctggaaataccgccagcatccatcaattgggaggggcaaccatcctacttgtcctgacaaggcacgccgcttgggttataaggccaaacatggatatgtgggttaccgcgtccgaggtaggaggggtggtcagacgcagcaacttttg

SEQ ID NO: 11778 - DNA, 523 bp, Gossypium hirsutum
  unsure (1)..(523): unsure at all n locations
  Clone ID: uC-gsflmaxxa106a09b1
cccactcgtccgtcatgatactcgtggctcagatggcataattgaactcgattagttagttttccgtgagaaattatgaatgcagtgctgttgtgcataggatactactgctgtcagcttttgatcatgagaggcatattaaaaattgggaattgttttacaatgttaatattgaatggggagagttcctgaaattttccgggttttactttgagataagtgatttgagataagtgaaccgtaacccagtttaaggtgattgctagcttccctacggtctcaccaggtgaattagctgatctacgctgcaaggtaattattctgcgaatgaaggctcctaatgtttttctcttttttaggtaatgtaattttttgttcttgtgcaaggatgaagtgttaataccaaattaacagtacttagatacttaggaattttcttttggttngaatatttttctatggaagaccggttaaacatcttgagggagaagcaaaatcttacataatttacaaagtttggttt

SEQ ID NO: 11779 - DNA, 215 bp, Gossypium hirsutum
  Clone ID: uC-gsflmaxxa106b01b1
cacaatttcttcttacccccagaaggggacaatgaaaaggggggtgttggtttgaaaaaaatgtgttttgagatggcccccattaacgataataacgaagctatatctattggcaggatcaatgcttatggtccagggcggagaacccacccttatttatcaaaaggaacgacacccatggcaccattgctcccctgagagtgtcagaaaagggg

SEQ ID NO: 11780 - DNA, 465 bp, Gossypium hirsutum
  unsure (1)..(465): unsure at all n locations
  Clone ID: uC-gsflmaxxa106b04b1
cccacgtgtccggggaatgcctttggagttaaattttacaaaattttcaatctgattttctgcaaatttaatcttcaagtggttgtggtcggtggcttttgaagtgaaattttgcaatttcagtcttcttctttgtgtgttattcgactgaggtttatgttccaaatcgaacatgtaaagatgggagtgttgtgaatgagaagacggctgaagttgtgttattcgattttttttctatctttttcatttataaatttaatccgttaaaatgaaactagcttaacagttgaagcaggcaaaaaactgccctgccctgctctgttgntatctctactatttattatagnaaataatttaatttagaacccatagtattttggtaaatttttattatatttatattatctaactgaaaaaaaaacccacaaaacccttgaaaaaagctgccttccatttgatataaca

SEQ ID NO: 11781 - DNA, 259 bp, Gossypium hirsutum
  Clone ID: uC-gsflmaxxa106b06b1
gtttcattcatcgccttcgcctaactttttctccttcaatttctcaggtaacacatatttgctcaattattatttttcctttttgagggctcttccgattcaattctcaacagttagggtcttgtacagaatctattcatttaattttagttttgatcaaagtaataaaggttttagggttcggcgggttaatctatcttgttggggtgaagatgtgggctgcttcatgccttgcatcgtgctgtgcggcgtgcgcctg

SEQ ID NO: 11782 - DNA, 388 bp, Gossypium hirsutum
  Clone ID: uC-gsflmaxxa106b07b1
atctttctcttcctctagaaggggataattaataaattactgtcgggcgaaaaaaaagggtaagagatggctcgattaatgttaatatcgatgctatttctcttggcaggatcaatgcttatggtccagggcggagatcccacccttttttttcgaatggaacgtcacctatggcaccattgctcccttgggagtgccagtaaagggtattcttattaacgggcaattcccgggaccaaatcttaactctaccaccaacaacaatatcgtggtcaatgtgttcaataaccttgatgagccattccttgtaacatgggacggcgtgcagtataggaagaactcttggcaagatggtgttctgggaaccaactgtcctatcccccctggg

SEQ ID NO: 11783 - DNA, 187 bp, Gossypium hirsutum
  Clone ID: uC-gsflmaxxa106b09b1
gttttttccatctcatgtatcgcagttgacatctactagtcaggctgagaagattcatacaggccagcatggaggagcaagtgtaaatgctcctatggcacgccttgaaccgagaaagaaagttagagatgaagatgatttcttggttcctgtttttgttaattcagagacaggtttacaacatagc

SEQ ID NO: 11784 - DNA, 90 bp, Gossypium hirsutum
  Clone ID: uC-gsflmaxxa106b12b1
ccgaaggtcctctttcgttctttcatttattcagtattgtaaaagatggccgacggtgaggatattcaacccctcgtctgtgaaaatgga

SEQ ID NO: 11785 - DNA, 214 bp, Gossypium hirsutum
  Clone ID: uC-gsflmaxxa106c03b1
gtttctgtactaccaaaatcacctttcagattctctccttctctccctgtcttcttattttctcttagatgcttccgggggcaaacgaaaaaaaaagggtattatctcttcttcttgattgattgatttttcattgataatctcatcaacaagaagaagaatctgctaaaaagaagaataagaagaaacagaggagagaagagaagagaggata

SEQ ID NO: 11786 - DNA, 232 bp, Gossypium hirsutum
  Clone ID: uC-gsflmaxxa106c05b1
cccacgtgatcggctgcccagaaatactgaaggaaagaaacaatcagaataatcagctaataataagcaaatgagcataactttaccaatgaagttgttattgcctttaacttctccaaccagaattccatctccttctttatacacttcttttctatctcttgcaaaccctattttcacttccccctcttcttcatcaacattcaccttcttttcgaagattctcatatct

SEQ ID NO: 11787 - DNA, 65 bp, Gossypium hirsutum
  Clone ID: uC-gsflmaxxa106e12b1
acctatagatgaaccaggacgaccgaaaaagaaagaaaggggggcggatttaaaagaaaatttcc

SEQ ID NO: 11788 - DNA, 235 bp, Gossypium hirsutum
  Clone ID: uC-gsflmaxxa106f02b1
cccacgcgttttcccacgcgtccgcccacgcgtccgctctctgtgcaccacaaacaaacaacaccgaatactgtaaaaaaaacccaccataaaaaagattgtaacaaagagaaataaactatcatttttcgagctttgctcactaaagaagacgatgaagaagaagagtggtgaagtttttcgttttgcgcaaagcaatgccccttaaattactgaattcaatgctcttctgttg

SEQ ID NO: 11789 - DNA, 391 bp, Gossypium hirsutum
  Clone ID: uC-gsflmaxxa106f06b1
tttattgtccgaaaaacatggcaccacaccttaatagggggcctttcaagtttgtacttctattattatccattccagcctctaaagttcaatcagatgcttttgatgttgctgccaagtttggcgcaaaagctaacgggaaaacggatttgagtaagccattcttggatgcttggaaagaagcatgtgcctctgtaactccatcaacaggtgtgattcctaaagggacatatttattatcaaaagtaaacttagaagggccatgcaaggctcctattgagaataatgttcagggcactatacaggctccggctgatcctagtgctttcaaagaccctaattgggttagattctatagtgttgaacattcaaaatgtttggcggaggaatt

SEQ ID NO: 11790 - DNA, 440 bp, Gossypium hirsutum
  Clone ID: uC-gsflmaxxa106f12b1
cccactcgtccgaaaaacatggcaccacaccttaatattgttccttccatgtttgtacttttattattattcatttcagcctctaaagttcaatcagatgcttttgatgttgttgccaagtttggcgcaaaagctaacgggaaaacggatttgagtaagccatttttggatgcttggaaagaagcatgtgcctctgtaactccatcaacagttgtgattcctaaagggacatatttattatcaaaagtaaacttagaaggtccatgcaaggctcctattgagattaatgttcagggcactatacaggctccggctgatcctagtgctttcaaagaccctaattgggttagattctatagtgttgaaaatttcaaaatgtttggcggaggaattttcgatggtcaaggaagcattgcttatgagaagaatacttgcgagaa

SEQ ID NO: 11791 - DNA, 98 bp, Gossypium hirsutum
  Clone ID: uC-gsflmaxxa106g02b1
aggcgttctctaacaactccttcatcttcttacaacccgggggggggtagatataaatataactttcattccacgaaagagaaaggcaaaagaccagg

SEQ ID NO: 11792 - DNA, 481 bp, Gossypium hirsutum
  Clone ID: uC-gsflmaxxa106g08b1
gttcataaccgctgccgtaaatctttatgatcatccattaatggctgcccaaacagtgcccaaactctgtgaaatccttgaaggggacctgtgcaacatgccactaacttctgtttcattggaaaacatcgacccgttaggctcgaggctctcgacatgtttgcctatctctgctggctcatcctatgcgcatgacatggtcgtggcaaccaaccagatggagtttattgatactatcatcacatcaatgccatcagcatcatcttcctcttcatcatccttatcagctttatccagtgggcaatatatcacaaaccctaatcttccatcaggcggttgggacccttggcacgacccattcacattttcttacatgattggggttagatttagctaggtacttcgtctgggggtttacttcagtccacacgcattatttttccctaaatattattttgcccagatttatttattttttagt

SEQ ID NO: 11793 - DNA, 93 bp, Gossypium hirsutum
  Clone ID: uC-gsflmaxxa106g10b1
acgtttactcgtgggcggacgcgagggcggacgcgtgggcgggattaattccagtgattcattcaaccccaccgcgaagaatggaccaggagt

SEQ ID NO: 11794 - DNA, 183 bp, Gossypium hirsutum
  Clone ID: uC-gsflmaxxa106g11b1
gttggttatcctccccaagaggcgccactaaaaaaatacgctagaatagtcctcgccgtgtcagcatgctacccaggtccactgaaaccagtagatcgtccatgcaaatcactgtgtagctcttgtccatcatgagcagaagagaatcgcaccgtggttagggcagtcggaccgtcgtagtcg

SEQ ID NO: 11795 - DNA, 218 bp, Gossypium hirsutum
  Clone ID: uC-gsflmaxxa106g12b1
atttgtaaaatcaaatctttggttctgttccagtccggacaagaaaaagagcaaagaaaccgtgcaaagattctggcaaagcgaatggctcaaaccatctcctacattaccggctctcaactccttccccttaaacgccttccgaatatcgccatcatagatgttagggatgatgaaaggagttatgatggcccttttgctgggtccttcccctattt

SEQ ID NO: 11796 - DNA, 90 bp, Gossypium hirsutum
  Clone ID: uC-gsflmaxxa106h01b1
ccgattagggcatccttacccgtttcttattttcgttggctttttctgccctcatcgatttctgcttattctcccataggtattgcagaa

SEQ ID NO: 11797 - DNA, 58 bp, Gossypium hirsutum
  Clone ID: uC-gsflmaxxa106h05b1
cacgagagggaaagccggaacgccggcaggaccggaccggaaaacccggaccgaccca

SEQ ID NO: 11798 - DNA, 397 bp, Gossypium hirsutum
  Clone ID: uC-gsflmaxxa106h12b1
cgcaccattggcaatgggttacatcgagggggccaacagtttggcaggaggtgccttcaatggagcctgaatgaacccagctggttcattaggaccaatcttggttagctggacatgggacaaccactggatctactgggtcggaccccttatcggaggggggctcgttggcttcatttacgagttaatcttcatcagcaacacccacgagcagctcccaaccaccgattattaagcctaatcagggtttaattgatttggctgtcactttgaaaccggattatttacgatcacatttgagactactatctctttccttgtatatagtgttgaattagcggccgtcgatcttgtttacttttttggtatttatcatacccatcctatatcatgatca

SEQ ID NO: 11799 - DNA, 346 bp, Gossypium hirsutum
  unsure (1)..(346): unsure at all n locations
  Clone ID: uC-gsflmaxxa107a01b1
caggatggtccgaggcttttgagctagcagccaaattctgctatggccttgcagtagatttaacagcagggaatatatctggtccctgatgcctgttgccgtttattccattggggttctttttaaaaaagagggctttaagactgacactatggccaacatgttgtcgatctctttaggggtcgctattgctgcttatggtgaagctaaatttgatacctggggagtgatgttgcagctgggagccgttgcttttgaggctaccaggttggttatgatccagatcttgcttacttctaaagggatcaccttgaatccgattacttctctgtattatattgcnnaa

SEQ ID NO: 11800 - DNA, 288 bp, Gossypium hirsutum
  Clone ID: uC-gsflmaxxa107a05b1
cttatttcaaatcatcaatggcgtattttaaagtagcttttggcttcctagtaacagctttcctgtcagccgcagtttctctggctcaccctggtttgggttttggctggggaggtgttggtgcgccaggtggtcaatttggtgcaccttcatatggccttttcccacagttctatcagttttcatgcctctcagctgaggacattgtcatgtcagttttagagatggccctagctcatgagcctaggatggctgcctttttgctaaggctctcatttccaccattgt

SEQ ID NO: 11801 - DNA, 445 bp, Gossypium hirsutum
  Clone ID: uC-gsflmaxxa107a06b1
gaggtttgcgtgagctcggattgcttaagttcagtggaatgcatgcaagaagctgcagtctagcctaatgtcctggattgaactggaatgtattgtgcatttgtttgcaagaatgaggagagcatttagtgaaggttatataatagacactgggcaacggtgatgtgagcgtcatccattcttccgtcaagcggccattaattgtcagaagctgttcttttgaagatcgaagggaaaagctttttagataccggaaccagaagacctaatagaattttggtcggaaaaacaaattttgcttggctggaggcccttgccggttgtcaacccaaggatccccggagggttgcaaagactcgagttttcgccaccttcagaggcagttatgggctacttattaaacacaatcaccaacttttaccccgacgaagctagttagttaaac

SEQ ID NO: 11802 - DNA, 78 bp, Gossypium hirsutum
  Clone ID: uC-gsflmaxxa107a08b1
atacggggaactgaaagaatgagcccttcaatgaaggaaacatcattagaaacaatggacaaaaagggtgaggatgtt

SEQ ID NO: 11803 - DNA, 278 bp, Gossypium hirsutum
  Clone ID: uC-gsflmaxxa107a10b1
ctcttgtttgatataatcagaggcaaagagagatggcgtctgtaataaaatctgcactcttaattctgcggcgtattatctgtgcgctacatgcgggtgttaggttgctccaggaacagcccaatgatgaccccaaaaacatggacgctattcctcccattgatgcactcaaccctaccgagttgaatggacccggtgttggcattcacgaagatcatgttgtcccaaaaggtgctgaaattggtactcttggttttggattcgaaaggctttcttat

SEQ ID NO: 11804 - DNA, 427 bp, Gossypium hirsutum
  Clone ID: uC-gsflmaxxa107b01b1
cccacgcgtccggtcttgctcattaataagttctataataaagttccaaatggatcgttcctctctttcagtctcagttactttctttcttctgctgattcttttaaccacagagatgggaactatgtcagcggaggctaaaacatgtgagactcaaagcggtaaattcaaggggatgtgcatgagttctaccaactgtgctagtgtttgcaaatcagagcctggttttgacggtggacattgccaaggttttcgtcgtcaatgcgtttgcactaagccttgttaaaccactaagctttgctagataagttacctattatatttcattgccaccaagatttccctttttttttcgcttatcatgcattatgtgcttgagagttgagagacataagacatcttcaaccatatttttgttctccctact

SEQ ID NO: 11805 - DNA, 338 bp, Gossypium hirsutum
  Clone ID: uC-gsflmaxxa107b02b1
cctacgcgtccgcttaaaaagagcaggagggagttagttttggcttctgatctgcggagaaaaacggtgttgatggctgcggcggtggccgggaggattgaacgtcggcgttaacgctgattgtatcggtcgcaccggcgttacgaatgacgtggccatcttaagattccagccaataaaaagaaaaagtgtgtggggggagtgcatccgagctgttttagtcctgggttgatttgaaccgtttcgcttttaagtttgtttttttctttttttcgcaatcttgttttcatttttttctgttttgttggctctatacttattttttttttacttctttt

SEQ ID NO: 11806 - DNA, 362 bp, Gossypium hirsutum
  Clone ID: uC-gsflmaxxa107b03b1
cttgcattttgttttcccttttttttccccacacctttttttaaacccatttgctaaaaatgcactgggttcttccagtgttgcttgccgttatcggagttactgcactgctcgttgtaacttcggtaagtgggtaccgtccatggccgtacttaaaacccaacagctccgacttaatgttcggaggctctaagaaatttgagggctcatcggagtttatccatatgagatatcatatgggtccagtccttactgttaatatcaccattcacccaatctggtccggtcggttggcagaaattccagaagaaaatcatccgtgagttcatcaactcgatctccgcccgtgatttcaaacaccc

SEQ ID NO: 11807 - DNA, 375 bp, Gossypium hirsutum
  Clone ID: uC-gsflmaxxa107b07b1
ttttagccaagccgacaaggctcttgcttccgccatttcattcaaagatggtgaagatttcgatatccttcaatcaccacggaattcagttgatggaagccaaaatgaaaatcctgttccaagaagcatgcctattctgccagtgggcacacccgagcaccatgatgttggcttgagctatagtaaagattccgaggataaaaacggctctgctagtgaagtggtctcaatcgaaatggaaacactaaagggtatctctgaagagagtaggaaagtcaatgctggtgttagtgtagcagcttgctctgttgggcaagcaactgatgccaatgagaacgaaggaagcctgtttaatgaaaacctatcgagtgcctt

SEQ ID NO: 11808 - DNA, 395 bp, Gossypium hirsutum
  Clone ID: uC-gsflmaxxa107b11b1
ctttcctctcctctccacaaaacagttgaaaatatctctctcttcactttcttctcttttcaacgcagggtgaaaggcggggaggccgtagacaatctctcttgcgctcttctcgtagaatggatcagattcaacatccaactgtcatgcagaaggtagctggccagctcctttcttctagcatttcccgagattttcaagggtatgatgggtctttcaggaggcctgccctataccaaggacattttgcatatgggaattattccaatgctggaatgcactatcctattgttccatcaacagctaccgtcatttgtgttcaagcccctgcagagaaaggatttaccagctttgccattgatttcctcatgggtggagttcttgctgctgtgtca

SEQ ID NO: 11809 - DNA, 433 bp, Gossypium hirsutum
  Clone ID: uC-gsflmaxxa107c01b1
ggaaaaaaaatctttactaggaaaagagagagatcaaaagatggagacatgaaagctattcgggttatttggtaaattacaggactgcacaataatttgtttggaagttcatacaagttgtaatgcaaggccaaaggggtacttttggttccttgcctgaaaccttatttgatcatgggtcttcatcaagtaatgctgctatagaccagcaagtatgctggaataatatccgaaatcccattgaaagcagattgtcggattgtttgctgtcagctaatgatgcgaatattggacatgggaactctaatgctggagaggatcaggagctgggtcggtgcagcttgggagagcctagctctagtggcacactgagtgttgtaagccataacgagcggaaaatgaaccatgggtggtcattttccatgagtgcttt

SEQ ID NO: 11810 - DNA, 319 bp, Gossypium hirsutum
  Clone ID: uC-gsflmaxxa107c02b1
cccacgcgtccgctttgatgttcgattaccataggcagcatggcatagagattcgaattgctcggatcttcaacacttatggaccacgcatgaacattgatgatggtcgtgttgttagcaatttcatagctcaagcactccgcaatgagcctttgactgttcaattacctggaacacagacaaggagtttctgttatgtttccgacatggttgacggcttaattcgacttatggaaggagagaacaccggaccaatcaatattgggaattcaggtgtatttaccatgcttgagcttgcagaatccgttgaaggagctta

SEQ ID NO: 11811 - DNA, 283 bp, Gossypium hirsutum
  Clone ID: uC-gsflmaxxa107c05b1
cttctaagaacgctttaccatcaaaaccagctagctaaatcaaccgcatttcaccaggatggctagaggattgaagaaacacttgaagaggctcaatgcccctaggcattggatgcttgacaagcttggtggtgcttttgcacccaagccatcatctggaccccacaaatccagggaatgcttgccattaattctcattctgcgaaacagattgaagtatgctctcacgtacagagaagttattgctattcttatgcagaggcatgtcatggttgatgggaag

SEQ ID NO: 11812 - DNA, 514 bp, Gossypium hirsutum
  Clone ID: uC-gsflmaxxa107d02b1
gttttttatgtataagaaattgctatatgcaatcaatgaagggcaaggatcttttgatttgtcatgagtccaccgccgcaaggctaacgaacagaagagagttgtgtggtgttgtgttgaggcagtgtgtatatttctgaacagcacaatccgagggtcaatttttctcacctgctgcgagtatttttgatgttccaaagtagcatattgattttgctcaaataatggcatttctcttcactgctgcgtctccgttactagttttaatggggtgactatcttttccaacttcaaacttttctcaaatcctgggtagacacaaatctgattttttcccctttagtatttctaatattttccccagttgcatgcgacttatatgctaaagcacggaagaatttagtaggatgttttttgttaaagcacttttgcattcagctgctagagctttgtatataaaattagggaggaaaatgaataaaataatgatgaaattgtaattctttttcttttt

SEQ ID NO: 11813 - DNA, 520 bp, Gossypium hirsutum
  Clone ID: uC-gsflmaxxa107d12b1
cccacgcgtccggaaaatatctcaaatctcctcctcctcctcagaaatcttagtatcatcaccatggcctcaaatcccaaggtcttctttgacatgactatcggtggtcagcccgctggtcggattgtgatggagcttttcgcagattgcactcctcgcactgctgagaacttccgtgccctctgtaccggcgagaaaggcgtcggccgcagcggtaagcccctccactacaaaggctcctctttccatcgtgtgatccctaactttatgtgccaaggaggtgacttcacggccggaaacggtaccggaggtgaatccatctacggatccaagttcgctgacgagaacttcatcaagaagcacactggtcccggtattctctcaatggctaacgctggtcccggaactaacggatctcagttcttcatttgcacggctaagactgagtggctcgaccgaaagcacgttgtgtttggacaagttgttgaaggcatggatgttgtgaaagccattgagaaag

SEQ ID NO: 11814 - DNA, 70 bp, Gossypium hirsutum
  Clone ID: uC-gsflmaxxa107e12b1
ctcacgcgtccgtaagaatcaacaatggcgacgggtctttttacaacaatcctcttgttttcttcccttg

SEQ ID NO: 11815 - DNA, 136 bp, Gossypium hirsutum
  Clone ID: uC-gsflmaxxa107f02b1
atttatttcactacccaacaacccaaaagataaaggaatcgtttacttgttcgtagcaatttatcgtcatttcaagctcaagtctctgaaaatttttgtgctgaactccttttttctgcttgcactaccatgtgtt

SEQ ID NO: 11816 - DNA, 85 bp, Gossypium hirsutum
  Clone ID: uC-gsflmaxxa107g08b1
tcttattttgtcgaagacaaaatcactgtacaaaacgaacatttttactattacattcgactagggttcgtttttacaaagaaga

SEQ ID NO: 11817 - DNA, 93 bp, Gossypium hirsutum
  Clone ID: uC-gsflmaxxa107g10b1
tctatttttgtgtagcgattctcagttagtcttttctttaagcttacagcttctctccagagttttataatgggtaaggagaaggtttacatt

SEQ ID NO: 11818 - DNA, 174 bp, Gossypium hirsutum
  Clone ID: uC-gsflmaxxa107h01b1
ctgtctttcctctccacaaaacacttgaaaatatctctcttcactttcttctcttttcaacgcagagtgaaaggcggggaggccgtagacaatctctcttgcgctcttctcgtagaatggatcagattcaacatccatctgtcatgcagaaggtagctgtccagctcctttctt

SEQ ID NO: 11819 - DNA, 532 bp, Gossypium hirsutum
  Clone ID: uC-gsflmaxxa107h12b1
actagatcagctcccactacatcttcaataccaaaatcagcttcccttacttcttcacttatgaaatcagctcctgctacatcttctgttacaaaatcaggtactgctgcgtcttccataacaaaaccatcagctgccactacatcaaaaagctcagtacaatcacggggcacatctccaaccgtgaagtctaggccttggaaagcatctgagatgcctggattttcgcttgaaacaccaccaaatttaaggacatcattgccagaaagaccggtatcagcctcacgggggaggccagcagcacctggtgccagatcatcttctgttgaggccaattctagtggaagaccaagacgccagtcctgctcgcctgctagaagtagggcatcaagtggcagttttggtaatgggagctccattcgttctgtgcgtagagcagatgccaatggcagtgacaacgaaagtccagtagtgattgtgacaaagatggttgagagagtggtaaatatgaggaaactggtacccccaaaac

SEQ ID NO: 11820 - DNA, 449 bp, Gossypium hirsutum
  Clone ID: uC-gsflmaxxa119a02b1
ccctcgcgtccgcccacgcgtccgctccaaacactagtagaaggtttagttttacaaacatggctagttccggtgtccttaagttggtttccatgattctcatggtgtgcatgacgatgatgagtgcacccaaggcagccaaagccgccatcacgtgcagcgacgtggtgaaccacttgatcccgtgcttgtcctacgtacaaaacggcggtacacccgctgctgcatgctgcagtggggtaaaagcactctacggcgaggttcagacctccccggaccgccaaaacgtgtgcaagtgcatcaaatcggcggtgaacggaattccgtacaccagcaataacctcaatctcgcagccggcctacctgctaaatgtggtctccaactcccttacagcatcagcccctccactgactgcaacaaggtgcagtgaggttgatgatgatgatat

SEQ ID NO: 11821 - DNA, 196 bp, Gossypium hirsutum
  Clone ID: uC-gsflmaxxa119a03b1
aatcaatactttactttagtttggcgtttactggggcaatttttgattattacgcactgttggcccctcctatcctctgctaaatggagctgtacacatcaactatgctatagctgctcatttagggatcaatctgtccttacgcgctgagaagaaggtgttttggaggtgggagcggtagctaacttcatcgatc

SEQ ID NO: 11822 - DNA, 236 bp, Gossypium hirsutum
  Clone ID: uC-gsflmaxxa119a08b1
ccaaattttggcattactttgttgagtgttttcaggggattctattattcattttgggctggtgggtttttgtttcttttgggaggagttgacctaaaaggctaacatcaaattggtgtctgattaggggattctctggtcttaggcagggatttgaaggtgtttttgaagtgggtttggtggctttttttcttcttcttctcaaatggtgtccatgtaatgaatctggtgatgga

SEQ ID NO: 11823 - DNA, 534 bp, Gossypium hirsutum
  Clone ID: uC-gsflmaxxa119a09b1
tcccggcccccggacttacatacattaactcgccgggggacgttagggggacatctgaagaaatgggggcgtgtggcataatccgcccttctgtgatgcaccagatgtagatgcttcatcactcaactgctgccatggggctgctgaataaaaaatgcagcatatggtggtaggtcatgtttattgcgacacttgccgtgttgaatttgagaccaaactcagcgaacccattagtggagcagtagtgaaattggaatgtaggaaccgtaccgacgaagcgattaccttccagagccaagaaatagtggctgacaatttcggagactaccacatcatagtggaaggcgattatgaggaatcagactgcgatgttgctttggtgaggagtccaagggctgattgcagcgatcccaccgaagcgtggagaaaatccagggtgtgctttaccacattcgatggtcttagcgggtaactccgttttgccaacatcttggctttaagaaggacaaagtcctttcttagtgcactcgattc

SEQ ID NO: 11824 - DNA, 188 bp, Gossypium hirsutum
  Clone ID: uC-gsflmaxxa119a11b1
tcccgggtcgttccacgcctccgggtaacaggagcaatgggcccagtgcgatgatggctccaaatggcgaaggttaccagttgatgatctcctcccttcaaagtggaaatgttctgataatgtttgggattctagcatgtgggcctgtaatgaccaaaacactctatccattattagcagttgaatat

SEQ ID NO: 11825 - DNA, 452 bp, Gossypium hirsutum
  Clone ID: uC-gsflmaxxa119b02b1
acttagcacacgtgaactatgcaaatcaagctggggggaatgtagaagacatttgcccggcttttcccaaaaccctgttcattacggaagtatagatcgtagactaaacctatttctacttatctctttactcccaaattaggggcaaaaccgctctcggtggtgtatgtacatacagatgttcaaaagagtgaaaattttcctggaatatcagttcttcgatcagtctccgatgctattccgatgaacctcaagaacaatctcgaggatgtttatttcttgcatcctggattacaggccagacttttccttgccacctttggccggttgtttttcgacggagggttgaattcgaaacttaaatacgtgagtaggcttgaggttctatgggaccatgtgaggaggttggagaagaaaataccagactttgtgcatgaccatgatgaagagct

SEQ ID NO: 11826 - DNA, 56 bp, Gossypium hirsutum
  Clone ID: uC-gsflmaxxa119b03b1
ccccgcaatataaaacttcaactttccaactcaggcggggggaaattagaagccaa

SEQ ID NO: 11827 - DNA, 554 bp, Gossypium hirsutum
  Clone ID: uC-gsflmaxxa119b06b1
cctcgcgtccgcccacgcgtccggcagctgccttggatcattcaatttcacaaaacacccaacagggaatggtttgaaacagatgcggtgctgagggtcagcttgtgaaattttctctttttcactatcctatcatttttaatgattgttgttaaaattcatagtgttttttctgttgtgtttctctattctttttttatttttttctttatattttattttttttttcatcttttcttatctatattttttttatatttttttttttatttattttttttttattttttttattttctttatctatttttttttttttttttttattctttattcttttttctttttttatttttttttactttcttttttatttacttttatttttttttttatttttcttccttctcctttcttctcttcatatcctttatcttcttcatttatttttttcctatctttcttcctttttattttcttttcttccttttctctatttctttttttatttatctatcttttcttttattattattttactttttttttttttt

SEQ ID NO: 11828 - DNA, 280 bp, Gossypium hirsutum
  Clone ID: uC-gsflmaxxa119b07b1
tcttagtctttaaggtcaaaggcagagataaacgcggtcgtaatgttcttctcatcatcggcaaatactttcctgctcgcatggttagtagtgaggttctgaagaagtatttagaagaaacgatttaccccaaattaggggcaaaaccgttctcggtggtgtatgtacatacagatgttcaaaagagtgaaaattttcctggaatatcagttcttcgatcagtctccgatgctattccgatgaacctcaagaacaatctcgaggttgtttatttcttgca

SEQ ID NO: 11829 - DNA, 150 bp, Gossypium hirsutum
  Clone ID: uC-gsflmaxxa119b08b1
cattatcccacttcaacttttcaactcaagctgcagcgaaagtagaagccgaagtacaaacgatagcgaaaacacagccatcatgtggagaagagccctgatggatagcaaagcttgccaatcatggtgccttatagcaaaaagaggttc

SEQ ID NO: 11830 - DNA, 74 bp, Gossypium hirsutum
  Clone ID: uC-gsflmaxxa119b09b1
gataatatatcagaaaaactataaaaagaagtgtgtcaggtcaggccctagttccccatgggatcgctctggct

SEQ ID NO: 11831 - DNA, 509 bp, Gossypium hirsutum
  Clone ID: uC-gsflmaxxa119c01b1
aattaacacccaattgaccaccatgtttaaattaatcaacatcctaaccatccttgtgctacttacatttagttcggaaattgcagatgccgcacctccgtgccaggaggttatcgtgtcgattaccccttgcttgagcttcataaaaggccaacccgatccggcaccaggatgttgttcgggtgctaaagggcttgctaagcaagctaacaccaaactagataggcaaggaatatgcgagtgccttaaaggtgtattgccaaaaataggaccatatgaccctaaaagattccctcttattgcccagaaatgtggtatcaatactttaattcctccaatttctgccactactgattgcaccaaggtgtgaagagtgaagtggggggaatgtgaaaatgaagagcatgccaaatgaataaaaaaatgggcagaacttttcataaattgatctgtaatcaaccccttgtattgcacttaagttatgattaattaaataataattacaattt

SEQ ID NO: 11832 - DNA, 94 bp, Gossypium hirsutum
  Clone ID: uC-gsflmaxxa119c09b1
gaataatggagtccaacaccaaaatgtcagctcttgttttgctttgcatgcttttcatttcttcagtgacaccaattcttgggtgtggttcatg

SEQ ID NO: 11833 - DNA, 123 bp, Gossypium hirsutum
  Clone ID: uC-gsflmaxxa119c12b1
cttttaatggcgaaaccacacattgtggtaatcccgtatcctgtacaaggccatgttattcctctcatggaactctcccaaaacttggccaaacaaggcatcaaaatcagttttgttaacaca

SEQ ID NO: 11834 - DNA, 96 bp, Gossypium hirsutum
  Clone ID: uC-gsflmaxxa119d03b1
gctcgcgctcttcaaatccatctccacgaattggaaggaatcactctacctgctccttctactgctctgatcttagctccacggatcgggtatttg

SEQ ID NO: 11835 - DNA, 102 bp, Gossypium hirsutum
  Clone ID: uC-gsflmaxxa119d04b1
ccctcgcgtccgcactctctcaacgctatctttgggttccttttacaagggagagcgtgatctgcccttcttaactctatctcactaacccatgcgtatttt

SEQ ID NO: 11836 - DNA, 303 bp, Gossypium hirsutum
  Clone ID: uC-gsflmaxxa119d05b1
aattttcaccataaaaaactcttactttattgacctgacctctcttaatgttaaatagcaaaggaagtaagagaacttgagtattaaatcccaaagtttcattattgatttctctggtcacaaatggcaaaacttagagttaccatcaccggggatggctcaagcaaggtggtgaagatgggagatgatgccttggttgttcatagtatattgattgttaacatatcattctttcctgtctaatccttgttttattgttcctaacacttttttctagttttttttcttcctctcttcctcttc

SEQ ID NO: 11837 - DNA, 65 bp, Gossypium hirsutum
  Clone ID: uC-gsflmaxxa119d09b1
gaattgtcaagagatagatgcttgggtactgctggtgaggttttaatggcattttctccaaggac

SEQ ID NO: 11838 - DNA, 96 bp, Gossypium hirsutum
  Clone ID: uC-gsflmaxxa119d11b1
tccaccccccggtatgtagagactatacattagcaatggcttgtcctctatctcataagaggctccgtctcatccaacatccttcataacatctta

SEQ ID NO: 11839 - DNA, 209 bp, Gossypium hirsutum
  Clone ID: uC-gsflmaxxa119e03b1
actcgctcttcctcccttctcgtacttcgcggattttcttttggtctcatttcaattttttcctgtcattcttttatagctatgtgtatccacgggcaaaacacacacacaaacaatcaacagttggatgatagtctacgagagagggagaaacctaaaagttcttctttgttactttaaactgatatcaaatatctatatcttaattt

SEQ ID NO: 11840 - DNA, 86 bp, Gossypium hirsutum
  Clone ID: uC-gsflmaxxa119e05b1
cattgattatttggatgatccagctgaggttgggggcatgtttaaatctcttgccgcggcattaacaccttaacccttctcaaaca

SEQ ID NO: 11841 - DNA, 56 bp, Gossypium hirsutum
  Clone ID: uC-gsflmaxxa119e06b1
atgtggtgggagcctccacttctacctatgaaaaatgtgatattaagctgttttcc

SEQ ID NO: 11842 - DNA, 58 bp, Gossypium hirsutum
  Clone ID: uC-gsflmaxxa119e08b1
acccccgccctcgcgtccgggagtattctgatgtgtcattggcaaggcattaagagaa

SEQ ID NO: 11843 - DNA, 105 bp, Gossypium hirsutum
  Clone ID: uC-gsflmaxxa119f03b1
tgtaatccctggaacttttttctgttcatggtaggcttttcttaaagcattgtctggctaataatactctgggtttcgctttctgcattcacgaaattgtaatgt

SEQ ID NO: 11844 - DNA, 121 bp, Gossypium hirsutum
  Clone ID: uC-gsflmaxxa119f06b1
gtttgcagtccgacccacagagaaaaggggactggcgtcaaattctctgctactaaccgacccatttcttgcaatcacctcttcctcctcctctctctctccatctcttcaaacaaaacca

SEQ ID NO: 11845 - DNA, 512 bp, Gossypium hirsutum
  Clone ID: uC-gsflmaxxa119f12b1
gtttaaaaaaatcccgagcttcaacactccaggcgctcactgattaatttcaataaaaagaagaaaaagacagttgctcactgatattggtgtagtggcagagcagtgaagagaatcagttgagatatgtctaagcaaggagaagtggtctgcgtaaccggtgccagcggcagcattgggtcttgggttgtcaaactcctccttgctcgcggctacaccgtccacgggaccgtcagaaatctcaaggacgagaaagaaacgaagcatctagaagctctagaaggagcagactcacgtctccgcctcttccagatcgatctcctcgattatgattcactcgccgccgcaatcaatggctgtgctggtgttttccaccttgcttctccatgcagcgtcgatcgagttcacgatcctcagaaggagcttttggatcctgcgattaaaggaacgcttaatgtactgacagctgccaaagagcttggtgttaaacgtgtgttgtttacgtcttcaat

SEQ ID NO: 11846 - DNA, 174 bp, Gossypium hirsutum
  Clone ID: uC-gsflmaxxa119g02b1
aaataaattccttttttttcagtctgctctccctagaaagcttccattttttttcctttttaaaattcctctatttctctctttcttcacaacaacaacaaaaaagtttcaatccaatctcaattattcatgtcggaggacaagggtcggccattgccgaaatttggtgaatgg

SEQ ID NO: 11847 - DNA, 62 bp, Gossypium hirsutum
  Clone ID: uC-gsflmaxxa119g04b1
cataactctctgtatcttcactcacttcacctgagattttatttgatattgttccccggtaa

SEQ ID NO: 11848 - DNA, 247 bp, Gossypium hirsutum
  Clone ID: uC-gsflmaxxa119g11b1
cgtactcttacttactctgataatggcttgcaaaattagttccttgctttctcacgttttcatcctcagcattctgtttgttattgctgggcaagccattgcagcacgtgacatctcgaagaatgatgatcaaatgaaacagtctgaatatctaaaacatgaccgtagtgtgctcattccaggccttggacgagtgttgctgccaccagttactaatacatacatttcacacactatcggctctgtc

SEQ ID NO: 11849 - DNA, 61 bp, Gossypium hirsutum
  Clone ID: uC-gsflmaxxa119h02b1
ccgtccgaattcccgggccaaccaacccccccagatcgagaccgctcgcgagataacaagg

SEQ ID NO: 11850 - DNA, 103 bp, Gossypium hirsutum
  Clone ID: uC-gsflmaxxa119h03b1
gaggtccccattttttttcctgagaattatatttaggattcttttaatccaaacgctcatgagatcacggccaacacttggttcaccgaatttgaatagatct

SEQ ID NO: 11851 - DNA, 495 bp, Gossypium hirsutum
  unsure (1)..(495): unsure at all n locations
  Clone ID: uC-gsflmaxxa119h04b1
gtttaacaaagcaccattaccgccgtcaggtgcattaggaaagcaagcagtggcactgaggatatcagcagatgcagcagcctttatcggttgcaagtttattggagcacaagatactctttacgatcacattggcaggcactacttcagacactgctacatccaaggttcggtagatttcatattcggaaatgggctttccctgtataaacactgccacttgcatgccgtaaccaacagctatggagccttgacagcccagaaaagggaaagcatgcttgaggaaacaggcttctccttcgttaaatgcaaggtcacggggtcgggcgccctttatctcggtcgggcttggggcgttttctctaggggtggtctttgtttatacttacatggacaagatcatcacccctagaggatggtatgactggggagacanaaatagagaaatgactggtgtttacggacagtataagtgctcaagacctggagctgaat

SEQ ID NO: 11852 - DNA, 278 bp, Gossypium hirsutum
  Clone ID: uC-gsflmaxxa119h06b1
cgtccttgacatttagcgttggcaacaccatgaggcgtatatcagttatagtctcttccatcatcatcttccacacgcctgtccagccaatcaatgctctaggagctgccatcgctatcctcggaaccttcttgtattctcaggcaaaagcgtgagaaaaaccaggggttcgagaattttgattcatcatacaacatagatgatgaaagacaaaatcggtatccgaatgaatttagctcagatgagttcttatagactactactgtctttttgaattg

SEQ ID NO: 11853 - DNA, 91 bp, Gossypium hirsutum
  Clone ID: uC-gsflmaxxa119h09b1
ccccgccctcgcgtccggtaaaaacttgggatgagtttataaaagctttagggcaaaagaaactgatctcagctccttggtgtaatgagga

SEQ ID NO: 11854 - DNA, 137 bp, Gossypium hirsutum
  Clone ID: uC-gsflmaxxa119h10b1
cgcccgcacttttcgagtagaatcccatcaaatttctcatggagccaaacagaaatctcatccccctacaaccccacttctctttccaaattagatagaaagaaggtgagggatttacattgattgtggttgacaga

SEQ ID NO: 11855 - DNA, 157 bp, Gossypium hirsutum
  Clone ID: uC-gsflmaxxa119h12b1
gtccggatttcccgtgtcgttcaaccaccccccgaatcctaggcaatctcctcacaatctctaccgtaagtcttgtttaaagctttggacgggcagaatcaccattggaaatccttcggccctgaaatcggaccccaacctgtaaagctacccgttc

SEQ ID NO: 11856 - DNA, 320 bp, Gossypium hirsutum
  Clone ID: uC-gsflmaxxa002a01b1
aaataaatttgttctcaacccttgagtaaatagtgtaccagaattacataggttaaagtgtgaaaacttctacaagtttcagtggtgtattcaagttatctgtgctgtttattatatttatttattacctatattttttttttttttctatcatatttttttatctttaattttatttttcttttattaatttttattttattattttttattttattttttattcattttatttaattatcttttaattttttttttttttctttattttttattataattttcttattatacttttttatcatttttatttttttttc

SEQ ID NO: 11857 - DNA, 266 bp, Gossypium hirsutum
  Clone ID: uC-gsflmaxxa002a07b1
gcgtttgtctcagatctcagaagatggcccgtaccaagcaaaccgcccgtaagtcgactggtgggaaggctcctaggaagcaacttgctaccaaggccgcccgtaaatctgccccaaccactggtggtgtgatgaagcctcatcgataccgtcctggaactgttgctctttgtgaaatttcgtaagtaccagaagagtactgagcttcttatcaggaaattgcctttcctgaggcttgtttgtgaaattttcctggtttccatgac

SEQ ID NO: 11858 - DNA, 532 bp, Gossypium hirsutum
  Clone ID: uC-gsflmaxxa002a12b1
tttattttcgtcatttccttatatatataaagctgaaggttaattttaaattttaatggtgtatttaaataatctctaattttatttttattataatatattttatattttaaatattttattttatattaatttttatattattattatttataattaattttataataatatattttataatttataaatttatattaatttaatttatttttttcatattttttatatttatttatattttattaatatttttattttataattataatatatatactatttttatatttattattattatttcttttactatatttataatatatatttatataaactttattaattataataattattttatatatttataattatacataaatttattgttatattatttatatataatattattataataaatttaataattatatttatattttaaattatatatattaactaaattttatttatatattattatattaattattattttttaaaatcttattaaatttatttt

SEQ ID NO: 11859 - DNA, 79 bp, Gossypium hirsutum
  Clone ID: uC-gsflmaxxa002b01b1
gcagtctccattacaatccgtattgtgctcggttggatggtattgacatagatatggaagttttactccacccccccac

SEQ ID NO: 11860 - DNA, 477 bp, Gossypium hirsutum
  Clone ID: uC-gsflmaxxa002b04b1
tgaaaacatgtctcgaaagagagacaaaccctacttctcccgtcacgccccagcttccatctctaaacggcgtcgtcctctgccacctcacccgccacctctgccgtcttctgagaatgaggccaagccaaagtcgccaccggctgttattgtcatgggtcttcccccgaattgctcggtgctcgatttgaagtcgaggtttgagatctacggttcgatctctcgcatccgcatcaattgtgatgctgtcggttacattgtatatcgcactaaggaatccgccgagtccgccattgcggcttcccttgattcctctttcggcatttaccgttgattccaaaagggttcaaggtcttgtgggctcctgatcctttagctcaatggagagaccgaatagggctaaatgcatacacccattatggggcatcttttttatcaaggattctaggtctgaggtgccttttattagtttttgtc

SEQ ID NO: 11861 - DNA, 438 bp, Gossypium hirsutum
  Clone ID: uC-gsflmaxxa002b08b1
gaactcggtagctctaatttccccgtcgttttaatccaaatcccaatgttcaacgaaaaagaagtttacatgatctcctttggagcagctttcggacttttcatttcttttttcattatttttttattttttttttctttttttttttttttcctctctcttcttttttaattttttttttctttttatttttatttctatttttttctatttttcttctttttttcttattctcttatctttctctttacttttccttactttttacttttttttcttttctctttttttatcctttttcttttcttctattattttatttttattttttttttattttttcttattttttttatttttatctttctatcttttattctcttcttatttttcttatctatctatttttctattctttctttttattctttttttttc

SEQ ID NO: 11862 - DNA, 60 bp, Gossypium hirsutum
  Clone ID: uC-gsflmaxxa002c10b1
atctaaatatctgctcctctcagtccccctcttcgccgggtttatttttaaaaatttttt

SEQ ID NO: 11863 - DNA, 140 bp, Gossypium hirsutum
  Clone ID: uC-gsflmaxxa002c11b1
tcccacgcgtccgtgaattgatagcaaagaggaagcggtaatttaattgattaagcttaatgcctgaaaatgttctctctcctcctctcctcttttactttctactttttttttcctctttcttccttttccttttcttt

SEQ ID NO: 11864 - DNA, 499 bp, Gossypium hirsutum
  Clone ID: uC-gsflmaxxa002d04b1
taaaaacattatctttttaaagttcctttgttccccttcggttttcataaaaattaacgccggagaattatgctctgccggagaattttactaataaaagtctggaacaacggtcgccgatggcttcttccttcttcatctctgtcgccggttccaacgacggcggactacaaacgtcacttctccactcacattatggcggcgttttcgttgccccaaaataaccaattcactctgaaaattccatatatggaaaatagatgtaagttttcaagtaatgctgtggctgatcttcatactaatggaatagttgatgtcccattggctcaaactggtgaaggtattgctgaatgtgagcttcttaaatggttcattcaagagggtgatgaagttgaagagtttcaacctctttgtgaagttcaaagcgacaaagcgacgatcgaaatcacaagtcgttacaaagggagagttgctcaagttcttcatgttccccgaaata

SEQ ID NO: 11865 - DNA, 448 bp, Gossypium hirsutum
  unsure (1)..(448): unsure at all n locations
  Clone ID: uC-gsflmaxxa002e12b1
tcggacgcgtgggcttatacaagcccaatttgtgggggccaaatggcttgggaaagcaatccctgtataatgtcagtattactgttgatgtcaagggatatggagagtctgatacgtggggccatctatttggtattcgcaagatcgagtctcacatagatagtgctactggagggagattgttcaaggtaaatgggcagcctatttttatccgtggtggtaactggatattgtcagactgtttgctacgcctttctaaggagcgtttcaaaacagacataaaatttcatgcagatatgaatctgaacatgattcgttgttggggaggtgggttggctgaaaggcctgatttttatcattatagngatgtttaaggagtggtggtatggcaggagttttggattactggtgatgttgatggaagaagtatcccagtatcaaatcctga

SEQ ID NO: 11866 - DNA, 377 bp, Gossypium hirsutum
  Clone ID: uC-gsflmaxxa002f05b1
ctctttctttctgaaacgctatgtaaaatggagtatagggtacataggcacataactcggatacaccgtgctttgtcgatacagtcattgggcgggcggccgaataaaccaaaacctaataaggataacataatagaagaaaggggctgctgagatatgagagagcgaagcagtcaacataggttgaaagaaaaagaaaaactccgaggaagaagaagtttactggaaggggcaggtatgatgaaattcaagaagggaaggcccagactaggcgagcatgtctttgctgtgcatgacaccctatgggggcgagcaaaagattcgctgttgcaacacgatggaggccactaccgctgaatactagaaggctaggtatg

SEQ ID NO: 11867 - DNA, 504 bp, Gossypium hirsutum
  Clone ID: uC-gsflmaxxa002f09b1
cttacattaaaaaaaaaaaactccccattacggtcttatcttaccccttccatttttaatttcgatttttccaaggcttacaaggaaaaaataaaaatttccagaaattattaaattttatatataaaaaggaaaacccactataaaagattccaagaaattgagtcttttgatgaattcatcagtagtgtatctctttttgtttggttcctcggaaatctaaaatgcgaagaaacgagtgtttcgtgttatgaatcgagctttgtaaacggtgaagcaaacgagtagaaggagagagaattttgttttggaagatagaaattgaagggttgggagaaaagatcagagaaatggcgggagagaagaggagattcgcgattggttacgcgcttttgccgaagaaagagaacagtttcattcgagaatctttggtgaacctggcgaaatcacgaggagtggatcttgttaagatcgatagggagcgttctttggtcgatcaagggc

SEQ ID NO: 11868 - DNA, 498 bp, Gossypium hirsutum
  Clone ID: uC-gsflmaxxa002f11b1
gttttgtatttcatactcatttagcccctttcattagcatcgaaatcactccagttttctttatcactgaaaaatgtcttgctgtggtggaaactgtggctgcggttctggctgcaagtgtggcagtggctgtggaggatgcaagatgtacccagacctgaacgttgccgagatgaccacaactgagactctggttcttggtgtagcaccccagaaagcacactttgagggagctgagatggaattcggggctgagaacggctgcaagtgtggagacaactgcacctgcaacccttgcaattgtaaatgattagagaccaaagccaaagctccctggaagcagagacgcctttgtctttaagaaataatatgttttgttgtttatgtgtttttagaataaagtagccatggcttgtcgtaggttatgcctgttgccgccacggttactaggtgcttgccaatagatagagtgaagtactaatatttacttggttttct

SEQ ID NO: 11869 - DNA, 509 bp, Gossypium hirsutum
  Clone ID: uC-gsflmaxxa002g03b1
cttaatccttgagccttaagcagatctggatcttctctttgaaagaaaaaaaaaggaaaagaaaaaaaaacacgttaaaaacggtttcaacttcccgggaacatcacagctcgtttcttgatcattaatctcagctgtcagttctaaagggctaagcttagagaagatcgaagatggtgctggtgtcggccgtacgggattatgtttaccggatgttacaagacatctccggcatgaaagtcctcattcttgattctcaaacggttagcattgtgagtgttggttattcccaatcagagctacttcagaaagaagtctttttggtcgaattgatagactccatctccaagtcaaaagaatctatgtcgcatctagggcagcttatttcctttggcctacatcagaaaatattcaatatctgccgcgtcagctatctaactctaagtttggagagtgtcacttggttttctcagacatgatgaaggatactcagattcatcttttagctg

SEQ ID NO: 11870 - DNA, 398 bp, Gossypium hirsutum
  Clone ID: uC-gsflmaxxa002h01b1
cctttgctttcgcgaaagctacctccaccctcttggtcgggacatcaaacaagaaccggctctgacattcatccctcatattccttctttcgttcctgaaggtaactgctaaaaaactggaggaacgaccattccaataactctaggaaaatcgaagaggcctcctcgtttactgagcaggaacttagggctttgactaggtatttgatcttaaaattttgacaaggttgcctgtcttaagattttcttgaactccatcctttctgggttagagctattagctacccaatttgctccatacataaatcgttgcccagctgaagctttagttgcatttcaagaggtttggtaccttatccaatcttctaaactgaagaaaaattgtcagactctcaaat

SEQ ID NO: 11871 - DNA, 522 bp, Gossypium hirsutum
  Clone ID: uC-gsflmaxxa002h09b1
attgttttctctgtttgccatttgccttaatcatggtcctctttctttaaaacctcttcctatttaatttccgactaaacttgcgctgaattccatggctactgcagaggttgtatcagctcagactgcaatccatgaggagaaacctgaagaagtggtcaaggttggagaaattgcaacagaagaggtaccggctgttgctcctgcagcagaacctgttgctgaagaaccaaaggaagcagtgcctgaagcagcatccggagaaccccaggctccagaaactgaagccacagttgaaactgaatcaaaggagggtggttaaagagcccaaggctgtgactgaggagccagaagttgagaaaaaagaagaagagactcctaaggaaacggtagcagagccagctgccgaggagtccaaggagtccaaggagacttctgagccaacagttgaagaaaccaaagaaagcacagagtctacagcagcagcagcagcagcagcagcagcagaagtaaaagcagaag

SEQ ID NO: 11872 - DNA, 507 bp, Gossypium hirsutum
  unsure (1)..(507): unsure at all n locations
  Clone ID: uC-gsflmaxxa002h10b1
cccacgcgtccgcttggctcaggggattcgagttacagttgttcttgccagcaggaatgatgtcgaacatgtacggatgccatctgcagttagatttcgcaattccagatcctatgatcacaggaggaatcggatgaggcaaaaggagaacattgctgtgccttctgtagctaaactatacaattcgaagtcttaccagacaaaaaggaatgatgggaaattcgagctctgtgcctgcactatgctctggaaccaggcaccagcactgcgggagtggattatgtaccatacctggctcggagttgaacgttggttcatttatgacaataatagtgatgatggaatccaagatgttatcgaagaacttgattttcaagactataatgttagcagacatacctggccatggattaaaactcaagaggcaaggattttcacattgtgctctgagagcangaaatgagtgtcaatggtaggattcttggtgtcgatgagttctactacttc

SEQ ID NO: 11873 - DNA, 492 bp, Gossypium hirsutum
  Clone ID: uC-gsflmaxxa002h11b1
caatttctcgccttttcttcccaagcaaagcacatggttttccaacaggaaaacaaaattaattaatcaataaataaaaaccctaagtaattttggtggaaatgtcgggtaaaggagcgaaagggttgattacggctagcaaatccgccaaagacaaagataaggacaagaagaaacccatctctcgctcatctcgtgctggtctccagttccctgtcggtcgtgtccaccgtctgttgaagacaagagttaatgcacatggaagggttggagcaacagctgctgtatacactgctgccatactggagtacctgactgcagaggtgctagaactggcaggtaacgcaagcaaagatctgaaggttaagcgtataacgcctaggcatttgcagcttgcaattcggggtgatgaagaacttgataccttgatcaagggaaccatagcagggggtggcgttatcccgcacattcacaagtcgcttatcaacaaat

SEQ ID NO: 11874 - DNA, 68 bp, Gossypium hirsutum
  Clone ID: uC-gsflmaxxa003b10b1
tcaatgcttcctttacaagtcagtttcctggggtttttttttgcatggaagggcttcctttccccctc

SEQ ID NO: 11875 - DNA, 196 bp, Gossypium hirsutum
  Clone ID: uC-gsflmaxxa003b11b1
tagtttcacatccaacagcaaataagcttttgttactttgtgacgaatggagggtccttagctttctcttttaaattaaaaaaaaaaaatcacacataaaaatatttaaaaaaaattaaactttgaacaaatttcaaagattttggttttcttctgcaatttctcatccaccaattgaatcaggatgtgaagtatc

SEQ ID NO: 11876 - DNA, 244 bp, Gossypium hirsutum
  Clone ID: uC-gsflmaxxa003c10b1
tcttagaaaatgggaaactgctttgctcgtaaaacagtaacgaaacgaccggtcacgaaaaggttgcagaaccagcaaaaaggacccaattccagcaaccggtgggctagggttcgatcgtcgtggaaagacatgtcttgatgattctttgtttcaagagctatcttttgcatcttctattcttgttctgtttttatctttacttacttggtcatcttttttttttctttttttattgtttttt

SEQ ID NO: 11877 - DNA, 134 bp, Gossypium hirsutum
  Clone ID: uC-gsflmaxxa003c11b1
tacagatatcatcatctacatccagaaagccggatgctttttaagaagcttgtacagtttgccaaggtctcccttttctcctttcctctctacctctcctttcctttttttctattttttctttcttttccttt

SEQ ID NO: 11878 - DNA, 455 bp, Gossypium hirsutum
  unsure (1)..(455): unsure at all n locations
  Clone ID: uC-gsflmaxxa003d02b1
cttttactcaagtttttggccataccgatggcggtcacttgcatgccaaggcagtggtatcgtgccctaacgaaggacttatcggttgcaaggaaatggaaggagggatcaccagcatcaaaacctgcaaggaagactaccctaatggcttccaaatgccagttcattatcctcgatactcgaaggccgattatgagaagatggaagaatggaggatcgatatgttgttgaaggaatatggattcagctttaatggtggcaccgtcgatgagaaaagggcttttgccatgggagcttttctttggcctgaccaactttaagttacatatatacatgtatgtatatcatgtttgattggtagattgtgtgattagggaagtgcttgcaaaagggatgcttttatttatgcttcggtgatattgagtngtagtaattaaccatgccctagcatgatt

SEQ ID NO: 11879 - DNA, 292 bp, Gossypium hirsutum
  Clone ID: uC-gsflmaxxa003d05b1
atcttttcttcctctccatgtctccttgatcacgatccgactgtccacaatgaacgcttatccttttgcttgtttcctctgcttttagtcctgcaaatcctcagatctactttcgcctccctcctaagcttctctgttttctcctttccttttgattttagctctgtaattcctcagatctactctctccgccttcctcatcttcgtttctcggtgagttgtgtttttccaaaaaccaaaagctaatttataccaaaaacaactttccgccggcgagttttgctcgtaattc

SEQ ID NO: 11880 - DNA, 419 bp, Gossypium hirsutum
  Clone ID: uC-gsflmaxxa003d10b1
tttgtcacgcgtccggcaacatattaatggctggtgttagctaagctagccaacagcaaccattcacattcatcattcttttttattttgctttatattccatgttgcccaattcttgaaagtaaccgttgcggctcggattgattggcggcttgataatcggagtcggagaaaatgcggggaaaggcggtttccgggaaagcaattctggtattgtgcctggctagctttcttgcaggttccctaataactagccgaacttggacttctcaatctcataacaacaaccatcctattgtgaaccatgttactgctagcaataaattgggagaatttgatcacaaattacgtaaattaggtgaaggaaaggcagaagatataatgggagaagtcttcaaaacttacaagggtatacagtc

SEQ ID NO: 11881 - DNA, 370 bp, Gossypium hirsutum
  Clone ID: uC-gsflmaxxa003d11b1
tctcttcatcttttaacaatggtagatcagggggctgtttgctgcatgtgcggcgacgttggtttctccgataaaatcttccgctgcaacaagtgccgccaccgctttcaacattcgtattgcagtaattactacagtgagttcgctgagccgattgaactgtgtgattggtgtcgaagcgaagaaagaaactcaaagcatggaagctctttgaagaaatcaccgttgatgaacagaaacgaaaccggaatcgtaaatcgatctgagtattcgggtgataaattaaagcaacacaacgatgatcatcaacatgaacatcatcatagagggaagaacggggggacaccttctcctaggcctacgactcgca

SEQ ID NO: 11882 - DNA, 547 bp, Gossypium hirsutum
  Clone ID: uC-gsflmaxxa003e02b1
ttttataaacagtttcatttccattctaagtttgtgtttttgatttgccttttgtgggtttttttttataaaaaagttcagcaaaaatgtttattgagaattttaaggtggagagccccaatgtgaagtacacagagaatgaaattcagtctgtttacaactatgaaactacagagcttgttcatgagaacaaaaatggaacctatcaatgggttgttaaacccaaaactgtcaaatatgaattcaagactgatatccatgtccctaaattgggggtgatgcttgtgggatggggaggaaacaatggttcaaccctcaccggtggtgttatagctaacaaagagggtatctcttgggctactaaggacaaggtacaacaggctaattactttggttcattgactcaagcatcaacgatccgaattgggtcttacaatggagaagagatttatgctccacttaagagtcttcttcctatggtgaacccaaatgatattgtgtttggaggatgggacattagtgacatgaacctagctgatgcaatggc

SEQ ID NO: 11883 - DNA, 296 bp, Gossypium hirsutum
  Clone ID: uC-gsflmaxxa003e03b1
tctctctgtagccgccgcctgcgtctctctcttgatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgaaggttgttgacattgttga

SEQ ID NO: 11884 - DNA, 456 bp, Gossypium hirsutum
  Clone ID: uC-gsflmaxxa003e06b1
gtgctgtgcatgaatggggcaaagcacagatttgagggttcccatggatcaaatccaaaaccaagaacaagataaggtgaatcttcataatcaaggcattgatgatgctatactaatggctactcccaagggagagaacattaggcgacctagaggaagaccagcaggttccaaaaacaaacccaaaccacccattattgtcactcgtgatagtgcaaatgcattacgagctcatgcaatggaagtaacttcaggttgtgatgtgcatgagagtttagctagttttgcaaggagaaaacaacgtgggatttgtgttcttagtgggagtggggtttgtaaccaatgttacactcaaacaaccatctttatctggtgcaattgtgactttacatggtcggtatgagactctgtcattgcttggttctattcttccaccacctgcaccacctgggatta

SEQ ID NO: 11885 - DNA, 463 bp, Gossypium hirsutum
  Clone ID: uC-gsflmaxxa003e09b1
tttgacgcgtgggtttgttttctaagttttgaggggctttcatggcttcttccattacatccaagcctttccttggagctactaaacccaattcttctctttctcctgatcttcaaagactttctttttcctctcttcgcatctcaatcaaaccaagaacccacaaaaagcttcagatacaagcagctgggagcacatttggaaattatttccgtgttacaacttttggagaatctcatggaggtggtgttggttgtatagttgatggatgtcctcctaggattcctctctcagaagctgatttgcaaggtgatcttgatcgaaggaggccaggtcagagccgaattactaccccaaggaaagagacagacacatgcccaatatattctggagtttccgaaagagtgactacctgaacacccatccatgtacttgtaccaaatactgatcagagaggacatga

SEQ ID NO: 11886 - DNA, 395 bp, Gossypium hirsutum
  Clone ID: uC-gsflmaxxa003f04b1
tttctatctagggttagggttttgctccttctgaggttctctctcaataccaaaaatatctccaaattgaagatgatgcaacaaccagcacaagctatggtaccaccaccaatggcttcaccaccttctatggcgggtgctccacagacccaacaacagtaccaatatcagcaaccacctccggctccggttcctcagacacaaccaccttacatgatgatgaacatgatgcatccgcctcatagttattctccacctatgtggcccccacaacaaggtttggctggggtaccaactcaacaacagccagcgggttaacccggttacgcagatgaaggtcggactttgtggatcggagatttgcagtattatatggatgagaattatttcttgag

SEQ ID NO: 11887 - DNA, 256 bp, Gossypium hirsutum
  Clone ID: uC-gsflmaxxa003f06b1
tgtgtatttggccgtcaagcacttctcagttgaggggcaacttgagttcaaggctgtcctctttgtccccaagagggctccttttgatctctttgacacaaggaagaagcccaacaacattaagctctatgtgagacgtgtctttatcatggacaactgcgaggagttgattcctgaattcctcagctttgttaagggtattgtcgactcagaggaccttcctttgaacatcttaagagaaatgttgcagcaaaac

SEQ ID NO: 11888 - DNA, 462 bp, Gossypium hirsutum
  Clone ID: uC-gsflmaxxa003g01b1
tcctggttctttttgcatccactgattatgcgggggttgttttgtggaatcaaagctgggccgttgaccatgattctccggtcagtattgatcttggatctgttgatggaggatctattccgtgcatggcattctttgcgttgcgatctgcaatcggtacaaactaaatgcatcgacgaagacatcaagagcaatttaatgactgtcggaaagtaccacgttgctaaacctaacaaaaatcatcctatgcccgaatctcacaagctcaccgtcagggtaacgggttcgcatgggaataattttcacttggcagaaaaggaggagaacgggcagtttgcatttacggcgacggatcaaggagattacatggctttgttttgggcgccggagcatttgtcgtcgatcacggtcaccgttgatttcgattggagggcctggtgttcacacccaaggacttgtact

SEQ ID NO: 11889 - DNA, 450 bp, Gossypium hirsutum
  Clone ID: uC-gsflmaxxa003g07b1
tttatgaagttcagcgtcaagaagagcgagtcaagtgtatagactgcagggtcaagaatgtggaaggaaagggaaattagccattgctgctgacattttcgcattaacaccgtcgtttctggtggtggaagttaaaaaagaccatggtgatacccttgaatacaaccagttttgcagtaaagagctccgaccggcgcttaaggacatcgtctggacgtcgccctccgataactcgactgtcgcttgacttttattttgttctagaccattgtttcataatgttgttattattgtttagaaagaaaaccagaaacagaggatgttctgggtttggtcgtttgtgattatgttaaagatggaatcatatgcgcatcattcgataaatttattgatgatgttccatttttacgccaatattttcatgtttgtgttgtttttctgcaagtggac

SEQ ID NO: 11890 - DNA, 478 bp, Gossypium hirsutum
  Clone ID: uC-gsflmaxxa003g08b1
tcgtcacgcgtccgcttttttttttcctttattttttgtgtttgtataatattcttagcccgcaaataagatggctgaaggagaagcaaatgcaaatgaaacttcacgtcaagcaccaaagttgaatgaaaggatcctttcatctttatcaaggagatcagttgctgcacatccttggcatgatcttgagattgggcccgatgctccgaatgttttcaactgtgttgttgagatagcaaaaggtagtaaggtcaaatatgaacttgacaagaaaaccggaatgattaaggtcgatcgagttctgtattcttcggtggtatatccacacaactacggttttatccttcgtacactatgcgaagacaacgatccaattgattgtttggttataatgcaggaacctgttgttcccggatggttcgtgcgagccagagcacttggactaatgccaatgattgacccaggggagaaagatgat

SEQ ID NO: 11891 - DNA, 227 bp, Gossypium hirsutum
  Clone ID: uC-gsflmaxxa003h05b1
cggattgagagggttgcgcgggggtcataccaaggctttgagggggcttttgcaagctgtggataaaggggagcctaggtctcttgaacttcttggggagatttatgctaaaggagctggaggtgaaaggaattataccaaggcacttgagtggctttcacttgcatgcgaacatgggcttttattcagcttacaatgggatgggttatttacatgttaaaggctat

SEQ ID NO: 11892 - DNA, 493 bp, Gossypium hirsutum
  Clone ID: uC-gsflmaxxa003h07b1
tgttagaagaaggtcggaagaacgaggaacgtgtggtgctcgtcaaggagtatagatcgaaggttgaatccgagttgtcggatgtttgcgctagtatcttgactttgttggactcgaatctgatcccatctgctgctgcgagtgagtcgaaggttttctatttgaagatgaaaggggattatcatcggtatttagcagagtttaaggttggcgatgagaggaaagctgctgctgaggatactatgctgtcttacaaggctgctcaggatatcgcactgacggatctagcaccaacgcacccgatcaggctgggacttgcgctaaattactcggtgttctactatgagattctgaatcagtccgataaggcttgtagcatggctaaacaggcgtttgaggaagccattgctgagcttgacacgctgggagaagagtcttacaaggacagcactctcattatgcaactcctaagggataaccttactctctggac

SEQ ID NO: 11893 - DNA, 250 bp, Gossypium hirsutum
  Clone ID: uC-gsflmaxxa004a01b1
ctctagactcttcccttgtaactgttaaaagttttgttactggtgatcattaatggccaccgctgaacctgaagttccagtcactgagcagcagccgccgggcagcagaggagccaaagccggtggaaaagcctgtgaaggagaagagacccaaagcttcaaaggagaaaaagcctaaacaacccaaatccacagcacgtcctccttattttcagatgatcaaggaggcgcttttggcttttgaacgaga

SEQ ID NO: 11894 - DNA, 244 bp, Gossypium hirsutum
  Clone ID: uC-gsflmaxxa004a05b1
cccatgcgtccgcccacgcgtccgcaaaaataaaagaaaagttatcgtacagaaaaatttattcatccaagttggaaacgtcggtcgcaaatctccgctccgttaccgatatctgaaatatgtccggccaaagccagcgcttgaatgtggttccaactgttacattgcttggaatcatgaaagctcggcttgtgggcgcgacatgaggctacgctcttcttaagaagatgagtgatgctctaac

SEQ ID NO: 11895 - DNA, 431 bp, Gossypium hirsutum
  Clone ID: uC-gsflmaxxa004d06b1
ctgttaggctgggctggaggatccagaagcatgacgaagctgctatggagcagctttgtgaagaaaccggggtccaaaggcaagttcttaaggtctggatgcataacaacaagtgcactcttggtaagaaaccctaatttcccatcaaaaccaaaacaacagtgcttaaacattgttacttgggaagaaacaaaacattccagagaagcatatgataatggggaatcgaagaaaaaaaacatcatgtgatttcagtagggattgtatcgcactagggttctcacttgtttatttctttattcattgcactttttttttgcaatattctgattttggattagcttatggtattattatcaatgccgatcaacgcaagatgatgacgatgatatgatctgaaagtttctgatgaggacattgctgctgactgc

SEQ ID NO: 11896 - DNA, 518 bp, Gossypium hirsutum
  Clone ID: uC-gsflmaxxa004d11b1
gtttctctgtttctcgagtgttttctggatgacttctgccagtgtggttttgattggtaacaacgttaccctctctttcgatgatattgaagctaattttgctccggcaatcaaagggtcaggggaatgcggagtattatatttggcaaatcctcttgatgcctgttcagacttgagtattaaagttgatgaactttcaaatggttcgtccccatttgcattggttattagaggagggtgtagttttgaagagaaagtaaggagagtgcaaaaggcaggatttgaagccgctattgtctatgacaatgatgatgatggtgtcttggttgcaatggcagggaatgcagctggcattaagatacatgctgtctttgtttccaaagcttctggtgaaatactcaaaaagtttgctgggtctactgatatggaactgtggctaatccctagctttgaaaactcagcatggtcgatcatggccatctcctttatttctctacttgccatgtcagcagtgctgg

SEQ ID NO: 11897 - DNA, 465 bp, Gossypium hirsutum
  Clone ID: uC-gsflmaxxa004d12b1
ttccctcgcgtccgcccacgcgtccgcccacgcgtccgggcaattgagattcctagagtgaaacttggaactcaaggatttgaggtttcaaagctgggatttgggtgtatgagtcttacaggtcacgatcattcagtgtcagatgaagatggcatagccatcattaagcatgcagtcgaaagaggagtcactcacatcgatacagccgacttatatggacccaaaactaacgaaattctggtcggaaaggcattgaagcatctgccacgagagaaggtacagttggctacaaaattcggtgttgaaagcatgggtccagatggtccggttatcaatggcactcctgaatttgttcgttcttcacttgaggctagccttcaacgccttgatgtggattatattgatctttactatataatcagagttgaccgcaacactcctattgaagataccatggaagaactg

SEQ ID NO: 11898 - DNA, 512 bp, Gossypium hirsutum
  Clone ID: uC-gsflmaxxa004e04b1
gaacaatgctagtttcagagtagcagatcagtgtctttaccaacttccctctgctcaaccaattcaagttttttttttttttggtttcaaaatttccctccaagttgacttggcattgaggagaaatggaaactagctcagtttccaagctgttgattttcttcttcacagcctttttagcgagttctaagctaatccagtgcagcattacctatgataaaaaagccattctaatcaatggacaaaggagaatcctcatctccggctccattcattatcccagaagcactcctgagatgtgggcaggatcttattaagcaagctaaagatggaggcttggatgtcatagacacatatgtcttttggaatggccatgaaccttctcctggcaattataatttcgagggaagatatgatcttgtacggtttatcaagacagtgcaaaaactcggactattatgtcatcttcgcattggaccttatatttgtgcagaatggaattttggaggatt

SEQ ID NO: 11899 - DNA, 452 bp, Gossypium hirsutum
  Clone ID: uC-gsflmaxxa004e07b1
atttactagcaaaaggaatgagaaatgctaaaaatgctattctttctggctgttccgctggtggattggcttcgatattgcactgtgacaggtttcgagctctccttcccgcttctactaaagtaaagtgcatttcagatgctggcttcttcctccatgcgcaagatgtctcgggagggaagcacatagaagaattctatggcaaagtggctagactacacggatccgttaagaatttaccagcgtcttgcacttcaagaatgggagccagaccagagttgtgtttcttccctcagtacgtggtgcagactatgcaaacaccaatcttcttcgtaaattcagcttatgactcctggcagattaagaacattttggctcccagtgctgctgacaaaagtaaggcgtggaaaagctgcaagcttgacttgaagaagtgtacagcagcgcagctc

SEQ ID NO: 11900 - DNA, 515 bp, Gossypium hirsutum
  Clone ID: uC-gsflmaxxa004e10b1
tggaaaaaaaaccagagtgcaaactacgtcagaaaccccccaccccccgaaaaaaaaaagccgtacaaaaagaagaagaagaagaacaagcaattatgactttgggcttgatcaatgcgaacccagtagttcacgccaagaaagaacgagtcgttcgtaacgaagatcctcacggtgacgacgccgttgatccactcgaaatctatgatttcgtgagggatatcagagatcctgaacatccttattcattggagcagcttagtgttctttccgaggaatcaatcaccgttgatgagaagctcggccgtattctgataactttcactcccacaattcagcattgcagcatggcgactgtaatcggtttatgcctaagggttaaattaaaagaatgttttcctccgcattttaaggttgacattaaagtcgccccgggatctcatgctgatgaagaatcagttaataagctgttgaatgataaagaacgagtcgccgctgccttagagaattctacc

SEQ ID NO: 11901 - DNA, 516 bp, Gossypium hirsutum
  Clone ID: uC-gsflmaxxa004e11b1
cggacgcgtgggctttcttctcttctttcaactcaaaaactcccaagtaatattagaatcatgggtgttgtcacttataactatgagtctacctctccagtcgcccctgccaggcttttcaaggctttttctcttgaagctgacaaggtttggcccaaggctgctcctcaggcagtcaagagtgttgaggttgaagctaatcctggccctggaagtatcgtaaagatcaactttgctgaaggccttccattccaatatatgaagcaccagattggaggacatgacgacaagaatttgtcatacagttatagtttgatcgaaggtggacctttgggggacaagcttgagaaaatcagctatgacaacaagtttgaggcagctgcaggtggaggaagcctttgcaagagctcgatgaaattttacactgttggcgactatgtgatcactgaagatgagatcaaggctcaaatcaaagggagtgaaggagtttacaaggctgctgaagcttacctcttg

SEQ ID NO: 11902 - DNA, 448 bp, Gossypium hirsutum
  Clone ID: uC-gsflmaxxa004g03b1
attatcctaaaagctttactgcgggaggggaggaagatacggttagttcagagaaattacaaaggctggggtggagttatcggccattggaagaaactcttgtggattccattgagagctataagaaggctggaatcttggattaatatataaaacagccttttggttgtgattttaatttctgttcactatgtgctctagtttcctcctggtcgcatgagattgcccacttgttgtgttcaacattttcaaaataataatgtcatacaacttgcatttctttcatgctaaacattgtgactatctaaataaacagagagatagtacatgtttatggatataactatttttattaaaaaacaaaaaaaaactaaaaaaaaaaaaaaaaatataaaaaaaaaatcaatctccaaaaaactcaaatccttatcggggggccgctttttgg

SEQ ID NO: 11903 - DNA, 547 bp, Gossypium hirsutum
  Clone ID: uC-gsflmaxxa004g04b1
tatatatctctcttttcttcctttctccaccaaagaaaatctgatttaaattttaatccattaatggctgatgaaccttctctcactcgatggtcttttctggtactctctttttcttttctctttccttctttctttgtttttcttttccttttccttttctgtttggttgtcaaatcgtcgttttcttcctgatttccctttggtcaattgaactgtatgaagctaattgacttacttcgattgactattttcctttttttactcatttattagcttagattgcattgcattgaatttctttttctaactcttaaattttgaaccaactgtgaagaaatgtgaaggaaaagggaaaaaaaaaaagagttctaagcattttctttaagcaattatgttattattccataggattttaaactattttatgatgccaagtttgggaggaagagattgcctgagccgcaaaatggtcaaactgctgatgagctcgactccaatggcactaatttcaacgtgacttcaaagaaaaccaccctgtcaggaa

SEQ ID NO: 11904 - DNA, 547 bp, Gossypium hirsutum
  Clone ID: uC-gsflmaxxa004g10b1
tctttcgcgtgggcggacgcgtgggatgtaccaagcgatttgcttcctttttaatgtgtctgaagtgaatccatggagaatgttccgcagtaaggtgaatatttcgtatatatgcggcgatttctgatttgtccataacatgattctggcattttttgactatagaaagcgcatccccttctattattgtttctaaacccatctctattactgtttgaatcgcacataaacatgccagggactctgctgcaaaagcagatccaacattctcatgcagtttcgatcttgcaatcaagacccgaccctccccattccttgctactactccgaatgccgttcgagatctttgcctgtcaaaagccccatcaaaattgatctttattgctgtaccagataggggtacccaggtcgtgatttcagcatttcttggtagtccacttccttctaaatcgtccatttcttttaacgtgctagatatgaatctagagatttcccttactgattgggtctttccttcatgagtcttttaatctatctgtccaagggc

SEQ ID NO: 11905 - DNA, 520 bp, Gossypium hirsutum
  Clone ID: uC-gsflmaxxa004g11b1
tttgctgctgctgttatagtaggtgcggatccattggctgaaatcgagaagcctatgtgtgaactcgtctcggcggcccaaacgatcttgccagacagcgatggtgccattgacggtcaccttcgtgaagttggacttacatttcaccttctcaaggatgttcccggcctaatttcaaagaacattgaaaagagcctagctgaggcatttcaacctttgggcatttcggattggaactcgctcttttggatcgctcaccccggtggtccagccatattggatcaggttgaggcgaagctagcccttaaacccgaaaaactccgagccacgaggcacgtgctttcagaatatgggaacatgtcaagtgcttgtgtgctgttcatattggatgagatgaggaagaaatcaaaggaagatggacttggaaccaccggtgaagggctcgagtggggtgtcctgtttggttttcgaccagggctcactgttgagaccgtggtgcttcatagtttctttgttaaac

SEQ ID NO: 11906 - DNA, 386 bp, Gossypium hirsutum
  Clone ID: uC-gsflmaxxa004h01b1
ccttcgcgtccgcccacgcgtccggaacttttaggtacatatagaaacaagggtcgcatagagagaaagacagtgaagtttctttttgtgttttttcagtatcgttgaagatggcgagtttgcaattgaggcgagagagtagcatggatcagcaagagagtccgaggagtccagaggcaaagcttgggatgaaagtggaggatctatggggtgttcaagaaccaaagcttagtcctaatgaaaagctcaacgcttgctttgagagcattcctgtctctgctttccctcttgctcctcaagggattgagataaaatcggatgctagtttagcagaggctgttcaaatactggctcaaaacaagattcttagcgcaccagttggtgat

SEQ ID NO: 11907 - DNA, 357 bp, Gossypium hirsutum
  Clone ID: uC-gsflmaxxa004h02b1
tggcatttgctattctgtcaattttaagaccggatcgggagcgactcactctcagactcagctgagttaaaatcgctcaagcgatgtggctatggagctatggggcgccaaaaaggaggctttagactgcgtcttgcagcactatatagaaaccagccctcaaaagctgaaaaaaaagagttgaatagagatggttctcaaccccttcggggttcgattttgacaacggaggtggaccctccggcgttgcaaccgtggggaaccggtgttgcgacgcgtggaaggggcaatggtcaggggcgtggtggccgaggggaggccaaaagcccagggggagtggcggctgaactttggtgg

SEQ ID NO: 11908 - DNA, 351 bp, Gossypium hirsutum
  Clone ID: uC-gsflmaxxa004h03b1
gacttacctagccccaccccaggaaattagggttggattggaattggtgaaagaaatggcgaggaggaaaatttacagcgagatataggggatgaaattgcaagaagttcccgggtacttcaagacgatgctttctgtggggtttgtgaagaaatctattcagaggggtgtagacaatgaccatgctaagtacattgagactgattacatcgaacctctttaccatatctgtttcggtgggatgatcttttcttatctcgtcgctcttgccaatgagcgtcgtcacctcgagcacaagcggcatgccgagcaacatggtcatcattaatcccattcagcttaaagatgggc

SEQ ID NO: 11909 - DNA, 277 bp, Gossypium hirsutum
  Clone ID: uC-gsflmaxxa004h07b1
ttgcctttttctattctttcaattttaagaccaaatcaggagcgactcactctcagactcagctgagttaaaatcgctaaagcgatatggctttgcagctatgggaaacgttgaaggaggcgacaacggcgtatacgggtctatctccggccactttttttacggttctagctctgttatgggctgtttactatgtagcaaagggtctatttgggtcatccgatgatcatatccatcaacggtctacggctttcgaggagcacatggagccgctacc

SEQ ID NO: 11910 - DNA, 420 bp, Gossypium hirsutum
  Clone ID: uC-gsflmaxxa004h08b1
tcgcatttattcttggacgattacatacggcagatctatcaaatcatcttaagcaagtacgatctttacaaatatacgcaagtttgagcgatagaaggccggagctggctgctctagtttgggatgtggggtcgtcaccgtgaagcattctcaatgtacaagaggatgccatcaagagatcattcaactctagttgatgatgtagaagagaattcagctctcttacagaacagcatggacgtggaaactacaaatccttcatggttgctttcctttccgcatgtagtagttgcgaccatatcttcactcctatttggctaccatctctgggtggttaatgaaccgcttgaaagcatctctatagatttaggtttcaggggcaatactctggctgaaggtctggtggtgagtacttgtttg

SEQ ID NO: 11911 - DNA, 175 bp, Gossypium hirsutum
  Clone ID: uC-gsflmaxxa004h09b1
cttttgctgcgggatcgttcctatagctttgttggatcttcatttctctgcaacgatgctaacttctgactttagaacgggaagtactgaagggaccagctctggcgtttactgctatgaagcctgggcgagggagccatactggaccttcacgagaagccacggttacattacc

SEQ ID NO: 11912 - DNA, 517 bp, Gossypium hirsutum
  Clone ID: uC-gsflmaxxa005a01b1
gttatctttttttgtttggggagagtagtatttctaaagagaagcaaagcagagatttattgttgttgttattattattatcagaatttccatttccatatgctcaatccatttcttctccttcacaaccaaattaaatccctgttcataaactaaaaatcccacctttgaaacagagcattcaaaaatggtgactggctggagaagagctttttgtacttcaattcctaaaaaacaggacagccctgttttaccagaaaaacaacaacaagaagaaagccatggtactaaaagtccaagattttcatcaaagtttgggtttttctccaacccatcaacaccaaggttacgatctcaaccgggttcaagccccagtctccgttgccgaaccgtttctactgctacttcatcccttccaaatagccccaagctccatttcagaacacctcatttatctaccccttcttcccctaaatccccttctagtttctccttccttaaatccactctgtgtatc

SEQ ID NO: 11913 - DNA, 422 bp, Gossypium hirsutum
  Clone ID: uC-gsflmaxxa005a04b1
cccacgtttccgatttattcttcgtgtgaattttcccccaaaggcatactattttcacttagcatttttatcaatatcgtttctgctgttaattaatagaacaccatatccttggctatagggttttgcttggtagctatgcagctatttattgaaagttgaaactcatgcctattttatgaatgcttacatgcatggcaagctgttgttagcctttctttctattatgtttgttgctttgtattagcattctctatgctacttgccctgcaaagttccaagtttccatttttattaaagatggcaatcgggtatttgcccagcagaattaagctaattttatggatctatctttaattaatgcaggactgagcaatgctttctttacaggtcaggttgctgcttctttgtcatggacggat

SEQ ID NO: 11914 - DNA, 429 bp, Gossypium hirsutum
  Clone ID: uC-gsflmaxxa005a07b1
tttgatcaacttggtgttcacttgaatgaacatgtgaaagagataaacaaacctctctcactggatagcagaaagaagttgctgtctgcgcacatatttcagcttctatcttcctctatttacttgatagcagcagcaggaagcaccccctgaagttcactcatcttctaccatagattaggtcaagttcctaaaattttacgttcttgttaattttattcataattaccattattaacttgtataaaactttctttattttcggtcattaaacaaaaatgcaagaaaaaaaaaaaagctaagcgaaagtccaccacttatcatcaaaaaaaaaaaaaaaaagatacaaatctaaaccaagaaaaaaacccaaacacaaaagccccaccgagactactgctactacatacctcacaaaaactcccgggg

SEQ ID NO: 11915 - DNA, 385 bp, Gossypium hirsutum
  Clone ID: uC-gsflmaxxa005a11b1
ctgggttcgattttgttagacaagatcggccgattaggatttcaggggattagagaagatggagtctcacgatgagacagggtgccaagccccagaaggccccattctttgtatcaacaactgtggcttcttcggcagtgcagctaccatgaatatgtgctccaagtgtcacaaagcgatgatcctgaagcaggaacaggcgcaacttgcagcatcatcaatcggaagcatcgcgaatggcagctcaactgggaacggcaaggaaccagccggggctactgctttggatgtacaatctggaaacgccgacaccaaaatggtcttaacagagctacccattgacccatccggaacgacttcatgtgggatgaaaatgaaagagggt

SEQ ID NO: 11916 - DNA, 556 bp, Gossypium hirsutum
  unsure (1)..(556): unsure at all n locations
  Clone ID: uC-gsflmaxxa005b02b1
ggtgtttggactttggagctttgatgtagcatgcaatagcttatgtggatgaagaaaagtactatggagcaaaggcaaccattaacgtttgggaacccaaaatacaacagcctaatgagttcagcttgtcccaaatctggatcttgggtggttcttttggtgaagatctcaatagcattgaagcaggctggcaggttagcccagatttatatggagacaaccacactagactcttcacttattggactagtgatgcatatcaagccactggttgctataatctactttgctcaggcttcattcaaatcaacaatgaaatagcaatgggtgcaagcatctaccctgtttctagctatcatgattcccaatatgatataagcttacttgtgtggaaggatcctaaggaggggaactggcggctacaatttggtaatagctatgtgttgggttactggccagctttcctattttcctacctatcagacagtgcctccatgattgagctggganggtnagtgntaaactcagaatcagatggacagcatacatccacaca

SEQ ID NO: 11917 - DNA, 451 bp, Gossypium hirsutum
  Clone ID: uC-gsflmaxxa005b07b1
cccacgcgtccgtgtaatcatcattcaaaaaaattaatttattggaaaagtcagcattcgtcactacaaaggtcgccatatgcgcatttgaagcagatctgcatccaggtatatataagctctaaatcaagagcaagctgttggtgggctctgcatgctatgcacagcaccgcatactagtgcactgtcaggcatgccgaattctatcttgagagaaccactctggacatcaacattatcgtactggtgatgcatatggagctacctgttgctataatttactcagcttgaggctttactatcatcaacaagtgattagtaatgggtgcacgcatctaccttgagtctagctatcatgactcccaatatgatataagcttacttgtgtggcaggatcctagggaggtgaactggggtgcacaattcggtaatagctatgtgttgggttact

SEQ ID NO: 11918 - DNA, 526 bp, Gossypium hirsutum
  Clone ID: uC-gsflmaxxa005b09b1
cttacgcgtgggagaaacccaaacaaattcaaaacccaaaacagcaactcgaccaagaaaaaggagacaacgtttgcggcaacaaaagccacaccctcctccctctgtcgtccagattgaacgtgccattggtgctggttccttccgtgacgctgactccagtgatttggaggagcaaaggaggaagacgatattcgatgggcttttgcctgtcactggtggtaaatttgaaggagacattgaaaagaagctccgcgagactggggagtggattggtaccactactgaagcaaccttccgttcctccggtacttcatttttctctctattttctttcaatcgagttcagataagttttagtactgaaaggtgaaagctacttgtaagacggaaagcttaagatgtatatgaagcatatttaggcataagaggtaggcaatatgatttttttctaacactgcttttgatcatagctggcaggatagcgcataacaagcaaccaattgaatgatctagaaactttaac

SEQ ID NO: 11919 - DNA, 73 bp, Gossypium hirsutum
  Clone ID: uC-gsflmaxxa005b10b1
ctataggtgaatgctggctcgcctgcctggaccgggcccggaacttactgtgctggacccacgcgatgcggtt

SEQ ID NO: 11920 - DNA, 515 bp, Gossypium hirsutum
  Clone ID: uC-gsflmaxxa005b11b1
atttacctttacagctttggttctgctcctctccctaatctccctcaccttcttcactgcgaaattgaaacaaaaacagacaaagaacaagtaccaccccgttgccggcacgattattaacctgctactcaactttaatagattgcatcattatatggctcatcttgcagccaagtatcggacctacaggctactttctccttacaggagtgagattcatacctcggaacctgccaacgttgaatatatactcaaaaccaacttcgataattatggcaagggtgagtataatcacagcctgctaagggatttttttggcgagggaattttcacagtggatggggataaatggcgtcaacagaggaaggcatcaagctatgaattctcaacaaggtgttgagagatttcagcagtgctggctttcggaacaatgtggcacgactcgccaatatagtgtctgaggcagctaattccaatgagacaatggatatgcaagacttgttatgaaatcgact

SEQ ID NO: 11921 - DNA, 447 bp, Gossypium hirsutum
  Clone ID: uC-gsflmaxxa005c02b1
ctgagtttaagcatatcaataagcggaggaaaagaaacttaccaggattcccctagtaacggcgagcgaaccgggaaaagcccagcttgagaatcggtcgccatcggcgtccgaattgtagtctggagaagcgtcctcagcgacggaccgggcccaagtcccctggaaaggggcgccggagagggtgagagccccgtcgtgcccggaccctgtcgcaccaagaggcgctgtctacgagtcgggttgtttgggaatgcagccctaatcgggcggtaaattccgtccaaggctaaatacgggcgagagaccgatagcgaacaagtaccgcgagggaaagatgaaaaggactttgaaaagagagtcaaagagtgcttgaaattgtcgggagggaagcggatgggggctcgcgatgcgccccggtcggatgtggaacggccagagccggtc

SEQ ID NO: 11922 - DNA, 496 bp, Gossypium hirsutum
  Clone ID: uC-gsflmaxxa005c04b1
ctttgtcacattttcccccatttcctgtctcagaactccaaaaccctaacatttcctcacagaaaaaaatagaaaataacgaaaggaattaccttaaccctaatggcattgatcgacctagcggtaaagctagaaaataagcgaaatgtcgtggctgaggacggctgtgaacaaagcggtggagctttttactcatctctctacaccctttctttcactattcttgttttttcctctattctctctactcttcatttttattttcttctatttctctttatctcccttcttctactcatttctattctaccattttttaattacttctttccttttttcttatatcacttattcttctatatttcactcttttactttctttagcccctatttcttcttctaccttatttactattttctttatcctgatctcgttcttactattttaccttttactttacttgcccaccctctcttattctccttctatattatt

SEQ ID NO: 11923 - DNA, 363 bp, Gossypium hirsutum
  Clone ID: uC-gsflmaxxa005c06b1
cctactcgtccgtcagaacagacgttgctctcctttggttagagtcgagaaaatgtttgaggatatccaatctaaactgcctggagctccacagtttcttctttgtcttttacctgataggaaaaattctgatctttatggtccatggaagaagaagaatctttctgagtttggcatagtcactcagtgcatggctccaactagggtcaatgatcagtaccttacaaacctgcttctaaaaatcaatgcaaagcttggaggactgaattccatgttagcaattgagcaaacaccttcaattccagttgtttcaaaggttccaaccattatccttggcatggatgtgtctcatggctctcctgg

SEQ ID NO: 11924 - DNA, 416 bp, Gossypium hirsutum
  Clone ID: uC-gsflmaxxa005c07b1
ctcggtatcggcctcggaggagcggcggaaaagaaacttaccaggattcccctagtaacggccagcgaaccgggaaaagcccagcttgagaatcggtcgccatcggcgtccgaattgtagtctggagaagcgtcctcagcgacggaccgggcccaagtcccctggaaaggggcgccggagagggtgagagccccgtcgtgcccggaccctgtcgcaccaagaggcgctgtctacgagtcgggttgtttgggaatgcagccctaatcgggcggtaaattccgtccaaggctaaatacgggcgagagaccgattgcgaacaagtaccgcgagggaaagatgaaaaggactttgaaaagagagtcaaagagggctcgaaattgtccggaggggagctgatggtggcccgacattctccc

SEQ ID NO: 11925 - DNA, 163 bp, Gossypium hirsutum
  Clone ID: uC-gsflmaxxa005c08b1
tcggttttatgtgtcaacataacgggtgtagagattacttacttggattcccctagtcacgacaagcgaaccgtgaaaaagcgaactaggaaatcggctgatagaaacagactaagaatgcaacaaatgcgggtcctagtgcacctagaagtgacatgtccaa

SEQ ID NO: 11926 - DNA, 144 bp, Gossypium hirsutum
  Clone ID: uC-gsflmaxxa005d01b1
atcggtcattgatcccgcagaacgaaaaaatagagggtttactgtgagctgcctcgcccttttgaacacgggcgacgtaccaagagagccccctggcgccggaccggccatcgtcctccgcgccggccaccgtacacggcggct

SEQ ID NO: 11927 - DNA, 182 bp, Gossypium hirsutum
  Clone ID: uC-gsflmaxxa005d06b1
ggataagtaagaaaagtcaggccacattgttgtccgcctctttcttttcaaagaatccctgaagggaaaactcagttcaaaaaacccagaagagaaaagcaaagaattaggcctttttctgggggggagggttactatgtttcaagagattctttttcatctctgtagaaactccttacttg

SEQ ID NO: 11928 - DNA, 494 bp, Gossypium hirsutum
  Clone ID: uC-gsflmaxxa005d07b1
atcggtgcattcggatccagtaaggaatgggcaccgacaacaccattaggtacaatgctaagcgtaggcactggcgccgtaccaagctagggttctaagttcgatgggcttatttgtttccagtattttctttaagttttctaagtttattttcggacttattttatttgggatttaactttgggttctatcgagaatctttgttttattgatttttcttactttgtccctcactttttttctttttcttttttccttctttccttattttctttctcttttttcttctcattctcttttattataatctatttatactttcttatttttcattctttttttttttatttccttttattttttctttctttctctcttttttttccgtctacttttcttatttttttatttttctctttcttccttttattttttatattttaatttttttcttttcttccattttatctctttttattattatattatttttt

SEQ ID NO: 11929 - DNA, 387 bp, Gossypium hirsutum
  Clone ID: uC-gsflmaxxa005d08b1
tctgtataaggagccaaagcgatataatacaaaaaaaagaaccgagttctttttttttagtctatctaaaataaaataggagatcatatgaaaaatgtaaccgattctttcgtttccttgggtcactggccatccgccgggagtttcggggttaataccgatattttagcaacaaatctaataaatctaagtgtagtccttggtgtattgatcttttttggaaagggagtgtgtgcgagttgtttatttcaagaataggctggattcacccagttgtactttttttcattataactaggaaagaaaagagtgcatgatcccgcgaattacttctgaataaatttctaaaaccatcatatagaaccattagcattcccgtgattcatt

SEQ ID NO: 11930 - DNA, 96 bp, Gossypium hirsutum
  Clone ID: uC-gsflmaxxa005d12b1
ttcgttgtgacaagggcagggccacatggtgggagggcttattgaatacaaagcgtccatacaacaaaactgcagccaaaaaaacccataatagaa

SEQ ID NO: 11931 - DNA, 123 bp, Gossypium hirsutum
  Clone ID: uC-gsflmaxxa005e02b1
ccggcccggaacttcccggcccgacccacgcacccggtcgatattgcgggataagaaacgcccgccggggggggctacataaaaatccaccgccctttagaaacccccccaaacgaaaacgag

SEQ ID NO: 11932 - DNA, 219 bp, Gossypium hirsutum
  Clone ID: uC-gsflmaxxa005e04b1
cgtccgcccacgcgtccgcacaaacggggggtttttttttaaaccggtggccgatataaaaccccggtcagggctcctttgtcgcggccccataggcctcgtgtcgctccggcccccctcctttctttgcccgccgttgtcccacccccctgtcgggcgagaaccccctctggccctcccctaccttttctctctgcaccccccccctctctttcccct

SEQ ID NO: 11933 - DNA, 339 bp, Gossypium hirsutum
  Clone ID: uC-gsflmaxxa005e05b1
ctcactcgtccgcccacgcgtccgcccacgcgtccgcttttttccttaaccttttaaaaaacataaaagatggtcaaggttcctttcgttgtgttcttattggctttggtgctctcaatccaattcgtagtgggacaagatgaggaggctatagatgaggaagcatcccgagaagccgacgaggcacttttcagtacagggtcagctaaactcgttcaagactttaaaaactctgctggagattattcccagagcgtggatgggccaacttctggcttagctgatgagattgcaccttcttccaaatcggatgttaaagccgctcctgtatctgcctgt

SEQ ID NO: 11934 - DNA, 121 bp, Gossypium hirsutum
  unsure (1)..(121): unsure at all n locations
  Clone ID: uC-gsflmaxxa005e07b1
acctcggacgcgtggggcaataagcagccccacaacttcaaaaggtttttttttcttttcctatctctgcntaaaatctgtttcaagggaaaggaggaggaaaactttatcatttcccgcg

SEQ ID NO: 11935 - DNA, 427 bp, Gossypium hirsutum
  Clone ID: uC-gsflmaxxa005e08b1
tcgataaggtgtcttaataaacgccttctttcttcttcttcttattcctttattgctttttagaatttttcttaatcgaaaatgagagagtgcatttcgatccacatcggtcaggccggtatccaggtcggaaacgcttgctgggagctttactgtctcgagcatggaatccagcctgatggtcagatgccaagtgacaaaactgtcggaggaggtgatgatgctcttaacacctttttcagtgaaacctggtgccctgggaagcacctcccttgcgcccgtttcccggatccctgcacccactgttcttgctccttcgcgccctggtccctccccccagcccccctcctctctcctcctcatctctcctcttccatctccccccatcacctttccccttttccccctccctcgtctcctcctcccc

SEQ ID NO: 11936 - DNA, 72 bp, Gossypium hirsutum
  Clone ID: uC-gsflmaxxa005f02b1
ccatgcgtccggaaaaaagaaaaaaaacgcaaagaaaagagaaatggctactttgggtggaactagccagcc

SEQ ID NO: 11937 - DNA, 108 bp, Gossypium hirsutum
  Clone ID: uC-gsflmaxxa005f05b1
tttacttgttcgtttgccctttagctgctgttaagggaaacattataataaacacaagcctttaacgctcgaaacgagcaaccttgaatcttaccctccagtctttcg

SEQ ID NO: 11938 - DNA, 77 bp, Gossypium hirsutum
  Clone ID: uC-gsflmaxxa005g08b1
atttgatacgcgcccgaaggaacacacgcccaagagggggacacatgcaagcacaccgccgaacccaccccacccac

SEQ ID NO: 11939 - DNA, 134 bp, Gossypium hirsutum
  Clone ID: uC-gsflmaxxa005g12b1
aagtaaagacacaggcggcgcttctctactgggcgggacttttgagatcacacagacctatacacagccccagcaacagaagccacaccgaaactcacaaaaaacaacgcgaccccaacaccaacaccccaaaa

SEQ ID NO: 11940 - DNA, 360 bp, Gossypium hirsutum
  unsure (1)..(360): unsure at all n locations
  Clone ID: uC-gsflmaxxa005h04b1
aattttcgggttgacccacgcgaatggttcgcttcaaatatctctccgaattctgggagcgtttacatagatttgacctttctttcccncaagcaatgtcagggaagagaccacgtccgatgatggggaaatcgtctgaattattggtttccggcaaaaaacccgtatttttggatgctgctgttacaagccctaggagtccactagatttgaagacaccatcacctagaagttcgaagagatatgatgctggtggggctggactagggattgctgctgcactagataacaagtgtagcacccaatcctggaggcatactatttgaagctcaaacgtaaccgccgcgaaacccggtggga

SEQ ID NO: 11941 - DNA, 118 bp, Gossypium hirsutum
  Clone ID: uC-gsflmaxxa005h09b1
aacgtaaactttcccttcaaattcgtttgatatggctcattgctcaagatgccttatcccatggactgcatccggcggaatatatctcccttgaagttcaccgcatatctcccccctg

SEQ ID NO: 11942 - DNA, 408 bp, Gossypium hirsutum
  Clone ID: uC-gsflmaxxa006a11b1
gaaaaaagcgtaattttaatgcgattcaaaagggggcgtaggaagtgggaaccaccacccatgtgccctccctcctgtctccaccagctgctgccgctcaatgattagcactctgctccctccccaatatccatccctctcctctctgtatttccattaatttgtttttttttttttttttgcttttcttttcacatcaaacacctacaataacactgcaaccaatcttttcagcttaaccccccccaacaaaaaaaaagaaaaaggaaaaagaaaaaaactaagtgagaacattttcagtgagcctagtcgaaattgtatacggttctggggttttgtttggtgccgcatgtcaaattcagaggctgctgctaaaaacggagcaacaatggatacccagagacaaca

SEQ ID NO: 11943 - DNA, 429 bp, Gossypium hirsutum
  unsure (1)..(429): unsure at all n locations
  Clone ID: uC-gsflmaxxa006b06b1
cttttaagtgagtaaatatggattttgatgaatatgagtatttagaaaagacggttgaaaatcctgagcatcaaaaggtgaagaaggaagatggtaatggtagagttgataatgttaagtctgaagagaagattcgaagtgggagttcaaagcataagagggaggagagagtcgatgattatgatgattatcgaagtcattccaaacgttcaaaatcacgagaggaatgattgtatgatcatgaccggcataaggaacgaggctcttgtcgtcacaggtcacggtctagagatggtgagaaggataggcacaggagtagcagagaagatagagtcaaagacagggacaagggggagaggatgnggagagaataaagagcaggaacgcgaacgagataggaaagagcatgatcgcgagagggaaagggga

SEQ ID NO: 11944 - DNA, 449 bp, Gossypium hirsutum
  Clone ID: uC-gsflmaxxa006b08b1
cttccattctcttcccttccctgggcctccaaaaatccacgtctctctctctcgtcaagacaacgaaacccacaaaaacctgttgagtgtccaaattcaccacaaaacatcaatggcgaacctcaaagcagggacaagaccaccatgggttggtcttggtgctgctgtctgggtacagatagcatctgggaatgcctacaacttccctctttattcccattcattgaaatctgttctggggtttaaccaacatcagctgacaatgcttggtgttgctaatgatattggtgaaaacgttggattactccctggtattgcttgtaacaagttcccaccttgggttatcctattgattggatcttttgcttgtatcttgggttatggtgctctttggcttgctgttagcaaaactgttctatatctgccttattggctgctatggcttgcac

SEQ ID NO: 11945 - DNA, 408 bp, Gossypium hirsutum
  Clone ID: uC-gsflmaxxa006b10b1
cccacgcgtccgcttttcttactttttattttcgttatttttttcatgattgtgcagatcagcccttaacctttcattttctttttggtttttttttttcgaagtattttttttgttgttgtttttcatgaagagaagaagctttacgtatggtttttctgaaattttgaattttttttgaaagtaacaaagaagatgacgtcgacttcggtagcaacttcgtcttctaggatttgcttcaattcagtctgtaacgatttgaaatcggaaagaccgaggaaaggatggcggttgcgaacgggagagttggctgagctctgtgatcgatgcgcttttatttacgatgagggaagaccttgcgatacttttcacttaaatgcttctggttggagaacctgcgagtcatgt

SEQ ID NO: 11946 - DNA, 107 bp, Gossypium hirsutum
  Clone ID: uC-gsflmaxxa006c05b1
gtgtattgtggtagctgatacttatccttgtactacaaaaatgtatcctttattattcatttcaagcgccgacgattggtgtaagacgatagattatatgattttta

SEQ ID NO: 11947 - DNA, 107 bp, Gossypium hirsutum
  Clone ID: uC-gsflmaxxa006c08b1
tcggtcacgcgttcgcctttctcactctttgacttcacttgaccctgcaggcttgcgttaagctaactctcttgagttcgtccctgggctaggagaaggtcccctta

SEQ ID NO: 11948 - DNA, 478 bp, Gossypium hirsutum
  Clone ID: uC-gsflmaxxa006c09b1
atcgatgatggccctcttactgaacatgagtcagtcggaatgcttgtatggcgttacatgtcatgagatgcttcaaattggagatgtcaggtggctccagaaacagcccaatgatgacctcaaaaacatggaagctattcctcccattgatgcactcaaccctaccgagttcaatggacccggtgttggcattcacgaagatcatgttgtcccaaaaggttccgaaattggtactcttggttttggttttgaaggtggtcctgaaaaatgttgttcttctggatgttccggtaattgtaatcctggtggtttcgttcctaccatttcctcaaattccagaaatcccaagaattccacagatcccccagatcccacaaattccacaaattccactaatcccacagatcccacaagttccacaaatcccactaatgccaggacagtctggatgtgagagtggggagtgttgccgtcaggg

SEQ ID NO: 11949 - DNA, 428 bp, Gossypium hirsutum
  Clone ID: uC-gsflmaxxa006c10b1
tcgattttcttcgagaaaaccatcttctccagaatctaaccctctcaccttatctctcaatcttccttcttatgttctgaaaattttcacagcatattgtgggggattcgtccccttcctctcccctcttcctctctcctcctcttctctccccttattctcctctctcccctcttctccctctcttctcctcctcctctctccttcctctctcactcctctctccttctttcttctccctcttcttcttttcttccctcatatctctctctcactccccttcccctcttttcccttctaatccatcttttcctctcctttttactctcattctctcttctactcttttcctctttccccttctacttcctttctcttcttctctcttcttcttttttcttttttttttctcctctttcctctctttt

SEQ ID NO: 11950 - DNA, 448 bp, Gossypium hirsutum
  Clone ID: uC-gsflmaxxa006c12b1
gttgaatccatagtgaagaacactgctaatagagctttgtaagatgacccaacgctgacagcagggtcgtcttggacgcaactacatgagtgcagcccgcgggaggattgtgatggagcttttcgcagattgcactcctcgcactgctgagaacttccgtgccctttgtaccggcgagaaaggcgtcggtcgcagcggtaagcccctccactacaaaggctcctctttccatcgtgtgatccctaactttatgtgccaaggaggtgacttcacggccggaaacggtaccggaggtgaatccatttacggatccaagttcgctgacgagaactttatcaagaagcacactggtcccggtattctttcaatggctaacgctggccccggaactaacggatctaattctttatttgcacggctaagactgcgtggttcgacggaaagcacg

SEQ ID NO: 11951 - DNA, 297 bp, Gossypium hirsutum
  Clone ID: uC-gsflmaxxa006d02b1
acaaatggcccatgcggttcaaatctttccggatatttctttaaaaaattcttccatgtcgttcaccacatcctcgacctccacggtcaaatattgcttgcaggattcgtcaacacacacgttcacacttctcagcagctcgggagaggaatcgccgacgacgttgatctaatgacgtggcttcaccatcggatctggccgtacgagtccaacatgaccgaagaagactcttacatctttactttacttttgggagtcgaacttattcactccggtgtcacgtgcttcgctgaagct

SEQ ID NO: 11952 - DNA, 483 bp, Gossypium hirsutum
  Clone ID: uC-gsflmaxxa006d04b1
gcctcctcatttctcttcaaacaaacatcagtttctttctctctctttcctcgacaatatttcgattttcaccctatttttatttttattcgtattttatttttggtttacttaccaaaaattacatactggcaaaaataaaattaaaagggcaatttgagttgagatcaactttgatagctgctgttcaaaacaagaaatgggatctcatctgaatttcaaggacttcggtgatgcttcaagtatggaaggaaacgagtctaagccactggggaattttccattgacaaggcagtcatccatatactcgttgacttttgatgagttacagaacacctttggtggaattggaaaggacttcggatcaatgaacatggatgaactcttgaagaacatatcaactgctgaagagactcaggcttttatgacagcttcagtttcaggtggagaaggaagtctttctggaggcaatctacagaggca

SEQ ID NO: 11953 - DNA, 96 bp, Gossypium hirsutum
  Clone ID: uC-gsflmaxxa006d05b1
gttcatttacgcgtcaggcgtgcgaactgtggatattggagtcaattaatagcctatttatgcccctgttgtttaacttgaatggtattgatacgc

SEQ ID NO: 11954 - DNA, 221 bp, Gossypium hirsutum
  Clone ID: uC-gsflmaxxa006d09b1
tcgctcctacataagaaatctgtgcatcaaaaacaccaaaacaataaaaaagaagaaggaacatgacaattccaaaggaacaagagagaaaatgagtcgaggaagtggtgtccttctctatctctattttactatcttttttatctctttgttttattttctttttcctttttttttttcttttcccttcttccttatatttctttttctttttttttttt

SEQ ID NO: 11955 - DNA, 217 bp, Gossypium hirsutum
  Clone ID: uC-gsflmaxxa006d10b1
cccacgcgtccgaaaaaaattttatggctcttcaatttaattttatttcatccatgttaataatattacttttaaccatatcatccgctaaagctcaagaagctggtggcgttggcggtagaggaggaggagatggcggcgccttggccgctggagtcgagatcaactttgatagctgctgttcaaaacaagaaatgggatctcatctgaacttcaa

SEQ ID NO: 11956 - DNA, 384 bp, Gossypium hirsutum
  Clone ID: uC-gsflmaxxa006d11b1
cccacgcgtccggtttgtttcctgagcaaatctcgggaaggaataccctttttttccccctgttgttaactcgttgtgattgtgaagctttctttaaaagaatcctagttaactcgacgcgtttacccagaaagaggtgaagatgtcaactcctgcaaggaagagattgatgagggattttaagaggttgcagcaagatcctcctgcaggaattagtggtgcacctcaagataacaacattatgctttggaatgctgttatatttggacctgatgacaccccatgggatggaggtacgtttaagctgactcttcagtttacggaggattatccaaacaaaccaccaactgtttcgttttgttttccgatgttccatccaatttt

SEQ ID NO: 11957 - DNA, 464 bp, Gossypium hirsutum
  Clone ID: uC-gsflmaxxa006e03b1
ccaccgccgtcgatctcgatccttatcctcgttttcaaacaagctcaaaaaagatggccaacgctgcatcgggaatggctgtgcatgatgattgcaagttgaagttcttggagctcaagacaaaaagaacccaccgcttcattgttttcaaaatcgaggagaagcaaaagcaagttattgtggagaagcttggtgaaccaaccgaaagctacgaggattttactaaatgtctccccgctgatgaatgtcgatatgctgtgtacgattttgattttctaacggccgagaacgtcccgaagagcagaatctttttcatcgcatggtctcccgacacgtcaaggatcaggagcaagatgatttacgccagctccaaagacagattcaagcgagaactggacggaattcaggtggaattgcaagcaacagatccaactgagatgggtctcgatgtgttaaaatgccgt

SEQ ID NO: 11958 - DNA, 482 bp, Gossypium hirsutum
  Clone ID: uC-gsflmaxxa006e05b1
atataaatagcatctcaaatcaaagcatcccgaccagacaaaacaatgaatctttcgtcgtggtttcgccgcagtgtttcaaggaacagtaaaaaccacaaaaacccaccagatcaacctcaaccccaccaccaagaacaagaagaatttcttggaattacccaacaattaatcgatcatgtcaagtcttttactttagaaaccttcaagaatttccctatccaagatgatggtgacattgaagcccaaacttcttataatgtgcgtaaagatctttctgattggcaagagcgtcatgctgtcttagtgctttctaaagtgaaggaactttcacagcttagattcaagctatgccctcgtcatttgaaggaggaaaaattttggaggatatatttcatgcttgtcaatagctacgtggctgaatatgagctgcatgctatacagcgtgctaaactgcaaagcattgctatgaaggatgagaa

SEQ ID NO: 11959 - DNA, 60 bp, Gossypium hirsutum
  Clone ID: uC-gsflmaxxa006e06b1
gatcatttatgatctcccaacacaaccagagaactaccttcatcgaattggtcgtagcgg

SEQ ID NO: 11960 - DNA, 191 bp, Gossypium hirsutum
  Clone ID: uC-gsflmaxxa006e07b1
gaattgttaccgcctccaactccccttcacaatttccctcatcgtcaaaccctattgtcaccctttctttctcgtggcgtttcgaaattaaagatttcaaccgtgtaatactaattcccatatgcaagcgaaaaaggaatcaggttcttggttgtgtggctgaatggcaagatttgagggtagggtttcgt

SEQ ID NO: 11961 - DNA, 146 bp, Gossypium hirsutum
  Clone ID: uC-gsflmaxxa006e10b1
tcgattctcaatgatttgcaggattggagaagagcaattagaaatcgaattagatgccgatgatggccctcctgaacttgtcttttctcatggaggccataaagttaagattatagatttctcgtggaccaaaaacgagccaagtt

SEQ ID NO: 11962 - DNA, 493 bp, Gossypium hirsutum
  Clone ID: uC-gsflmaxxa006f05b1
gtttatcagcaggcctaaacgatcaaccaaccagaaaagagatacaagatggcttcagggtcagttatctgcaccatgagagtgtttttttttttccttctttccctttctctttctcttccctttctctttccctcccttcctcttcctcctttctttcacccttccttcctcttctctccttctctcttcttcctttctctcctcttctttctctcttttctccttttttctcttttctttacttctattctcttctcctcttttcttttcttttttcttctttccttctctccctctctttcttttcttctctttccctcttttctctttctccttctctctttttcccttttctttcttcctccctctctcttcttttttctttttcatcctttccttttctcttcccttcttttctccccttcttttctctttctctctcactttatttctatttctttctctctccttcttcctcttctttctcttc

SEQ ID NO: 11963 - DNA, 129 bp, Gossypium hirsutum
  Clone ID: uC-gsflmaxxa006f08b1
ttgactcttgtgaacgcccacggcacccaaggataaggaattagttttacaattatattcctttctttttcacccttttattatattgctgtatcttacttttccagtttcctgtttctttcttttttt

SEQ ID NO: 11964 - DNA, 445 bp, Gossypium hirsutum
  Clone ID: uC-gsflmaxxa006f10b1
tcgcccacgcgtccggcctgctgatacggaaaaaaaagtaaataaccaaacagattcctctttctttcttacttcagtaatggcttcttctatttcgattattccgtcttattttgcttccaccagccttcctcccctccccattgcttctcacttcccctttaacctcaactctttaaccttcttctttcctttgaaaaacgggtccttcaagcttcgtaatgcccctcctctctctcccaaggccctttcttctcgtgcacccaaagctgctgttgtttctaaagcccaccggtagaaaccagcttcgaacagtgtctcccccgttcctgtacacttttactccaggccgttatcccccctcctccatctcccacctcttatctctttacctcatctcctacctaccctctttatttctctcctcctttactttcctttttcc

SEQ ID NO: 11965 - DNA, 570 bp, Gossypium hirsutum
  Clone ID: uC-gsflmaxxa006f12b1
tctccattcaaaagggaccgccccccgcccccagggcttctttccctcccctccccctccccccccccttccctcccctccccctctcccccctcccccccctcccccccccccccccccccccctcccccccctcccccccttccccccctcctccttctccctcctcccctccccccctcccccccccctcccctccccccctccctcccctccccctctccttctccccttcccccctcccccctctcctctcttccccccccccccccccctccccccccccccccccccccccttcccctccccccccctccccctccccccccctccccccctccctcctccctccccccctccccccccctcctccccccctcctctcccttccctcccccctttccctcctcctcccctctctctcccctccctccccctccccccctccctcccttccccctctccccccctcccccctccccccccctctccccccttccctccctccccccccccctcccccccccctcccccccccctctctcccccccctcccccccctccctcccc

SEQ ID NO: 11966 - DNA, 57 bp, Gossypium hirsutum
  Clone ID: uC-gsflmaxxa006g11b1
actatatgaaaagctggaacgcctgcaggcaccggcccggaaaccccggcaagaaca

SEQ ID NO: 11967 - DNA, 252 bp, Gossypium hirsutum
  Clone ID: uC-gsflmaxxa006h04b1
gtctactccactctcatcaatggctactaatgaaattgaaaaaccggatacctgaatatgttcaaagcacagtcaaagcccgtaagacaatgtgcctgaatgggcaccgggaccggcaccagctgaggaggtcagagacctctaacgcgttcgaagagcgtggactagcatgcaaaaaagaacttgctgtggagctcggggttgctgttgatgcatggctgcgtgctggccggagggaaggggctgcctcac

SEQ ID NO: 11968 - DNA, 77 bp, Gossypium hirsutum
  Clone ID: uC-gsflmaxxa006h07b1
ttgcctcgggctgggcacggaggaaacaaaacaaagggtttatttaaaaatacttacccctatttaccaataataaa

SEQ ID NO: 11969 - DNA, 127 bp, Gossypium hirsutum
  Clone ID: uC-gsflmaxxa006h11b1
ctcgaatcattgttctcctcagcttttgaaatattcttctttttatctagatctacaatattgcttcaagaaagaaaattctttgatgatattaatagaaatacaaaaagaataaatatttattatt

SEQ ID NO: 11970 - DNA, 72 bp, Gossypium hirsutum
  Clone ID: uC-gsflmaxxa008a01b1
ggagcggaagacccgggtcgaccacacgcgaccggaggtaaaaaaccaaagaaaaagacaaaaaaggggggg

SEQ ID NO: 11971 - DNA, 191 bp, Gossypium hirsutum
  Clone ID: uC-gsflmaxxa008b09b1
gaattcctttgtcgtcccacgcgtctcgatcactcgtttttttatagattcaatttgatgccccttttttctctacaatcctttttactgccccaaaagatacctatcttaatttccttttgattttcaatggcgggcatgctagctggtgttgaatgtgctcgaagaagactgtcccatattagcggcgg

SEQ ID NO: 11972 - DNA, 301 bp, Gossypium hirsutum
  unsure (1)..(301): unsure at all n locations
  Clone ID: uC-gsflmaxxa008b12b1
tcatatatgctttcgagtatgcttatttgaacaatctaaagaaggttactgctgttcataaggccaatattatgaaacttgcagatggattgttcttagagtcttgccgtgaagttgcaactaagtatccaannatcaagtataacgaaatcattgtggacaattgttgtatgcaactcgtttcgaagcccgagcaatttgatgtcatggttacccctaatctttatggaaatctggttgcaaatacagcagccggtattgctggaggcaccggtgttatgccaggaggcattgtgggagc

SEQ ID NO: 11973 - DNA, 57 bp, Gossypium hirsutum
  Clone ID: uC-gsflmaxxa008c04b1
ggaccgtccggattccttgtcacccacgcgccggtagcgcgggaaccagacaaacaa

SEQ ID NO: 11974 - DNA, 407 bp, Gossypium hirsutum
  Clone ID: uC-gsflmaxxa008c05b1
caaaaaaaaaaaaaaaaaaaaaaacacacaacaaaaaaacaacaaaaaacacaacaaaaaaaaaaaaaaaaaaaaaaaaaaaaaaaaacaaacaaaaaaaaaaaaaagaaaaaaaaaaaaaaaaacaaaaacaacaaaaaaaaaaaaaacaaaaaaaaaaaaaacaaaaaaaaaaacaaacaacacaaaaaaaaaaaacagaaaaaaaaaaaaaacaacaaaaaaaaaaaaaaaaaaaacgaaaaaaaaaaaaacaaaaaaacaaaacaaaacaagacaaaacaaaacaaaaacaaacaacaaaacagaaacccaaaaacaaaaaagaacaaaaaaaaaagacaaaaaaaacaacaaaaaaagaacgaactaacacaaaaaaccaaacacaaaaaacaaaaccaaac

SEQ ID NO: 11975 - DNA, 270 bp, Gossypium hirsutum
  unsure (1)..(270): unsure at all n locations
  Clone ID: uC-gsflmaxxa008c06b1
caggaacacgtaccggaagacccgggacgacccaagcgcccggaatgaaacaccgacngacaagaaacaaaaaaggggggggaattaaaaagggaaaaaccccaccaatcccccccaaacaaaaaaaaagaaaaacaaagcaaacaaaaaaagaacaaaaagaaaagaaaaacaaaacaaaacgacacaagaaaaaacaacaaaaaacaaaaaacaaacaaccacaaaaaaacaaagaaacaaaaaaacaaaaacgacagaaaaaaacaa

SEQ ID NO: 11976 - DNA, 72 bp, Gossypium hirsutum
  Clone ID: uC-gsflmaxxa008c08b1
ccggtagaagcgcatcgaacccagagcgcaggggcgataaaagcacggccagccttccgcggcggagacaac

SEQ ID NO: 11977 - DNA, 86 bp, Gossypium hirsutum
  Clone ID: uC-gsflmaxxa008c10b1
gcagaccggtccggaaaccctgggacatcccacgcgccctgatacacagccgcaaaaagaaaaaaggaccgggagaattaagggga

SEQ ID NO: 11978 - DNA, 313 bp, Gossypium hirsutum
  unsure (1)..(313): unsure at all n locations
  Clone ID: uC-gsflmaxxa008d02b1
tgtaaacaacaaaacgaaagcaaaagaagggggaaataaaagagatacccccgagattcccccaggagagaangacaaaaaagcacccaaaaaaagacagaaaaaaagaaaacaaaacaaaacaaaaaaaaaaaaaaaaagaaaaaaaaaaaaaacgaaaagagacaaaaagacaaaaaaaggaaaagaaaaaaaaaaaaaagaaaaacaaagaaaagaaaaaaaaaaaaaaaaagaacaaaaaaaacaaaaaaaaaaaacgacaaaagaaaaaaaagaagaaaaacacaaaaagaaaaaaaaagcaacggag

SEQ ID NO: 11979 - DNA, 107 bp, Gossypium hirsutum
  Clone ID: uC-gsflmaxxa008d08b1
cccacgcgaccggtaaagccccgatgctctgcgatagctccgccactcgccctcaccgagagcgccccgcgcttccgccagcgcaccagagaccaggaagccaccac

SEQ ID NO: 11980 - DNA, 538 bp, Gossypium hirsutum
  Clone ID: uC-gsflmaxxa008d10b1
aggaccgtccggaaaccatgacgaccaaacccagattaaaacaccaaaaaaaaaaaaaggggggaaaaaaagggaaaaccccaaaacccccaaaaaaaaaaaaaaaaaaaacaaacaaaaaaaaaaaaaaaaaaaaaaaaaaaaaaaacaaaaaaaaaaaaaaaaaaaaaaacaaaaaaaaaaaaaacaaccacaaaaaaacaaaaaaaaaaacaaaaaagaaaaaaaaaaaacaaaacaaaaaaaagaaaacaaagaagcaaaaaaagaaaacaaaaaaaaaaaaaaaaaaaacaaaaagagacaaagaaacaaaaaaaaaaagaaaaaaaaaaaaaaagaaaaacaacaaaaaacaaaaaaaaaaaaaaaaaaagacaaaagaaagcagaaaaacgacaaaaagacaaaacaaacaaagaaaggaaaaaaaaagaaaaaaaaaaaaaaaaaaagaaaaaaaaaagaaaagaaaagaaaaaggagaaaaaaaaaaaaagaacaaaaaaaaaaaaaagaaaaacgaaagaaaaagaaa

SEQ ID NO: 11981 - DNA, 237 bp, Gossypium hirsutum
  Clone ID: uC-gsflmaxxa008d12b1
cttaagccccccactcccaggcaagcaatcgggagggcttttaagctacgaggcgctgcatatccccacccctcccaagtcttttcgatctcgtagggtttatttcagcaatgaggaaaacggatcactgcttgtccccaagggccaggctcagaatgcacaagcacaaatggtctctgaccctaacatggctatggacatgatgaagaaaaacccttcctatgattatacctcaca

SEQ ID NO: 11982 - DNA, 458 bp, Gossypium hirsutum
  Clone ID: uC-gsflmaxxa008e05b1
cagtatactgttttttttctttccccattctcatagctttcatcatcttcaaatggctaaatcacttgtcattgttatgttatgttttctcttagtaattgttttacttggagaaatccaggcatcaagcccttctcaaaaacaaagacaaggcaaccatggaaatggaatgtatggtgccacccaagggagccttcgtcctcaagagtgtggtccaagatgcacacagagatgctcagctacagcatacaagaaaccatgcatgttcttctgccaaaagtgttgtgccaagtgcttgtgtgtgcctccaggcacttacggcaacaaacaatcttgcccttgctacaataattggaagaccaagagaggaggccccaaatgcccttagatccctaactatatctatgttgttctctagttaaagtgcttaattatccaattataggccattaatcttc

SEQ ID NO: 11983 - DNA, 86 bp, Gossypium hirsutum
  Clone ID: uC-gsflmaxxa008e11b1
atgacgcgcgggaggcggagaaaaaaacgaggggcgcttataagaaaaaacacccaaattccccccccaacaacaaaaaaacaaca

SEQ ID NO: 11984 - DNA, 130 bp, Gossypium hirsutum
  Clone ID: uC-gsflmaxxa008f04b1
accggatccgaaacccgggacgacccacgcgccggataaaaccccaaagagaccacaaaagggggacataaaaaaaaaccccaaaaaccccaacaaaaaaaaaaaaaaaaaacaccaaaaaaaccacaca

SEQ ID NO: 11985 - DNA, 53 bp, Gossypium hirsutum
  Clone ID: uC-gsflmaxxa008f05b1
ggaccggttggaaacccggttcgaccacgcgcccgttttaaaaccagaagaag

SEQ ID NO: 11986 - DNA, 97 bp, Gossypium hirsutum
  Clone ID: uC-gsflmaxxa008f09b1
atacaacccccgacacgccaagataccacgagaaggctgttcaagaagagaccccctccctatccccaagaaccaaaaggacacacaaacaaccacc

SEQ ID NO: 11987 - DNA, 57 bp, Gossypium hirsutum
  Clone ID: uC-gsflmaxxa008g01b1
accggaacggaaaacccggttagactcacacccccccctttaaaaacccacgaccac

SEQ ID NO: 11988 - DNA, 275 bp, Gossypium hirsutum
  unsure (1)..(275): unsure at all n locations
  Clone ID: uC-gsflmaxxa008g03b1
ccccttcggaaaacccggtgcgacccacgcgnccggtaatcacaacccatnacgccngccacagcagcgggccaaacccacggacagagcccacacttccccgaagacaagcgcaagaccgcgggcacgactggaaaaccaggcaacgctgacagagcagggaggaccacccagcgcaacaagcacgacagcgagagggaacaaacatccaggataagagggtgcgggaagcacagcaaggggacaagaaagcggatgacgcgcagaaggaccgg

SEQ ID NO: 11989 - DNA, 154 bp, Gossypium hirsutum
  Clone ID: uC-gsflmaxxa008g04b1
cgattcttttgctcgatctgaatctggttaaaatttcatattaacaatggaagagctgaaatcagctgcggaggagcacatggaattaatggcggatctagttcagaagctatcctcggagcttcgttcgggccttcgacccgtctatgataac

SEQ ID NO: 11990 - DNA, 130 bp, Gossypium hirsutum
  Clone ID: uC-gsflmaxxa008g05b1
cctatgcgacacgcggaacccctcggcacaaaaagggcgcaaatgggagggaaccccccgcggaaaaccccggaaacaccaaaggaagcaaacaaagcacccccccaccgacaaaacaccaaaaaaccaa

SEQ ID NO: 11991 - DNA, 244 bp, Gossypium hirsutum
  Clone ID: uC-gsflmaxxa008g06b1
ccggaacggaaaacccggatagacccacgcgaccgatatttaaacaccccacacaaaaaaaacaacggggggacaataaaaagaaagccccccaaaacccacccaacaacaaaaaagaaaaaaaaaaaaaacgcaaaaacaaaaaacacacacaaaaacacaaaaacaaagacaaaaaaaaaaacaaaaagaaaaaaaaaaaaaaaaaaacacacaacaaaaaaaaaaaccaaaaaacaaagaa

SEQ ID NO: 11992 - DNA, 65 bp, Gossypium hirsutum
  Clone ID: uC-gsflmaxxa008g08b1
aggaccggccggaaccccgggcgacccacgcgccgatacgcgcccgaaaacacagaaccgggggg

SEQ ID NO: 11993 - DNA, 104 bp, Gossypium hirsutum
  Clone ID: uC-gsflmaxxa008g10b1
ctaactcaaagattttctcttttccttaaagagagaagaaaattggggcattccacccctatatttcccctcaacacaggggaacctaaaacccccccgcaagg

SEQ ID NO: 11994 - DNA, 502 bp, Gossypium hirsutum
  Clone ID: uC-gsflmaxxa008h10b1
tgttattcaagcttgcaaatgattcaagatatggtcttgtgttgtgctgttttctccggcagtcaaaggcgcgccaaggagatagcttcccaaatacattgtggagttgctgcagttaatgattttgcatcaacttatatgtgccagtccctgccttttggtggcacaaaagatagtggattcggccgatttgctggtgttgagggattgagagcttgctgtttggtaaagtcagtcgttgaggatagatggtggccttatataaagaccaagataccaaagcctattcagtatcctgttgctgaaaatgggtttgagtttcaagaatcgctggtggaggcactttacggcttgaacatttgggaccgtcttcgggcactggtcaatgctctaaagatcatttcggagcaaaacccttgtgccactagcaagataaatgactgagttcccacaccttcccaccctcaactagctagttctactttctcaacctttatatttt

SEQ ID NO: 11995 - DNA, 316 bp, Gossypium hirsutum
  Clone ID: uC-gsflmaxxa008h12b1
taattgctgtttctttctgcctctattgagttgtgttatttattgatcaaatcgcgtctgttttcacgcatccggatatcatctgtgatccttgatgattttttttcatgttgaatccaatcctgaatatacgatgagatctgaaccttatcttgggctacccgaaattagaggataaaccatgaaaccgatgtgacaaccattccaaataatcatctgcagatcgcgaataatcgctctttttaggcattctaaactggctgatgcagcaccgtccatcaagtgcttccaattaaccattctggactaccaattc

SEQ ID NO: 11996 - DNA, 510 bp, Gossypium hirsutum
  Clone ID: uC-gsflmaxxa009a01b1
gcttttacgcatccggacttataccattaacagtagctaagccgtaacgagaagcaactcctattatggtgactgctctggacatattcttgtgtcttcagcacgagggagattgttcgattagagaagcgtggtatcatttatccgatgaatacccgatcaaatacgaagctgaacgtctccccccgcctctcgttgccgatctgaatggcgacggaaaaaaggaaatcctcgtcgccactcacgatgccaaaattcaggtattagagccacacgcacggcgtgttgatgaaggattcagtgaagcgcctttgctggcagaggtgtctctgttgcctgataagatcaaggttgcttctggtagacgtcccgtagccatggccaccggtgttatagatcgaatttattagtctgggcaacctcagaaacaggttctggttgttgttacttcaggctggtcctgtatgtgttttgaccataatctcacaaagttatgggagaataatttgc

SEQ ID NO: 11997 - DNA, 336 bp, Gossypium hirsutum
  Clone ID: uC-gsflmaxxa009a06b1
tttatatctgaaaaaggctttctatggggcaaaaggtcccacctttggctccaaagttagcaactacccaccatgttcgaccccggacaaaattcatggagtccaaactctcgatgaggccaagagcaatttccctaatggcaagtacctctttgctggagtctgtggacggaaggaacatctgggccaatgatcttgctgcttctttcagcactatgaaggagcttgaggctgttgctggcaaagaaaaccctgtggtgtccacatcatgctggcttgtccacaccgctgttgatctagcgaatgagactaagctagacgacgaaatcaaatcgc

SEQ ID NO: 11998 - DNA, 386 bp, Gossypium hirsutum
  Clone ID: uC-gsflmaxxa009a07b1
cccacgcgtccggacttatcccatcaacgttagctaaaccgtttcgcagagcaaaacccagttaggtgatgcaactggactcatcaggaagcattaacaatcacaatgatgcccacaatagttggtagcttaattttggtgaggaaaagccgaaagatgatgagggtatttcctccctcattattgaagttgtggaaggaatgggagatccgagcaatggttgtaaccagccttgtgctccaaattttgctcatttcatttggcaagcgcagaaaaaggagttcaaaaagaaggattagagctgctgttggtgttcctatttgttggctgattctgagcaagtattcgccttggcatactaacaaatgacctggctgatatatatg

SEQ ID NO: 11999 - DNA, 564 bp, Gossypium hirsutum
  unsure (1)..(564): unsure at all n locations
  Clone ID: uC-gsflmaxxa009b03b1
cccacgcgtccggagaatgcatctgttggaaagactacgtatgttcactgcaaggcaggtcgaggacgcagcacaaccattgttctctgctacttggtggaacataggcatatgactcctgatgcagcttatgagtatgtgagatctatcagacctagggtccttctggcacctgcacagcagcaggctgttcaagattactatcttgacaaggtgaatgataatggaatctgtggggactggtgcttaatgataatgcagaacactctaggtgctgcatattcacaggcatcggatcatctctgttacagattatcaagacagcgaccagcggaggtacggcataagtctgcacttttggtgttaaagaattgcgaggagactggtcttgcattgggcttttcttttctgttagttttgtagggaaactgatgatatatttactagagatatgcttacgttgtgaaatgttcngaatttgaataaagacctccctttctttgtctggtcatagagctttgtctgctacttttttcattattgcatgagatggacaaaaactga

SEQ ID NO: 12000 - DNA, 521 bp, Gossypium hirsutum
  unsure (1)..(521): unsure at all n locations
  Clone ID: uC-gsflmaxxa009b04b1
cccacgcgtccggaattggtgaaacccgaattcactaccaacgagcacagctttcaccattatcaatccttgagtcacccatccgtttgtttgaggaagaaagagaaagcccagaagagatataaccaaagtaaaagatgtacgtgagagctgtgccacccacagatctgaacaagaacactgagtggttcacctattggccgtaatgtacgcgaggatcaatcggggcaaactccgtatcagatgaaccagtgagaggtagccagctccggaaccgaccctgcgatgaaatctatgtcgttggcgaaggtgaaacccttcactccatcagcgacaagtgtggcgatccgtttatcgtcgagcggaacccgcatatccatgaccctgacgatgttttccccggccttgttatcaagatcatcgcttcaactgataggaaattatagaggtagctggttttacacattatacacacagaanattttaatattgtatactgggctctggtcttctttggttct

SEQ ID NO: 12001 - DNA, 484 bp, Gossypium hirsutum
  unsure (1)..(484): unsure at all n locations
  Clone ID: uC-gsflmaxxa009b05b1
cttctttcatttccccatattacctgttttctcttttctctcatctttccccccaactcttgtcaaatgatagaaaggaaacatgacagtaattcaagccaagtgataaaaagtttcagcctgctgttactgtctctggtttcttttgaccgttttttaaaactctgtttcttaattcgttgctcctctactttgcattcattctctgttttcattgacatgggttataaaggtggtctgatgaagctaaatatatgccgattttggtatgacttttgaagcacctctattgatccgacactggcataaaagggaatggatagtttgtgaacatcctatttagtggctatgacaaagagacaggaccatctctgttctatatcgactacattgctacacttcataaggttgataacggagcatttnggtatggatcctacttttctcttgctatgatggacaggcactaccacagtggcatgac

SEQ ID NO: 12002 - DNA, 404 bp, Gossypium hirsutum
  Clone ID: uC-gsflmaxxa009b06b1
cgcgcatttttacttaacattgcccaatacaaggtgcctgcatacttgggtgcaatttcaggtttcgcatgctttatggctgctttggtgtcccttggaatttctatttcaattgtgcctcgacaagtgatgccatggactggtttgctcttgatgtatgagtggacgttttcaatcttctttctttcattcggagcatttcttcatttgatttatctgtggggaaaaagagaaccagggccagtttcctctcgtatggatcctattgattcggattctagaaaaggttatcgacaggcatcctcttgcgatattgttacttggtattatgggttgaggatggcttttttggctatcgcaggcccatccttaccatgtatttttggaatcaccgctctgttctg

SEQ ID NO: 12003 - DNA, 324 bp, Gossypium hirsutum
  Clone ID: uC-gsflmaxxa009b11b1
gttataaactcagaatcaacagatcgaagtgaaaatggagtgtgtgttcggtttagtgggcaacgactttgccatagtggcggcggacacgtcggctgttcacagcatccttgttcacaaatctaacgaagacaagatcatgatcctcgattctcacaaactcatcgccgccagcggtgaatccggggacagagtgcagttcacggagtatatacagaaaaacgtggccttgtatcagtttcgaaacggtattcctttgacgactgccgccgccgctaatttcactcgcggtgagcttgccactgccttaaggaagaatccata

SEQ ID NO: 12004 - DNA, 399 bp, Gossypium hirsutum
  Clone ID: uC-gsflmaxxa009b12b1
ctgtttcctaacagtgcacagaacaaggtgcctgcatacttgggtgcaatttcagttttcgcatgctttatggctgctttggtgtcccttggaatttctatttccattgagcctcgacaagtgatacccatgtctggtcaattcatgcccttccaatccctcaagcttgacctgcctgaactgcaaggagaaccggaagaaatatccaaagaaaaggcttgtttggctgctgtccaggtgaatggaccagtgttggttgaagatacatgtctttgtttcaatgcactaaagggtcttccagggccatacgtcaagtggtttttgcagaagattggccatgaaggtttgaataacttgttgatggcatacgaggataagtcagcttatgctttatgcgcg

SEQ ID NO: 12005 - DNA, 354 bp, Gossypium hirsutum
  unsure (1)..(354): unsure at all n locations
  Clone ID: uC-gsflmaxxa009c01b1
tgctgcagccagccacagcattcgccgcacggcatcagtctcagcaggcggggaagaatgtctcacaggaagttgaacacccagctgtgtcctagtatttctttcatgctcttggcttgtctcatttcctgcactacagcacgggattccagcagagaagctctacaagttacaattggtattggcaatggcaacttaagcaagggctgtaatgataaacaccataatcttccattcaaactcaattgtaagttgccaacaacccccttagcaaatgaagtattgaagtttgctgatcaaagactggctttagtgcatcccataatccanaaatttaagtctttaatcacttca

SEQ ID NO: 12006 - DNA, 365 bp, Gossypium hirsutum
  Clone ID: uC-gsflmaxxa009c07b1
aaaataatacttgatttttagttttgggtgaattatgaatgtaataataatgtatcacttgaagattgaacacccaagcatgtttccctggtatttcttccgaggaagcgaagcttctcgtcacagagggaaagtgaaggcatttcctaaggatgacccaagcaaaccttgcaagctcactgcctttttgggctacaaggcaggcatgacacacattgtccgagaggtcgaaaaacctggatctaagcttcacaagaaagagacatgtgaagctgttacgatcattgaaacccctcctatggtgattgtggggttgctgtttatgtcaagacaccacgtggtcttcgcagcttgaacaccgtttg

SEQ ID NO: 12007 - DNA, 427 bp, Gossypium hirsutum
  unsure (1)..(427): unsure at all n locations
  Clone ID: uC-gsflmaxxa009c12b1
ccctcgcgtccgaccaaagcccccccttgccgaccaggaaattaaataagcagttcagactttaaggattctgcttcatcatggtcaacgcgactaaagggctggtcgatgctcgtgacatttccatgccacagtattatatggacgtgagagccgtgccacccacagatctgaacaagaacactgagtggttcacctatccaggggtttggaccgcttatatcttgatcgttttcttttcgtggctcatggttttatctgtatttggcacctctcccggaatcgcttggaccattgttcatctcacccatttctttgttacatatcacttctttcactggaaaaaggggacaccatttgctgttgacccaagtatctaccatggctcgacctggtgggagcanatagataacggcaagcaactcac

SEQ ID NO: 12008 - DNA, 498 bp, Gossypium hirsutum
  Clone ID: uC-gsflmaxxa009d04b1
gtctcacaggttgggccaatttcaattaatctcattgtctcatatattcttctcagcttggtgttgtgaaggaaattcaaaatgggagattgtaagggagatagactaagagcatgttgttttatcattatcttggttatgctgcttgtgtgctgctgcaccaatggagaagatccatacaggttctatacttggaatgtcacgtatggtgatatctaccctcttggagtgaaacaacaggtgatattgataaatggccaatttccgggaccacaaattgaaaccgtgaccaacgaaaacttgatcattaatgtcttcaatagcttggatcaaccctttctcatctcttggaatggcgtgcagcagagaagaaattcttggcaagacggagtatatggcaccaactgccccatccctccctgggggaacttcacctacactcttcaagtgaaggatcagattggcagctacttttacttcccatcgctcgccttacat

SEQ ID NO: 12009 - DNA, 518 bp, Gossypium hirsutum
  Clone ID: uC-gsflmaxxa009d06b1
tctacagttctcaactaaacttataacgttcgatcgtttaacgcaaacccatttttaagtgggggaaaggtttaagttcagagtcataagcaacatcaatggctccttcaactctgacggctcttgcggaagagaaaaccttgcaggcaagcttcgttcgtgatgaagatgagcgtcctaaggttgcttacaaccaattcagtaatgatatccctgtcatctctcttgctggtatcgatgatgttgatggcaagaggggtgagatatgcaagaagattgttgaggcttgtgaggacttggggtgtcttccaggttgtggatcatggtgttgatactaaactcgtgtccgaaatgacccgttttgccagagagttttttgctttgcctgctgaagagaagcttcggttcgatatgtctggtggcaagaaaggtggtttcatcgtctccagccaccttcagggagaagcagtgcaagactggcgggagattgtgacatacttttcatacccatttgagag

SEQ ID NO: 12010 - DNA, 315 bp, Gossypium hirsutum
  Clone ID: uC-gsflmaxxa009d09b1
cagctttcaaaatagttccccactttctttctctcatggtttcatttcaatcacataacaagtaacatataggtttaaacatagtaaaacaatgagcatcattatttctttcatgctcttggtttgtctcatttcctgcactacagcacgggattccagcagagaagctctacaagttacaattggtattggcagtggcatcttaagctggaggctgtttatggtttacatcaacatggtggatgggaaccggtttgaaaggagaccaccactttgggaaaccagttgggttcttctataaccttccatggtttt

SEQ ID NO: 12011 - DNA, 570 bp, Gossypium hirsutum
  unsure (1)..(570): unsure at all n locations
  Clone ID: uC-gsflmaxxa009e04b1
ttcacgcgtccggtgaaattgtagaccataaaaatataataaaaacaaattttaatgtgttggatttgtggtcccgaaaccactgttccgactaggccctaatttgggatgttacacatcatcatttgaaaaatatttaaaaattagaaaatggaaaaaaataatttaaattttataaaattataaattagaaaagaaatataaaaatataaaaattattatttttaaatttttaaaaaaatatattagaagtttaatatctttaaaattttataaatcacatttactggagcttgaacatgagattgttgtcgcttagaatgatatcacctactataattgttttataattcaatcaaacaaattttataataactgatagatctttttaggtgataaattggataaacttttttttcaaattatttaaataaatttaaataataaataaaattatttttattagtttttatctattggtttcaaagataaatatcataattagttntactcaaatcatatgtatctatacttaanntactattataagatttaatttagcatcatggg

SEQ ID NO: 12012 - DNA, 405 bp, Gossypium hirsutum
  Clone ID: uC-gsflmaxxa009e07b1
gctgttatctgtttgtgctggacaaattcgattgcatagggccaatcatgacatctattgtggctggtgcgattcttctcttgctgtcgttgaccggaattgtctcagccggtagagatgtaaccggagacatactccggttaccttcagaagctaataagttcttccatgggggtgacgatgatgaagttgaaggcacgagatgggcggtcttgattgccggatctaatggatattggaattacaggcatcaggctgatgtttgtcatgcttatcaactgttgagaaatggtggcctaaaagaggaaaatatcattgcttttatgtatgatgatattgcctacaatgaagaaaaccctagacctggaatcatcattgacaatccccatggcgattatgtttata

SEQ ID NO: 12013 - DNA, 538 bp, Gossypium hirsutum
  unsure (1)..(538): unsure at all n locations
  Clone ID: uC-gsflmaxxa009e10b1
cccacgcgtccgtttcaatggcggtttcacggcttaggaacccagttctctcaagagccctcccatctctgtttagagctcgttttctatcttccttcgcctcacccacaccactttctcgcagttcaaatgtggaaaggcctttcaaggactgggatggatcttgcttaaggtccaatgctttgtccaccataattggagtatacggtaattcatcaaagctcaagttgcagattggagttcgtcatttctcttcttcagaccttccggagcatacagtgctggggatgcctgctttgtctccaacaatgagccaaggtaacattgcaaaatggaagaagaaagaaggagataagattgaacctggtgatatactgtgtgaaatagagacagataaagcaacacttgagtttgaatgtcttgaagaagggtttttggtcaagatactagtacctgaaggttcaaaagatgtgccctgtggngcacccattgcaagtatggttgaggatgaagaaaatatcacgaagatcccttttac

SEQ ID NO: 12014 - DNA, 315 bp, Gossypium hirsutum
  Clone ID: uC-gsflmaxxa009f02b1
gtcgtctgtaataaaatctgcaatcttaattctgtcggtgtttttatctgtacgcttcagttcgggtgttaggttgctccaggaacagcccaatgatgaccccaaaaacatggacgctattcctcccattgatgcactcaaccctaccgagttgaatggacccggtgttggcattcacgcagatcatgttggacgattaggggctgtggtgggaatctgaagtggcgtgctctgaggctcgacaccggaaactactcatggggaagtgaggctgtgacttcgtagaccaggattttggatgtggtgtacaatgca

SEQ ID NO: 12015 - DNA, 552 bp, Gossypium hirsutum
  unsure (1)..(552): unsure at all n locations
  Clone ID: uC-gsflmaxxa009f05b1
gttataaacaaattactcttttttttaaaaggaaagaaggaggaggaggaaatggatggaaaaagaatcgagggcaatgaagtttatgctctagcaatgtgtgtaagtattctcctctttgctccgattgttgtgtcacaaccaataccggcagataaatcccaagtggaagcttggtttaatggcattatcaagccggtgaaggaaaggggtacaattttagaccctgaattggttcaagccgagacagaacctagaatcataaaggtgatgcaaggtgggggtggtagaattcgataccataaccaaagccatcgagagcgttccatcagggaacgccaaacgcgtgattatatccatcggacctggatcttacaaagagaaaattagaattgaaagaaataagcctttcattacattgttaggagatcctaaaaacatgccaaattngacattngacggcaccgcccagcaatatggaaccgtagatagtgccactcttattactgagagtaattaccttgtgggtgctaatctcatatagtgaactct

SEQ ID NO: 12016 - DNA, 403 bp, Gossypium hirsutum
  Clone ID: uC-gsflmaxxa009f09b1
cttcttctcttcatattggttttttcccttagcactccacgacacagatccgaggagttggggaaaaccctcacacaaattctatatctaaatcttaaccgagcaagtctccaaaaaagactactaacttggcatattgacaaaattcacagtgaggcttcagtcgagaaaaatgccaaagaaataaaggattacattgaggaaatttattggggttccaagaaacgcgttttgcttcttggacatagcaaaggtggcgtagatgcagcggctgctttatctatctattggtctgacttgaaagataaagttgctgggttggcaatagcacagagtccgtatggtggaagccctatagcttcagatatcttgagagaaggtcaactcggtgattatggtaata

SEQ ID NO: 12017 - DNA, 442 bp, Gossypium hirsutum
  Clone ID: uC-gsflmaxxa009f11b1
ccacgcgcgctttttaaaatccatgtagcaatgcgttactgccttttagccggtggcagaaagggtccgcccgggactttgggtggctgactgtgaccgctgtagcgggagagaatgcatggcttcgccatgctcctagtgctgttgaacagccccacaccatggatttagtccacgatgatcctccttgcatggacacgatgatctccgtagagggaaaccaactaaccacaaagtctatggtgaagatatcgctgcgttagccggggatgctcttttagccttttcgtttgaacatataactggatccacagttggtgtcacacctgagaggattgtcagggcaattggagaattagcttaatctcatgggactgaaggttggcggctggtcaagttgtggatataacagtgagggtcttaccgatgtggggtgggtcat

SEQ ID NO: 12018 - DNA, 229 bp, Gossypium hirsutum
  Clone ID: uC-gsflmaxxa009g01b1
gtctttgttccggcaagcgtcacgcctcttggctcgaactaccaccccatggaggagaagtcgagcattttcgtcagatctaccagccacacccgctcaagattcgaacttcatcgaatcatggtccaaagtcatacccaacatagacccttccaagacaccatcttctttcatgacccctcgacccggcaccccttctggtatcccttttgaactcacctttgatact

SEQ ID NO: 12019 - DNA, 404 bp, Gossypium hirsutum
  Clone ID: uC-gsflmaxxa009g02b1
cttcttccatcctcactccacatttcactctctttttcaactttcccttcttctctttgttttaaagaggggcttgagttttagccaaagaaaactacatggctaaacttgtggctagtgccttatagactctgatagacaacctgatcaagcataaccggaagttcggatccggaaatccccgcggtcgaggccgtggatccggaccgggacccgcccgccgctttcctaaccgcggaacaaaccgctcggcaccgtataccgttgctacggcgcctgagacgacgtggcagcacgatatgtattcggataagggaggagcgctccaaggtcaaagccgtcgggccgcttcaataagaaccggaacgaagctctacgtctctaatttagattatggagtatct

SEQ ID NO: 12020 - DNA, 487 bp, Gossypium hirsutum
  Clone ID: uC-gsflmaxxa009g05b1
ttcaaggaagcacttgctgttggatacggcacagaaggtggtgtagattactttcttgtgaggaattcatggggtcctaactggggagagaatggatacatcaagatggaacgtaatgtcgcaggtacatcaaccggcaagtgcggtattgcaatgatggcctcgtaccccatcaagaaaggaccaaatccacctaaaccggctccatctcccccttctcccgtaaaacccccaaccgtgtgcaacgagtactactcatgtcctcaaggaagcacttgctgttgcttatatgagtatggcaaatactgccttggctggggatgttgcccaatggaatctgcaacctgctgtgatgatcactacagttgttgccctcatgagtatcccgtatgtgacctgacagccggaacttgccgcatgatgcaggacagtccattgggagtaaagctattgaaacgaggtccggctaagttgattaccaagcaac

SEQ ID NO: 12021 - DNA, 510 bp, Gossypium hirsutum
  Clone ID: uC-gsflmaxxa009g06b1
tccacgcgtccgctttcatatttcccaaaccttaccttatctagggttagggttttgctccttctgagtttctctctcaataccaaaaatatctccaaattgaagatgatgcaacaaccagcacaagctatggtaccaccaccaatggctccaccaccttctatggcgggtgctccacagacccaacaacagtaccaatatcagcaaccacctccggctccggttcctcagacacaaccaccttacatgatgatgaacatgatgcagccgcctcagagtcatcctccacctatgtggcccccacaacaaggttcggctggggtaccagctcaacaacagccagcgggtcaaccggctaacgcagatgaagttcggactttgtggatcggagatttgcagtattatatggatgagaattatctcttgagctgttttgcccaaactggagaggttgcttctgtaaagttatccgcaacaagcaaaccgatcaagtggagggctatgggttta

SEQ ID NO: 12022 - DNA, 416 bp, Gossypium hirsutum
  unsure (1)..(416): unsure at all n locations
  Clone ID: uC-gsflmaxxa009h02b1
gaaaaaaactcagaatcaacagatcgaagtgaaaatggagtgtgtgttcgtgctagctgttcttccccaaatcgataacccacctccaccgatccaccattccacctctggtgtncagtcctncacaactccacctccgctctagccttcaacgtggtagaatttcaaagggctgaattctgagatcaaatacaagtatattttttctgcttctttcatgcatgctggttcacaaacagcaggtggtagccttgtcaaggcttgtggtagcttgggtgctattaaacaagatcatgaaccaaagaaaatggatttggatcggngaaaaataaaaataattgaatagtcggctattccgtccgtcgatatccgaggttagtttattagcaaattaatattttaattttttattaaat

SEQ ID NO: 12023 - DNA, 185 bp, Gossypium hirsutum
  Clone ID: uC-gsflmaxxa009h05b1
ttcacgcgtgcgcccacgcgtccgcggacgcgtgggctaggactgtcttcatgtctcaaccgactttgttcattttattttattcctggctggtgttagatactggcagaacacgctgttctctagtatcatatactgatggtagaccattaaatcgcataaccactgtttatagccagcgcaat

SEQ ID NO: 12024 - DNA, 410 bp, Gossypium hirsutum
  Clone ID: uC-gsflmaxxa009h08b1
cggtcgacgaacagtcgactcagaactggtacggacatggagggtgtgttctgtttagtgggcaacgactttgccatagtggcggcggacacgtcggctgttcacagcatccttgttcacaaatctaacgaagacaagatcatgatcctcgattctcacaaactcatcgccgccagcggtgaattcggggacagagtgcagttcacggagtatatacagaaaaacgtggtcttgtatcagatttgaaacggcttttccatggtcgagggaggtcgggtgctattttacaagatcatgaaccaaagaaaatggatttggatcggggaaaaataaaaataattgaatagtcgtctattccggccgtcgatatccgaggtaaggttataagcaataaatattataaattttaa

SEQ ID NO: 12025 - DNA, 411 bp, Gossypium hirsutum
  Clone ID: uC-gsflmaxxa009h10b1
ttcaatttctccggaaacggaaaaccagtaaagtattgtttggaaatttgcaatccaagtaaatgcaaaagtcgtgtcgtttcatttctcgcttccttcgctcctccaagcacacttcttcccctatcattgttaactcatcgtttaacaatctctcccattttgattttttaaacccccgaaatcagagctttttccaatttagtccccatacaacaaattctgggcaagccagaggtttgaaacgttgcgttttgctgggttttgtattgaccgctgatgatcccatctattatcagcatcatacacatttttactctctccgtcgaaaatttttcacgagggctaaacaaataaagaagattgaaatcaatgatcagcacagtcaacgtgctgttacaactgctttat

SEQ ID NO: 12026 - DNA, 330 bp, Gossypium hirsutum
  Clone ID: uC-gsflmaxxa010a11b1
taaaatttcaacttcatatattcgcagtagctggcaggaccagcaagaatatgagtcttggaaatctggcgagtgcagtcggcaatgttgtcggcgacattaccggccttagtaaacccagcaagaacacaatcacaggcagtgttgttatagttaagaagaatgttttggacttcaccgccgtgcattcaactgtaagctgctagcctctttgaattgctcggcaatcaaaagggattacagctcgactgagctgcaaatgccgaccctgcaaatgaaaatggtggtcagctgctgaagatataggtaacggaatactggaaccatgca

SEQ ID NO: 12027 - DNA, 537 bp, Gossypium hirsutum
  Clone ID: uC-gsflmaxxa010b10b1
ctctcttttagcatatagacaatagcaaatgcagcaatggcttccagtgggctgcttcatgtggatttcgagctcaagtctcctgcagaaaaagtgtggggaaccattagggactccaccacgattttccctcaagccttgtcccatgattacaagagcattcaagtgctagaaggcgatggcaaggcccctggatctgttcgtcttattaactatgccgaagggtctccaatcgttaaggtatcaaaagagagaatcgaatcagtggatgaagctgagaagaaatatgtttacagcatcattgatggggatctcctgaaatactacaagactttcattggcaagatcattgtggttcccaagggagagtcgagcttggttaaatggtcctgtgagtttgagaaggcatgtgaagagatccctgatccaagcgtcattaaggaatttgcagtgaagaactttaaggagatcgatgactatcttcacggtagggcttagagaggccaagccatgccattgcatgccatgcatgatcct

SEQ ID NO: 12028 - DNA, 441 bp, Gossypium hirsutum
  unsure (1)..(441): unsure at all n locations
  Clone ID: uC-gsflmaxxa010b11b1
cccacgcgtccgcccacgcgtccgatctcaacagcgacgatgaccatgaatctggtggaatccgttggcgttagggttcctcctagtgcaccggcatcgtttttctcctctaaaggtacgtgtaaacgcggaggcagcgtccgacctggtttctgcaaacgagatttctcacagaacaacgcaaatttcggatggagcgcggttccgttgcggttcatgtactttcgtaatgattcatgggttaatttctcggccgatgtagtagaaacgctccgagccggtttcttggagcggaaaccgattatcgagacgtcgattgacggttcgaagtatatatttgatttcaagaggatgctgcagatcgagtactcgacaggtaattgcccgtcaatttcttggatagacgaaagtggcangtgttttttccttaccgatttttta

SEQ ID NO: 12029 - DNA, 236 bp, Gossypium hirsutum
  Clone ID: uC-gsflmaxxa010c04b1
tatgaatttggatctaatatgcaaattctcaatctgggggcttttaatttaggtttaaaaaataaaatctaatctgccttaaatttaggaaattttttttggtaataactgaaaattttcatttcaatgtaaaaattatgctttgaaattaaattttttgcttgagttttgggctattttatttttaatttcggacatgcttcttatccagctgaataacgacggttagttgtagc

SEQ ID NO: 12030 - DNA, 154 bp, Gossypium hirsutum
  Clone ID: uC-gsflmaxxa010c05b1
cggatacattcatgcattaatggaaccattctgtttgccgatgatttattacttttcctttttatggactcaaattataaataataataataataataataataaaacaggggaagtcgtaagaagaccatgatgaagctatgaactaataact

SEQ ID NO: 12031 - DNA, 340 bp, Gossypium hirsutum
  unsure (1)..(340): unsure at all n locations
  Clone ID: uC-gsflmaxxa010c10b1
gatatctgttccttccgagtctctctatttctcaggcagtcaatttatttttaaaaaataaaatctaatctgcattaaatttaggaaattttttttggtaataactgaaaattttcatttcaatgtaaaaattatgctttgaaattaaattttttgcttgagttttgggctattttatttttaaatccggacatgttttcgatccagctgaataacgatggttagttgaagcttcgcggaggattatcttcattncaaatgcctggtgaatacagctcagggagtatagagttgctcttttccgcccattcccatctctcttctctttccttccttcctt

SEQ ID NO: 12032 - DNA, 169 bp, Gossypium hirsutum
  Clone ID: uC-gsflmaxxa010d06b1
cccacgcgttcgaagaaactttagaatttataaagctaaaggagatataatcattatggcaagttctgcaatagcatcttgttgcagagaacttagtgttgaactcccctatcaggagataaagtctttagagttggttaaaaacagtgttgacttttttctatttgga

SEQ ID NO: 12033 - DNA, 161 bp, Gossypium hirsutum
  Clone ID: uC-gsflmaxxa010d08b1
ataatcagttaatcttctttccgggccctcctaaagatgtcaaaaattgacaataacaatgctccatggcaccgtcttaggcgtgcttccacaccagggaaggctactgcgcttttcattggtaagtttttctcacggctatctttttcctcaagatttct

SEQ ID NO: 12034 - DNA, 476 bp, Gossypium hirsutum
  Clone ID: uC-gsflmaxxa010d10b1
gcttcttcatattttgcctgcacaagcataaatacgaaggaatcacaaatgggcttttgctccgaatagtaatttctcttaaatacttgcctaaaattcattaatatgcccatttcccgcttcattttcttttccgccaagcaccgcttcgcccatgcttccaatcttcttccaaggtttggttcatctaagagaattcaatcttgtggctataccaaatcagcaaagaacaattattacaaaaagccaactggtcatcctgttgggaatgttgaaacacaggcttctcgctcgtcgggtgcttatattattccacctattttactaggatttggtgggattgctagcttttctgcattacaatgacgagcgaagagcagttaaaataggcaaggacagctataccggtagtgatactgcagcagcttcaattattggcggcccattcactttggttatattcggaaaatagattg

SEQ ID NO: 12035 - DNA, 368 bp, Gossypium hirsutum
  Clone ID: uC-gsflmaxxa010d12b1
gaacaaatggcattttagcgaggtttaaggaagttgatagtttgattcaagacaagggtttgctttgggctttcgatcaaatgcttgaaactggtgaactaccttatgaggagataaagtctaaagtgacggttaaaaagagtgttgaggttattgcaattggaactgacaagaacgttaatgatactaagcttggtggttatgacatgcatgtagagagtgagatccttgcgaatgcatggcggttagccaacaacccgtctcactggaagaacccagaagaggtccggccttgaaaggcttttcgaggagggatctagggttgaaacttgtggtaatgacttcaggtatcatccatttggtgatgg

SEQ ID NO: 12036 - DNA, 190 bp, Gossypium hirsutum
  Clone ID: uC-gsflmaxxa010e04b1
gggatctgtatccccaaaatcttttggttgatcctctgacgggaccattttaaaatctgagacttttttaataaacatacatctttcacctaaacctcatatttaaatcccatttctctcttctattttaatactattatatttttaacttaataatatatctataacataattattaaatatattcatt

SEQ ID NO: 12037 - DNA, 58 bp, Gossypium hirsutum
  Clone ID: uC-gsflmaxxa010f01b1
cgtactcgatgtgtagcaacaaaaccaatgcccacaggaagggggttaattttaaaat

SEQ ID NO: 12038 - DNA, 227 bp, Gossypium hirsutum
  Clone ID: uC-gsflmaxxa010f11b1
aaaacgttgaattattcacacgaaacaatgaaaacgcacttttttcccctggttttcctcctcattatttccttagcccaaggtctgaaccccaaatgtgacatccaagaccatggctcaaacctgcaagtgttccatgtttacagcccatgctcacccttgaaaccctcaaaaccactctcatgggaagaggatgtgctgcaatcgctagccacggaccatgccag

SEQ ID NO: 12039 - DNA, 92 bp, Gossypium hirsutum
  Clone ID: uC-gsflmaxxa010h04b1
gtcagatctatagccgtattctagcgatgtcgtttaccgggggcttaatttaaatgcaaggcttgtctgaaaaccgcttattcagacgaact

SEQ ID NO: 12040 - DNA, 133 bp, Gossypium hirsutum
  Clone ID: uC-gsflmaxxa010h09b1
gaagtacatcagactcaaattccgcatccaatgggggaccgatgtgccgtatcagatccattatgtggatagaaatactatggtaatgcaaggaggggctatattgtctcatatgtctatcttttactatttt

SEQ ID NO: 12041 - DNA, 349 bp, Gossypium hirsutum
  Clone ID: uC-gsflmaxxa011a09b1
ctttcttgctctttccctcgctttctcggtaaaaaaaatggcaaacgcggcttcaggaatggctgtgcatgatgattgcaagctgaagttcttagaactgaaggctaaaaggacttaccgcttcatagttttcaagattgaagaaaaacaaaagcaagttgttgtggaaaaggttggtgaacctactgatagctatgaggctttcactgctagccttccagccgatgagtgacgatacgctgggtatgactttgattttgagaccgatgagaactgccagaagagctgacttttatttcaatggtctggtctactgacacatctaaatgttagaagcaagatgatctat

SEQ ID NO: 12042 - DNA, 453 bp, Gossypium hirsutum
  unsure (1)..(453): unsure at all n locations
  Clone ID: uC-gsflmaxxa011a10b1
ttccacgcgtccgtaaagttagcatagaagtttaaaggcattcttacaccttacttctcttctgtctttctctttttcagctaaatctcacttgttgaatagtagaacatggaagggaagatgagttggacggtggcggatgcggtggactacaagggtttccctgctgacaggtcaaaaaccggaggttgggttccggctgcactcgttctagggattgagatctgtgagaggctttcaacaatgggaattgcagttaaccttgtgacatacttggttggtgtactgcatttgccaagttcaacttcagccaatgttgtgacagatttcatggggacatctttcctcttgtgtttgcttggaggcttccttgctgattcattccttggcagatacaagacgattgccatctttgccgctatacagacactggggactggngcattagcaata

SEQ ID NO: 12043 - DNA, 486 bp, Gossypium hirsutum
  Clone ID: uC-gsflmaxxa011a12b1
taaaaagaagagtggcagcctatttacaaagcaattaatccttgtaatatagtatttgcactcattagcctgtccctcatggaatcccatcttgagaaacaaaatggagatgtgcttcaaaaatctttcaaagagatgatttctactctccctaaaaagagttgttggggttttcctgaagatcaatatcaatatcaaagtttttggttcagcccgccttttctacaaggagcattgtcggctcaacaacaattccaagctcagccaactgatatcatcctttgtagctttccaagaacaggcacagcctggttaaaatccctcactttcgccactattacaagaacttcatacaatgattccaccacccctttactttccaagatgcctcatgatgttgtgccttacatggagttttgatcatgcccagatttccattaatcgacatcttggaattcctcttttagccactcatcttccttattc

SEQ ID NO: 12044 - DNA, 506 bp, Gossypium hirsutum
  Clone ID: uC-gsflmaxxa011b01b1
gcaaaagccccagtaaaaagaggcaattcgatttggtaggaggtttcctttttggatgggaaagaatgcaagttttgagaggcggaattcgacaatcgaagaggatcaacgacaatccagagagctctgcttccttagttccgactgctcggaatgctgctgctaatagaggtagaggtagagggagaggtaggggtagagggcgcggaggaatgaatcctgaagaaaatcaaaagcttgttggtcccagagcttgtggccggggttgcaatggaataaacttgccagtgagacaggtcgttgaaaaaagtgcagaaaaaccggttgctgtcaaggaagaaggaagcactagttcactacctgaaagggtacaacttggtaactctcctgtgtacaagttagacagaaaactcggtaaaggtggtttcgggccagtttttgttggaagaaggatatctggtgggacggggtgcagtggacccgatgctttcgaggttgctttgaag

SEQ ID NO: 12045 - DNA, 472 bp, Gossypium hirsutum
  Clone ID: uC-gsflmaxxa011b05b1
atttttcaactctctccattttagaaaaaagcttaaatacccaaagtttggattcatcactctcaactagatccctttcatctaccacacaaacttagctgaaagatcaatggcagccatggcaacagctctcacctcactgtcttcaagccccaaaccatctttcctagaccacaacaagtcatccttcagcggcactccaattccttctcgcttcactcccatcaagtcctcctcacacaactcaaacatttccatgtccttaacccctccttatgacttacaatcctttgaattccaacccatcaaagaatcctatgtttctcgtgaaatgacacgccgttacatgatggacatgattacctatgctgacactgatgttatcatcgtcggcgccggttccgctggcctctcttgtgcttacgagattagcaaaaaccccaacatccgtgttgccataatcgaacaatct

SEQ ID NO: 12046 - DNA, 215 bp, Gossypium hirsutum
  Clone ID: uC-gsflmaxxa011c03b1
gcaattccctccacatatcgatcaggctatttactgccggtgatttttgtgggatgtttccttagcctactatgataacaacggtttatgatgctggactttcaaggtcttggtcctttgccatggttccgcattctgaaatctcatgtgttgtcattaggacctttagttttttatgtattgatcatgttcaatttcgatccctatcattgttt

SEQ ID NO: 12047 - DNA, 112 bp, Gossypium hirsutum
  Clone ID: uC-gsflmaxxa011c04b1
cttcttctcaactctcaaacccagaaagctcaaaggaaaaaaagatggctttggagatctgtgtcaaggctgctgttggtgccccttttgttcttgtacactgttttttctt

SEQ ID NO: 12048 - DNA, 52 bp, Gossypium hirsutum
  Clone ID: uC-gsflmaxxa011c10b1
ctttttctttttaaaacaatgaaggcaaaattttctgggtttataacctttt

SEQ ID NO: 12049 - DNA, 195 bp, Gossypium hirsutum
  Clone ID: uC-gsflmaxxa011c12b1
tattgcttgtttaaattgacatttatacgttaatggctacttgctttttatcatcatattggttaaagcaacagttcatcattgttgtctttctctttaccgtaatatccagcatcagtttaccggtgaatggatgtttcacatcgattttcagcttcggtgattccatgtcgtataccgtcctctcaattgcga

SEQ ID NO: 12050 - DNA, 80 bp, Gossypium hirsutum
  Clone ID: uC-gsflmaxxa011d01b1
tccatgcgtccgtgcttttacaaggaatcaatcatcaataagagcacgatctcactttcagttagccggattgttagaga

SEQ ID NO: 12051 - DNA, 405 bp, Gossypium hirsutum
  Clone ID: uC-gsflmaxxa011d10b1
tagacttcttggtcaagccaaaaatctttccgacagggtgctcctaccccaccatgcccggccctttaccttaccttaagaagaaagagggggtatgaagcgtgggaaacaatgcaagaagtgtttgatacagcaggtaaccttaaggagtggcggcaaagctcttgattgatcaacgcgagtgaactgtgcttagacgctttgtaaaaccgtaccggtctactagaggagctgatggatgagtaggttttcacttttgatttacggaatgtgacttgttactctatggtagtttcgttgtcttttaaggtattgataaagttatagtttattacatgtacttttttttattttattaattttattttacatctttttccttttataatttttttacattttttt

SEQ ID NO: 12052 - DNA, 229 bp, Gossypium hirsutum
  Clone ID: uC-gsflmaxxa011e05b1
tcataagggaaagtaggtgggttttgaggatagtgaaaaatggttggtcctgcttcatcggtggttgattttagtgggttttttgtcagaaaatttttttattagctttagaagatattattttatctttaattagtttttattatattatttattattttattcttttagaataccttattttaatgttatatttttatctttttttattttaatataatttattttt

SEQ ID NO: 12053 - DNA, 74 bp, Gossypium hirsutum
  Clone ID: uC-gsflmaxxa011e07b1
tccacgcgtccggcaaaaaaagattcgttttaaaaaaattaaaaattgaagctttgttctgtagtaaaagtgat

SEQ ID NO: 12054 - DNA, 77 bp, Gossypium hirsutum
  Clone ID: uC-gsflmaxxa011g06b1
ttttataataacgatatatgcaaatcaaaggcttttgctggtttctcacacaaatatcctaatcgttcctttgcatc

SEQ ID NO: 12055 - DNA, 273 bp, Gossypium hirsutum
  Clone ID: uC-gsflmaxxa011g09b1
tcgttgatttgcagaaactcacagatgagtatatgaagaagattgatgtcatttacaagcagaaggagatggagttttcttacttttatatttttcatatatttttatatattataaattctttttctttttttttaaatttctttttatacatttaattatatttctcacttatcttactattttatttttatatttattttatttttatcattttttttttatttttttttttttattatttatttttattttatattttttcttattttt

SEQ ID NO: 12056 - DNA, 83 bp, Gossypium hirsutum
  Clone ID: uC-gsflmaxxa011h11b1
tcgatcgggttcaattataatcgatggaattgaatatgttcttctacaagttaattggtactcaccttatgaacataaccata

SEQ ID NO: 12057 - DNA, 195 bp, Gossypium hirsutum
  Clone ID: uC-gsflmaxxa012a03b1
tgtacgcgtgggcaataatcttggataatggtaggagattttgccataaaatttctgtttttacagccatacctgagaattgtttgcgatagcttgagagaggtgatgcttttgtaagttattctactcgtttcttcgattggatttgcttgtcacaattcttttttaatctaatgttttttatatatttatctt

SEQ ID NO: 12058 - DNA, 483 bp, Gossypium hirsutum
  Clone ID: uC-gsflmaxxa012a07b1
gttttctcgctaaagcgcagcagcggttgcacgactggttcaacgggaaggagctctgcaagagcattaatcctgatgaggccgttgcttatggtgctgcggttcaggctgctatcttgagtggtgaaggaaatgagaaggttcaggatctattgcttttggatgtcactcctttgtcccttggactcgaaactgctggtggtgttatgactgttttgattccgagaaacactaccattcccaccaagaaggagcaggtgttttcaacttactctgataaccaacccggtgtcttgatccaaggttatgacggtgagagagctctaacccgggacaataatttgtggggtaaattcgagctctctggtatttcaccagcacccagaggcgtttcccaaattaccggttgcttcgacattgatgcttatggcaggttgaacgtctttgacgaggacaagactgctggccccaagaacaagattt

SEQ ID NO: 12059 - DNA, 398 bp, Gossypium hirsutum
  Clone ID: uC-gsflmaxxa012a08b1
ttgacgcgtgggcagagaacaaaagcccccccccatttgcgccgttctgtggagcagtcgttcgaaaaggaaatctaaatccttgctcaaaatccgattacgacggagagaagcaaggtccggctaacaggtacggatgtatgcgggcgtgcgtacggcgtggtccctggtggtggcgtggctcggctcggaggcgctacacgcgggcggacgcaacacgcgcgagggggaagcctggctctgttgcggcgctggaggcttaccttagctgctagggttttccgattttggtctctgttaggctaggtgtttggttttgattttgggctgcaatgggtttgtcatttgggcctggggtagggtcatgcaattaggcaatgcgttaggttcaaccttga

SEQ ID NO: 12060 - DNA, 428 bp, Gossypium hirsutum
  Clone ID: uC-gsflmaxxa012b01b1
ttgaataaaaaaaagttaaattttacattatatatctaaataataaaagatgggattgttttggagagttcttgttgcattacctttcttttttgcatatgtgaatggtgaacattttacgtacccttctcgtcatcctggcaaagccgagttagccggtttcaaggggccggactctcttgctaccgatgggggcggtttctttagcggtccctcgattgttgatgatagatgtagctgctactacaggcaacctaggcggaactaccgtggactctgatggaacgtcagttgataacgcccttaaactcatctttagccaatgatggaattggcaatgctaatatgattgaggctgcaactacgtttaaagggagtcgggaattgcttcctgagaaatggtgggcctccccacagtctttctcttt

SEQ ID NO: 12061 - DNA, 322 bp, Gossypium hirsutum
  Clone ID: uC-gsflmaxxa012b04b1
ctccctctgtgccacgaagtcctggaggggcagagaaccctgtaaaccctgggtcacggtggaaaaaagggaagcttctgggtagaggcacatttggtcatgtttatgttggttttaacagtgagagtggtgaaatgtgtgcgatgaaagaggttacgttattttctgatgatgccaagtcaaatgaaagtactaagcagttgatgcaggaaattgctttgttgagccgtttatggcatccaaatattgtgcaatactacggctctgaaaaggttgatgacaggctttacatatacctcgagtatgtatctggtgcctctat

SEQ ID NO: 12062 - DNA, 506 bp, Gossypium hirsutum
  Clone ID: uC-gsflmaxxa012b05b1
gtccattgatcaagtctcatcgccaaagatcaccgctggttttggggtgccttcaatccatccctgaaatctggttccccattccgtccccagctcagctctctttctaaaatacaactcctgatttagctttttaatttttgtggatcaagatgccagagaggtcaaaatcttcttctgtaagtaatcttccactcatcctggacattgatgactttaagggatatttttcatttgatgcattatttgggaacctggttaacgagctcctgccatctttccaagaagaagaagcagatacagcaggtggacatggccttggtgggactgaggctctaccaaatggacatgcccgtgcctcttccgatgcagcaaaatttgcacaaggagactctatccctctatttccagaagtagatgctttgctatcactgttcacggattcttgtaagagttgattgatcttcgaaagcaggttgatggaagactccacaatttcaaagaag

SEQ ID NO: 12063 - DNA, 501 bp, Gossypium hirsutum
  Clone ID: uC-gsflmaxxa012b06b1
tgttaacaagggtggttgaatattcgtgaatcccaagccacctaggtaactaccacctgtcacaaattctggcatcataaccggaaaattcgatgggaaacacttcctccatgctcactcagtatgacatcgaagaagtacaacaacactgtaacaacgccttttcgcagcaggagatcgtctctctatacgaaagattctgtcagttggatcgaaacggtggcggtttcgtctccggcgaggagtttttgtccgtgcctgagttcgctgttaatcctctctctcagagattgttgacgatgctagatggattgaatttcaaggaattcgtagcgtttttgtatgcatttagtcctcgtgctactgtgcaacaaaaaattgaatttatagtcaaggtgtttgattcagatgggaatgggaaagtcacctttaacgacatgttggatgttttgactgatttgactggcccattcatatcttgacatagagggagccagtttt

SEQ ID NO: 12064 - DNA, 515 bp, Gossypium hirsutum
  unsure (1)..(515): unsure at all n locations
  Clone ID: uC-gsflmaxxa012b07b1
tcgacaacagcccagattcagaaacaacaaaagaagcaacccagttgggtcgacgacgatgatgaatcggatttagtgtcggagttccgggatctaccggctaagttccagcaaacacttataccggacctggagagaatctcgacaacctcgaaagtttacatcaacaaatacaacaaagagttcaccaaacagttcaaaccatatgtcggcaacaaacatgctcccaccattgctactgtaatctcttgtgctttccttttaatccctttactattagtttccctcatttttaaccgcatcaaagcttatttttcactccaaaagattctcatcttcatccaaatttacctctcgatttacttttcaatcctttgccttacctccctcgtcaccggacttgagccgcttaagttcttttacgccacttcgccgtcgacctacgtgtgtttacaagtgcttcaaacgcttgggtacgtgctttacttngtggctgctgtgatgtatttgatact

SEQ ID NO: 12065 - DNA, 556 bp, Gossypium hirsutum
  unsure (1)..(556): unsure at all n locations
  Clone ID: uC-gsflmaxxa012b10b1
tccttcgggtcgactccatncgcgtccgtttgactgcgttgggcacgactgcgatgggcaagccgaagagaaaccacaggttaagacagaagcatggccagccagctcgtaggaacaaagagagcttgtgtcgtgggtggcagaggattcgttgcctcattgctggtcaagttgttgctcgagaagggttacgccgttaacactacagtcagggaccctgacaaccagaagaggatctctcaccttgtaacactacaagagttgggagacttgaagatctttcaggcggatttaactgatgaagggagctttgatgcccctattgctggttgtgaccttgtcttccatgttgcgacacccgttaactttgcttctgaagatccagagaatgacatgatcaaaccagcgactcaaggagtggtgatcgttttgaaagcttgtgccaaagcaaaaacagttaaacgagtcgtcttgacatcatctgccgcagctgtgtctatcaacacactggatgggacagatctcgtcatgacagagaaagactggaccgatatcg

SEQ ID NO: 12066 - DNA, 429 bp, Gossypium hirsutum
  Clone ID: uC-gsflmaxxa012b12b1
ttgagatccaatctctctctgtgcataatcaaagcttcttctccattctctgtgattgaaggaaaataaaatggataagcctttgctgtttggagaaactagcaatggcggtggaaggcgagatcgattatatcgtcgatctgaagctattacgtatggctctcattaccacagagcagctgccctcgtacatctggctgaggatggtgttggcctgtccgaacaaattcttgataaatcaagcttcggaagtgctgcacagatctacttcatgttcattaactttgaaattatttggacccttaattattttgcattgggtgtcctaaactttcttgagaagccgatgtggtgtttgagtagttcatattcttgcagtgatagggactacttttttcttgtgcaggtgccttatttgaatgctacagg

SEQ ID NO: 12067 - DNA, 82 bp, Gossypium hirsutum
  Clone ID: uC-gsflmaxxa012d07b1
ctccacgcgtccgcggacgcgtgggcagaagattgggatgatgaagaggatggtgagtggtatgccctcaaaattgatatcc

SEQ ID NO: 12068 - DNA, 378 bp, Gossypium hirsutum
  Clone ID: uC-gsflmaxxa012d08b1
attagatttctgatttttttttaaaaaaaatttttttttcccaaatttccttttccaaacatttttctctcctctatcattttccactttcaatttttcatttccttcttctgattgctatcatttttctcattcaaattgttgctactgcgatttttgggttctttaatcggcttagtaagtgaagttttgtttattattaacgattggtttttggaaatgtgggcaatgctagtgatagcagataattggtgtgcattcaataagttccgttgtgaccgatcacgtccgcctcggtcctccccctcctctcctcttctctaactccctctcctctcttctctctattcctctcttctcctccctcctcctctcctc

SEQ ID NO: 12069 - DNA, 159 bp, Gossypium hirsutum
  Clone ID: uC-gsflmaxxa012d09b1
tagatttctctgcactttatcccactcctttcctcataaatccactctttttcctttctctcgctctcgctacttttatactctagccatgtcccaaaaacagacaaagccgaacccgtttacatctgcttacgcatcggacgatgaagctgttacttc

SEQ ID NO: 12070 - DNA, 106 bp, Gossypium hirsutum
  Clone ID: uC-gsflmaxxa012d10b1
gcgatgaactcagtgaaacagaggtgtcattttagcgttattgatcctagacttatcgcagtatgtggagaaaggaaaagaagatgggtttgttattatgctgcgt

SEQ ID NO: 12071 - DNA, 175 bp, Gossypium hirsutum
  Clone ID: uC-gsflmaxxa012e08b1
taaaagtcctctttgtaaccgtcctctgctagtttttttctttacctttctttcctccatcttttgtctctatagccgaattttcttctctttccccactccttttgttttctctatctttgcaaattgtctttttgcgtacaattcatccaacttatctgccttgtacactttt

SEQ ID NO: 12072 - DNA, 541 bp, Gossypium hirsutum
  Clone ID: uC-gsflmaxxa012f03b1
aaaatacaaaaaaaaaaaaaaaagaaaggaaaaaaagaaaaaaagaaaaaataaaaaataataaaaaaaaaaaagactggacaaaataagtgaaaggaaaaacacaagaagggaaaaataaaaaaaataaaaaaaataaacgaaagaaaaaaaaaacgatattaaaaaacaaagaaagaaacacaaagaataaacaaagggaaaaatataaaaaggaaaaaaataacacgaaaagatataacaaaaagaaagagaaaagagaatagaaaaaagaaaaaaaaaacaaaaagaaaaaaaaaaaaagacaaaaaaaaataaaaaaagaaaaaaaacaaaaaaaaaaaaagaagaaaaagaaaaaaaaaatagaaagaaagaaaaaaaaaaaaagaaaaaaaaaaaagaagaaaaaaaaggaacaaagaaaaagagaaaaaaaaaaaaagaaaaaagaaaaaaaaaaaaagaaaaaaaaaaaaaaaaaaaaaagaaaaaaaaaaaaaaaaaaaagacaaaaaaaaaaaaaaataaaaaaagaaaa

SEQ ID NO: 12073 - DNA, 88 bp, Gossypium hirsutum
  Clone ID: uC-gsflmaxxa012g11b1
atcaaatcgagttaaattaggaggtgcagtgatcccattttgactgttcctaccctttttccttaccttaacactcacatatccattc

SEQ ID NO: 12074 - DNA, 321 bp, Gossypium hirsutum
  Clone ID: uC-gsflmaxxa014a07b1
ttcgttacgcgtccggtttttgagaaatcgattgccaagagccccgatgctcttaaagattctggtgattctgaagcagcttcagccctcaacaatggcttcttggctacccattttgccactcttcatcctggctcagtcactgtcaatcttgggtcttctggtttcatggcttactctcttgataaacaaaacccacttctgcccaggctctttgcagtagtggatgacatcttctgcttgtttcaaggccacattgagaatgttgctggtgttaagcaacaatatgggttgaacaaaactgccaatgacggtatcatt

SEQ ID NO: 12075 - DNA, 400 bp, Gossypium hirsutum
  Clone ID: uC-gsflmaxxa014a08b1
tcgctacgcgtccgcggacgcgtgggtttttattttattttaattcactctcagaagagagcattttggggtttagttttagagttctcaaagaatgagcttttcgactaagcataataatagcagagccatgaatccttgggttcttcatctccaaaaactgggtctcgagcttaagtgtcctctctgtttgaacaatggccggctcatgtcgcattctcaaagattatggtattccatctgaaagatctgatgatcttttagaaccgtatgttgaatcacttggagacaaccaagcgatagagcacgactttggggagagtcccgtttctgtattggagagaggctttgatggacttctttgggcttaatgattaacgattgtgaattcagatcgaca

SEQ ID NO: 12076 - DNA, 386 bp, Gossypium hirsutum
  Clone ID: uC-gsflmaxxa014a10b1
tcgttcacgcgtccgctttaaaattaaaaaaaaaagaaaaagaaaaaaagataagcaatcattttccattgctttcctttttcttgttttctggttttctttttccccatttgtttcccattaaaaaaaaaatggcgacaatcaatggtgagactgcaatggaaaaggccttggggtctataggaagctttagtaacaacaacaacaaggaggtgtttcttagagcagataagatagatttcaagagctgggatttgcaactggataagcacttgagcagggcttggtctagggacagtgatggttcaactctcacaaagaaggaaagatgggaaattgatttggcttaacttgatatacggtatgttatagcttatgggacttat

SEQ ID NO: 12077 - DNA, 332 bp, Gossypium hirsutum
  Clone ID: uC-gsflmaxxa014b06b1
ttttcttgttctgaaacacctagctcagcaggtacatccttaggagggacttgaccatatgagtctattgtctgcgagacatggacttttggcaatgaacagactgcaatcaatgaccacaacctgacaagggaaagatggagagatgccttatgaggtgagctgttatcaggggtgacaaggtactaaaggtgaatgagtattctgtgactgaatgatgtcaactgaagcagcgagaccgctggagggcaacatttgactatcttctactatactacaaactgcgcctgcatcaaaagatatttttttgacctcacactatgataacatga

SEQ ID NO: 12078 - DNA, 402 bp, Gossypium hirsutum
  Clone ID: uC-gsflmaxxa014b10b1
tcgctatttgaagccttcttcgaatttcctcattcaagatgcatattttcgtcaagaccctcaccggaaagaccatcacattggaggtggagagttctgatactattgacaatgtaaaggccaagattcaggacaaggaaggcatccccccagaccagcaaaggttgatcttcgctggtaagcaacttgaggatggccgcacgttggctgattacaacatccagaaggagtccacactccacttagtgcttcgcctgcgtggaggaatgcaaatttttgttaagactttgactgggaagaccattacattggaggtagaagagttcagataccattgataatgttaaggcaaaaatttaggacaaggagtggaattcccccagaccaacagaggcttgattt

SEQ ID NO: 12079 - DNA, 277 bp, Gossypium hirsutum
  Clone ID: uC-gsflmaxxa014c07b1
atcgctgacgcgtgggaacccatcttgccctgtgctttggtgttgtaatatcatcatagttatgagcagtgatatagagtgtgtctgggtcttcgcccttgcatccaactgccgagctttttcacgggaaagtactgcctggtcaactttgatcatcgctcttgcctggcctcttatgatctttctctcctgggctcacccctgttgtcccgtccgttccttttttcgtgtttatcactttctcccctctttccttcctacccttcctctcttctct

SEQ ID NO: 12080 - DNA, 426 bp, Gossypium hirsutum
  Clone ID: uC-gsflmaxxa014c08b1
attttacaccacatacattgctatgactgtgtctttacataaatgcggggattgaatctacagggactggtcacatgaggagtgcggtggaacattatcatgggatcaacaaaagggctggctcatctacaccacgattggtctgcaaggatcatacaccgtgacataaagtccagcaatattttacttgatagcaacttggaagctcgagtatcggactttggacttgcaaaactgttagaggatgaagaatctcatattacaaccattgtcgcaggaacttttggttatttggctccagagtatatggcaagtgggagagcaactgagaagactgatgtctatagttttggggttttggtgcttgaagtcataagtggcaagagacctactgatgcatctttcattgaaaagggcctcaacatc

SEQ ID NO: 12081 - DNA, 432 bp, Gossypium hirsutum
  Clone ID: uC-gsflmaxxa014c12b1
ttgtagactgcttagttaacgcgagtactcttcatttttcttgaaacacctgtgtttgacaatccgacactgagccttcatgatgaacagggttgtgatgggtcggtacttttggaccgataactcgacgtttataggtgagaaaactgcggttcctaacaataactctgtgagagggtttaacgtttgtgacaacatcaaagctctgttggagaaagcgtgttctggagttgaattctgcgctgatattctcgccattgctgcttgagattcggatgatcggttaggggggcctgtcatggaacgttatggtctgtaagaagggttttcgcatgctttagtataaattgctcttaatgtcttttatttaccaacaacttcttatttaagagcttttatttaaagcttcttaactcaagggctttcaataaa

SEQ ID NO: 12082 - DNA, 72 bp, Gossypium hirsutum
  Clone ID: uC-gsflmaxxa014d01b1
ctcactcgtccgaacggatacaattggttgatttgctgaaaagtgatattaggtaacttgttcaaacaaaaa

SEQ ID NO: 12083 - DNA, 341 bp, Gossypium hirsutum
  Clone ID: uC-gsflmaxxa014d02b1
ctcactcgtccggcttcctgccttttgccttctgacaggaaaatttatcattcctgagataagcaactttgctagcatgtggttcattctccttttcgtctccatttttgccactggaatacttgagcttaggtggagtggtgtcagtatcgaagactggtggagaaatgaacaattctggatcctaggagggacatcagctcatctctatgctgtttgcagggtcctatgaacgcgatcgctggaatagacaccaacttcactgacacttcaaaggcgtctgatgatgaaggcgattacgcctaacttgtatgttatcacatggtctttacttgtttccc

SEQ ID NO: 12084 - DNA, 177 bp, Gossypium hirsutum
  Clone ID: uC-gsflmaxxa014d03b1
ctcactcatgcgtgcgcacgcgggatgacccggtgcgtttaagcatatcaataagcggaggaaaagaaacttaccaggattcccctagtaacggcgagcgaaccgggaaaagcccagcttgagaatcggtcgccattggcgtccgaattgtagtctggagaagctttcttagcgaca

SEQ ID NO: 12085 - DNA, 322 bp, Gossypium hirsutum
  unsure (1)..(322): unsure at all n locations
  Clone ID: uC-gsflmaxxa014d07b1
ctcactcacgcgagcgcagtgccagctgggggcgagacgcgtgaagaagatgcgggatatcctttttagaactccctactgtgagatgaacaaggataggcgtatgaaaatgggccantgcaatacgtagacggttaggaggagtgcatgagaagaaagaagatggctgaccacaagacaactaccacagacgacaaacggttacaaagcacccttaagagaataggagtcaatgctattcccgcaatcgaggaagtcaacatcttttaaggacgatgtttgtatgcagtttattaatcccaaagttcaagcatctattgct

SEQ ID NO: 12086 - DNA, 255 bp, Gossypium hirsutum
  Clone ID: uC-gsflmaxxa014d09b1
tcgttcacgcgtccgcaggcgggattacccgctgagtttaagcatatcaataagcggaggaaaagaaacttaccaggattcccctagtaacggcgagcgaaccgggaaaagcccagcttgagaatcggtcgccatcggcgtccgaattgtagtctggagaagcgtcctcagcgacggaccgggcccaagtcccctggaaaggggcgccggagagggtgagagccccgttgtgcccggaccctgtcgcaccaagag

SEQ ID NO: 12087 - DNA, 85 bp, Gossypium hirsutum
  Clone ID: uC-gsflmaxxa014e02b1
gcgctcactcgtacgatctaacatttgtccgcacagattatttatattaaagattcaaccggaaacccaagtcctaggaaatagt

SEQ ID NO: 12088 - DNA, 495 bp, Gossypium hirsutum
  Clone ID: uC-gsflmaxxa015a04b1
atcaaccactacctcccacaatcattccctattccaacgtccacatctcctctcaatcccagccgtcaaatttccactgtcggtcgcaatctcaaaatttgaaccctttaccagttaagatcatcctactaaaaacccattacactaaattcgattacaccggattagataccgttgctttgattcataatttccaaatttctcacagagcaacaaaaacagagaaaaagggaaaatctcagttagttcatttttaaattcaaataaataagtattcttcttgatttgcttacaagcctactctctcagtctctctcttgtagctgctttcttgtgatacgctttgctttctattttttttctccattttcaatataagcatggggtttctttctctaaacttttaaaaaaaattcatgcttcggtcttcctttttggtggctttggaaacaggattgctagatttgagctgcgaaagtattgcatttacagggt

SEQ ID NO: 12089 - DNA, 332 bp, Gossypium hirsutum
  Clone ID: uC-gsflmaxxa015a05b1
ctcacgtgtccggtgatgacggtggagatggaggtgctggctgctgaaatggaggaaagcctttcggttcggctccgcgctctattggcctccaaacggctactgataatggggatcggtcgtgggctcaacttcaatgcgggcatcagtttcatttggatcgtattggatcaagcttcaatgtccagggcgcgacgcaatgcccatattggccagaaattgcgaaaggccaatggctttatgccaatggttgccgttcgtatccagagcttaatgtggatgatcggacacatgatgaggacctttatgacctaagtgtctcagaaatgtca

SEQ ID NO: 12090 - DNA, 212 bp, Gossypium hirsutum
  Clone ID: uC-gsflmaxxa015a07b1
ctcggtcggtggtggtggaggggcacatggaggtggatatggtagtggagctgtgtgccgttatccgcccggtcaatggggtaccgagtttacgaaattgttattgtgactagagaaaaggacagaaactttttcgataaggagattggcttttacttaaaattttttattggattccttttgttaatacacccttccattgacatcaaggc

SEQ ID NO: 12091 - DNA, 499 bp, Gossypium hirsutum
  Clone ID: uC-gsflmaxxa015a08b1
ttgcttacgcgtacggtcgactccggcatccccggtatggctattgaaactgctttcccaggtccaaccgctaaaagcgccaccggagatacacgaatgtcaccgccggctaggataggttaagggcaagctcaatagctgcaacagacattatctgaagatattctttccggaacatcatcaaaaaacatactggctattgacatttaagcaagaggttctgcaacaagatttggagtttcgaactgattttgtttcgacctggaactgaaagagatatggaagatcttgaaaatccaagagaggttccagcctcgttcactctccggtcatcagaagagagggttatctctgtgctcggtgaagtagcttgcatctcaggtttacagagcactggaaaacattttctggaaaatttattgggaaaaactccctcaaactttttcggtgggttcggaaatcaaaagggattgattcaaagatcatctgttttttacat

SEQ ID NO: 12092 - DNA, 447 bp, Gossypium hirsutum
  unsure (1)..(447): unsure at all n locations
  Clone ID: uC-gsflmaxxa015b02b1
tttttgtgtttgtaggaagaagaaaagaatatgaagagggtttcctttgttatgatcttgtgtgcggtggcactagcggcagcggtggtgttttcaggtgaaacacgctcggtggaagcagtgacatgcagccccatcgagctcatcccatgcttgccggcaatctcaacaccgccaaagcctccatccgccgcttgttgcggaaaggtgaaggaacagctaccatgcttttgtggctaccttaaggacccaagtgctaagccattcattgacaatcccaatattccaaaggtggctagctcttgtggagttgcacatgcatatcctcctaagtgttaaaatgttgctttcattagagcatttcccactcaaggactagtatgaataaattaataattaaatggaaaattatctaatattctactcatttgccttctaattttaant

SEQ ID NO: 12093 - DNA, 450 bp, Gossypium hirsutum
  Clone ID: uC-gsflmaxxa015b12b1
tcgatcccttcaagaaacaccatcaaagcttgcaagtttcaataatggatgaatctggggagtacccaaaggagtactacaccagcaacggcaaccccaggagactgacttcaacatcctcatcttcttcgtcaacgacgagcgttcacgttaccgacttggatggactcgtcaacgtcaactccctcttcaccatcgccgtatatgtgggcctttctttggccactccgggccaacacagtctcgagaaccgagccccctgcgacgccggcattgacgtagctaaaaagctcttggacttcgaggtcgtctccttcagcttcttccttttctgctccctggtggctcagggtctaaagctcgccatcaatttgttgaacagcaaagatgtggatgaagctttcagggcacacattaaccttaaagtattgaggtttgggatgatgggct

SEQ ID NO: 12094 - DNA, 123 bp, Gossypium hirsutum
  Clone ID: uC-gsflmaxxa015c01b1
atagttgcagcagtggcttgacgttcccctttgctcccttctttcagaagccaaaagtttgagttaagaacattgtctttttgctgtgatgaagccgatcaatacttgttttgttggattttc

SEQ ID NO: 12095 - DNA, 615 bp, Gossypium hirsutum
  Clone ID: uC-gsflmaxxa015c02b1
ctcactcttccgacaatctaaaagcacagaactaaaatttaatggacaaaaacgcgagaggggcacgggatctcgattccaaccttttttactctcttctgctcctttctcccttttttcccttcttccttttcctcccatccctttcttcctctattccttccctcttttccctttctttcttcttctttttattctttcttctccctatcctcttcttttccttcttcctctcttctttatcttctctttttttatctactttttcatttctttttcctatttctcttctttttccttctcttcccttctctctttcattttattcttcccctttctctactttctctctcatcttctttcttcttctctcttcttctacttcctctcctctttctcttctcctcctctccctcctttctctcttttcttcatttctcttctttccttacttctctaccttcctctttctctcttcattccctcattctctctcttattctctctcctcttcctatcttctcttcactctctctcttcatctttccctcatcttcctcttctcctcttccttttttcttcttctccttctttctcatctctacttacttcctt

SEQ ID NO: 12096 - DNA, 122 bp, Gossypium hirsutum
  Clone ID: uC-gsflmaxxa015c07b1
acctccacgcgtccgccacgcgtccggcggaaggttataacacccatttactgtgtcgttgcaaaggaagccgaaaagaacaaaaatggaacggttttttattgcagactgttgtaaattat

SEQ ID NO: 12097 - DNA, 246 bp, Gossypium hirsutum
  Clone ID: uC-gsflmaxxa015c10b1
tcgatttgtcaaatattgcctagactaaccatgttgcaacctatgacatttccgatgaggtttacaagggttttgttgctttgtcagtttaagatgccccattgttttggttaagatttcaaacaagaccaggtggccttcccagcaccgtcacgcatacttctgaaactcagtgattatagcccggccttggacttaaattctcaaagaagcattttctcgctcttaaggagacaacccttgctt

SEQ ID NO: 12098 - DNA, 154 bp, Gossypium hirsutum
  Clone ID: uC-gsflmaxxa015c12b1
ttgatatatcgcttcctcctcagatctgatccaacccctcagatttcttaaccccctttgcaaaaatctcgaaaacccttcttagaaacttgatcactatgcttttttccaaaaaccccccttaagattacttgttctcagtcccacctttgaa

SEQ ID NO: 12099 - DNA, 182 bp, Gossypium hirsutum
  Clone ID: uC-gsflmaxxa015d01b1
atcaagctagtggaacagcatggtcccaggaactggtccatgataagctcctcaatccctggaagatccggcaagtcttgcaggctgcggtggtgcaatcaactcagtcccgccgtgcaacaccgtcctttcacggctgcggaggatgctgctactatacaagcgcatgcggttcatgggaa

SEQ ID NO: 12100 - DNA, 194 bp, Gossypium hirsutum
  unsure (1)..(194): unsure at all n locations
  Clone ID: uC-gsflmaxxa015d02b1
atgatgagagaaagagaggcgacgaaaagaccgaattgacctcggctttcttttgaaattaccctttcttcttcttcttcctcgtcggcgtcgtcgccggcgtcgttctcgtcgtctccggcatcatcttcgtttcctcttctcctggttnccgatcatgtccttttcttccctcttccccgatcgagatggcc

SEQ ID NO: 12101 - DNA, 53 bp, Gossypium hirsutum
  Clone ID: uC-gsflmaxxa015d10b1
ctcgttgaagaaagatgatcaaaatgggttttattgttttggccttgatggtg

SEQ ID NO: 12102 - DNA, 202 bp, Gossypium hirsutum
  Clone ID: uC-gsflmaxxa015d11b1
tcgttcagtagggttgaaacaatggctttcctaagtaaaattgggaatatgcttaggcagacctcgacaacacagatcaatgctcagttgtctgcatcaagtccaagcctctttcaagtgttccggtgcatgtcgaacatgccgagctcaaaactatttgtgggaggtatttcataccaaacagatgaccaaggtctgagag

SEQ ID NO: 12103 - DNA, 107 bp, Gossypium hirsutum
  Clone ID: uC-gsflmaxxa015e04b1
aaataaggaaaaccctctctcaaatcttggctcgccagtcgcctatctttcttcttctgatactcccacttcattctgctggcagatgacagccgcttagataacct

SEQ ID NO: 12104 - DNA, 208 bp, Gossypium hirsutum
  Clone ID: uC-gsflmaxxa015f04b1
gatagtcttaagctggaaggaggcctggaatatcacccaaagaaccgtggcatacacaaaccacactgttctacctgaggctttggagaaatggagtttagaacttatgcagaaactgttgcctcgacacatggagatcatagaactgcttgacgaggtgtctatttgtctcatttttccagaatcatgttacattattttctttttt

SEQ ID NO: 12105 - DNA, 143 bp, Gossypium hirsutum
  Clone ID: uC-gsflmaxxa015f05b1
ttcatcgtccgaccaactttaccatggaaggtaaacgaaccagtgcagccttctgaaggacttactcgtcaaggaagtggaatcattggcacaatctgtccgttctagctgtttcaatttatcttattcctatcatttatttc

SEQ ID NO: 12106 - DNA, 146 bp, Gossypium hirsutum
  Clone ID: uC-gsflmaxxa015f12b1
ggaccgaccggaaaacgggcgacccacgcgttgtttcacccgcgaaacccgacaaaaggactgctaacaccaccggggatcagccgaccagccagcccaccaaaacaaacacacccaaaaccacaaaccccaaagaacggcacaca

SEQ ID NO: 12107 - DNA, 59 bp, Gossypium hirsutum
  Clone ID: uC-gsflmaxxa015g12b1
ggaccggtccggaagaacagcgactcaaactaccacccttttttgtatcaagccggaag

SEQ ID NO: 12108 - DNA, 74 bp, Gossypium hirsutum
  Clone ID: uC-gsflmaxxa015h08b1
acccacgcgatcgatcatgcgtgcgcaacaacaaaaaaaagctagggagtttctatttcctaaaaccactcctg

SEQ ID NO: 12109 - DNA, 385 bp, Gossypium hirsutum
  Clone ID: uC-gsflmaxxa026a05b1
ttcctgtttctgattgcgacgatggtccaaatacaataatgaaagatgaggatagaaatgaccttctagaggtggtgtggtgccgagcaaatgttgtaattttcgcctgggggaagcgaattgtatgatattaaaatctataaattttgcaaaaagcctatcgaggaaattatgttggggcgttcctctgaggcttcttcactccacctggatgcatatcccttgagggcttgcagcagggaagcaacactctgagagtgaatgagtgaatgaaaaagacatttgcatattaggtagtcatattttagcatttgtcaacaatgaagaagaaaaaacctaccgcattgtgggctactggggttcaagagaatttaactttattcac

SEQ ID NO: 12110 - DNA, 260 bp, Gossypium hirsutum
  Clone ID: uC-gsflmaxxa026a10b1
tctttagcttcaatcttttttatcaatggcggcttacactaccttgcgacaaaacatccattgatggaagtcggacaccattggttcaaaatctagattcggatttctcttctgggtatcttgaagatgctttacttgaattcactgaaatgtcaaaacggagacgattgttgtcgcttcatggtgatgattatgatgatgatgatttaacaaatagcttcaaagatcttgcattgaattatttgaattctgagaattta

SEQ ID NO: 12111 - DNA, 480 bp, Gossypium hirsutum
  Clone ID: uC-gsflmaxxa026b02b1
gttggggaaagctttcactgtataactgctccgaaagaaaaggaaaaaaaaagaagagaaagattcttgcttaaccatggcggagaaggcagtgactattaggaccaggaagttcatgaccaacaggctactttccaggaaacaatttatcattgatgttttgcatcctgggaggcccaatgtttccaaggctgaactaaaggagaagcttgctagaatgtacgaggttaaggaccccaattcaatttttgtgttcaagttcacaacccattttggaggtggtaaatctaccggatttggtttgatatatgattctgttgagaatgcaaagaagtacgagcccaagtataggctaatcaggaacggactcgattccaaggtagagaaatcgagaaagcaaatgaaggaaaggaagaaccgggctaagaagatccgaggagtaaaaaagaccaaggccagtgaaacagcaaagaagaagtg

SEQ ID NO: 12112 - DNA, 492 bp, Gossypium hirsutum
  Clone ID: uC-gsflmaxxa026b04b1
tacaaaacaaaacagtttattagtcctcactgaacatcggaaggttgaaaaagttgaaaccgaaaagagagagaatggcttggatatggttggaagctgcacttcctcttggaatcatagctggaatgctctgcgttatgggcaacgctcagtatttcatccacaaagcctatcatggccggccaaagcacatcgggaacgatatgtgggacgtcgccatggaaagaagggataagaagctcttcgagaacctctcttcctccgattgatccctttttagtttattactggttaaatgtaggaatcttggccaatggagcgatggagaagaaataaaagttctttatgatgttttgtcctgctgaaagaagactaaagagtcaaagtatttttcttttttgtaatatgaagcatggatttcggaaatgttgcactttttacaacagtgctaaatgttacattctcgagtggtgattcgagaattggtgtttc

SEQ ID NO: 12113 - DNA, 494 bp, Gossypium hirsutum
  Clone ID: uC-gsflmaxxa026b07b1
tcgttaagagcaagccccggtgcgagagagctggatcagacacccacacgggctgaggctcttgatgtggctgccaatagtatgaggtcaatagctttgaacaaggctcactattcagttggagagcagcctgaacataaaaaaacggaggcttcatatgaggcttcttaaaaagttaaaggccaacatacggcctggggatgtatctctatgcttctgacattcgaacaaagctatatctgcaaaatctgtattccagagaggctcgcggatacgaatgtattttgccccaaaaacatcgacatttcctatcaaggtcatcaaaaaagcggtgggtggacatcattggtgactgttttaatctcaagcaaacctattacgatcttttcccttaaatttttatgaagatgttgttttggttctaagatcatactttgggatccacccattttttctgtgcatgtgatacaaacttgaacaattttatatttttt

SEQ ID NO: 12114 - DNA, 430 bp, Gossypium hirsutum
  unsure (1)..(430): unsure at all n locations
  Clone ID: uC-gsflmaxxa026c01b1
gtgctttgatggttgagattgggaattatgattccttctatgaggctggtgttattttctccccagagcagatactaaagctaacaaaggaaacaaggggcaatcttccttctataacactatcagttacagtgcctcacacacttagcctccctgaccaggtcaagcttgcagagatgctggaaaaagaaggtgttgatgttatccaaactgaaggaggaaaatgttccactccctcaaaatctggtgtccttggtttgattgagaaggcaacaccaacattagcagcagcatattcaatatcaagggcagtgaagataccagtaatgtgttcatctggacttagtgcagttactgctccaatggcaattacagcangggcagctggtgtgggtgtgggatcaagcatgaacaagcttaatgatgtcat

SEQ ID NO: 12115 - DNA, 408 bp, Gossypium hirsutum
  Clone ID: uC-gsflmaxxa026d05b1
atcatcttcctcttcctctagaaggggataattaataaattacggtcggcgaaaaaaagggtaggagatggctcgattgctgttaatatcgatgctatttctctgggcaggatcaatccttatggttcagggtggagatcctaccctttttttcgaatggaacgtcacctatggcaccattgctcctttgggagtgccagtaaagggtattcttattaacggacaattcccaggaccaaatattaactctaccaccaacaacaatattgtgatccatgtgttcaataaccttgatgagccattccttgtaacatggaacggcattcagcataggaagaactcttggcaagatggtgttctgggaaccaacttgtctattcccctgggaagaattacacatattaaatt

SEQ ID NO: 12116 - DNA, 450 bp, Gossypium hirsutum
  Clone ID: uC-gsflmaxxa026d06b1
cccatgcgtccgcccacgcgtccgcaacaaaggggcacaattcgacgctttctagttgtgcaggggaaaaggtagaaaatggtaaatcatgaagaggaagaagaagatattgtgtggttggacgaatctttcttcatcaatgacaattaccagctaacttctttcacctttgggtctcatgttctccagctctattgtcttcactcagcttctactgattttgatttgacaggacaattggtatggcctggtgcaatgcttttgaatgattatctctctaaaaacgctgagatgcttcaaggatgttccgtgatcgaattaggctctggtgtgggtatcactggcatgctctgcagcagattttgtcgtcaaattcttctgactgaacataatgaaaaagtgctgaagatccttaggagaaacattgagcttaatgcattcttctgaaaa

SEQ ID NO: 12117 - DNA, 461 bp, Gossypium hirsutum
  Clone ID: uC-gsflmaxxa026d07b1
ttctttaaataataacaatcaccggcggatccccattctccagcaattaaacgcaggtcttgttcatttctggtgcgtttaataatccctttatacgccatggacatgaagaaggtctccaccgccatcattgttgctgccgcctcaattagcgtcgtcatggctgccgatgcacctgctccctccccttccgccggtggttctattcctagctcctctcccggttccgccccatcatcaggaccagatttcagcgtggctgcccgagtcttgccggtccttggatcattggttggggcttccattgtttctttgtttttttacatgctacatgtatgaaaaattaacattgtgaacgaatattatatttaatatatatttttttattttttggaaaagaaatatattttttgtttttataattaattaatattctaattttatttcatttcttttttttc

SEQ ID NO: 12118 - DNA, 289 bp, Gossypium hirsutum
  Clone ID: uC-gsflmaxxa026d09b1
ggcgggtacagggatatatcgctaaggcttgtgtgaaaggaacaaggacagggtgggagaacatgagtcctaattggggacaagaaaaggcaggcaaacgttgggctggtcggccagtcgttttacaattagggtcacaagtagtgacagaagcacatttacccattggaacaatagcccatgcccaattggaaattggtcaaacaaattaagggcaaaaaattttaaaatcttaatcatcttcaaataaaaagaaaaatgaaaattatttaaccccataaggttggaa

SEQ ID NO: 12119 - DNA, 449 bp, Gossypium hirsutum
  unsure (1)..(449): unsure at all n locations
  Clone ID: uC-gsflmaxxa026d12b1
aagaggctgttatctcgctttatgtttatagctgacgcatactatttatggcatttgtaggaagacacaggtgggttgaatatgcaaaaaaggatagatatgatgcatctcaggtacccccagaatggcaaggttggcttcacttcataactgatcacacaggagatgagcttttgatgctaaaacctaagaggtatgggttgagcacaaggaaaacttatctggaaaggggagtgaatttatctaccattctaaaggacatgcacttaatccttgtcagagagagtggactaggtatcaatcatggcaacccacgaaacctgagtaatctttcaaaaccaatcttnttttttttccttactttgcaaacactgggtacttaactggatttttttttctttttttgatgaatgatgtcttctattccgctcaaaaaaatactttcttat

SEQ ID NO: 12120 - DNA, 522 bp, Gossypium hirsutum
  Clone ID: uC-gsflmaxxa026e01b1
ttttgagatataattgaaagaaaagaaaaatggttctgctagagaaactttgggatgatgtagtggccggacctcaaccggaacgtggccttggccggctgaggaagatcacaaccaccccacccttgtccaccaaagatgaggcttcatcaatggcgatgccgacgagtccgacgacacctgggacaccgtcgacgccggtgtcggctcgtagggacaacgtgtggaggagcgtgttcaatccaggtagcaaccttgcaaccaaaggtattggcgcttaagttttcgacaagcctcaacctaactcttctactgtttatgactggctttacagcggggagacccggagcaagcatcaccgctgattgggcgatggctgacggcggcggagggtagcaaaaccacttgcagaaggttgctgctactgaaggagcaagaattgcatggaaatatatatattcgttctttttaaaaggttttaatgggtcaattaaatagtagtagtggtagtaagatgttaaa

SEQ ID NO: 12121 - DNA, 461 bp, Gossypium hirsutum
  Clone ID: uC-gsflmaxxa026e06b1
cccattcgtccggccttttaaaacttgggttctacaatcaacgcttccatttgcttcgctttattccaccacagtcttccaatgtctccccatctaccttttgggtgcaaaatctgaccaacaataacaccaccaaccactcatcgttatcttgtactcccaggattaatcctgtaatagccaaggcactgcgtactgaagcagctgccacatcacagcccataaaaatggtgaaagctatcagggttcatcaacttggtggacctcaggtccttaaatgggaggatgtggaacttggtgaacccaaagagggtgagatacgtattaaaaacaaagctattggactgaatttcatcgatatctattttcggaaaggagtttataaggctgctaccatgcccttcactccaggtatggaagctgttggagaggtgactgctgagggacctggactgactggc

SEQ ID NO: 12122 - DNA, 463 bp, Gossypium hirsutum
  Clone ID: uC-gsflmaxxa026e07b1
tcggttatctctgagggtgtcttaataaacgccttcgatttactttcggtttccatttacttctttatttctacgtttttgaatttttagtaagcgaaaatgagagagtgcatttcagttcacatcggtcaggctggtatccaagtcggaaatgcctgctgggagctttactgccttgaacatggaatccagcctgatggccagatgccaagtgacaagactgtcggaggaggtgatgatgcttttaacacctttttcagtgaaactggtgctggaaagcacgtccctcgtgctgtctttgtggatcttgagcctactgttattgatgaagtgaggactggtacttaccgtcagcttttccaccctgagcaactcatcagcggcaaggaagacgctgccaacaactttcgcccggggcactacacttatggcaaagagatcgttgacttgtgcttggaccgta

SEQ ID NO: 12123 - DNA, 490 bp, Gossypium hirsutum
  Clone ID: uC-gsflmaxxa026e11b1
ttatttttgatttttacacattcttctcccctcctatcctctgctcaatcgatctgttcacatcaactttgctatatcttctcatttttggatcaatttctcctttcgcgctttgaagttgatttcttgaagatgggagcggaaaagaacttcattgacatggaggagggaactctggagatcgggatggagtatagaactgtgtctggtgttgcgggaccattggtcattcttgacaaagttaagggtccaaagtatcaggagactttcaatattcggttgggggatggaacaactcgacgtggtcaagtcctggaagttgatggggagaaagcagttgtgcaggtctttgaaggaacatctggaattgacaacaaatacacaactgtgcaatttacaagggaggtattgaaaactcctgtgtcgttggatatgctaaggcgcatattaatggctttggaaaacccattgacatggccctcctatttac

SEQ ID NO: 12124 - DNA, 363 bp, Gossypium hirsutum
  Clone ID: uC-gsflmaxxa026f01b1
ataataaagctgctcgcctgctgtaccgccccgccagtgtaccggctcgaccgcacccgtccgtccttttatctttttctgtaaaaacctaaatctgaagttcttgaaatgacgaaaggaaagggagttgtaagccctaatttgaagctctctcttcctcctccagccgagacctccgtctccaaatttctgaccgaaagcggcacattcaaagacggcgatcttctcgtcaacaaggacggtgttcgaattgtctctcaatccgagcctgaagctcatccgcccattaagccatcagaagctgacaatgacgatcagttgagtttagaggatttagatgccattaaagttatcggaaagggt

SEQ ID NO: 12125 - DNA, 202 bp, Gossypium hirsutum
  Clone ID: uC-gsflmaxxa026f06b1
ttattatcaacggcttacaacaaagggagggtgtccatacaccgtgcaagctacagtctatctcaatgctctcaggaaacaagctcagacaggcctgcctaagtgtctgaggtcaatatccatatagatgaagaggggtgggtccatgatgcttgaatgcttaggcaggagcttgcgggaccccacagaccaatgtggggcc

SEQ ID NO: 12126 - DNA, 492 bp, Gossypium hirsutum
  Clone ID: uC-gsflmaxxa026f10b1
cccacgcgtccgcttctttccccttaccaaaccagctcgcctatctatggctactccactaagaagcaacagcaggctgtccactgccatggagaggaccggccagtgggttttctcccaagagattcctactgatgttattgtcgaagttggtgtagccaatttcaatctccacaagttcatgctggtggcaaagagcaattacataaggaagttgataatggaaacaaatgaagcggatttgacaagaatcaacctgtctgaaatccccggtggccctgagatcttcgagaaagcagccaagttctgctacggcgttaatttcgagattacagtgcataatgtggcggctctccgatgtgctgccgagtatctccaaatgacggataaatactgcgacaacaacctggcagggcgcaccgaagatttcctctcacaagttgcctgtctagcctttctggcgccgccgtcgttctcaaaacatgcgaggat

SEQ ID NO: 12127 - DNA, 507 bp, Gossypium hirsutum
  Clone ID: uC-gsflmaxxa026g02b1
tccactcgtccggcggaaagtatttgaggccctggatacacttggaagcaccaaatggagagtgaataacaaggtgcttgccgtggtagagagtatttgggctagtggtggcaacattgcaggcttggttgatcgtaatgatattcctataccagagaaaccttattcagaggattcaacagaaatccaagagtggaaatggagcgtgagaaaggcaaacaaggttaatcgtgaaagacattctcagcgatgcgacaccgaacttaagctttctgtggctcggaaaatggaaaatgaggaaggcttttattatcctcacaatcttgattttcgaggccgtgcataccccatgcatccacatttgaatcatctaagttctgatctctgtcgaggagttcttgaatttgctgaggacgaccattgggagatcaggattcattggctgaaatacatttacaaacctgtactcagagtgttgaaagctttccatgacggcgttgcatttgt

SEQ ID NO: 12128 - DNA, 338 bp, Gossypium hirsutum
  Clone ID: uC-gsflmaxxa026g04b1
cttatgagacacagaaaagaagaaaaaaacgacttcctccctggaaatcttaaactcctcgtttcaaaactcttaactataaatattctattaataccaacgaggtgtttaagtaatttgttcaattggtttatgttcttttaatttcttgttagatttgtttttctgttttggattttaggttaagaagagcaggaattgttttataaatcaatcgaaaaagaaaagaaaggatagaatcaatggatggaaataatgaataagataaggaatttaagatgcatacccctaagaataacgaggatttttacagccgtccgctttccggtggcgttatc

SEQ ID NO: 12129 - DNA, 321 bp, Gossypium hirsutum
  Clone ID: uC-gsflmaxxa026g05b1
aaaaaacattaattaagggagatcacaaaatatttactcatttatatttagtagtcttgtttaaactagaagcatacacaatgcctttagattattgtctttttatgcatattgcagattatttttaaaaaaaaaaaaaaaaaataaaaaaataaaaataaataaaaaaaaaaaaaaaaaaaaaaaaaaaaaaaataataaatattataatatatataaatattatattattaataataattttattataaatatctattttattatattaagtctttattttattattagggggtttgttcttttttataattttaattt

SEQ ID NO: 12130 - DNA, 398 bp, Gossypium hirsutum
  Clone ID: uC-gsflmaxxa026g07b1
ttccacgcgtccggttaaattgctgtttccatttctgtctcaacggcgctcgtcttcctcgtgcgctcagatcaagccacgtcaactcgtactctaacttttcaacggtccagtcaagcgccgactcggccatggcagcactcaactcaatccgagtagccgcggttcagatgacctccgtcaacgatctctcctccaatttctccacttgttctcgcctcgtcaaagaagcagcttcagctggggcaaaaatgatttgtttccctgaaaggtttctcctttttgggtcccaagtctgaggatagtcttttggttgcggaaggctttagatggaccaattatgcacaaatactgctctttagcaagagaatatagcatttggttgtcccttggagggt

SEQ ID NO: 12131 - DNA, 267 bp, Gossypium hirsutum
  Clone ID: uC-gsflmaxxa026g11b1
tcgttccacgcgtccggtacttttgcagtttctgccatgaatttggtgacaagtctgtttatcactgctctagttgtaaattggactttcatattaaatgtgctctgtttacatttaatattgctgagaataaacaaataaaacctattctaatggagacttaaaaaaaaaaaaaaaataaataaaaaaaaaaaaaaaaataaaaaaaaataaaaataaaaaaaaaataaaaaaaaaaataaaaaaaaaaatataaaaaaaaataaa

SEQ ID NO: 12132 - DNA, 447 bp, Gossypium hirsutum
  Clone ID: uC-gsflmaxxa026h02b1
ctgagtctagacgagaaacacaagcgtttcaacgtgtttaaacaaaatgtcaaacatgtgctccacaccaataatgacaacaagccttataagttgatgctgaacaagtttgcagacatgacaaaccatgaatttcgaaatgcttatgccagttccaagatcagacatcataggatgttccaagggacaccccgtggaacaagcagtttcacgtatgaaaacgtgaacaatgtcccaacctccgttgattggagaaagaaaggtgctgtcaccgctgttaaagaccaaggccaatgtggtagctgttgggcattttcaagtgttgtagcagttgaaggaattaatcaaataaagacgaataaattagtgtctttatcagagcaagagttgatagactgtgacactgaaaaaaatcaaaggtgcaatggaagtttaatggacattgca

SEQ ID NO: 12133 - DNA, 399 bp, Gossypium hirsutum
  Clone ID: uC-gsflmaxxa026h03b1
tccacgcgtccgcccacgcgtccgctgaaatagagatacctgaaagttacattgattcactccccaggaacggaagagcgagcctcggtgattcgatctataaaggcattacggtggaccactttgatccatcacaattcctttcgactatggacttgtcgacggaacacaaagttcttgaccttaagaataggattgaggcttccattgtcatttggaagaggaagatgcaccaaaaagacggtaggtcttcttggggttcaggtgttagcttggaaaaagggaactcttcgaagaagggcggaaactattttaattctgttaaagcaacgttattccggactttcacaatcttcactcgatatatcttagttacaagaaatagggatgtaggacacg

SEQ ID NO: 12134 - DNA, 472 bp, Gossypium hirsutum
  Clone ID: uC-gsflmaxxa026h04b1
gaaaaaatggattttcctttcatttcattccatttcggcctgaaatctgaaaatatgattaattttttggttttttaggttatatttacatgtaatttcaatgttaaccagttttgtgtttaaatttcgtctttgaaattttacattttcaatcgatcaactgtacataggatttgattaatgaagctaatagttgtgaattaacaaaagggaaaggttttaatgcctgctgtaatttgattgatttgaacactatatggtgtttaaggcaatcgattattttcattgttaaaatatacctctgtttgtctgttttagctcgttggatagtagctctataaatatttttttttgtcggctatgttgctgctgatgaatgttggatatgggttcgagttttctcatttaagttttacataaatttggaggtaatgttaattggactcaggtgttttttcagatatgtgtatgt

SEQ ID NO: 12135 - DNA, 539 bp, Gossypium hirsutum
  Clone ID: uC-gsflmaxxa026h10b1
ctcacgcgtccgagcctcctatttccccaacctcagcgcaagctactcatcgtgcgcaatacaaaccaccatcgtcactgaccgcgatcggcgtcaattcgattttaaaggcaaggagagatgtgggtattttacctgatctcgttgcctttaaccctaggcatggttgttttcaccttgaggtacttcgctggccctgatgtccctcgttatgttctttttaccgtcggatacgcttggttctgttctctctccatcatcattcttgtgcccgccgatatttggacgacgatatcgaagccgggaaattataatgaaaatggaggaatttcattcttttggagttggtcttattggggtacctttctcctcacctgggctgtagtgccccttattcagggttttgaagatgctggagacttctctgtgactgaaaggttgaagactagtgtgcatgtcaacttagtcttctattcagtcgtgggttctataggcctttggggacttattctcctcattacaatgaacaggaactggag

SEQ ID NO: 12136 - DNA, 464 bp, Gossypium hirsutum
  Clone ID: uC-gsflmaxxa027a01b1
ctgcagtgtacccgtgtccggaatatcctcgggtcgtacccatcgcgtctcgtttttctttacttaaaatatttagtgcccatattctccactcctatttcaatcaataccgtcattcactccctaccctctttctgttaaagtctttcacgttcactctacagtaaagggaatatcccatctccttgtaaaaaaatgcagcttcactcggccgtggcattgatttgtgccactgtttctctttttgtcattgccggagctgaagatccctacagattcttcaactggaatgtcactaatggtgacattttaccctcttggtgttcattaaacgggtatttttattaaagggcaattcccaggccctgatattcactctgttaccaatgtcatacctcattattaacctttttaacagcttaaacgagcctttccttctttcccggaatggggtccaaaacagg

SEQ ID NO: 12137 - DNA, 487 bp, Gossypium hirsutum
  Clone ID: uC-gsflmaxxa027a03b1
cccacgcgtccgctttatttctccccaaattttcaatcctaaatactcgatccaattgaaactcaattttgattttttaatcattattcttattatttattcgatgtgatcatgcccgcgacggattatcaaggaacttcgtcaccgttgacaaatatcggccgttcgttattaccagtgaggagggatcaagtacacgccatggaatcgccgatcggtggatcggcgtctaacgaggcggagatcgagtcctttcaaaggcaagtagctgacagatttcacgatttagcttctgtcccttccgatgaattgctttctctgccgtgggttcggaagttgctcgacgttttcctctgttgtcaagaggaatttcgggtcatgctttttaacaacattactttagtgaagaagccgcccatggaccgtttgatcgccgatttttacgagcgtactgttaaggcgcttgatgtttgcaatgcgattcgcg

SEQ ID NO: 12138 - DNA, 372 bp, Gossypium hirsutum
  Clone ID: uC-gsflmaxxa027a11b1
tttgttttaccactacttttaacgttattatacttattccgtgaatcggaagcggggcactgccccttcttttggacccaaggtcagatccggccgtccgttccgggcggaagaaatcgtcaggtggggagttttggttggggagggacatctgttaaaagataacgcaaggggggtaagatgagtctcacgagaacattaaattcgtgtggaacataagggtataagctgcgttgatcatatttccatgtccagtaacaacccgtgaaagcgtggcctatcgattcttttttccttcggaatttgaagcctagaggtgttaagaaagctaccacacggattactggcttgttggaatcaatcgttcatagc

SEQ ID NO: 12139 - DNA, 113 bp, Gossypium hirsutum
  Clone ID: uC-gsflmaxxa027a12b1
ttctttatatctaagggtattatgattaccttattctactattctgtcatattacatataatgatcaattcatatcatgactaggcaaagtctcaagccataagaagtcacac

SEQ ID NO: 12140 - DNA, 308 bp, Gossypium hirsutum
  Clone ID: uC-gsflmaxxa027b02b1
catgaatcgtacaactgcaagcgcgcttggatcaattccaaaaacatttaaaggagtacaatgttttagtatcttcaggcaattgataaaccggttaatgaagctggtgaaacccattgatatactgtggagttcagcctgggtgtggacttagacctgcctttgatttgattgtttcttctttgatgctatggctttcttcctccatttttgatgcttcaggttagtttactgttgtgactccatattataaatatatgcattgctcctcccttcgttataaataaaatgtgtgaaatttattcagc

SEQ ID NO: 12141 - DNA, 356 bp, Gossypium hirsutum
  Clone ID: uC-gsflmaxxa027b06b1
ttctatctttcattctttgctgttgaagtagtaatatctatagcatacagagatggagtggcaaagaagcaagcaggtttgtttgttgatgtgggttttggttgctgcctttttctcccacaatagggtcattgcagtgacctacactggccttggtgagcagaaaaactactatccagctcctgaccctcatgctggaacttccccttcaggttcacatggcacaccaccatctttaggaggtggatcaccctcctcttatggaaccccctcacatggaggtggttactacccttcaccaacaccatcaacggctttctgtgtggtaattgtggaacttctccacatgacccttt

SEQ ID NO: 12142 - DNA, 443 bp, Gossypium hirsutum
  Clone ID: uC-gsflmaxxa027b08b1
tcgtttacgcgtccgagaaaaatggctttggcaagcttggtgagaagaaaggcattcctttagtctagaaacctgttgaattcgcccgcagatgcgttgaaatactctttttcactcatcattttctcgaggggtttcgcttcatgatctgaagagaacgacgtccttgtcattggtggctgacccggtggctacgtggcaattatcaaggctgcacagctaggtctcaaaacaacctgtatcgataagcgtggtacccttggtggtacttgtcttaacgttggttgcatcccatctaaggcgctttttcattcattccacacgtaccaatgaagctacccattcatttgctggccatggtgtgaaattctcctctgttgagattgatttgccttgcatgatggcccaaaaggacaaagctgtttctattcttacccctggta

SEQ ID NO: 12143 - DNA, 459 bp, Gossypium hirsutum
  Clone ID: uC-gsflmaxxa027b10b1
tcgggtttctcagcttcatggtgcaccgaagtctcgtgctcccctgatgaagttgagtccaaatccaatggcttagattcgtccaaggccaagaaccaaactgtggagattactcggtcaccacttgtgaggacctccagagggcgagttcaggtacttccttcgcggatcaatgattctgtaattgagaattggaagaaagaaggtaaaactagcttgcctgatgatagtttagatgatggtgatgatgacgacgattatgattttgaatgtaaaaacgataaatttagctttaagaaacctaaagtttgtaagcagaacatgaaaaatcggcgagctgaaaagaagaatggttataaagggagaaagtatactacattgtgtgaggaagatggaagagaaacaaagtttgcttggactttttgatattaaaaagtactcaagttcccggagtacttt

SEQ ID NO: 12144 - DNA, 424 bp, Gossypium hirsutum
  Clone ID: uC-gsflmaxxa027c04b1
tccactcgtccgctctctctctttcacttcacttccacagccttctcttctccaccaatccaaaaaaaaacaaagatgcagtacaaaaacctgggcagatcaggcttaaaggtgagtcaactatcgtatggagcatgggttagtttcggtaaccagctcgatgttaaagaagcaaagtcacttctccagtgttgtaaagacaacggagtcaactttttcgacaacgccgaggtttatgccaatggtcgagccgaggagatcatgggtcaggctattagggaacttgtgtggaaacgatcggatatcgtggtttctaccaagatcttttggggcggtcctgggccaaatgataagggtttgtctagaaaacatattgttgaaggaaccaaggcgtccttgaagaggcttgatatggattatgttg

SEQ ID NO: 12145 - DNA, 199 bp, Gossypium hirsutum
  Clone ID: uC-gsflmaxxa027c06b1
tttcactcgtccgcaagaacagtgaagggtatcctggagcttgatactacggaggaaacgaatacattgacatggctgagtccttgtgacaaacgcttgctctagaggcttttgggttggatcctgcaaagtggggagtcaatgtgcagacactttccggatctcctgctaactttcaggatatcttaagccttaagaa

SEQ ID NO: 12146 - DNA, 544 bp, Gossypium hirsutum
  Clone ID: uC-gsflmaxxa027c07b1
tcggttggaacagacgatcgtcctcttcccgcaatggcggatgctcaaactgaaaaacccctttccctttccgagcaatatgcacttcaggagaaagaggaaaaatcagatgtgactacaaaaccagcagaagcaaaagaggttgaaaatcctgtaaatgcagccactggttctggggatgttgtaactgagaaattggaggagacttctgccgatccagatgagggaagcactgaggcccctcctcctgctgctgaagaaagcactgaagcaaatcctgctactgggaacagtggtgaagatgctgcagaggaaaactcgggtgactctgaggaaacttcagagataaaggcttggagactgtcccagcggatttccgttttccaaccttaccaaccaaaacaaggcattgctttacacgatatattgagtacccccgttgtgtagctgcaaaaggagaaggtgcttcagagcgtgataagtttgcaaaatattatcgtgccttgttgtcctgcagaatggatagatcgattgaatgagcaat

SEQ ID NO: 12147 - DNA, 574 bp, Gossypium hirsutum
  Clone ID: uC-gsflmaxxa027c12b1
ttcttttaataaaaacatggcaccacaccttattattgttccttccatgtttgtgcttttattattattcatttcagcctctaatgtccaatcaggcgctattgatgttgttgccaagtttggcgcaaaagctgacgggaaaacggttctgagtaagccatttttggatgcttggaaagaagcatgtgcctttgtaaccccatcaacagttgtgattcctaaagggacatatttattatcaaaagtaaacttagaaggtccatgcaaggctcctattgagattaatgttcagggcactttaaaggcttcagtttgtcctggtgctttcaaggaccctaattgggttagattttattgtattgaaaaatttaaaatgtcctggggatgaaatttcgatggtcactgaagcctttgcttatgataagaataaagatcccctcaattgtgcttttcgcgtcaaacttctcgttaatataagggttgactttgtgaccaatccattgttccaagatatacctagctatgaccgtaaacttttctcccttaattgtttttgatgtaaaaccatttacct

SEQ ID NO: 12148 - DNA, 407 bp, Gossypium hirsutum
  Clone ID: uC-gsflmaxxa027d02b1
gtcaggcgcagcaaattgggtttccataaccttactgttttcagtatgtttatcggcgtcctatggtaagaggaccggaatctccaccatggctgacggagccgatgggtttcaaccaagcaacggttttccgcatgaagctgatcctgattcttcaacctctatcgatcctgatcctaccggattcggtgctggcataggtataggttatgaaagaagcccttactgtatcgactgcgacgatgtggatatcatgggcggcagcttttgcggcacctgcaattacggatgcccttaccgcaggttcaataatgggtgtggtggtggtatcgcttatatggatgaaactaaacgaacgattaaggaccttaccatgaaacttgatgccaatgggtcttttagggaaa

SEQ ID NO: 12149 - DNA, 476 bp, Gossypium hirsutum
  Clone ID: uC-gsflmaxxa027d06b1
ttcactcttccgatccaaaatagtaatactctcatattttcaacaatggctacccctatctcactctcactctcatcactagcttctaaatcccagcaactggtgaggaatgagcgtcggatgttggccgcatccgacgatggtgcaatgatgaagcaaattcagtcgactcatgcccccgatggtcgtgttgttgatgttaaaccaattctccaagtcattgacaatgtgttgcatcatatcattcccaacattgatcatgctatgaaatggtggaacgggacacatcgatgctctcgatgatcggaccaactcgtctgccgttgatggtgcacttgatgctttggcttatatcgcacacaaaatctgctgcgaggtatcatgcaagtgttcaggaggaggggatgctcatgcacaacaatggggattctcaacatgctttcaagctatttcgtgggatgcaaagtggtgcttac

SEQ ID NO: 12150 - DNA, 553 bp, Gossypium hirsutum
  Clone ID: uC-gsflmaxxa027d08b1
ggaggatgtctgcctagttggagattttacaggaaactggaaagaaccaataaaggcaacccataaaggtggagctagatgtgaagttgaaatcagacttccccaaggaaaatattactacaagtatattattaatgggaactggcggcattcaacgtcttcaccaacagaaagggatgaaagagggaacattaacaatgtgattatgattggtgacactgcaagtgtgaggcccacaattcaaccacaacagaaggatgccaatcttataaaggtgatagagaggcctttgacggagaatgaaagattcatgctggccaaggcagctcgttgcattgcattctctgtctgtccaatcagactagtccccaagtagtttttgtcactgcaattccaccaagtggaatgtgctttggtctcttcttgaatctcaaatacatttagcacattcaattccctgtgcaaaataatttttgcccttcggtatgaagtgatctgccaatgtaattcttacggctgaattttttttgaatacatttaattggtctctttg

SEQ ID NO: 12151 - DNA, 539 bp, Gossypium hirsutum
  Clone ID: uC-gsflmaxxa027e03b1
gtcgactggtatgcggcaattaataaaccagctgctgttgttcattggctcaaccatgtaaacgttgatgctgagtacatagttatccttgatgccgacatgatcttaagaggcccaattacaccatgggagttcaaagcagcacgtggccgaccagtttcaaccccgtatgaataccttattggttgtgacaatgagcttgctaaacttcatactcgccatcctgaggcttgtgacaaagttggtggtgtcattatcatgcatattgatgatcttcgggaatttgcactgctatggttgcttaaaaccgaggaggtccgagctgacaaagctcattatgcaacaaacatcactggagatatatatgaatttgttggaacagtgaaatgtacggttactcgtttggtgcagcagaattgaaattacggcatcttataagcaatgagatattaatatatcccggatttgtttccaaacctgatgtcaagtacagagttttcactactgcttgtaatttaaagtcgggaactgagctttat

SEQ ID NO: 12152 - DNA, 448 bp, Gossypium hirsutum
  Clone ID: uC-gsflmaxxa027e10b1
ttgacacacacataaagagaaacaagttttgagaatggccaccactaagacaacccttttgcttgctgttctgtgtcttttcctagtttgcgagattgggatgctaatggttgaagcccaagttcaaaggccagaatgcgaggggaagtgtgcatcaaggtgcagcaagtcatggaagccggagatgtgccttaaaacatgcaacgcttgctgcaacacctgcgatgggtgtgtgccttctggccctactgctaacaaggaagtatgcccttgctatgccaagtacaagaatggcaagtgcccttgaatcacttttttcttattttctaaaacacgcattcctttcatggattcattttcaattataatttctatttatgagagggggtcttgtatttaataaaatctcttaaacaaagagagaaaagaaaaaaaatgtattcactta

SEQ ID NO: 12153 - DNA, 480 bp, Gossypium hirsutum
  unsure (1)..(480): unsure at all n locations
  Clone ID: uC-gsflmaxxa027f03b1
cccacgcgtccgcggacgcgtgggtttgtctttaggcaacggtccgtcgtgcggaaggtcgaaggtcggtagtaacggcgaatgctccacttcttccgtcgttgacattgtgcttgacggtgtctcggagacggtggaccagatgttggggaacgctttctgttggaaccgtactgactatgttcgaattcaggcaaacggactggggagtggaaggatgagaatggaggaggtactgaaggaaagaggggtcgagtcgttacccgttggcgggaagaggttactgacagagactaacggaaatagaattgaaagcttttgtgcaacgccttgttgcttccggaaaaaccagccttcccccaagcccctgcaaggaaatagcccgcagcccacttgcaaaacggccgttagctactcatttaaaaaattnggtctccctctgttttctctttttacccactccttttggttttctctttt

SEQ ID NO: 12154 - DNA, 277 bp, Gossypium hirsutum
  Clone ID: uC-gsflmaxxa027f04b1
tttctttgaaggagcagtggagagcaaggagcgagggttgtttgatttcatggggaagaaagaagaggtgaagcctcaagaggatgttgatcgtaaccgagtctgaaaaggttaatattcaatagacaaaggcagaggaagaaggtgaggagaagaagaagcatggtctactggagaagcctttaccgattagattgcaatcagcttcagcttctttaagcgactaggtaataatgtgaaggatcaagagaagacacaaaaacataaattaatatgg

SEQ ID NO: 12155 - DNA, 384 bp, Gossypium hirsutum
  Clone ID: uC-gsflmaxxa027f07b1
cccacgcgtccgattctctctctgggaaattaaaaaaagaaagaaagcagggaaatgcttaatctatggaatcttctcttcctctcctttgttcatttctcatcattcagtgttactttgggtggggtgtcgggaaacccatttactccaaaatcctccttcattcgctattggaacaaagagctccacaaggaaatccccaacacccattttttactctctaaagtttcaccattaactgccgtcgactccgccagtttctcgaaactcgccgtccacaacaacctcgcttctcgtcttccttccttttgttcctccgctaaactctttttgcttcccccgacttatcgcccagtctcgagaaacattcccaagacgttaact

SEQ ID NO: 12156 - DNA, 429 bp, Gossypium hirsutum
  Clone ID: uC-gsflmaxxa027f09b1
tctgaagaagaggaacagcgattagaccgagttgactcactccacgagccggacctgacttcaaccagctcaagcctgtcctcggtattcagtgcggttgattctaggagtgcgacgagttccggcgatatatccggaacgagcgggagttccggcgagatcttaacggcggatgctgtggttccgaggctgctcgagcctgcgcctgcatgtgaggagttgaaggtgacggtaacggcgaggcagaaatgtgttgggaggaataacaagggagtgacgtgggggttcacttcggtgatcgggagacagcgagagatggaagaagccgtcgccgttgtaccggcgttcatgtctttcacgtgtggtcaacgtggaagttgtaccgctcctggttctgaaccctccctgggaactccctattcatttttt

SEQ ID NO: 12157 - DNA, 535 bp, Gossypium hirsutum
  Clone ID: uC-gsflmaxxa027f12b1
tcgtttttgagaaacaaaaaacagatagcttttgctctctctccctctcctcttttccttgcggctagggttttgaaaccctcgtcgccgccattgtcactgcgccaccacaggcggtagttgggacgttgcgagcttggctttctagcccctgtttaaagcgtccccaaaggccaagccttctcagtccaaaaggtgcgaaagagaggatcctttccctccctattcggtccgatcccgatgacgaatgagagccctccttagactaaaaccaccggcgactactgtgagaccctcttccctttccctttacttattttatgtcccacttttttttaaatggattttttttaaaaatataaaaaaaatgaatggaaaaacaaaataatagaatatcgtgatcaaccttaaccttgggtctgtttctttaaattcaaatgtgtgtgtaaaaaataccaagtatgtggattggtttttattgccggttaaagcaactctccatttcattccttttatttttttggaattaatcctt

SEQ ID NO: 12158 - DNA, 399 bp, Gossypium hirsutum
  Clone ID: uC-gsflmaxxa027g10b1
ggtttccagtacttccacaaaaaagaaagttttactctcaagaacaaaagcatattctttgatttcaaagcgtttaatttttaagggaaaataatcaaggctcttcattagaggattctctgtcaaaggaaaatcgaactgtttttctttctgttttaatcggcgaaaaagaaaatgcattcgactcatctgttactcgaagagccaatcaggatggcttcaatcctggagccatcgaaggctagcttttttccggcaatgacgaagatagtgggaactttaagtccaaaatctcgatccattgaagtcatttccggttgccttaaagctggaatgtctgtggctaggttcgatttctcgtggcatgatcccgcgtatcatcaggaaactttagaaaat

SEQ ID NO: 12159 - DNA, 394 bp, Gossypium hirsutum
  Clone ID: uC-gsflmaxxa027g11b1
tcgtgtcgcgtgggcggacgcgtggggggaaagtcttgaattcgattcatgctcgaaaaagtggatcgattgggaaatggtttcaacaccacaaggaattaggcaccaacacagtgaagaagaaagatatgatacgtgcggaaaatgctcgggtgcactctgctgattcggttgctggactagctgcaggtttggcagctttagccgcagctggaaagtccaatgggacaaccacaggctcaaagatgagcacgtgattggcatttgcaactcaacttttggcatcacattgcattgaattagctgaactagccggtgcttgatatgatcgtgttggttctgttgttaaatcagccgttgatattcaaactgctggtgatctgatgactttcac

SEQ ID NO: 12160 - DNA, 416 bp, Gossypium hirsutum
  Clone ID: uC-gsflmaxxa027h09b1
tcgctcacgcgtccgacccgcacaggcaacaccaccactcgcgctcgttctctgcgcgtgcaatatctttgccttctcttccttttcgggcaccttctcccgccccaccgatcctgctctggttcacccgattcctgacccgagttatcgcttccggtcccgccttcaagttctcgacgggtcaaaccaaaacctataaacaaaactattaaatgagatgagttttgcaactgattccccagtacactcgtctagcagtgacgattttgctgcattaattgatgcggagcttgaagctggttcttcaggctcatcgccagatgaaccaagacaatgaagaggaagaagtcgatgctgatagtgatgatgaccaccgcgaccaataaaaggatgacacgtatgatgaccctaacgat

SEQ ID NO: 12161 - DNA, 545 bp, Gossypium hirsutum
  unsure (1)..(545): unsure at all n locations
  Clone ID: uC-gsflmaxxa027h10b1
ctttactctgtcgtatctctccttctaaaaccctacttatctcctcctcgcaaaaccctagccccttccttttttctttcgtagtaatcatccatggagttctggggtattgaagttaagtctgggcagcctattaaagcagatcctggtgctaactacgttatccatctttcccaggcttcacttggagagtccaagaacaaagcagaatccgttccactctatgtgaatgttgatggaaagaaacttattctgggaaccctttcccaccagatttgccctcaattatcttttgatttagtatttgacgaagagtttgagctctcccacaactggaaaaacgggagcgtatatttcctcggttataaaactttcataccaaaggaaggtgatgattttggtatgtctagtgaagaagaaagcgaggaggaggaagatgaggangcttctgtcgctgctgctgctgctgctgctgcagtaaatgcaaaagctagccagatgcaaaacagccaaagcttatgctgggaaacctgatgctgttaaac

SEQ ID NO: 12162 - DNA, 410 bp, Gossypium hirsutum
  Clone ID: uC-gsflmaxxa028a02b1
tttctttcattttccgcccactactcttccaaatgctcatcatgtacggcagagatccgtggggaggtcccctggagataaacgccactgattctgccactgacgacgacaggagcacgaatttggacgacctggatagggctgcactctctcgccccttggacgagactcagcaaagctggctgcttggccccggggagcaaaagaagaagaagaagtacgttgatctcggatgtattcattgtgagccgcaagatctttgtatggaccgtggggaccctgctagtcttcgtccttctggccggactcatcacccttatcgttaagactgttccacgtcatcaccaccgtcactgttcgaccaataactacactttggctctttacaaggcgcatatgatctttaatgc

SEQ ID NO: 12163 - DNA, 472 bp, Gossypium hirsutum
  Clone ID: uC-gsflmaxxa028a05b1
ttagatttcgatttggcccccttatttaaagactcaatgcaaatcggtgtaaattgtaaatacattcatccattccccttgttctctccaccatttgttgtcttttaaacctaccaaataaaaatggccaaaaccatttttgcattatcaatcttgcttggattcaactatcttgctacgaccgtgaatgcctacgcggcttctggctggactaaagctcatgccaccttttacggaggcagtgatgcctcgggaactatggggggagcttgtggatatgggaacttgtatgcgactggctatggaacaatgacagctgctttaagtaccgccttgttcgatgatggagcttcatgtggacaatgctacaacatcaagtgcgattatcaaacagacccaagatggtgcataaaagggaaatcagtgaccattactgctacaaacttttgccctcaaactttgcttttctaac

SEQ ID NO: 12164 - DNA, 465 bp, Gossypium hirsutum
  Clone ID: uC-gsflmaxxa028a08b1
ttcgttttgaaatagtaaatgttgagttttttaagggcatatgccagttatttgaaatgtttttctattttgtatttgaaacatttggtctgcaaaacatgaatttgagtggaaagacttcgacggactctcttaattatcggttaaagactgccttatcacaaataacgcaagattgtgaagagtggataaaaacttcatcaggacccttatcatcttcaactgcacatgcagatttgacagccactgctcctcaaaatacaaattttggttctccagcaggcacctcctttggtctaaaggaaagatgtgcaggtgctgatactgtagcttttgtagctcggatattgcatagatctagaactaatcttcaatcattgctattaaagagtaatacagctatagttgaggctttctttgtgcacctggtgggtgctgtgccagatcttgtagagcacatacata

SEQ ID NO: 12165 - DNA, 377 bp, Gossypium hirsutum
  Clone ID: uC-gsflmaxxa028a09b1
tttttactgaccaaggaaatttccaggctctgccaaatctgccttgctggtaaacgtgaaataagaggaattttgatcagttcgcagaggaagagcttgaagatggacgaagatcacagtaatagcggctttttggagactggaaaagctgatagatcggtttggttaatgaagtgtccggtcgttgtggccaaaccatggaagagtcagaccgcttcttcttccgattcacagcctgtcgccaaggttgtcctctctctcgacccttcgcaaacccgatgaccctttttctatgcagtttactatggagatggctggatctgagattggaaaatattccaaagagttacgcctttgatatgtttaaagacttttgt

SEQ ID NO: 12166 - DNA, 453 bp, Gossypium hirsutum
  Clone ID: uC-gsflmaxxa028a11b1
ttgcaggtactttttattaattcccgtttcttccactcgtttgttttcgcgtgggctcaaacccatatttgttctctctctctctctctctctatttccaatctattaattcctccattggaggagcttagggtttgttggtgttctggtctttgctttgtctgaaaaataaacagatttttaaacgaacaccaacgccatgggaagattttgaagagagaggattcgattcagtggtttgccctaagcctatcctaacctttagatggtctaccaactgttatcagactgagatggctgattcaaaaactggtgcagagcttcttgatttaatcctccccgagggagggtatggggcctagattcccaccaccaaatggatttatcaccaccgtatttctgtggatcacccgccgagcagggcgtcgtattcggttattcaagatgcccgat

SEQ ID NO: 12167 - DNA, 582 bp, Gossypium hirsutum
  Clone ID: uC-gsflmaxxa028a12b1
ttttctgtttctttccacgcgtttctttttgggaattttgtgcaatctgttgtgccttgccagttggtttatggcaccatggtctatgtccgacaaacaattgtttctgatgcttattgtgctttagctagagcagtttgtatttgcacaaggtacagtgctgttcgtagacaatttggttcccagaatggcggttcaaagacccatgtgattgactataaactcattaaagcaaactcttgtatttgattggattgtgcaaagattcaaaattggtgtttagtaggttaaattgctttacacttgatttacacaaaaattggaagccaatgattttcttccacatttactccgaggcttaatgtcatgtacctgcaaggggtttaaaatctaatgactaactttctgtaacctgcagaatgctaattgaatgattgctcggaaattattgtgcgtggtccatgggttatcttctctaacaagtgtggctcctctgagattatttgctagtttattatacctaacctgtacctatgaaggaaaacattttggtgctgttcttacaaggtgcaagatttttta

SEQ ID NO: 12168 - DNA, 479 bp, Gossypium hirsutum
  Clone ID: uC-gsflmaxxa028b02b1
ttttgctggagagacgaaggatcattagtgatcaccaacacgaacgtgttcgctgctctcgaaactctccggaagaagaagaaatccgacaaggaccggcggtcgaagaaatcttcttccaagtctgaaaaacaacagaagtcgcaacaagaagccgagtctcaggtgttttgggctccggcacctctcaccgtcaagtcgtgggccgatgttgatgatgaagacgatgacgattattatgctaccactgctccacctcagtccgtttggggatcctcggaaccttctcagagtcacgaagagaagacagctaatgtagaggacagtgagagtgaagaagatattttagatgaaggagatgatgatatagaggaagatcaatgaacatgaaccggaaattcaagtacatccaaagcctgtgctaaaaagggatcctgaaattcctgcaccgcccaaagaggcagaaaggcaacttttca

SEQ ID NO: 12169 - DNA, 462 bp, Gossypium hirsutum
  Clone ID: uC-gsflmaxxa028b03b1
ttttgttcctaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctattgatgttgacattggtgccaatccttcagccgaagatgctgatgaggatgaaggtgttgatgaccaatctgtgaaggttgttgacattgttgacactttcaggctttaggagcatccccctttcgacaagaagcagtttgtcgtgttcatgaagaagttcatcaagaacttgacaccgaaactggatgcggaaaagcaagagtcccttaagaaaaacattgagggagcaaccaagtttttgctttcaaaatgaaggaccttcaatttttcatcggaaagagcatgcacgatgatgga

SEQ ID NO: 12170 - DNA, 583 bp, Gossypium hirsutum
  Clone ID: uC-gsflmaxxa028b06b1
gtcgttatgttcgaacacgtgaagctggtatccaggacattcaccataaaattagacctgaagaagttgagcttgttcgacgtgattatactgcaaatgaaggttgggaaacatttttgtcgtatgaagatacgcgccaggatattcttgttgggttgttgcggctgcgaaaatgtggccggaacactacttgccctgaactaatggggaaatgttctattgtccgtgaacttcacgtgtatggaactgctgttccggttcatggcagggatgctgacaaactccaacaccagggttatggtacactcttgatggaagaagcagagcggattgcgagcagagagcatagatcaacaaaaatagctgttatatctggggtaggaacccggcattactataggaagttaggctatgagcttgaagggccttacatggtgaaatatcttgtttaacgaggctagttttgtgattaaagaattagtgtaaaattcttgcgacatatataaatcatcaatttgtttgcctgcaggaagccatatttgtatgctctatttcaattttttttaagatgttggagattgat

SEQ ID NO: 12171 - DNA, 565 bp, Gossypium hirsutum
  Clone ID: uC-gsflmaxxa028b09b1
tcgtgctctctttgtcgcaaaccgcttcgcgattccgatattttcatgtacagagggaatacgccgttttgcagcaaagagtgtagacaagaacagatggagatggatgaagcaagagaaaagaactggaaatcgggtagatctcttagaaaatcagatgcccagaactccactcctaacaaagctgtacggaccggcacggttgctgtggcctaatcccatcatcttgctttttgagtgaaaaaaaaagatgttaaaaagatttatcatgtgttaatgctgaagttttgatggagtgaagtttccaaggcacttctttcggtacccgtgcctgttttctaagatcaaaaagggggaaagggcaaagtacttgaacgattgattagagtgtggaactaatacataacaatatatgctaaacctaatcaggatgaatgtgaacatgtatgaaggatatattcagtgttgaggtgtgcctgctttattttatttaactcattagtcttgtattcccagagtagggtagggaccaagggtaagagatgaaagcacttaatatgtggga

SEQ ID NO: 12172 - DNA, 461 bp, Gossypium hirsutum
  Clone ID: uC-gsflmaxxa028c01b1
ttttattctgtccgatttctttctttcaatgggttttattggttcaatccgtggaaccatttgtttacgacgtcaactttgctggagccgttggagatggagagagtgatgatacagaggccttcaagaatgcatggaatgttatctgttgttcgcatatccctttagggatatttcgtgttccttacggacaaaagtttctggtgcaacccttgacttttaatggtgaatgtcgaccaaaaaatattaccattcagattgatggaatactcattgccccaagtgatccatcttcatggaaatgcaatgatgcaaactgtaacaattggataacctttcaacatttttgatggccctcgtcattcaaggaagcgggagccttcacggtcaaggacaaaaatggtggcaaatgggttgatgcaaaataaagtgctttgttcatttaaaaagcagcgggtttt

SEQ ID NO: 12173 - DNA, 492 bp, Gossypium hirsutum
  Clone ID: uC-gsflmaxxa028c07b1
tcgttcacgcgtccgcccacgcgtccgtctttacattcctatttcattttggaattccattatccactttgttttctttttcttaattcaattgagcattagattattttgtcttctttttacaaaatttgtctaattctctttgcaatttttcctatccatttccactacctttttcatataatttctatcattttcataaccttcaagcatgattaaattcatgccacactaaacccctttcaggtttaagccgatgttaaccccgtcaaaatacccgtgagttatgaacccgagctatttaactcccaactttcgatatttattatttctccggattaagagtatgacttcgtcaactcacaaagtcaagtcaatactaagtcaaaaaagacgtcgtttgagttagtgtggctagacgtacagttggaattccgaaaggatcgattgtctaattggtcttccgtgaacacattggcgtgccaagtgggg

SEQ ID NO: 12174 - DNA, 471 bp, Gossypium hirsutum
  Clone ID: uC-gsflmaxxa028c08b1
tcgttgctgaacgagaaattgtacgcgacatcaaggagaaacttgcttatgtggcactcgacttcgagcaggagcttgaaactgcaaaaagcagctcatcaattgagaaaagttatgagctacctgatggccaggtaataaccattggagcagagcgtttccgttgtcctgaggtcttatttcaaccatcgcttattggaatggaagctcctggaattcacgagaccacttataactccatcatgaaatgtgatgttgatattagaaaggacttgtacggtaacatagtgcttagtggtggatccaccatgtttcctggtattgctgatagaatgagcaaggaaatcacagctcttgcaccaagtagcatgaagattaaggtggtagcaccctcagagagaaaatatagtgtctggattggggggtctattttagcttctcttaatacattccagcagatgtggatattaa

SEQ ID NO: 12175 - DNA, 532 bp, Gossypium hirsutum
  Clone ID: uC-gsflmaxxa028d03b1
ttcatttttctcacacccgacgccaagtcaatggctctctcaaaactcgaacaacaatcacccacacaagaaccgccgtcgccatcccactgctacactgctttaccaacccaatcttctgatgaaaactacgccgttttgcccttctactcccccgggggacgactccgctggtgcggttgccggatgctatacaccggcacggcttccttcttcttgttagctaccttggtgtacattttctggccctccgaccccgacgttaagatcgtacggatgcatgtgaaccgcatgaaaatccacaccgtacccatcatagcgttggatatgtctttattgattacgttgaaagtgaggaattcggacgtctactccatggacattaccagtttggacgttgccgtcgggtacagagggaagatgcttggacacgtgacgttcgagcaaggtcacctgaaggcgttggggtcgtcttatgtggaggcggtgctccagctaatggggttgagttgttgtcgacgttgtgtatttg

SEQ ID NO: 12176 - DNA, 451 bp, Gossypium hirsutum
  Clone ID: uC-gsflmaxxa028d07b1
ttctttcacaaaaagggcaagttgcttcttttttcttgtccaatagttcctttgtttgttcaaaaacatattcttttttaaggttgaaacatgtttaagcttaagggaaaatggcattcacgggaactttggacaaatgcaaggtttgtgataagactgaccatgtggttgatatgatgactcttgaaggagtttcttaccataaaacttgtctcaaatgcagccattgcaagggaaaccttgtgatgaacacctactccttcatggatggagtcctgtattgcaagcctcattttgagcaactatttaaggaatatggcaatttcagcaagaatttttatacagcgaataccgataagcaaaatgccacgtctaggactcccaaaaacttttaatctttatttttgaacccaagataaatgtgctggttgctagaaaacatttttccctt

SEQ ID NO: 12177 - DNA, 554 bp, Gossypium hirsutum
  unsure (1)..(554): unsure at all n locations
  Clone ID: uC-gsflmaxxa028e01b1
tttactgattccgtgagctccaaatgaaccataaagcgcagcaaaaagtccaacactattccttagtactcttttcaaaaacctagggcattgtttaaagacatggtggctatcctcttctccggagcaacaacgaggacatctgacgttagtggtcactcgcttgtgtctaagcttctgcaagagggatttgcaagattctttgggcaatttctgtttgaaagatcacatttcctcttccaactctccaacaaagtccatctcgaagaagaccctttgctacccaaatactcttccaggtaaatgaagatgcagatctccaccttggctatctttcttcaaactgtaggagacaaatgtgcaagatgcgccgacttcaagcaatagaaaacaaaaaacagcagaaaaacctagaactcttgccagagacgacagacaataacgtgctggggtagcaaactttttttttatatttataaataaatttacaatctataaatacatgataaaaaaagtagaaatttccaattctttcttttcattggntttgtttt

SEQ ID NO: 12178 - DNA, 115 bp, Gossypium hirsutum
  Clone ID: uC-gsflmaxxa028e03b1
ttcacttcgtccgacatgatcgatttatttgtatgatgtccttgaacaagtttatagcattgtctatcaggaacatctttgtgaaataatattgatctattgtgtgttttgttcc

SEQ ID NO: 12179 - DNA, 513 bp, Gossypium hirsutum
  Clone ID: uC-gsflmaxxa028e06b1
ccctccgcagttcactgagaaatgggtgaggaagttaaggctgtggttcctgagtcactcttgaagaaacagaagagggctgaagaatgggagcttgccaaaaagcaggagcttgaagtttcaaagaagaagaaagtcgagaaccgcaagctgatttacactagggctaagcagtatgcaaaggagtacgaggctcaggaaaaagagctgattcaattgaagcgggaggcaaagttgaaagggggattctatgtagatccagaagctaaactcttgttcatcatccgaatccgtggtatcaatgccatgcacccaagaacaagaaagatcttgcagctattgcgtttgagacagattttcaatggtgttttccttaaagtgaacaaggcaacaatgaacatgcttcatctgggcgaaccttatgtgacttactgataccctaatcttaagagtgtgaggggaatgattttacaaaagacgctttgggaaagttgacaaacagagaactgcttt

SEQ ID NO: 12180 - DNA, 432 bp, Gossypium hirsutum
  Clone ID: uC-gsflmaxxa028e09b1
ttctttaaaaaaaaaaaaaaaaaaaccacccaaacagacaatagactaggacaggaggatctctcagggtttaggtgatggcttcgaagcggatcttgaaggagctcaaggatctccagaaagatcctcctacctcttgcagcgcaggccctgttgctgaagacatgtttcattggcaagcaactattatgggtcctcctgacagtccatatgctggtggagtgtttctagtcaccattcatttccctccggactatccatttaaaccaccaaaggttgcattcaggacaaaggtctttcacccaaatattaacagcaacggtagcatttgccttgatattttgaaggagcagtggagccctgccctcaccatatccaaggtattgctatctatctgctcactcttgacggatcccaattctgatgacccat

SEQ ID NO: 12181 - DNA, 527 bp, Gossypium hirsutum
  Clone ID: uC-gsflmaxxa028e11b1
tctttacgcgtggggtagtttttcacgaaaataaaaagtgatcccgtcggtgaaacagagttaatctcagagttgaaaaatgcaagatgaataaaataggtaatcgttattcagctttcatgtgcaacgaaatgaagaaacaagattatccaaagaatcttcaaagtcgaaatgatgcagtaggaggtgatctttggacagatggacttatttgtgcttttgaatatgttaaaggccaaggtaaaagaggtcagccaaaatcaggtgcaaaggtcttgtctgcacaatatagtttgaaagaagcttctagaagacggatctatgctaatgaacccgaaaatgttaatttctaacaatttagctaaatcttcacccttgaaagactccgtagtcacagttaaagatgcattatatgtaacccaagatctcaatcccggggaagagtttccaagagcttattgtgaaccaattggttgtacagagtttatcaactagtccagatgctacaagctgatgatggatggggc

SEQ ID NO: 12182 - DNA, 430 bp, Gossypium hirsutum
  Clone ID: uC-gsflmaxxa028e12b1
tcttttattctccccgcaactaaaagcacgatcccatcttttccttacagagcagcaccctttgtttctctctcacgttgttcttagtgattgtgtgaatgtgcgactgagtgtatatataccattgctgcttttgtcgattcccgaacaccactcgcctgattcaaccgcagtccaatatcccgtgtattacgccccccttgtcaaaagcaaaaaaggaaaaaaagaaattcgtgttgttgggttcgatccttttgcctttgataaattgtgaaagactgagagaaaaaggaaaatgtcgatctctgtgtaacggctacttttggcggtgttgttgaagaagtaaagactgagaaaaaaagggggaaataaaaggtgtggtttggatcagttttgaaaggtaagctgaggaaatggattacaacaatga

SEQ ID NO: 12183 - DNA, 420 bp, Gossypium hirsutum
  Clone ID: uC-gsflmaxxa028f03b1
taagaaatccctagaagcttaaagaaaggggggaaagatgaggccgatgccgatggaattcgtgacggacccagacgaccaaggttcagccatggaagtcgacgatgttgacacaccggagatcttcggcgaaggcgtcatcgcttccgacaacaagctcgccgatgccgatttcttcaacaacttcgaagacgattttgatgactccgatatcaactaaaaaaacaaagaagaatcgtttcaagtactcatctatcttttttttccctttttactttcgctttttagggtctgaaatttcttaaaactttgttcaatttagtttaatctgaactgcactatggatgcttatctgtatgcaaatcaaaatagtgtagtttataagtttaaatcgttttaaataaatataattttcctttt

SEQ ID NO: 12184 - DNA, 557 bp, Gossypium hirsutum
  Clone ID: uC-gsflmaxxa028f08b1
tcgtttcaacaacaaaaaaaaaaagaacatggctaagaagaagcatgttttgaaggaagacgatgaacatgatggttccaacactaaaaaacaagtttgtcgagctgatttccctccccactttgtcttcggagtttctacctcttcctatcagattgaaggaggtgtgaacgaaggtggcagaggtaaaagcatatgggatgctttctctcacattgaaggaaaaatcgttgatggaagcaatgctgatgttgcagtggatcattacaacaggtacaaggaagatatagagcttatatccgagttagggttcaaagcttacagattttccatattatggtctcgtattttccagaaggtttgggaaaccaaagttaatgaggaaggaattgcattttacaacaatgtgatcgatgccctttttgaaagggtattgagccctttgtgacattataccattgggattcttccttgcatctccatgagtaaatagagggtggataaacaagcaaattggggactactttgcaaaattgcaaatacttgcttgaacattt

SEQ ID NO: 12185 - DNA, 522 bp, Gossypium hirsutum
  unsure (1)..(522): unsure at all n locations
  Clone ID: uC-gsflmaxxa028g02b1
ttaattcgcagagaatttttaggttttgtcactctcacccctttcttcaaccctcttccattacagtcctactatatatatacacatatatatatataataggagctgaataggagcagccaaaagggtcttttgttcaacaccattgttgagctgagagaaaaacagagaaaaattagagaattctctctatatatacatatacatatagagagagacagttcaaacttcaaagatctagtagattggtaataaaaaaagaatgttgggacaaaagcaaagtgaagaagcaatagtgtcgaattataacgaaagtgaacatcatgttgagaatagagatgaagagaaagaagaagaaaaccagccattgtttaatgttaagaatctactttggcatggtggatctgcctgggatgcttggttcagctgtgcttctaatcaagtagcacaagtgttgttgactctaccatattcattttctcaatggngcatgctatctgggattctgctacaagttttcta

SEQ ID NO: 12186 - DNA, 546 bp, Gossypium hirsutum
  unsure (1)..(546): unsure at all n locations
  Clone ID: uC-gsflmaxxa028g04b1
atttctctttttcctttcactcgctgaactgagaaaggaaaggagaaatggagatggcaattagcttccataactcttccttcaaatctcctttcattaactctagctctaaccctaagcctaaatttctatttcccacgcagctttccggtctcatctcttctccactttcttccttcaactccaaaaggacatgtctcaaatttggttctaggactttcactaaaccggtcaagtgctctgtttctcaggcggctcaacctgcaatcgagaagaggagtcagttaaagaggcgaagcgatataaggaacatagcaatcgtggcgcatgttgaccatggaaagactactttggtggatgcaatgttgaaacagtcaaaggtttttcgggacaatcaattcgtacaagagagggtaatggactcaaatgatcttgaacgggaaaggggtattacaattcttagcanaaatacatctatcacatataagggcacanaaattaatataatagatactcctggacattctgactttggaggtgaagttg

SEQ ID NO: 12187 - DNA, 563 bp, Gossypium hirsutum
  unsure (1)..(563): unsure at all n locations
  Clone ID: uC-gsflmaxxa028h05b1
gtgaaaccttgggaatctcctccaatctctaccgtaaagcttgtaaaaagctttggaaaaccagaatcagcattggaaatcctccggccctgaaaatggaccccaacctgaaaagctacccgctcctctcctatgttttgtcccgccttccttccatctcatccaggctccagtcctcaccctcctctgatacccccttcgacctcgaacaaccaccgcctatcgacgccgcctcttcctccactgctccgccaccaatagtcgaccagatgccccacctttcccatcccaaagtcctcgcttccatgacccatgccatctacgacgtcgcccaaacccgctctgtcctccaaaccctcggcccccgacccgaccacgagtccgtcgacatggctcaccacaagctcgccgagatcgattccaacctctccaaatccctggaagaactcgtcctctctcctcgaccngagggtgtggatcaaagccgatggcgtgccaacttggccgacaagagcacagattcgacaacagctgagcaggaaaatctatgtacagtcgatact

SEQ ID NO: 12188 - DNA, 533 bp, Gossypium hirsutum
  unsure (1)..(533): unsure at all n locations
  Clone ID: uC-gsflmaxxa028h06b1
gtgatttgctctttttatttccgaaattttcgttttccaatttttcatcaccaaatcgtcagcaaccccccattagccttctattttctcaaatcaaatttggtttcccaattctctttttaccttaaagtcttcaccttttgtttttgttctgctgaactcagtaagccgccatggctacgacgactcagtctccttctcctcccaattccaacgacgataagccccaaccaagctcagaggtggtagaacaagctaatggggttcaacaagatgttaggccagaagctactaaacagaacgttccagcatctgtgtttgtgaactctgaaccaataagagaagaccaagtttccaatgctgttaaattcctttcacatcccaaagttaggggttcacctgttatttatagaagatcctttcttgaaaggaaaggccttacaaaggaggagattgatgaagcttttcgcgtgtgcctgatccancctctagttcacagccagctagttcgaatcagattgacagtcattact

SEQ ID NO: 12189 - DNA, 446 bp, Gossypium hirsutum
  Clone ID: uC-gsflmaxxa028h10b1
tcgttccctttctctgtagtttttttttttatacctcctctctctctctctctctctatctctctccccaaatccctcccaccctagacccccggcgagaattcttgaagggaatccccggctccgccacccgcggtagatgctactctttccaccacccccaccactactggagccgcagccgttccctgtgccgcctaagccgactccatagactgttcccctcgctcccgcaacacggacacatgggacgaccctgctctccccactacactccacccaaagctacgcctcatgtgcagcaatggtggcaccaaagtccctggcccccatgacaaaaacttatgtaacgccagcggtgacactcgtatggccgttgatgaccgccacacttccctcatttacgtacaccaacggctctacctttcttttctccgggggtgccc

SEQ ID NO: 12190 - DNA, 581 bp, Gossypium hirsutum
  Clone ID: uC-gsflmaxxa038a02b1
aatatcttccttctccccttctctccatccccttcactcaatacttcaatctttcccccatgccagatttatatatgtatagagaaatatgagcttcttgttgaagatcattaacatcagcatcagcaccaccccatagcatattgcactgttccatgcattgtcatcaagcatgacatgcaaccatgcatatgttttggcatccatgtgtatatcatgtatgtgcctggctccctgtatgccatccgcagaacctatcgaacaacgatggcatctgtgaatggcgtatgaggagtcaagcatatatttctattttctacatatatatctccatcagtatacctcttttgcaggctttactgttttaatctttttgctttccaattaaactgaagggcttcaaggtacttcattttcctcatcctcatcttcatcttcttctttaatcttaatatctggtattagggttggtttcttcttctttgatatgacctggtttcctttctgcagagagacactaatttcttaagcttctgcagtctgcagatatttgaattggattcctttctgttttattaatt

SEQ ID NO: 12191 - DNA, 498 bp, Gossypium hirsutum
  Clone ID: uC-gsflmaxxa038a05b1
gatttattcatgttttgcaacagttgttggtcagaagatagtataaaatcaaaacagatgcaaaacttgagtgaggaggctcatgtatatgattgttatagctctcaggaattttccaatgatgaagactacaaggaagagcaaaggaggaggaagataggactggcaaataaagggagggttccatggaacaaaggccggaagcatagtgctggcagagacacgtttacgaatcaaacaaagaacaatagaagccttgaatgatccccaggttaggaagaagatggctgaacatccccgcactcatagtgaggaaagcaaggcaagaattgggtcttcagacgaagtatacgctttaagtcaacatatatgtatgtctgctcacaaagcacgaagaattattgatcagattcgtggacgttcctacgaagaaacacttatgatactagaactcatgccctatcgagcatgttttcccattttaaaaattggttattc

SEQ ID NO: 12192 - DNA, 422 bp, Gossypium hirsutum
  Clone ID: uC-gsflmaxxa038a06b1
cttcattactctctcttcaaaatgcctcctacatatttgcctcttcgttgggaaagcactggggatcaatggtggtatgcatctcccatagattgggcggcagctaatggccactatgatttggtccgagagcttcttaggatagatggcaatcacctcatcaagctgacctctttgaggaggatccgccgccttgaaacggtatgggatgatgaggaacaatttgatgacgttgctaaatgtcgttcccaagttgctaggaaactttttcttgaatgtgaatcaaagaaatcaaagaattcccttatcagagctggctatggtggatggcttatatacacggctgcctcagcaggagacttgggttttgttcaacaactgcttcaaagaaacccactactggttttttgaagaaagggagt

SEQ ID NO: 12193 - DNA, 187 bp, Gossypium hirsutum
  Clone ID: uC-gsflmaxxa038a10b1
tggacgcgtgggcttgttttgtgattaatggggtgaagatttggaatatagacggatatttttggagttttgtgaagagatcaatgatgagtgagaagaccggcatggaatggaagagttgctctacaaagcggagaatgttgagcttgttagctgttttgaatccctttatgagcctctgattaca

SEQ ID NO: 12194 - DNA, 592 bp, Gossypium hirsutum
  unsure (1)..(592): unsure at all n locations
  Clone ID: uC-gsflmaxxa038a12b1
tctgattctgccccttgtattattctgcataaacagtttacgagtgacttttggaatgaactccccctttaaaatagtacaattgattcaattactaatgttgatcatcttactgtccttttatcagatcggattggccatgtctcctctgagcaataattcccttttcctggactatcatcgcaacccatttccttcattctttcagcgtgggctaaatgtttctctttcatctgatgatcctttacaaattcatttgacgaaggaagctcttgtagaagagtacagtgttgcagcacaggtttgttacttgcttttgacagtactatatctataatactgtggaaaaccaaatggccagntctctctctctctgtatatatttatatatatccttttccaatattcctgaaaatgtggaacgaaaaaaaaaaattcatccaactgttcccccacacagtctaaaggaactagtaaattaaaagacacatggtaggtgcttaaccataatgcttgatgtctgtcatcatcttaaatcggtactttgcaggtttggaagctcagtgcttgtgacttatgtgagattgctaga

SEQ ID NO: 12195 - DNA, 412 bp, Gossypium hirsutum
  Clone ID: uC-gsflmaxxa038b01b1
ctttttctttcactgacttgtgatgaaggatttggggccggacacatgcatgacacatatacaaagggaattcgggtttggggaaccccgctcgaagtggatattgatggagtaagaacttatgttttctaccttgacaccgagggttttgaaagtgttgggaagtcaaatgtatacgacgataggattattgcattggcaactgttatgagctctgtactaatttacaagctgcctgagacgactcgtgaagctgacatatctcggctgtcatttgctgccgagcttgctgaagaattttatggaagagtgaaggggcaagacattggtcttgaacctggagaacttttgtggcttatccagcgtgatttcctgcaaggaaaatcagtgaaagatatggtggatgatgcac

SEQ ID NO: 12196 - DNA, 512 bp, Gossypium hirsutum
  Clone ID: uC-gsflmaxxa038b07b1
cttactcgtccgcccacgcgtccgcggacgcgtgggaaaaaattagaaaaaaaaaagaacaaaatccccaagcagcagcagccaaaaacgggggcaaattgaagaatgggtgttgattattacaagattcttcaggtcgaccgcaatgcaaaagatgaagatttgaagaaagcgtatcgtaaactagccatgaagtggcatcctgataagaaccctaacaacaagaaagatgctgaagcgaaatttaagcaaatctctgaagcttatgatgttctgagtgatccccaaaaacgggcggtttatgatcaatacggagaagaagggttaaaaggccagatgccgcctccaggggcgggagggtttggaggcggtgacagtggtggtccaacgacgttccggttcaatactcgcaaccctgacgatattttctcggagttttttgggttttcgagtccgtctgggatgggtgatatgggggccacgtgcaggggcgtctgggttcccttgggaat

SEQ ID NO: 12197 - DNA, 582 bp, Gossypium hirsutum
  Clone ID: uC-gsflmaxxa038b10b1
gtctcatgtttactcctggatcaacaaatacgggagcacttttcttagttggaatggaattcgagctcaactgcaaattacagacccagatctggtcaaagaggtccttaaaaacagtgacaaagcttttcgaaagccaaagacttcatatttcttcgtcaagctaataggcgatgggcttgcttcaaccgaacgtgagaaatgggcaaggcaaaggaaactggccaattatgcctttcatggggagagcttaaaaaatatgactccagcagtagttgctagcgttgaaaccatgcttgagaaatggaaaagtaaggagggcaaagagatagaagtgttccaagagttcagattattgacttcagaagtgatatccagaaccgcctttggtagcagttacttggaaggggagaagatttttgacatgctgatgaagttgacagtaattgcgggcagatatattttaaaagcaaagattcccatcatcagcaagttttggaaatctgctgatgaaattgaatcagaaagaattgccaaatgatacatgattctgtgatgagattgtaaaaaaaggaagagaga

SEQ ID NO: 12198 - DNA, 411 bp, Gossypium hirsutum
  Clone ID: uC-gsflmaxxa038c06b1
ccctctcgtccgaaaaaataaaaatttcatcctttattgcttcttctcagctttgtgtctgcataacattagggtttctttcttttttctttattttttccccctctatttggatcttcattatttcaacgacacatttcagggtttcttcattcctccgtttccatctgtttcctccttttcctttatcctttcttttttcattcttcattcttttcttccatccctcctctcctcttatccttattttccccttttcccttctttacttccctttatcttaaatcttttcttacttctctctttcctttactccctctttcctttcttcctcttccctctctttttctcttctttcttctattctccttcctcttcttttcctctttctttcctttcctcctttttttc

SEQ ID NO: 12199 - DNA, 211 bp, Gossypium hirsutum
  Clone ID: uC-gsflmaxxa038c08b1
ctgaggtaaatagttaagcaagctaaagaaatggcaaaagttcaacagatcactcttgtttccttggcgatctgcctttcaaccctcctcggcttcgctgccgccgccaaccctgaagagaagttcatcgttgaaggccgagttcactgcgacacttgccgcgttgaattttagaccaaattcagtttaacctcttctaggctgctattag

SEQ ID NO: 12200 - DNA, 490 bp, Gossypium hirsutum
  Clone ID: uC-gsflmaxxa038c10b1
ttcaagtctcaagatggactccagctctggagaagagtcagatcttagtgagtctgagatcaatgaatacaaagaaaagccatatgaagagattaggtctgggaagtacaaagtaaaggccttaaatggtagcttaagatgccccttttgtgctgggaagaagaaacaagactacaagtacaaggatctgcttcaacatgcttctggggtgggtaaaggatctgccaacagaagtgcaaaacagagagcaaaccacctggccttggcaaaatatttggaaattgacctagccagtgaagcagatgagacctcccgaccaactgtaccacaagctgtggacgagactccagagcaaactgagctttatgtctggccatggatgggaataattatgaacattgttgctgagtcgaagaatatagacacattgcatgatatagggtactggttgaagaggtttgctaaatataaacctattaatgttcaatgt

SEQ ID NO: 12201 - DNA, 124 bp, Gossypium hirsutum
  Clone ID: uC-gsflmaxxa038d07b1
cctcaaaagaaagccgtctcacatcaacatccgggccacattaatactattataggcgtatcctagctctccttgactccgccatcacccaaaatgctcacccaagatttctatacatatgcca

SEQ ID NO: 12202 - DNA, 568 bp, Gossypium hirsutum
  Clone ID: uC-gsflmaxxa038d09b1
tttctcgtgggcggacgcgtgggcggacgcgtgggacctgatcaacctcagccaaggatggctttcacaggagatgctctgttgataaggggatgtgggaggacagattttcagatttacattaccgaaagagacattgctatatccagctcatgactacaaaggattctcagtaaccactgtgggagaggagatgctatataatccacgcttgacaaaggataaggagactttcaaaaacatcatggaaaatcttaacttggcatatcctaagatgattgatgttgcagtgccagcaaatatggtttgtgggttgcaagatttggaacctaaagccaactgaggctttgctggatcatccataagtgtgcacagattttagttgtattataattctggatcttaatatcactggatatgctaaataaaatggctagagaagccacgtgattgcaaggaatccataaattatatatatactatatcatattggaatcatgtaaatatggtcgcttctatctgcatagaaataatccttacgtgtatcatgctaaataacatcgaaact

SEQ ID NO: 12203 - DNA, 534 bp, Gossypium hirsutum
  Clone ID: uC-gsflmaxxa038d10b1
cccacgcgtccgggagaattgcgtgttggtgtacgacgtgcaatgaggcaggagggcaatgttccttcatcagtaatatcaagtcacagcatgcatcttggtgtgcttgcaacagcatggcatgccttcacaacaaaaaccattttcacggtgtattacaaacctaggacaagtccggctgagtttattgttccatttggtcagtacatggagtcattaaagaataattactcaataggtatgaggtttaaaatgaggtttgaaggggaagaagctcctgaacagaggtttactggaacagtagtcgggattgaggatgctgatcccaaaaggtggcaggattccaagtggagatgtctcaaagtgcgatgggatgagacgtcttccatacctcgtccggagagagtttctccttggaaaattgaacctcctttagctcctcctgccttaaatcccctaccaatgcccatgaccaaaaggcctcgatcccatgcagtaccttcattccctgattcctctgtgctgactagggag

SEQ ID NO: 12204 - DNA, 498 bp, Gossypium hirsutum
  unsure (1)..(498): unsure at all n locations
  Clone ID: uC-gsflmaxxa038e10b1
acgtatgtaatgcatcagaagaaatcggaagttcagatcggaaaagaaagcagcggcgtctcctccggttttaatcccaaaccttccaccgttcaccaccaccaccaccaccaccaccagcatttcaattaccaccaccgtttacaacagctttccgatacaacagcgccggcgggtaccgggacgtctccggtttacgttttccctcagataattactcagagctcgtctggaaatgatgcgattccatctcctccgtcttcatcttccacttctccgaacccttacaagagaccccttttgacccaaacgccgtctctcaccaaatcccctactttgtaccgtttcacccctcccccgcagttcaattcccggaatacggcgtcgttcttttccttctccgtcgctgctaaatcatccttttatcgaatcctccaccgtttcaagcacctgcgtcgtcttcgagtttacctacgcttaatcctncttttatctctc

SEQ ID NO: 12205 - DNA, 550 bp, Gossypium hirsutum
  Clone ID: uC-gsflmaxxa038e12b1
ttttatctcgaaaaccccatctgagatagaacaaaagaaaaggaaaaaagaaatgtcgccgccagcagcagcagcgggcggaggaggaggacagcctcagcggcagcagcaacaaggtggattcggacagagcataaccggaatcataaggatcgccgtcttctggtacttcgcttccaaattcttctctcccaaaaagcccgtcgatccttctaacctcatctccaatctcttccagaagggcgaacccctggatatgtggttgtatctttctgagcaccaaaggttcaatgactttgggaacgaagcttctcttgtttggcatgaaactaatataccttatgccacttggggtcctgaaagcactcgtactctttctttagactaccatccttccgataccttgaaaaacaatggcagtctttatgctcatgttttctttgctcgctcgggttaccctccagatccaaatgacccttgataccagcctcaagctgcctttgtgaggactcaccctgtggtgaaatatttgcccaagtcaagatcagat

SEQ ID NO: 12206 - DNA, 502 bp, Gossypium hirsutum
  Clone ID: uC-gsflmaxxa038f04b1
ccctctcgtccgccccaattctctaatttctcctaatccctaaatttcccccaaaagaatcagcagacacggtgaagactcattgtcgaggtaacatacatctgacgcttttctcgtttgcttcgtcggagtataaaatttcagctgcttcggatcattccaagatctgtacggccgagaaccaaaagaagaaagatgatgaggatctgcagttgcagtcttccttcattaactaaaaatttctaaagggtagcagctccagcataggtgcaatgagggttaaaaatgcatgtatcgcattttggagtttcaacgacgctaaaaaccgcgaagggtgtttgaggtgtttgcaacagctctctcatgaatactccctactgaagaacatgcttcaaaccttattccagctggagcaacaaatagttgcagctggtggatcgattccaagagtgcattaaatcacatttcgtatcgtcttcttgtagaataaaaattgtcaaac

SEQ ID NO: 12207 - DNA, 521 bp, Gossypium hirsutum
  Clone ID: uC-gsflmaxxa038f07b1
cccacgcgtccgcccacgcgtccgcccacgcgtgcgataatatttgcacatactatcagaaaggaatctgttcttatggtagtcaatgcagatatgaacatgtgaaggcatctcaaacggatttatctgcttcgtcttcatcgacaaagcctcgtcaatttggggtctcgggttctgctcctttaggtccttcaacgagtacatattgtggttccgttgtacttccagctacttctggcgagtttcctggttctaatggaggcttcctccctccctcaacgaatcaagcatggcatttggaatccgggcaacaagatcttttggatgatggtgatgttttgcagcctaagagtgctaatctagtcgaacttcctatttgctcatttgctgcagctggtaattgcccccgtggagataattgtccccatattcatggagacttgtgtcccacctgtggaaaacattgtttacatcctttcagagctgaggaaagggaggagcatgtaaaaatgtgcgagaaa

SEQ ID NO: 12208 - DNA, 555 bp, Gossypium hirsutum
  unsure (1)..(555): unsure at all n locations
  Clone ID: uC-gsflmaxxa038f11b1
tgtagaagcttgggcggagtaaaaatgagaatattgtggcgcagtctcaaaatgcatctggactggttggtttattggaaacgatgcgtgtccagatggagatttctgaggcaatggacattaggacaagacaaggattgcttaatgccctttctgggaaagttggaaaaaggatggacacactactgattcccctggaattattgtgttgtatttcacgaacagaattttctgacaagaaagcatatataaggtggcaaaaaaggcagttgaacatgttggcagagggtcttgttaatcaccccgctgttggatttggggaatctggacgcaaaaccagtgagtttaggattcttttggcaaaggttgaggaatctgaggcttttccaccttctactggtgaagtccaaaggacagaaagtttgaaatctctaagagatattgcccttcctcttgctgagagggccgcccgaggtgacttaactggagaagtatgccactgggcagatggttatcatctgaatgtcngaccttatgagaaattgcttgtcagcg

SEQ ID NO: 12209 - DNA, 478 bp, Gossypium hirsutum
  Clone ID: uC-gsflmaxxa038f12b1
atatacccatattggtgcttcccccatcttgctttctctcaacaatatcaactgaattatcggccgacaggtatttctcccaatacccaattcttcggagcatccggaaagcccagaaataagttgtttccggcttcctcctatttagtcaaatttgtaaagggaaagggtggacagtaaagatgccaatggcggcgggggcagcgacgccgagggaaagggttcaagctatggggccagcagcggtggtaccgatgatgcaagctgtgccggctgttgctgatgttttggccaaggacacgatcatttcttggttccgaggggaattcgcggcggccaatgccatcatcgatgctctttgcggtcatttggcgcagcttcaaggagggggcggtgaaagatccgagtacgaggcggtgttcgcggcgatccacaggaggcgcttgaattggattcctgtgttgcagatgcagaagta

SEQ ID NO: 12210 - DNA, 510 bp, Gossypium hirsutum
  Clone ID: uC-gsflmaxxa038g04b1
tttctcgtccgaatcatggtaagtctcaaatcacttgtatctctcagttcccgatccgctgccgtagcactacttgttttggtggtttcagtggcagtgcagacccatactacaaatgcacaaagctgcccgaccgagctgacgagcctgaacgtgtgcgcacctttcgtggtgcccggtgcagctgtggctaaccctagcattgactgctgtaacgcactccaatcggtgcaccatgattgcctttgcagcactctaaggatcgcttctcgactcccttctcaatgcaatctcccaccactcacttgtgcttgaaagaaaagcagtggtgctgcatgcttaattgggtaggaaaatctaataacgccatggaatatggataccgccctgtttttttctttcctttttaatgggtaataagcaatggtggtggtaaaatggaaactaattagagccgcagttcttttattttatattcacatattattatatttcttattactattttta

SEQ ID NO: 12211 - DNA, 488 bp, Gossypium hirsutum
  unsure (1)..(488): unsure at all n locations
  Clone ID: uC-gsflmaxxa038h02b1
tttttctttgccttttgtttttagatctcccaactgcttatacccttaagtgtcccaacggtcgcttttccatcgatcttcccacactttccctttttgattagtattcaatcccctgcacattccaaaccatcaaccgcctctctccctcctaccatgtcccaaaatcacttccttcctctctttctctatctcattttcgtgtcgctgccgcgttctttggcccagcacggcggcggaacggtggtcacggagctttggtgtgtcgcaaagaacaacgccgaggacgcggcgctgcagggagcgctggactgggcttgcggtcctggcggaacggactgcagccggatccagcaaggcggaccctgttacgacccctctgatgtccagaaaacggcgtcttatgccttcaatgactactactngaagcacggcatgactgacgatgcttgctccttctncacaatgctgctctcactctttagacc

SEQ ID NO: 12212 - DNA, 421 bp, Gossypium hirsutum
  Clone ID: uC-gsflmaxxa038h11b1
ttctcttcaccaccatctcttactacaatggcgtttactttcatcttctgtttcattcctccattcttattcatttttctattccattctcttcttcttcatttcttcaaacccaatcgccccaaattacctctccctcctggaactatgggttggccttacatcggtgaaacctttcacctttactcccagaaccccaatgtcttctttgcttccaagcagaaaaggtatggctccatattcaagacccacatactaggttgtccatgcgtgatgatttccagccctgatgctgcgaaattcgtgctcgttaccaaatctcatcttttcaagccaacattccctgcaagtaaagagaggatgttaggcaaacaagccatcttctttaaccagggaccctaccatgccaagttgaggaagc

SEQ ID NO: 12213 - DNA, 449 bp, Gossypium hirsutum
  Clone ID: uC-gsflmaxxa039a02b1
gttttataagagaaagaaatggcaaaagcttctgtgatctcccttgtttccttatttatttgcattttctcctcacccagctttgcctatgcttcagcttcagctccaggtccatctccatcatccaatcaacaaatgagattcgaggtcttaggtcatgtttattgtgacacttgtcgtgttgaatttgagacatctatcagtgaacctattcccggtgcaacagtgaagttagaatgtaggaatcgtacagacgaaaagatcacttatcaaagtccagaaataacggctggcgataaaggaaattataaaatccaagtgacgggtgattatgaagaatcagattgtgatgttctgctagtgaagagtcccagagcagattgcaatgaccccaccgaagagtggaggaaagccagggtggttctcaccccattggatggggttcttgg

SEQ ID NO: 12214 - DNA, 496 bp, Gossypium hirsutum
  unsure (1)..(496): unsure at all n locations
  Clone ID: uC-gsflmaxxa039a07b1
aaaaaacagagagctaacttgctctgttttctctcatcatctttctttctcccccttaattctcacttcatatatactttatatcaacgatgtcggtaaaagagtgcggcaatcacgggaagtaccgccggaaaatcttccgtcgaatcatcgccggcatcctaattttcattctaatcgtgctgataacaattcttctcatatgggccatcctccgtcccagcaaacccaggttcatcctccaagacaccactgtctacgctttcaacgcctccacccctaacctcctcacctccaatttccaagtcactctatcttctcgaaaccccaacgacagaatcggcatttactacgaccggctcgacgtttacgccacctaccagaaccaacaaatcaccctccgaacagccatccctccaacgtaccagggtcacaaagagatcaacgttnggtcacccttcgtcaatgggaattcagtgcctatcgcaccggaata

SEQ ID NO: 12215 - DNA, 218 bp, Gossypium hirsutum
  Clone ID: uC-gsflmaxxa039a12b1
tttgttcgcgtgggtggagcgcttggtcggtggattatggaaagaaatcaaagctcgggttcaccatctatccttctcctcaggtctcaactgcagttgtgggagccttacaatagtgttctgtccactcatttccctccttgagcacacagatgtggccgtgctcttggacaatgaaagcaatttacgacatatgccgggagatccctcgatatcga

SEQ ID NO: 12216 - DNA, 338 bp, Gossypium hirsutum
  Clone ID: uC-gsflmaxxa039b05b1
ccctaattcctgtttcccttcttccacaaatccctaaccccttgcccgactgccctcctaccttttttctcaacctccacctccggtcctccacggctccactcatttccagaattagagtgtttccatttcgaagtgaatcatggcgaggaagatgttagttgatgaggaaatgaaccaaacgaatcaagaggaggcttattatgatttcgacttgtttgttatcggtgccgggagcggtggcgttcgtgctgccagattctccgctaactatggagctaaggttgagatctgtgagctcccatttcatccaatcagctcagaagtcattggaagag

SEQ ID NO: 12217 - DNA, 402 bp, Gossypium hirsutum
  Clone ID: uC-gsflmaxxa039b06b1
tatatagcatatttcgaagtgttagcgttaaaacaacatggtgcgttatgcccagaacatgttcctgaagtttatcactttgaccgtaccatgtccttgattggaatgcggtatttagagccgccccatataatcctgagaaaagggttaattgctgggattgaatatcctttgttggcggaacatatgtcagaatacatggccaagactcttttctgcacatctctcctatatcggtcaaccacagagcacaaacgtgctgtggccgaattttgtgggaatgtggaactatgcaggctcactgagcaggttgttttttctgacccctataaaagatctgaatataacccgtggacttcaccttatcttgaccgtgatgcggagactgtccgggaggataat

SEQ ID NO: 12218 - DNA, 459 bp, Gossypium hirsutum
  Clone ID: uC-gsflmaxxa039b07b1
ccgtccggtcttactatctgatggtctatctggtcactgggtgagaataccgaagtgctaatccatggagccaaacattctcatagaactgagactcatggattcggttgctagtgaagctgttcgttcatgacctatggatgatgctctgcttagacgaatgaccaaactgggtcattcagtgtatgctgaaactgcacagaggaccatcttttatggaggacaagagagtgcgatcaacccatatctcctcgacaaagctaaggggagcatgcttttagctggcataggcagttctcaaaacaatagcttgaaccccaatactgcccacatcaatgccccctttacttctaccatagcaacaagtccgattgagtccggtttggggctgctcctacccctaatttcagcaccacggtaactcaagaatgcatacgatctgctcagcgacccattccc

SEQ ID NO: 12219 - DNA, 466 bp, Gossypium hirsutum
  unsure (1)..(466): unsure at all n locations
  Clone ID: uC-gsflmaxxa039b08b1
tttacgcgtccgcccacgcgtccgaagaaatttcatgtacatttctttatttttctcagatttttctcactctctgcctcctttttctctccaatgttagttgaatcgatccaggaggaaaaaccattcttatcagggatggtggatggaagcaccaatttgccagtcaacctttcttgctttgagctgattaaaccaagcttggatgagaccaaccagcattgttctcttgatgtcttgcctattctactagaggaaacttcattttcagcaagagaaaaatgcagcttaaacacttcacaaggccaggatgtctatagcatttctgtcttgcctgaggaaggaaacatgaatccaaaatgcacaccacagttaacttttttgagcctcttaagagttccttttttatcaaaaaaccagatgtgcttggatgagncattgagttgccagaactgcatcgatttga

SEQ ID NO: 12220 - DNA, 350 bp, Gossypium hirsutum
  Clone ID: uC-gsflmaxxa039c01b1
ctgatacgcctccaggtaccgccccggcagtatttcctggacccacgacgccggttctagacaatggagatgaagcatttaaccctccttctcagcctcttatccttctctgcgtataccgcttcccctttagtagctttagctccatctccttccgatggtcacggccccacctgacaaagaagaccatgctctcgaacccgtgattgctaggcgtgtcaagttgaaccctaagcttaccgagatccgtcacgagcttgatatcccaaccgcttgcgaggctgtagatggtgcctaaatagaagaggcggatgctgcatgtccccttctttagggggaagttgctacaa

SEQ ID NO: 12221 - DNA, 71 bp, Gossypium hirsutum
  Clone ID: uC-gsflmaxxa039c04b1
tcgtgattctctgactaacctctttctttactgagttcgttgtaccggtttaactcggatcgccaaaacca

SEQ ID NO: 12222 - DNA, 444 bp, Gossypium hirsutum
  unsure (1)..(444): unsure at all n locations
  Clone ID: uC-gsflmaxxa039c06b1
gtacccggtcccgaatccccgtgccgccccccccgcccganttaaacctgctccaagcctaattattttttgggggaaattgggattttntttcgcgacccatgcactccgtntttctagaccccatcccccgccccaactcaccctccctcccccataccccttctccctaccccccttctccccccccccctcctcacccccctcccacctttccccctccccacactctcccccccccccccccacctcccctccccccccccccccccactcctcccccacccccctctcatccccccccctccccccccccccctctaccccccctccctcccccccccctcccccttccccacctcctccccccttccacccactaccccctcccccactcgcccctctccatccccccccaccccccaacatcccttcccccccccc

SEQ ID NO: 12223 - DNA, 323 bp, Gossypium hirsutum
  Clone ID: uC-gsflmaxxa039c11b1
tctacgcatcgtctataaattataaaccactaacatttcagaccgtttcttgttccaaattagggtttgatattacaaattttgcgagaggaaaagcatttcatcgtcagccaaaaaaagggaattttagtcttcaggggaacgatcgaacgatgtcgtacctactaccacacctgcactcaggatgggccgtagatcaggccatcttggcagaggaagagcgtttcgtcgtcatccgattcggtcacgactgggacgaaacttgcatgcagatggatgaggtgcttgcttttgttgctgaaacaataaagaacctttgctgt

SEQ ID NO: 12224 - DNA, 240 bp, Gossypium hirsutum
  Clone ID: uC-gsflmaxxa039d01b1
acgacgaacaagggggactttttacaacgaattcaggtgtgccacccccaccctcggcggggacgccgtctactactccgacactccctcaacggagtatgatactctcggcacttctgctaaagcagccctcgatcaaacgcgacggtcctaaatctagcttgttcgtctagcaacggcgaagaaggccaaaaacgagcgatggcttccatccgtaccaggaaactatgaaggcaagga

SEQ ID NO: 12225 - DNA, 421 bp, Gossypium hirsutum
  Clone ID: uC-gsflmaxxa039d07b1
taaaattggggccaaaaaatacgaagaaagatgacgatgtttcacttcttcaactgtgcgatcctcactttcggtcctcacgccgtctactactccgccactcccttatcggagtatgatactcttggtacttctgttaaagctgcccttgtttatcttggaacagctttggtaaagcttgtttgtctcgcaacgcttttgaaggtttccgagaatgatggcttcgatccgtaccaggaacttttgaaggcagggattggttgtatagatgttgctggactttattttgccttaacacagtcgactcataggaacatctctcaaaatcataaatttcaagcggtcggactcggatgggcattcgctgagtcggttgtacatagattggcacctccttgggtgggagctagaggactacaat

SEQ ID NO: 12226 - DNA, 473 bp, Gossypium hirsutum
  Clone ID: uC-gsflmaxxa039e02b1
cttgtcgcgtggggtatatgtatatatgtattcgtatcttcttcaatctccaccccacttcctttttcttttcttctctttccattgaaaagaaaaatcttaagaaacagtgatggaaggtatttcagcgaccatgtacaagaatttgaaagggtactggcaaaggagaggatacatcaagctaaatggtacgaaaggaggaggacggcggctcaaggtggagcttgggtcgtcgcggcggaggcgattctggaagataagggtgaaagcgaagctgagattaccttcgcccaagaaggtctttgtttggctacgtgatgcgcacgtgaaaatgatgctggggttggctaactccgggatggctagcaccggctaccgaggagctattggggaccatcatgggatgcagccttgctgaagcgttcgttaggagtacgatgagaaaagatcgtcgagactataattcgtgtgat

SEQ ID NO: 12227 - DNA, 488 bp, Gossypium hirsutum
  Clone ID: uC-gsflmaxxa039e09b1
ttcttcaatattttcagtgacgcccaaatttattacaagatgccgaagaagatgggtgtaaacagcaaagccgaggcggcgcgtgcgcgcaagagcgccactgaagccgaacgaaaagatcgggaagcacgggagaaagaagagcagtactggcgcgaagccgagggtcctaaatctaaggccaccaagaaacgcgaggaagaagccgagaaacgagctgaagccgccgctcgcaaggctgaggcacgccgtcaagccgaaatggaggagaaagagatcgaaaaggcgttgaagaaaccggataagaaggccaaccgtgtggcgattccggtgccgaaggtgaccgaagcggagctacagaagaggaaggaggaggagcaagcggagatggcgaagaaagcggaggaggcgaaaaagagacagagtaggaccgcggccgagaggagtatgagaggatggtgttagtgacaaacatgaatagggatgat

SEQ ID NO: 12228 - DNA, 440 bp, Gossypium hirsutum
  Clone ID: uC-gsflmaxxa039f01b1
tcccggggggcgccccgcgcgcgtttttctcgtgcgagtgaagcattcaaggcgttttctgctgcgccgccgtccgttcgccgtggtttcgccgcaaccagtggccggaggctcgccggactgggttttttaaccgtcttcggagcacgactcgaaggcaaagtaagccctcaccttcctatttcctttttgtaaatttaaacaccaaatcggaaaaggaaaataactctaaaatatttaaaaaactaataaacaccttaaaaagaaaacgatgttgatttattctctattgagtttctttgcattttctttgtctctctatttctgtctctggttaagctcacaaatccccccccttttttatagatttttcaaggctctaaatagccgacaaaataaaaaatctaaacaatataaagaatcccacttgtttcccgtat

SEQ ID NO: 12229 - DNA, 349 bp, Gossypium hirsutum
  Clone ID: uC-gsflmaxxa039f05b1
agaaaagcataattatataaattatttaataaaatgttatcctattggttacatatttattcatccataataaattcaagggtattggtatttattttattgggtctacattggtaccaaacatatcaagcagtatgctggatttcccggacatgggtctgcaacctccttgccttcctattatcaatataattttgataaatttaagaagcaaaaccacaaagagccaaaagcatggcaattaccttcacaccattcattttgtcatggaaaactaccagtgcagcttgtggggtaacagccaaagaagtgctgattacattggagaagagagatgacacaacaaaaa

SEQ ID NO: 12230 - DNA, 270 bp, Gossypium hirsutum
  Clone ID: uC-gsflmaxxa039f07b1
tttttacgcgtgggcgcaagcgctctggtgtccttctttatggtcctccaggaacagggaaaactttgttggcaaaagctgtggcaactgagtgttccttaaatttccttagtgtaaaagggcctgaactaattaacatgtacataggagagtcagagaagaatgttcgagacattttccagaaggccagatcagcacggccatgtgtcatcttctttgatgaactccattcgtttgctcctgctcgaggtgttctggagaatcttgggg

SEQ ID NO: 12231 - DNA, 393 bp, Gossypium hirsutum
  Clone ID: uC-gsflmaxxa039g07b1
gcctctcgtttgctttctgcttctctactgcttaagaggtaagtatcatggacctccaaagagtttcccacttgttgggatgataccacagtttctcttcaacattcctcgactgcacgactggtttaccgacacactcgagatatgtcactgcacttttcttttcaaagggtttgctaagatgaacgtactggttacctgcgatccttccaacattcactacattatgagttccaactttaacaacttccccaaaggacctggattcaaacagatttttgacatcttgggagacgggattttcaatgtggatatggatttgtggagaaaacaaaggatagctgctcaagggttcatgaggcatcagctgttctacccgtttttgtcaaggac

SEQ ID NO: 12232 - DNA, 335 bp, Gossypium hirsutum
  Clone ID: uC-gsflmaxxa039g09b1
tttacgcgtccgtgagaagcaaacaaggcatatacttgataccattgttgaaactttatcaaaggatagtcgacggaagttcatatgggaagagatgtcttatttggaaaggtggtggagagatgcctcagatgataaaagggagtctttcacaaatttggtgaggaatggtcagttagaaatagtaggaggtggctgggtgatgaatgatgaggcaaattcacattactttgctataatcgagcagataactgagggaaatatgtggctgaatgacacgatcggttttattccaaagaattcttgggcaatagatccctttggttactcaccta

SEQ ID NO: 12233 - DNA, 424 bp, Gossypium hirsutum
  Clone ID: uC-gsflmaxxa039g10b1
tgttgaactaatcgtcgtttcctttttatcatcttctctagatccctttacctctccaataaatactttcaaacaccaaagacaaaaataaaggcttcagttttctaaagactaaagaagatttttttttctttttttttaaattttcagtttggctttttgcagattcaaatggttgtgggagagatttaaaatcctacactgtttgggggaaagagacagagagataggcttgctctgctatgggtctttgcacttccaaaccatccccaaacccttcttttcctcctgattcaaggaatactcctatccatcccccgaataaagatatccaccataagtctaactcggttccagcttcgcctttgcctgatgtagtaaatggtaaccacaaccacaacttagatcaagctaaaggaacaga

SEQ ID NO: 12234 - DNA, 322 bp, Gossypium hirsutum
  Clone ID: uC-gsflmaxxa039h02b1
cgttacatttcgcattgtcgtattatcggaattcagcatattcattgcgaggatacaacggcaggtcggagataaactcttggatccggggcctcgaagaaggcgacaaaggggaggagcaaggccagacttcagtttccgggggggcgaatagctcggttccttaaggctggaaaatatgctgaacgtgtctgagctggagctcctggttacctagctgccgtatcttgaatatctggcggctgaggctctaaagcttgctggaaatgcaaccagagacaacaagaaaaccgcaatagcgccacgccatatacggcttgct

SEQ ID NO: 12235 - DNA, 446 bp, Gossypium hirsutum
  Clone ID: uC-gsflmaxxa039h06b1
cttttcgtccgatggaggcttcttctgtcactgaaaattcttccactggcaatgaccacgagcaagagcctgttttgaatcatggaggcacggagtcgaaccctgagactgatcgagaagaagaactagacggagaagaagttaggcgcgtattgcaagttagtgccgctactgggaaattttggcataattgggataagctgaagagcatgctatcctttcagttgaaactggttttatcagagtatcctgaggcaaaaatggcgattgagcaacaaaatgcttcactaggtgaaactaacctagagttggttacacggctaaatgaagagcttcattcttttattgagggcccaccatttacccttcaaagactctgtgagatcctactggatgcaagaagcatctatccaaaactatcgaagcttggcctagcactagaaaag

SEQ ID NO: 12236 - DNA, 432 bp, Gossypium hirsutum
  Clone ID: uC-gsflmaxxa039h10b1
ttttgattttggctatattcacaattcaaagagattgggaaaaggaggctgaaaaggctaagcagagagttaaaaggtgggcgaaatgatcaaaccacggcaacccacaatcaagggatctactaattggacaatgaattttgcacattttgggacaccttaaactttcactcccaataaaaacctgttaattgtttcaaaataatgttcaatgttttccatccctgtttaaatatcataagcaaaaatgtagtgttcacctgttttctaactccaaacactttgatttttcgccattgatgccagcaacttcaaccattgattcagccaactatggcgtatctgccattggacttgtttttgattgggtttgaaaattctcttggatttattggaccaaattattacaattgggctcttctactttgcaaa

SEQ ID NO: 12237 - DNA, 463 bp, Gossypium hirsutum
  Clone ID: uC-gsflmaxxa039h11b1
tcttttacgcgtccgcggacgcgtgggaaagtgtgctgcggtgacagagcgtgttcttgctgcttgctacaaggctttgaatgatcaccatgtcatgctagaaggtactcttttgaagcctaacatggtgacccctggttccgactccccgaaggttgccccagaggttattgctgagtacactgtccgtgccttgcagcgtaccgtccctcctgcagtccctgctattgtgttcttgtctggtgggcaaagtgaggaggaggctacccttaaccttaatgccatgaacaagctccagaccaagaaaccatggtcactctcattctcatttggacgtgcccttcagcagagcactctcaaggcctgggctggaaaggaggaaaacgtgaagaaagcacaagatgctttccttgttaggtgcaaggctaactcggaggccaccttgggtacatacaagggtgac

SEQ ID NO: 12238 - DNA, 384 bp, Gossypium hirsutum
  Clone ID: uC-gsflmaxxa040a01b1
ttcactcgtccgcccacgcgtccgcggacgcgtgggtcaacttggagaaactgaatggtgagagagcagcaaccatggatctaatcaaagatgcctgtgagaattggggcttctttgaggtgttgaaccatgggattccctatgaatttatggacagagtggaaagcttgacgagggagcattacaagaaatgcatggagcaaaggtttaaggaactggtggcaagcaaggcccttgagggtctccaggctgaggttactgatatggactgggaaagtaccttctatttgcgccatctccctgaatccaacatggctgaaattccagatctaaccgatgaacacaagaatggtgatgaaagaatttgcgttgaaattggagaaa

SEQ ID NO: 12239 - DNA, 457 bp, Gossypium hirsutum
  Clone ID: uC-gsflmaxxa040a03b1
ttgactcgtgggaaatttctcattttcttcagcttaaagtgcttttggctgaaaattgaccaaattaacttgtcgtcttctcccacaaactttcttttccctcatctgctggttctttggaactgtcttctcccacaaacgtgcttttggccgaaaagaacagaaatttgatttctcattcaggataactgctactgctttgaggcaaccctccagtgcttaaaagcttaaaagatacccaggagaaggtgctggaagaacatgaacaacttggttttatcccttgctcctaaatttaccaaattgctaactctcgtactaggctaagaaaatccgcagctttaggacactgctgtggagacgattgcgacattgtcatggtctgcaggatctggacctcagcaaaagtttcaagcttggtgatcgctcattgatgctttggcctaggttgccgtaa

SEQ ID NO: 12240 - DNA, 330 bp, Gossypium hirsutum
  Clone ID: uC-gsflmaxxa040a04b1
tttcactcgtccggaaaatttgagagaaatggaggtggagagagtgcaagagattgctaatttctcgaaagaaacaatcccggaagaattcattagaacaacgcacgagcagccagcactgactacggttcaggggacggtgctagaggtcccggttatcgatctaagcgaccccgatgaagagaaggttgtactaaccattgtggacccgagcagtaattggggaatgttgcttgatctgcactttggatttgtctccttgggcactaaggcgacctatagaagcctgtagggcatcctttcacctttatcccatgtaaaggtatttct

SEQ ID NO: 12241 - DNA, 477 bp, Gossypium hirsutum
  Clone ID: uC-gsflmaxxa040a05b1
ctactcgtccggaaaatttgagagaaatggaggtggagagagtgcaagagattgctaatttctcgaaagaaacaatcccggaagaattcattagaacaacgtacgagcagccagcactgactacggttcaggggacggtgctagaggtcccggttatcgatctaagcgaccccgatgaagagaaggttgtacgaaccattgtggacgcgagcagtaattggggaatgttccaagttgtgaaccatggcattccccatgaaaccgtaaggaagctgaaagaggtcggaaaggctttcttcgagctcccaccacaggaaaaggaagcttacgccaagtccccgggatctcaatccattgaaggctatggaacgaagcttcaaagagaagttgaagggaagaaagcttgggttgatcatctctttcataagatctggcctccttctgaaataactatcaatttgggctaaaacccacctt

SEQ ID NO: 12242 - DNA, 555 bp, Gossypium hirsutum
  unsure (1)..(555): unsure at all n locations
  Clone ID: uC-gsflmaxxa040a06b1
ttcactcgtccgaaaagagtgcgcacccacacgctgcagctcagcagctgtctccagcccatttccctcgctttcgcgcgaccccattcccctctttatatacacccgaaatccccccatttctctatacctcctcctcctccaccgccatcgccgncaccaccaccaccaccaccaccaccaccaacccattttctctttcatctccaccgctcaaaatgtctcttcaccatttgctctttcccattctaatactcgcattctccactgcttcttcattagctgccactgcaaaagaccaaactttaaacactcatcaagctgagttctttaaccccaagcttccacccagaatcctttcctcttccaaaaagttcgaaggctcatcggacattgtcgacctccgttaccacatgggtcccgtccttttctcgtcgccaatcaatatctacctcatttgggacgggtcgtggtctgtttccaaaaactcctcatcaagacctcataaactcaatttccccttcgcgacgccgtcgtttccgcggtttctttccg

SEQ ID NO: 12243 - DNA, 509 bp, Gossypium hirsutum
  Clone ID: uC-gsflmaxxa040a11b1
ttcttaggtttctggaatggaagaaagaaaagtaaagggagaggttatgtgcggcactctcgacctgactgctctcccactagattgtgtcaccctcattatttccttgacctcccctcgagatgcctgtagattgtcgcttgtttcaactgcttttaattcggctgctgaatccgatgctgtttgggaaagcttcttgccatcccaataccaggaattaattccctcatcgctctctttctcgtccaagaaacaactttatcttagcctctgtgaaaatccccttctcattgaagctggacgaaagagcttttggctcgaaagagtgagtgggaagaaatgttacatgctgtcacccagggacctctccattatatggagtgacaccccagattattggagatgggtgtctatacccgaggccaggtttgacgaggtagcagagcttctgcacgtttgctggtttgaaatccgtggaaggattaatatctccatgctttcacccatga

SEQ ID NO: 12244 - DNA, 502 bp, Gossypium hirsutum
  Clone ID: uC-gsflmaxxa040b01b1
tttcagtgtttgcgggtgttggagaacgtacaagagagggtaatgacttgtacagggaaatgattgagagtggtgtaattaagctaggtgacaatcaggctgagagcaagtgtgctcttgtctatggtcaaatgaatgaaccccttggtgcctgtgctcgtgttggccttactggtttgactgtggctgaacactcccgtgatgctgaagggcaagatgttcttctctttattgacaacattttctgctttacacaagtgagatggtttattgtggaagctttggaaacattttacattacggctccgtttggaagctaggaaaacattttctggaaaatattttcctggttttacggtgtttgacagcttgaaaatattttacacttggaaaatggattccaagacacgggtaaaatgacttgcaatttggggaaaatgtcttaccgatttcttttcagtaagacatttttcatctccttcatccaggtaaaatttctctg

SEQ ID NO: 12245 - DNA, 434 bp, Gossypium hirsutum
  Clone ID: uC-gsflmaxxa040b03b1
ttagaatgcaaattcgaaaccttaccaacgacatgggaatggagaacaggcctagacatgacccgaaccaggattcatattgaccggatgaaccagagctcgacctttacaccataccgagctacttctgttggcgtgttcggaacgagatgcacgaaacagaaaggcatgcattgacagaatggttggaaggcagctgaatctcaagaacccctaaaatctacaaggagtacagggatttcatcatcaacaaatacagggaagacccttctcgccgcctcactttcaccgaaatccgcaaatccctcatcggagacgtcactttactccacaaggtcttccgcttcttggaaactggggttttgatcaactttcttgccccgtcttcaccccacgaagggttcgagaacgatgatagggtttgggtcgaaaac

SEQ ID NO: 12246 - DNA, 274 bp, Gossypium hirsutum
  unsure (1)..(274): unsure at all n locations
  Clone ID: uC-gsflmaxxa040b07b1
atttatttatttttctctcaaataataacaaaattaatttttatttataattatcaaaaaataaataaaaatctctttctttgcttttctcaagatagctgctgctttattgctgaagttgaacgctatatataaaaattcaaaaaaaaacatttgtttgtttgtgttctttaaagttttcgtttgatttcgtgattgcggatttttagtcattgttgcgatggggaaagtagcggtgggtgcggcggccgtgtgtgccgcggncgtgtgtgcc

SEQ ID NO: 12247 - DNA, 207 bp, Gossypium hirsutum
  Clone ID: uC-gsflmaxxa040c01b1
tagcttctttcattcctagcccccgctggcaaggtccttcaagttatgcacctctgattttaccccaagggatggtatcagttccagggtggaatgcttacagcgcatcagtctcttctttagagaacctgcagcagacaaacggaaataattaaatctatggaacctcaaaccagaatgaatcggtgactggaggatattaagctt

SEQ ID NO: 12248 - DNA, 386 bp, Gossypium hirsutum
  Clone ID: uC-gsflmaxxa040c02b1
gtggttcagttagcgaaaggagaagaattcgtgaagatagcagagaaaaagctaaatggttggggcttgtttagttctaaatactaagacgccgtcgatttattttgattaagctgctttttgctttaagcttgccatatcatgtgacaaagctgtttctcctttttttatgttgcttttatgttttttgattttttatcttacttatttttttattttatgtttttttatcttttcattttttttttttctatcctttctatcttctgtttattttttttccattcttatttttttcttttattctttttttctttcgttcttttatttctttatcttcttatatttttcctctcaattttttctcctattttttcttttatttt

SEQ ID NO: 12249 - DNA, 213 bp, Gossypium hirsutum
  Clone ID: uC-gsflmaxxa040c04b1
tctcacgcgtccgggcaacttcgcatggatggttggcctactctgtcaattcatggagataaaagtcaagcagaaagggattgggtcctttcagagtttaaagctggcaagagccctataatgactgcaacagatgttgcagctcgtggtttagatgtgaaagatgtgaagtatgtaatcaattatgactttcccgggatctctctaggatta

SEQ ID NO: 12250 - DNA, 261 bp, Gossypium hirsutum
  Clone ID: uC-gsflmaxxa040c07b1
tcgggattatcataccattttgttgctggatcggtatcatcagtctattgcatttagagatatggttatcgctgttaggacaaggactgctcaaactgtgagtgattacagttgtaatggtcgtcatgttttcactcgtacaagggagctgcagaggccgcttgttggttcaattttacagagtatgtggggagtgtcgcctactcatttgttatggagccctacacataacagtacacttgtggattatacatggactgt

SEQ ID NO: 12251 - DNA, 343 bp, Gossypium hirsutum
  Clone ID: uC-gsflmaxxa040d10b1
ttcttcacgcgtccgatttcagttctcaactttcattgctgcagattgataataagatcaataaaagatcatggagggagaaacttgggaaatgtgatttcacattagcctctttacttctactacataatcaaagttcctctgggtatgagagacatctttctttgggatgcctccttaatccacatgaaattattacttcactgcagcactatggtagctggatagtctggcgtaacactgggggagttgaccattaaccattagggcggttgcacaaatagggaattgcactgtactatactagtggatttaggaagcacccataattttatggatgttt

SEQ ID NO: 12252 - DNA, 383 bp, Gossypium hirsutum
  Clone ID: uC-gsflmaxxa040d11b1
tcgttcttttctcctactttccaccttggccgactaattcccttttgcctaaacatcaatcggctaccacagtagcatattcaagcctcgatgattgttttttagccttgaggtcccctcttagcttcgatttcaacgaagcaaaaggaaactcatggcatcctcgtaagtctgctgcaggaggagctagctggagaagtcgttcatgggagtgtacgaaggcacagaggaacacgtgcgatgtggcgaggctgctcgtgagggctgcggcgcaagaggaaaagaaaccctaaagtttctgttcctgcaagactttgggttattgggcttattactgggccactacaatttgagttaatgggtcctgaaatttgggctgtttt

SEQ ID NO: 12253 - DNA, 532 bp, Gossypium hirsutum
  Clone ID: uC-gsflmaxxa040e07b1
taaggtgttgatgtgcttgtagtcatggtcacaaatgaagctcaagctgagagtgttttatttggggatctggctgcagtttcagcccttccatctggagcatctataattctttcttccacagtctcccctgcatatgtgatccaacttgaacggcgtttacagaatgaaggcaaagatttgaaattggttgatgctcctgtttctggtggtgttaaaagagcttctatgggagaacttacaataatggctgcaggttcagatgatgctctcaaaagtgcaggtcttatcctctcagcattaagtgagaagctctatgttatcaaagggggttgtggagcaggaagtggtgtaaagatggttaatcaattacttgctggagttcatatagcagcatcagctgaggcaatggcttttggggcccgattatgtcttagcacaagaatattgttcgatatcatcagcaatagtggggcaacatcctgcatgtttgagaatcgggtttcacacatgttagacaatgactataccc

SEQ ID NO: 12254 - DNA, 474 bp, Gossypium hirsutum
  Clone ID: uC-gsflmaxxa040e10b1
tttttaagtgctactgatgcttctgctgctgttgctgatgcttctgttagagaaaatgttaacggaggtggtgagcaaacagaagtaaactgtaatgccaagagaaaactgttggaaaaaccagttgataagaaggaagctaataaacctcccgattcttggtttcaactgaaagtaaatacgcatgtctatgtgactggactacctgatgatgtaactgcagaagaattggttgaggttttttccaagtgtggaataatcaaagaggaccctgaaacaaaaagacctcgtgtgaagatctatgttgacaaggagacaggaagaaaaaagggggatgcacttgttacatatctaaaggagccctctgttgctttagctgttcaaattttggatggaacaccttttcgtcctgatggaaagatccctatgtctgtaagccaagctaaatttgagcagataggggataaatttata

SEQ ID NO: 12255 - DNA, 532 bp, Gossypium hirsutum
  unsure (1)..(532): unsure at all n locations
  Clone ID: uC-gsflmaxxa040f05b1
gggtgtcttcagggaatcaccaacttattttaggtgctgttatacgtcatctagaccacaaaaatgtgtcccatgaccctcagctgaaatctaatatcgtacaagtagcggctgctttagctaggcaaactagatctagaggggtgcttgccgaaactggtttcgttagtgatctatgcaggcatctgagaaaaagtttccaagccactcttgaatcggtagggcagcaagagtcaaacttaaatatcttgcttcaaaattccattgaagactgcttgttggaaatagcaaaagggattgataatgcactacctctgttcaacatgatggcaatatcactcgagaagttgccttcttctggcattgttgctcgtgcaacaattggatcattgatggtccttgctcatatgatttcattagcattaatctcctctcgctcacacaggtgtttcctgaagatcttcttgttcaactgatgaaagcaatgttgcatcccaatggtgaggtccgtatnggagcacatcacatattt

SEQ ID NO: 12256 - DNA, 451 bp, Gossypium hirsutum
  Clone ID: uC-gsflmaxxa040f06b1
ttgtcgcgtgggcggacgcgtgggctagcttccaagctgactggagccggcggcggaggttgcgtgctaacactcttgccaacccatatatcaggagaagtcatcgataaactagttgaagagctcggatcattcggtttccagagttttacagccggaattggtggtaaaggtgtccaaatttcctttgatcattcttcctaatttgccgtccccatattttagtcgtaataagactctctgcgaataacatcatgaagcacattatatcgatgttatagatatttccgttccctttcgttatctgtacacttcattttcggattagtcgttgtctagttaaactggaacgaagaaaaactactgctacagagaacaatgttgtagctgtgtctatactcctttgtacattagttgactgcatcaatttgtgttgtctttgctgttgaaa

SEQ ID NO: 12257 - DNA, 389 bp, Gossypium hirsutum
  Clone ID: uC-gsflmaxxa040f09b1
ctccacgcgtccgcccacgcgtccgcccacgcgtccgcggacgcgtgggcgagggcatggaagaaggtgaattctcagaagcccgtgaggatctggctgctcttgagaaggattatgaagaagttggtgctgaaggtggagatgatgaagaggaaggtgaagaatattgatgtgcttatgcaaaatcatctattttgaagatcggttcccagggtatgcccaccctcttttcctatatccttcctatcgttctttatatgtgtgaggtttgtgaaattatgcatgtaataagcctaggatcttttcatgctattaatggaataaatttagagttgtgtttgcatgtcatttttgttagaaatgcttgtcttttacttttgaaagatgct

SEQ ID NO: 12258 - DNA, 497 bp, Gossypium hirsutum
  Clone ID: uC-gsflmaxxa040f12b1
tcgttagaattttcctctttcttgttttgtgaattcttgagaaatggttgatgtaaccgataaattggcatattttcaagccaccacgggactcgaagatcccgatttgtgtaccgaaatccttcaggcccatggttgggaccttgaactcgccatctcttgcttcacctcttccactcaaccctccgcttcttccactgtctctgattccgaccctcccgattcacgggcccggactgattccgcctcggcctctgccttcgactccgcctgcgcctgcgcctccggtcctattaccgctcccgcaccgggcttagcctggagactcgttacattaccgatttccgtgatatccggaagtttagggttgatctctggcgctgttgggctgggtctatgggccgcgggtggagttctttcgtattcccttgggatgatcgggctaggctctgggcagggcggtgaatcatcggccggattggtatcggtctcagctg

SEQ ID NO: 12259 - DNA, 471 bp, Gossypium hirsutum
  unsure (1)..(471): unsure at all n locations
  Clone ID: uC-gsflmaxxa040h03b1
gtcctagagaggtcttgcaggactgtaatgagtaagtctcccaacaagcacaaccgattatacatggaagctcgacccttggaggaaggtctggctgaagccattgatgaaggtcgtattggtccaagagatgatcccaaggttcgttcaaaaattttggctgaggagtatggatgggacaaagatcttgctaagaagatatggtgttttggccctgagaccacaggtcctaacatggtggttgaatgtgaagggagttcagtacctgaacgaaattaaggattctgtagtcgctgggttccaatgggcatcaaaggaaggtgcaatggccgaagagaacatgaagggtatatgctttgaagtttgtgatgtggttcttcatactgatgctatccatagaggggggggtcagatcattccaactgctangagggttttctatgcttctcagctgactgccaagccgaggct

SEQ ID NO: 12260 - DNA, 400 bp, Gossypium hirsutum
  Clone ID: uC-gsflmaxxa040h05b1
gttttatgcaatgtcaccctactcttgtttaatcggttttctcaaattaattgtcttaaatttgacgaattaacttccactacatccaaattcaagtccatttgctgtgctgtgagtgaattggagagagatgagaagggggaaaattgccccagatggcaatgaagcgagaaagaggagcgagaaaggagactccaaatccctcaatgcctatttcaagcagaggaagtcacgaacagaagacttcaaatgccgggatcttgaaggagaaaatcagaaacaaataagagaatcgggaaatgaaaataagggcaagccgggaaaagggttcttcgcttgctatctgctaacctctctcagccctcgtcataaaggccacacctatatgacatggactgtg

SEQ ID NO: 12261 - DNA, 448 bp, Gossypium hirsutum
  Clone ID: uC-gsflmaxxa040h06b1
attgtgttctcgtgtgttgctctctcctatccacacctttcatcccactctctcttcctctgttttggtttccgtttctttattttccagtaaacatggagatggtgacgatagcataattatctctagtattagattatcctatcttttttcttaaagatcgaagcaatgagaagtagtagaattcagagctcaacttggtattcagcatcatcttcctccacgtttcctcgtcctccatgtctcacctctacctctcgccattgcaggctgtctatctctcagagggtgtctagaatttctctactttcaagctgttcctccggattgtctaagacacaattgtcagtttctacacaacggaacgaacagaatttgttgtccgtgggcgtcggtgccgatgctttggtgacttcaacgctccaggtgtctccaatgagcctcttgt

SEQ ID NO: 12262 - DNA, 397 bp, Gossypium hirsutum
  Clone ID: uC-gsflmaxxa040h08b1
ccttaatgcttacattggttgccattattcagcaaagcagcctactatccacataagctttcgttttctgttgtctataatgaagtggcaaaagcttggttaaaagatttggttgtttatagtttacaatttttgcagtggcacataccaggaagaagcaacagaaatgaggaggactgaactggaccttaatctggaacctatttactcatgccatttgggatgctttgctgcatgaaaatgggtacaattaatttaactatgcttttggttatatgtgaatatggacatagatctatgcactatggtccctttctttaaaaaagaaaacaacatgagaaaggataaattggtgggaactcaagccttttatgtctggtttggcttgacatacata

SEQ ID NO: 12263 - DNA, 473 bp, Gossypium hirsutum
  Clone ID: uC-gsflmaxxa041a08b1
tttgaagctgaggcagccatgcttggtcagccgatgagcatggttttgcctggtgttgttggattccagttatctggaaaactaagaaatggtgtgacagctactgacttggttctgactgtgacacaaatgctgaggaaacatggtgttgttggcaaatttgttgagttttatggggatggtatgggtgaactatcattggctgacagagctaccattgctaatatgtctcctgagtacggtgcaaccatgggattcttccctgttgatcacgtcactctgcaatatctcaaattgactggcagaagtgatgaaacggtggcaatgatagaatcatatctccgtgcaaataatatgtttgttgactatgacgagccccaacaaaaaagagtttactcttcatatcttgaactaaaccttgcggaagttgaaccctgtatttcgggacctaagagacctcatgatcgagtttc

SEQ ID NO: 12264 - DNA, 471 bp, Gossypium hirsutum
  Clone ID: uC-gsflmaxxa041a09b1
ttttacgcgtccgtatccacatgtgaaggatatatgggtcacttatctgtcgaagtttgtaaagagatatgggaaatcaaaactggaacgagcaagggagctgtttgagcatgctgttgaaacagcacctgctgatttagtaaaacccctgtatcttcaatatgcaaagctggaggaggattacgggctagcaaaacgagctatgaaggtctacgatcaagcgactaaggctgtttcaaatcatgagaagcttggcatgtatgagatttacattgcccgtgcagctgagatctttggtgttccaaaaacaagagaaatttatgagcaggcaatacagtctggccttccagataaagatgtgaagacaatgtgtttaaaatatgcagagttagaaaaaagcttatgagaaattgatcgtgctcgagcaatatatgtatttgcatctcaatttgctgatccacgctctgatgc

SEQ ID NO: 12265 - DNA, 416 bp, Gossypium hirsutum
  Clone ID: uC-gsflmaxxa041b02b1
cttactcgtccgcccacgcgtccgattagcttggcttctctccaacagaaatggcacccgcttccttccatcacgagaaagtttgcgtgatggatgcctccggtcgcctgggctctaccctggttgaacgcttgctggaaagaggctacattgtccatgctgctgttcaaggccatgttgatgatttgaaactgaatggggtagctactgaaagggaaaagaagctcaaggttttccatgcagaccctttcgattatcagagcattaccgacgccctgaaaggctgctctggtttgttttacgcctttgagcccccacaagaccaccctgcctatgatgaatatatggtagaagtggaggtacgagcagcacataatgtggtagaggcatgcgctcggacggagacaatagacaag

SEQ ID NO: 12266 - DNA, 493 bp, Gossypium hirsutum
  unsure (1)..(493): unsure at all n locations
  Clone ID: uC-gsflmaxxa041b03b1
tgtcttcctctgtttattcgcttcagctcattacttcccgtgctctctcgtcctccctcaccaaatcaaaatgtctctggtggcgaacgaagactttcagcacattttgcgtgtactgaacaccaacgttgatggaaagcagaagattatgtttgctttgacctccatcaagggtattggaaggcgtttcgctaacattgtttgcaagaaggctgatgtcgacatgaacaagagggctggtgaattgactgcacaggagctggacaatctcatgaccattgttgcaaaccccaggcagtttaagatacctgactggtttttgaataggcagaaggattacaaggatgggaagtattcccaagttgtgtctaatgctctcgacatgaagttgagagatgacttggagcgattgaagaagatcaggaaccaccgtgggctgaggcattattggngtcttcgtgtacgtggtcagcacaccaagaccactggtcgc

SEQ ID NO: 12267 - DNA, 460 bp, Gossypium hirsutum
  Clone ID: uC-gsflmaxxa041b05b1
tatgattaagccaatcaccttatttccagcattggaaaagttgagcctgtggaatatggaagaagtagaagaatggttagaagtggaaccaacagttactgtgtttccttcactaaaagagctacatattgaaggttgctgcaagctaagcagtgttccaagaatgagtagactttcttgtcttgaggcactcactattacaggtaacaatgcattaagttgtataggagatgaacaatttccctttccctctagcctcaaaaaattcaccatacagaggtgctataagttaacgacagttccaagtgtagagggcggtatctcttttcttcagcatcttgaggtgaagctttgtgaccggttatgtaaaataggacaaggattacttacttccacatgtctaagagttgtggtcatatgtgactgtcctaatttgatctccattccagtatatggcata

SEQ ID NO: 12268 - DNA, 530 bp, Gossypium hirsutum
  unsure (1)..(530): unsure at all n locations
  Clone ID: uC-gsflmaxxa041b07b1
tctcacgcgtccgcccacgcgtccgtctttccccaacgcgaagaagttctgcatatacacatacatacatacatatatatatatataaaatgtcacgtaagaaagaagagaaaactcaggctgctgctgaaagaataaaggcagcagcattgagtgctgcaaaaggcctaagtcgagctcaggctgaaagggcagctgcggctgctgcccgaaatgtcaatgcttatgggcaaaaagaagaggggcctagcagatggcaagagaaaagggaagcgaagaggcaaatgtatttgatgagtactgaaaaggcagttagattaggcgaaaggaaagacaagatgaccatgacgtctacgatgggtgcttctcagtgccaaaagtgtttccaagtggggcattggacgtatgaatgtaagaatgaacgggtttatatgtcgcgaccgtcgcgtactcagcagcttaagaacccaaaaatgaggatgaagctttctgctcttatgattnggataccctgatgtgaggatgatgag

SEQ ID NO: 12269 - DNA, 456 bp, Gossypium hirsutum
  Clone ID: uC-gsflmaxxa041b08b1
tttatctcgtctactacgttttccattttcgttccgatccgtagctcttatttcagcaccatgactgttcactcccagattcaagatgaaactggcagaagtgtcaagccttcttattttaactcgccacctttggacgtttcggtcgcattccctcaggcaactccagcatctacttttcctcctcttgcttccgactattatcaatttaatgatctattgagtcctgaggagcaggctctacgtaagaaagtaagagagtgtatggaaaaagaagtagctcctataatggcagagtactgggagaaggcagagtttccattccaaattgttcccaaacttggtgctcttcatatttctggtggtactatcaaaggttatggatgcccaagtctctccctcactggaagtgctattgcaatggcagaggttgctagggttgatgcaagttgctca

SEQ ID NO: 12270 - DNA, 357 bp, Gossypium hirsutum
  Clone ID: uC-gsflmaxxa041b10b1
gaattcgaaaattgattccatttttccatgatttcaaggtattgttgaggctgcatatttgaatagcacttaggaaaaatattaagccgaacatgagcacaatagaagtgagggggccttctgttagagggtatcgacgaaggaaggcactcctggatctcaatgttcctcccactgaaatcagggaacaggagggtacttcgcagcaggctggatctgagcaactgactactcaacccgtacagcctccaccatctgcaactattgatgttgaagctattgatgttgaagctattgatgatgatgtaattgaatcttccgctatagcattcgcagcggctaaaaacaattctagga

SEQ ID NO: 12271 - DNA, 535 bp, Gossypium hirsutum
  unsure (1)..(535): unsure at all n locations
  Clone ID: uC-gsflmaxxa041b11b1
gtcatgacaaggtgcagcaggtgttgcttgcactactccatgaaaatagtgaatctcatcatgaattttcttgggattgcaatcattgtttactccctttggctccaaaagaagtggaatattggtgttgctcaattgctttcttttccttcaattcccaacccttggtttatatatacgtgttttggtgtgggaattgcagtgtgcttgagctcactattcagtttcattgtctctaattgtatcagcacatctgtactttgtatttatattttcagcgtttgctcccttcttcttctggaaattgccgtgattgtcaccattttcttcaagaacgactggagttcgctaatttcaaaatacattgatgagaatcatgaatatttcaagaactttgttgtcttccatgaaaagatgtgtcgcttgattactcttttgattctagtcccacaggttggtgtaatagcattagcaataattttatnggagggtgggattgaaagatatcggagagggagcaatcangaatagggga

SEQ ID NO: 12272 - DNA, 492 bp, Gossypium hirsutum
  Clone ID: uC-gsflmaxxa041b12b1
tataaatcttaaaatagaaaaagatacagaggctttgcagttgttctacgaccataagggattaacaataaaggtttcattggcgctggtacctgaggagatagagagtttggttcaacgtctgagggaaaactctgatgtctttgtgtggtctgtgatggatattccaagggtagatccttaggtaattgtctatagactgaatgtgctccccgagatgaggccaattaagcaaaggaagagaaggttcactccctaggttgtagaagcagtgaggcaaggttcatcaaagaaattgagtatccaaactagatttcgaatgttttcatggtaaagaaagctagttgcaaatggagaatatgtattgattttaccaacctcaataaggcataccctaaggacagcttccctttgccatcaattgatcacttaatggatgagtctttagggtacaaattcatgagcttcatagatgctttttcatgttatgat

SEQ ID NO: 12273 - DNA, 546 bp, Gossypium hirsutum
  Clone ID: uC-gsflmaxxa041c02b1
ataatggagtccaacaccaaaatgtcagctcttcttttgctttgcatgcttttcatttcttcagtgacaccaattcttgggtgtggttcatgtgggaaagcaccacacaagcatcgaaagcctaagggaaagtcccctaaaggtcccatcactttgcctccccttgtgaaacctccaatcaagttgccaccggttgttcctccaatagttaagccacccattgacctccctccggttacagtccctccaattaacctccctccagggacggttcctccagtaactaagccaccaagtgggaaaccctgcccaacaccaccaaccaaggacacttgccccattgacacactgaaattgggtgcttgtgtggatctgctgggagggttggtgcacattggactaggtgacccggttttgaatcaatgttgtccggttctttcaggacttgccgagctcgaagctgcggtctgcttgtgcaccaccctcaaacttaaggttctcaaccttaaaaattatgtgccactggctcttcaactccttgcacat

SEQ ID NO: 12274 - DNA, 472 bp, Gossypium hirsutum
  Clone ID: uC-gsflmaxxa041c04b1
cccacgcgtccgcccacgcgtccgtgaaaaactaaggtgatttcatatttattttttcgtgttctgatttagtttttttttctttgttcctacatatagatttttcacagaaaaataaggagaaaatgacttaccttaatgctggctccttcatgtctttgcttgcttcgtcgtaattgaagcttaagcgagaatcttgaagcttctgagtggactcgtggtcgaacaaggccagattatgccttcatgcgatgttcatttgccgaatatggggatagatcgacagttgaaagatgccttaagttcggtcgaatgaataaagaggaataagctttaggtttttttattttttatttgcttttaagtggatgagtgttaattttagggttttcttttcctttcttttgatctggtgttaacaaagtgaaacagcatcgtttggaaacaaagatccgcacgttgacctttttgg

SEQ ID NO: 12275 - DNA, 414 bp, Gossypium hirsutum
  Clone ID: uC-gsflmaxxa041c12b1
gagtggggccagcaactgagtagttcttttgatggaaaaaagacatcacctgctggtaattcaaaagagacttcaagtgctcacaagcgggaaccagaggggatgaatgtgggtggcccaccagagaagaggcgggagatggaccgttgcatgactgatgagggctgtgtcctacctgaccaaccaggattcaacatgaagggaggaaaatgcaagtcagatgctacgagtgccaagctatccgtgaaatccaaagctggaaagaaatcggggaaggctgccaaggatccaaacatgccaaataggcctgctagtgccttctttgtcttcatggaggagttacgtgagcaatacaagaaggatcaccctacaaacaaatccgatgtggctgtcggcaaagctggtggagataaa

SEQ ID NO: 12276 - DNA, 536 bp, Gossypium hirsutum
  Clone ID: uC-gsflmaxxa041d02b1
tagaaaaggcctttttgttttgcttgcttatcatcatcaaatacactttcttcttcttctcttcatattggttttttcccttagaactccacgacacagatccaaggagttggggaaaaccctcacacaaattctctctctaaatcttaaccgaaaaggtctccaaaaaagactaccctttttgcccatttactctccttattcaacaaattcagcatcacatccccaaaatagtcgcttttttatctcttgctttcttcatctgcttcaagtcatggctggtttagcacctgaaggatcccaattcgatgctcgtcaatatgatcagaaaatgagtgatttgctccaaacagacggagatgattttttcacttcttatgatgaagtttatgacagtttcgatgcaatgggacttcaagagaaccttctgaggggcatctatgcatatggttttgagaagccctcagcgattcagcaaagaggaattgttccattctgcaggggtcttgatgtgatacaacaggcacagtctggga

SEQ ID NO: 12277 - DNA, 490 bp, Gossypium hirsutum
  Clone ID: uC-gsflmaxxa041d09b1
ttcattcaaaaaaactctcttcattcttcttgctttattctctttagttttctgtttgtttcagcttcaagccacgacacttgctgctcaagcaattggctgaaacttcttgttagttgctctcagctccaacaaaatagaaccgaatttcttttccagtctacttcacccacacattacgatttctctaagcacagtatgcatgagtgtccaaatttttcgatttttcacatggatataatgagcttcatgaaatggctttcatagtccaagtgaacgagggtaccagagcaacctgcgacgacaatgaaaaacagttacggagaaacaacaccgatgaccagaactacgtatcctggcacataccctaatcagatgagagtggtggatgaagtcattagagaaatgcacatccctacatatttgttggacataaccatgctgtttgagcttaagaaagatgggcacccttcaatttacagtggtgact

SEQ ID NO: 12278 - DNA, 535 bp, Gossypium hirsutum
  unsure (1)..(535): unsure at all n locations
  Clone ID: uC-gsflmaxxa041d10b1
ttgtcgcgtgggctcaaaatctcaaacccagatttgttctctctctctctctctctctatttccaatcaattaattcctccattggaggagcttagggtttgttggtgttctggtctttgctttgtctgaaaaataaacagaattataaacgaacaccaacgccatgggaagatttgaagagagaggattcgattcagtggtttgccctaagcctatccgaacctttagatggtctaccaactgttatcagactgagatggctgattcaaaaactggtgcagagcttcttgatataatcctccccgagggagggtatggggccgagaatcccaccaaccaaatggcttcatcaccaccgtatttctgtggatcaccgccgagcagggcgtcgaatccggtaatccaagatgcccgattcaacgacgagcagccggtgctacctncactaacattcccagcaacctccttaaggggaggatgcgtgagggtgaaattccggcagatgccagctgctgtacgaatcgagggatttga

SEQ ID NO: 12279 - DNA, 530 bp, Gossypium hirsutum
  unsure (1)..(530): unsure at all n locations
  Clone ID: uC-gsflmaxxa041e02b1
gttgttctctctctctttcccatagtttcacccgtcttttaatccatcgctcacaaaattatgggtttgaaggaggaattcgaggagcatgccgagaaagttaagaccctcccggccgccccttcgaacgatgacatgctcattctctatggactgtacaagcaagccactgttggaccagtgaataccggccgtcctggaatgttcaacatgagggaaaggtacaagtgggatgcatggaaggctgttgaagggaaatcaaaggaggaagcaatgggggattatatcaccaaagtaaaacaactgtttgaggctgctggaagttcttgatgtgtgtgtgtatggccaatgaaaatggtgtaatttcaagcccttgtttgttacttggggttttcattactatgaataaattatgtactctttttctattgctatatgttatttatagtagaaactccttgatttacttttattcttgggntattacaaaagagattttacacaaggatggtaatggacggagcgagagc

SEQ ID NO: 12280 - DNA, 508 bp, Gossypium hirsutum
  Clone ID: uC-gsflmaxxa041e05b1
attaaaaaaaaagaaaaaaagccgttgctaattaaattaaaaaccttcatttttttttactatttatatgcttattttgttcctctcttggcttcaaatcgtttactttggttccattgtttgagttgaagttagcaaatttctgggtttaaaaaagaaagaaagaaattcaccattttcttttaatctatttcttaatgattattactattccattttcacatgctttggattctactttaaccgtgtagaaatcatcatcatcacaagaatttgcattcttcaccctattgggcctttgctttttatcatttctctctggtcggcgagtgaaaaaaaaaagcagggtcttcaagaagtattcaactaagcaaagaagtgagcttggaagcagaggattttgaggattttaaaaacgagcttaaaaaccatagatgtaaaagaaggggagccgtgaaagtagcagaaacagctcgttttttttgcttcaggttgcgtgtaaagtgag

SEQ ID NO: 12281 - DNA, 464 bp, Gossypium hirsutum
  unsure (1)..(464): unsure at all n locations
  Clone ID: uC-gsflmaxxa041e09b1
ctcacgcgtccgatgctctcactctctccaaatcctcccatcacaactttaccctctcttcgttccactttcaagggaaatctgaggaatttacaaccaaacccttttcacattattcgtatcaggaccaagcagcaaggggtagaggcacaaaaggggacacggtctttagtggttgtgaaccaagcagcaacaacccaagtgtcggttacagcttctaatgtgaggtttcggttggacaacctgggacctcagcctgggtcaagaaagaaagggaagagaaaggggagaggaatatcggctggacaaggtgggagctgtgggtttggaatgaggggtcagaaatcacgttctggcccaggtgttagaaagggatttgagggtggccaaatgccactctataggcgtatccccaaattgagaggaattgccggaagtatgcatgcnggattaccaaaatacat

SEQ ID NO: 12282 - DNA, 517 bp, Gossypium hirsutum
  Clone ID: uC-gsflmaxxa041f04b1
atttcttgtaagaatcaacaatggcgacggctcttcttacaacaatcctcttgtcttctttccttgttgtttcatcagctgaaatctcgagcaagattggtataaactacggtcgaataggaaacaatttgccatcaccatatcgaaccatcgagaccatgaaatcgatgaatgccgggcgtattaagctctatgattccgaccctgaaatactgaaacttttatcaggtaccaacattcatgtatctgttatggtacaaaacaatgacataatccgtatcgcttcgagccaagctgttgccgaacaatgggtacaagacaatgtcttggcttattaccccgacacgatgattcggttcgtgttggttggtaacgaagtccttagccaccaagatcgaagaatttggattagtcttgtccctgccatgcgtaggatcaagaacttcgtgaacacgcacgatatcaagaacattaaggtcagtacgccattggctatggacgtaatgcaatcaacttt

SEQ ID NO: 12283 - DNA, 504 bp, Gossypium hirsutum
  Clone ID: uC-gsflmaxxa041f05b1
ctcacgcgtccgcccacgcgtccggaaaataaaaaataaaaaagaaatcgatgaagaaaaaccctagaaccgggatcgagaaggctgtgtagatgcatgtcggcggaataacgttggatctgaattggttcctgcaattcattttcacgctcttcattttcgcatttgtgtctcttcgcttgctgaagaacacggcgtcgaaatacttcgaggtcgacgccaatttcgatcgggaccaaccaatgccttccatccccatggacgccgatcacttcccttgcgccgtatgctctaatcccgccttcaagaagtgctctcgttgcaaatccgttcgttattgctcctcagcctgccaacaggtggactggaaggatgggcataagacaaagtgcaaagtaaattcaacacaaactacaaccaccaaaccgttttcaggagttgctctggttcctgtcagtggaacctctaagattatcaagaaaccgagaaaggttcttttcccat

SEQ ID NO: 12284 - DNA, 530 bp, Gossypium hirsutum
  unsure (1)..(530): unsure at all n locations
  Clone ID: uC-gsflmaxxa041f12b1
ttgtgaaacaagataaaaaggattttgctttgcctaatttgtaagctttgaggttgactgaaaaaactatggcggaagagggacaagtaatcgcctgccacactgttgattcatggaaccagcagctcgagatgggaaaccagtccaagaaactggtggtggtggatttcacagcatcatggtgcgggccatgccgttttatatcaccaatcctggtggatcttgctaagaagctgcccaacgtcatattcttgaaggtggacgtggatgaactgaatactgtggctcaggagtgggctattgaggcgatgccaacttttgtgtttctgaaagaaggcaccataattgacaaggttgtgggtgcaaggaaagaagaattgcagcagaaaattgcctttcattcatctaacccggtgcagacagcatgaatcaacatttaaatgtacttgatgtctggagttgtttatgaaactaggatcttatgaatgtctgacagacagaccctaaataatgtgtggntgatttatatt

SEQ ID NO: 12285 - DNA, 518 bp, Gossypium hirsutum
  Clone ID: uC-gsflmaxxa041g01b1
cttctcttccgtttttgattttcagcttctctccagagttttataatgggtaaggagaaggttcacatcaaccttgttgtcattggccatgtcgactctggcaggtcgaccactactggtcatttgatctacaagctaggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactttatcaagaacatgattaccggtacctcacaggctgactgtgctgttctcattattgactcaaccactggtggttttgaagctggtatctctaaagatggtcagacttgtgagcatgctttgcttgcttttacccttcgtgttaggcagatgacttgctgctgcaacaagatggatgcaac

SEQ ID NO: 12286 - DNA, 488 bp, Gossypium hirsutum
  Clone ID: uC-gsflmaxxa041g08b1
tttgtttcttggtgggttttgagtgtaaatggtgctaatttaccaccatgtcaattccctgctatttacaactttggtgactcaaactcagacactggtgggatttcagctgcttttgaacccattagagctccatatggtgtgccctattttcacaaaccatctggtagagactctgatggtcgcctcatcattgacttcatagctgagagacttaagttgccatatcttcatgcatatttgaattccttgggagcaaatttcaggcatggagcaaatttcgctactggtgtatcaaccataagaagaccgaatgaaaccatttatgaatatgggataagtccatttggtttagatatgcagattatacaattcgaacagttcaaggcaagggctactgaaatgtataatcaagctaaagatccttctgaaaaaagataactttccaagacctgaggacttttcaaaggcgctttacacctttgaca

SEQ ID NO: 12287 - DNA, 437 bp, Gossypium hirsutum
  Clone ID: uC-gsflmaxxa041g09b1
cgcgtccgaaattatcagtgcattaccactttgatctaatcctcaatttcccaatttctcttgaaaccctaatcctaaatcgatttcccaacttcggcgttctaatggccactgaggaaccaactgtcgccgtggaatctgcgcctgagctggcggaagagaatcccgctgaggctacagccaatcccaaatctggcaaagcaaagaaagctaaagagcccaaagccaagaaggctgcagctcctaggaagcgacgagctcctcctgctcatcctccttacgaagagatggtcaaggatgcaatcgttactttgaaggagaagactggatcaagtcagtatgctatcactaaattcattgaagagaaacagaagaatcttcctggaaattttaagaagcttctgcttttccatttgaagaaacttgtggctgctggg

SEQ ID NO: 12288 - DNA, 440 bp, Gossypium hirsutum
  Clone ID: uC-gsflmaxxa041h03b1
cttatttttccgcccacgcgtccgaaaggccttctcatcatcataatttcaaggctggagccctcaacgtccttcttcgagtctcagcgataataagcaattctccatatattctaatgcttgactgcgacatgtactgcaatgacccaacttcagttaggcaagcaatgtgttattattgcgatccccaaacaccttcttctatagcatttgtgcaattccctcaaacatttcgaaatatatgtcaagatgacatctacgacagccaaattcgacatttattcaagatactttggcacggttttgatggcgtcggaggaccaacgatatcaggttcgaacttatatataaagagggaggctttattgggtagtttcagcaagcaacaagaactcatggcacttaagagatcatttggtccatcccatgatttcattaaa

SEQ ID NO: 12289 - DNA, 489 bp, Gossypium hirsutum
  Clone ID: uC-gsflmaxxa041h09b1
tcgtttggtctatcagcatccttcctgattgtaggaatgtagtgttcaatacggccaaggttggagttcagacatcacaaatgcagatgttgcctacgaattctaagatgctctcatgggaaacttatgatgaagatacttccgcattagattatagcttaatgataagtgctaatggtctactcgagcaaataaatgtcactagggacgcaagtgattatctatggtacattactagtgttgacatcggttcatctgaatcattccttcgcggaggagaacttcccactctcattgttcaatcaacaggtcatgcagtacacatctttatcaatggacagctttcaggttctgccttcggaacgagggaaaataggagattcacattcaccgggaaggtcaatctgcgtgcaggaacaaacaaaatcgcgctgctgagtgttgccgttggattaccgaacgtaggtggccacttcgagacatggaaca

SEQ ID NO: 12290 - DNA, 483 bp, Gossypium hirsutum
  unsure (1)..(483): unsure at all n locations
  Clone ID: uC-gsflmaxxa041h10b1
tattcagacacggtgctgaagcattccatctataaagccctcctgcccttttcaccagcaaactaagtagtcatgaatattagtgaacaagaacaggacatcgtcatcgtcggcggtggtatttctggcttggctaccgcccttgctcttcgcaggaaaggaataaagagcatggtgttagagagatcggaaacgctgcgagccgccggcgttggcatcattatgcaaccgaatgggtggcgtgcacttgatcagttgggtgttgccgccaagcttcggcagacttgcactnnaattccatcgggagtatttatatcagttgctgagggcaagtgtcgtgaatcagaattacctcttgggaaaggggaattacgttgtttgaaacggatggagctgatgaaggcactaacggaggaattgcctgtggaaagtgtgtatttgggatggcgagcgggctctatcctacttgaccctcttactttc

SEQ ID NO: 12291 - DNA, 525 bp, Gossypium hirsutum
  Clone ID: uC-gsflmaxxa041h12b1
ttgtttgaatgaacagagaagatcacaagaagaccgaccacgattcccacttctccgaatggaagcttctcatttgtcctcatgactggaaaaatgggaaaggaggagcagtgaccagataccggtttgaaaatcttccgaaaagttcaggtccaggaatctatgagcttgcggtgtgtaaactgccgagtagggaccgccgtggcaagcttgaacctgattcggtggtttatgttggggaggctgaaaatataagagcaagactccaacaatatggccgtgatggtactcatctctgtcgaaaaaatggatttggtgaaaaaggatgtcctttgtttgataaaatttttgcaaggggttgctctattatctacagatgggctcgtatgaaaagtaaggcagcagctcaaagaactgaagctcaacttcttgaaaaattcgattatgcatggaataaaagttcttatggtgcacgtcgccacaatgatattcttcggaaactagataaacatgtattcaacaaaa

SEQ ID NO: 12292 - DNA, 457 bp, Gossypium hirsutum
  Clone ID: uC-gsflmaxxa042a08b1
tcgttcacgcgtccgcccacgcgtccgaaagcaaggaaagcttctctgcaaacaccttaattttacaactttgttattgctttgcaaagatgggttcacttgaaaccagtaaaccccacattgtaatcgtcccatttccagcacaaggtcatgttaaccccatgatgctacttgctaagctcttacactctagaggcttcttcataacctttgttaacactgagttcaaccataggcgtttggtcaggtccaaaggccctgactttgttaaaggtctgcctgatttccagttcgaaacaattccggaagggctgacatcgtccgatcgaaatgcaacacaggatcttccagttctgtgtgattcgatacgaaagcattgcttggcaccattcgtagatctactagctaagttaaactcctcgcccaagtgcccactgttacttgcataatctctgat

SEQ ID NO: 12293 - DNA, 251 bp, Gossypium hirsutum
  Clone ID: uC-gsflmaxxa042a10b1
tgcttgggggaagttatatctgagcttaaggcagatggtgcttcctggattcagtttgatgaaccgacccttgactagaatcttgactctaaaaaatagcaagcattaaaaagtggctaataaagatttggaataaccctcttaaaggctggaatgtaatgaaaaggaacctcctttgttgatcttcgtggggaggggaaaaaaccactcattgggttaaaaactgaacccgcaatatggtttggatttgc

SEQ ID NO: 12294 - DNA, 343 bp, Gossypium hirsutum
  Clone ID: uC-gsflmaxxa042a11b1
tttctcaaaaccatgcaaagctacctacttgaagtctcacagcccaattgctgagaagaatgctcgggatgctgttcatgaggacaaatcagctaggggagttcgatcccctcgggtccccatgaacaaatccgatggtacatttgaaccacctaggctctccaaggacaaatccgatactgcatttcagtcgcccaggctctccaaggacaaaccagatactgcatttcaatcacccaggctctcgaggggcaaaccgaatactgacgttcaatcccctaagctccctgagatagggaaagagctgatatgcgtatcaaatcaagttagcagctcaaatgac

SEQ ID NO: 12295 - DNA, 425 bp, Gossypium hirsutum
  unsure (1)..(425): unsure at all n locations
  Clone ID: uC-gsflmaxxa042b04b1
ttcggtttgcagaagctgagcatcgatgaagtccagaaaatgccgtggcatgagcttgaagacgagattgaacgctggatcaaagccgctaacgtcgcccttcgtatcctcttcccgagcgaacgccggttatgcgatcgcgtattttttggattctcttccgccgctgatctttccttcatggaagtctgccgtggctccaccattcagttacttaattntgctgacgccgttgctatgggtagccgatcgccagagaggcttttcaaagttctcgatgtgttcgagactttgagagacttgatgcctgaattcgattccgttttctctgatcaatactgtttggttcttcgaaacgaagcggttaccatttggaagagattaggagacgcgactagagggatatttcatgagttagagaatct

SEQ ID NO: 12296 - DNA, 424 bp, Gossypium hirsutum
  Clone ID: uC-gsflmaxxa042b05b1
gtttactccttgcaattgtaaatgattagagaccaaagccaaagctccctggaagcagaggcgcctttgtctttaagaaataatatgttttgttgtttatgtgttttttagaataaagtagccatggcttgtcgtaggttttgcctgttgccgccacggttacttggtgcttgccaatagatagagtgaagtactaatatttacttgtttttctgtccagtgtgagcatctctgctatctcaggatatattgtgactattacataattaatgtaaggaagtgagtcagattcataatgaatgaaaagaagctcctatttcgttaaaaaaaatacaaaatcctataaagaaattatattaccaaatatctaaaataagaaaagaaaaacttactttaaaaatttggggcggccgttttaaaggat

SEQ ID NO: 12297 - DNA, 430 bp, Gossypium hirsutum
  Clone ID: uC-gsflmaxxa042b11b1
ttcgtttcgcgttcgccttaatatggttgctcccatgtttgtgctcatattatcattcattgcagcctctaaagctcaatcaggcgctgtcgatgttggtgccaagtctggcgcaaaagctgacgggaaaacggatctgagtaagccatttttggatgcttgggcagatgcatgtgcctctgcaaccgcatctacagttgggactcctaaagggacatatgtattatcaaaaggaaccttagaaggtccatgcaaggctcctattgagatcaatgttcagggcactattaatgctgcggctgatcctggcgctttctaggaccctaactggggtagagtctatagcattgagaacttcaaaatgaccggcggaggaattttcaacggtcatggtaacattgcttatgagaagaacaaagatccccacaat

SEQ ID NO: 12298 - DNA, 398 bp, Gossypium hirsutum
  Clone ID: uC-gsflmaxxa042c04b1
gtctttacgatcactctcgaggtcgagagctccgatacgatcgacaacgtgaaggccaaaatccaagataaggaaggcatccctccagaccagcagcgtctgatcttcgccggaaaacagctcgaagacggccggaccttggccgattacaacatccaaaaggagtcaactctccacctcgtcctccgtctgcgcggtgggatgcaaatcttcgtgaaaaccttgactggcaagacaatcactctcgaggtcgagagctccgacacgatcgacaacgttaaagcgaagatccaagacaaggaaggcattcccccagaccagcaacgtcttatctttgccggaaaacaactcgaagacggtcgtaccttggccgactacaacattcagaaggagtcaac

SEQ ID NO: 12299 - DNA, 538 bp, Gossypium hirsutum
  Clone ID: uC-gsflmaxxa042c07b1
ccccctgcaggtaccgcggcggaaccggggggtcgccccacgcgtctgtttgatgcgggcactccatataaatggcgaaaccccaacttgtatttctattttgcttttcccttctctgtctcatatgtttttgcgccgccgatccgtgcatcatggacgacttacgtctagccggctccagtttcccgccggttcatgcaaagaggctgattagggagttgaatgtgttgcctaagggggaagtcaatgtcgttgacgaacatcgggtttcgctgccggagggtcccaaactggtggagaagcggatcaagttcccaactttggaagtgcccggtggagcctccgtcgaggatttgggtcactatgctgggtattacaagcttcctaactctcatgatgccagaatgttctacttcttcttcgaatcacgcaatatcaaacaggaccctgttgtaatctggtcgactggagggccaggctagagcagcgaattggctttgttttatgaaaatggccctttcacaattgctgataacat

SEQ ID NO: 12300 - DNA, 407 bp, Gossypium hirsutum
  Clone ID: uC-gsflmaxxa042c08b1
gtgctggaccatctccttgtgtatcacctactgtaagggataaagaacaacctatgaggccaagggggtctaatttgactggtgaagaggcagatgaagctgaagaagggacatcagctactagagatgctcctgttacaggtggtacagattcagatgcaaaagtagaatttgacttgaatgaaggctttaatgcagatgaggggaaatttggagatcctaataacttgacagcatcaggatgttcagctcctgttcaattaattagctccttgcctttccctgtttcttctgtgtctagcggcgtcccttctacaattactgttgctgctgctgctaaagggccttttgttcccccagataaccttctgcggcctaaaagggcacttggttggaaagggatcagc

SEQ ID NO: 12301 - DNA, 399 bp, Gossypium hirsutum
  Clone ID: uC-gsflmaxxa042c09b1
tcgtcacgcgtccgcctttctcaaaaagaaaaaagagccagaacttggacatgaatttcttctgctaactggttactgccatttttttacgttaaatcctgcgatctttgatggcggtctcatcttcagcttcttcctctctcttaagagcagcgtctttatactctcgaactcggttctttcattcttcgtttcggaatctcagtccaagctctccttcgcttctcgatcaccaacgatctcttgcctccgccgccgttcgttccttccattgctctgttccgcgatggagccaccgactccattggagatctccttttagccttcgtgctcagatcagagctgttaatcctgtcatcgaacggctcgagggaagttttccactatggctgctgaaca

SEQ ID NO: 12302 - DNA, 160 bp, Gossypium hirsutum
  Clone ID: uC-gsflmaxxa042d01b1
caacagggggggaagaagaccccgcagacgagaacccccccgacccagagaaagacccgagagggggaggaaaagaagcagcccacgggcgaaagagaaaaaccaccacctttaacgccatctgaaccaaaccgagaaaaacggaggcggggcacggccc

SEQ ID NO: 12303 - DNA, 467 bp, Gossypium hirsutum
  Clone ID: uC-gsflmaxxa042d02b1
cccacgcgtccgcttcttttcatttttttttcaatcaatattttctttcagatctcaagctttcttgttagtgagtaagcatgtctcatcgtaagttcgagcatccgaggcatggttcattggggtttctcccgaggaaaagagcctctcgacatcgaggaaaagtgaaggctttccccaaagatgatcctactaagccatgcagattaactgcattcttgggttataaagctggaatgacccatattgtgagggaagttgaaaagcctggatcgaagcttcacaagaaggaaacttgcgaagcagttaccattatcgagacaccgcctatggttgttgttgcagttgttggatatgtcaaaacaccgcgtggtcttcgtactttaggcactgtatgggctcagcatttgagtgaggaagtgaagcgaaggttctataagcactggtgcaagtctaagaagaaagct

SEQ ID NO: 12304 - DNA, 497 bp, Gossypium hirsutum
  unsure (1)..(497): unsure at all n locations
  Clone ID: uC-gsflmaxxa042d06b1
ttcggtaaaacccttttcagacaatagtcaaatggcttccaatgatcaccatggccatcaccatgaccatggccatgaccatcaccaccaccaccaccatcatgaccatgataaatcaacaaaatcatcatgggtgggagctgatgggaaggtttaccatagccatgatggcctagcgcctcactcacatgaacccatttactcacctggatacttcagcagaagagccccaccgcttgttaacagggatttcaatgagagggctttcactgttggaattggtggccctgttggtactgggaaaacagctntaatgctggcactgtgcacgttcctgcgggataagtacagtcttgccgctgtgacaaatgacatattcacgaaagaggatggtgagttcttggtgaaacaccaggcacttcctgcggaaaggatacgtgctgtagaaacgggaggctgcccacacgccgcttttcgtgaagacatcagtatcaatc

SEQ ID NO: 12305 - DNA, 518 bp, Gossypium hirsutum
  Clone ID: uC-gsflmaxxa042d12b1
tctctcctaaataccaacatccttccaacgctctctgcgaccattcccacgccctttccccttgttttctccgcccctattgtttctttcctctcttttatattctactccccactttctcttccttcttcacctcccattttctctccttttccttcttccctccccactaggaagaaaatggctacagctttctcaccttccaagtttgccgcccaaccattccctctcaacaccacttctcaaaacaaccctcttacaatccccactaccgtctcacccttcctcggatctacccgcaaactcatccgcctcagttcttcttccaatttgaatattcgccgtcgatctgggaccgtcgtcgccgtctccgatgtcgtcaaggaaaacaaatccaaatctaccctcaatctgttaattacaaaagaggaagggttggaattatacgaagatatggtattaggaagagcgtttgaagatatgtgtgctcagatgtattacagaggcaaaatgtttgg

SEQ ID NO: 12306 - DNA, 509 bp, Gossypium hirsutum
  Clone ID: uC-gsflmaxxa042e04b1
ctcttttctcctctccataaatctctctctcaacgcagagcgaataggcggagacttccaagaatctatcgcatcagctaatcacgctccaaagaatggatcaggttcaacacccatctgtcatgcagaaggtagcaggccagctccttcgttctagccattctcaagattttcaaggttataatgggtctttcaggagtcctgctctataccaaaggcgtgctgcatatggcaattactccaatgctgcactgcagtatcctgtccgggcttgtggagacctgtctatggttccatcaacagcttcagctatttgcgttcaagcccctgctgagaaaggatttgccagctttgccattgatttcctcatgggtggagtttctgctgctgtatcaaaaacagctgctgcaccaattgagcgtgttaagcttttgattcagaaccaagatgaaatgatcaaaagtggaaggctctctgaaccttacaagggtattggtgattgtttcaag

SEQ ID NO: 12307 - DNA, 442 bp, Gossypium hirsutum
  Clone ID: uC-gsflmaxxa042e08b1
ttccacgcgtccgtgttgtttttgaaatccaattgcaaatggccatcttcaagtctcttttgacttccctgcttctttctctgttttttcttcgctttgctgagtcgtccgatccactggtgatcgagaacatggtggaggagaactctttcaatgataagaaaatatattgcggtaggcttgtgctgagagatgcaagttatcgtcaaggcctaacctttgcaagagagcatgtgggacatgttgttctcgttgcaactgtgttcctccgggcacctacgataactatgatgtgtgtccttgctaccgtgacatgaccacccatggcggcagacacaaatgcccatagcctaaaactccacttcatcagcctgtcgtgcgtcaaactcgtagtaaattatacaataagaatgtgatgatgatcataataacgaatcacaat

SEQ ID NO: 12308 - DNA, 486 bp, Gossypium hirsutum
  Clone ID: uC-gsflmaxxa042e10b1
tttttacgcgtccgcccacgcgtccgctttttctctacttatatacataaaaagggccctgcaattacaagctgcaaaaaattaaattaaaaaaggaaaaccctaatttcggcaatggccagaactgatcaagaagcaatcgagactttcatcaacatcaccggggcatcagaagctgttgccattgaaaagcttgaggagcatggtggtgatctcaatgcagctgtaaatgcacatttcagtgaaggagatagaaacaccacaaggtcaacgtcaactgtagttcctgtagatgacgccatggatatagatgatccaatagaagctgtaccaagcaggccagcctttccacttcttccaccatctagaacaatgaatgcattctcattgcttgatccaaactttcgtagaagcttctttgatggtgtttccgattttacaactcgtgaaccattggttacacatccaagagaggtgagggaagta

SEQ ID NO: 12309 - DNA, 474 bp, Gossypium hirsutum
  Clone ID: uC-gsflmaxxa042f08b1
tttcacgcgtccgttggcaatcaacatggagaacggatatatcaacccggcaccaagtccacttaggaaaatcatcacggttgcatccattgctgccggcatccagtttgggtgggctctgcagctgtctctcctgacaccctacgtccagacccttggtgtaccccacgcttgggctgctttcatttggctttgcggtcccatttctggccttctggttcaacccatcgtgggatacaacagtgaccgttgcacctctcggttcggccgacgccgaccctttattgtcattggagctctctctgtctccatagctgtcttcctcatcggtttcgccaaagacattggccaccatgcgggagattccttgaagagaacgaccaaaccgagagctgtagccatctttgtcgtcgggttttggatcctcgacgtggctaacaacatgttgcaaggtccgtgtcgagctctcctcgc

SEQ ID NO: 12310 - DNA, 363 bp, Gossypium hirsutum
  Clone ID: uC-gsflmaxxa042g05b1
actaccaccaacatagtccaacattttcataacaatggctgcagtcacaaacgccgctgctacatcctccttcatggggacacgcttccccgacgtctacacaagttcagggagattcgtcgccaggtttggttttggcggcaaaaaagcagctcccaagaaagcctcgaaacaaacctccgaccgccctctatggtacccaggagcggaggctcctgactggctcgaaggaagcttggtgggtgattacgggttcgacccgttcgggttagggaaacccagcggagtacttgcaatatgatttggattctttggaccagaacctgacctaaaatatggctggtgagatcattggaactagga

SEQ ID NO: 12311 - DNA, 394 bp, Gossypium hirsutum
  Clone ID: uC-gsflmaxxa042g11b1
ttctgacgcgtgggacagagatcaaagaggaggtgactgactgtaagcagagaacacagcaaatttttttttttaaatgggtgggaaaatcagcatggctgcattttttgtagttttggctgcaaatgtgttgcagagtacgtatggtgcaacttataaggtgggtggctccactggctggcgagtccctaccaatattgatttttacgaagattgggctgatgataaagtcttcgttgttggggatgctcttgttttcaactttactactggaaagcataatgttgcagtggtgaccgaagctgcttacgaggcgtgcaacaccaccgatactataactatcatatgcgacggaccggcaaggattacccttaacaggaccggcaatttttac

SEQ ID NO: 12312 - DNA, 506 bp, Gossypium hirsutum
  Clone ID: uC-gsflmaxxa042h02b1
gtttgtttagaacaatgaacaacaattcagcaaagagccctatgatcgtctcgttcggcgagatgctaatagacttcgttcctgatgttgccggcgtttccttggctgaatcctacgctttcatcaaagctcccggcggcgcacctgctaacgttgcatgtgccatcgctaagctcggaggcaacgctgccttcattggcaaagtaggagacgatgagttcggtcacatgttggcgaatctgttgaataagagcggagtgaacagcgacgggatctgctctgacaaagatgcgaggactgcgttggcattcgttacgctgaaggcggatgggcaaagggaattcatgttttatcgatcccctaatgcggatatgtctgtgaaagaatcggagttgaaattggatctcattaagcaagccaagatattccattatggatccataagtttgatatcggaaccctgcaaatcagctcacatggccgccatgaaagctgctaaacaggct

SEQ ID NO: 12313 - DNA, 252 bp, Gossypium hirsutum
  Clone ID: uC-gsflmaxxa042h03b1
ctgtctcgtgggttgctttttgcttcttactctcaaccaaaaatgactgctcaggccgacaaagagatcgaagagatcctggcaggtcatctcgaccaacataaaatcgattgcgagataccagagcaacctgttgttgaagatgacgacacggaagatgacgatgaccatgatgacgaagatgatgccgaaggtcatcatgagggagaaggagatggaactggtaggtcaaagcaaagcccgagtgaaaag

SEQ ID NO: 12314 - DNA, 496 bp, Gossypium hirsutum
  unsure (1)..(496): unsure at all n locations
  Clone ID: uC-gsflmaxxa042h04b1
tttcttttctcttctcttcccttttgttctttttttttctcctgagtttactggctctctctgtcaatggacaaggacaagcaccagcaacagctgtctttggcaaagagttccaggcaaagttgcaatgaatggatttttagggatgttccaagtgatatcacaatagaagtaaatggagggacaattgctctacacaagtttcctcttgtctctcgaagtgggcgaatccggaagctagttgaggaacatagggactcagatatctcaagggtggagctcatgaatctacctggtggtgccgagtcatttgagttggcagcaaaattctgttatggcattaactntgagattacacccttaaatgtggctcagctctgttgtgtttcggattacctcgaaatgacagaagaattttcaaaggataatctttacttacatgctgaacaatatcttgaaagcattgtttataagaacctggagatgtgtgttgaag

SEQ ID NO: 12315 - DNA, 413 bp, Gossypium hirsutum
  Clone ID: uC-gsflmaxxa042h07b1
ttctttagaagacagaccccagccaggaacgaacctctctttcttttctgacagacttgctgctaaattcgcatcatgtcttggtgcacaattgaatccgatccaggtgtttttacggaacttatacagcagatgcaagttaaaggcgtacaagtagaggaattgtattcattggatctcgattctctaaacaatcttaggcctgtgtatgggttgattttccttttcaaatggcacccaggggagaaggatgaacgtcttgtaatcaaggacccgaaccctgatctgttctttgctagtcaggtcatcaataatgcttgtgctacacaagctatattgtctattctcttgaactgccctgatattgacattggcccaaaactatcaaagttgaaagaattcactaaaaactt

SEQ ID NO: 12316 - DNA, 410 bp, Gossypium hirsutum
  unsure (1)..(410): unsure at all n locations
  Clone ID: uC-gsflmaxxa042h09b1
agaaatcaaagcagaaactgcttccttcctcttgaatttttagccttatatatctttatctttctccccagccaacggtttacttcgcaagtttttaaacangaaaagcaacaatttccaatggctccctgactcgttgttgtaaggcgtagtagcattaggcaaagggttgaggaaagtcaaatccccattggtggtctggggagcataggctgattcttgagaaccagggttgtatatcaacccgtttacccgccggtgaatcagactcagttcgccatggcttattacgtcattaactattccaagctctgtctttgggagttcgtggagtatagtaaaatgctatacctggacggcgacatacaattatatgacaacatagatcacttatttgattngcgaaacgg

SEQ ID NO: 12317 - DNA, 462 bp, Gossypium hirsutum
  Clone ID: uC-gsflmaxxa043a03b1
acttcttttcattttccttcagacttcaccaaagtgagaaaatgacttccccgttttcctttccttgacttctccatctttctactttaaaacccaaagccccaaaagagtttttaattttcttttcttataaccctcaaaaaaaattttcttattggagagagcttttgataggatatgaatatggaggcaagagttggggtggtggtagaaggagggcaaagggctttgaattcagcccatggagctgttgttgatgctggggctagaaagtttttacagcagcagcagcaacaacaacatgagcattcttcaaaacagggcttgaatccgcagattgggactgttcaacagcttcttgctggtggtattgctggtgcttttagcaagacttgtacggctcctcttgcttcgttaaccatcttatttcaagtccaaggaatgcaatcagatttatcagca

SEQ ID NO: 12318 - DNA, 344 bp, Gossypium hirsutum
  Clone ID: uC-gsflmaxxa043a04b1
tttacgcgtccgcccacgcgtccggagctcgatcaaatttgtggagcaaccgactaccccatcgaatgcgtaagattcatttctccgtacttgaacgacagtatcaaaatcgacccactcaacgtccttaaagtcgggattcacgtagcgactaacatgaccatagaagccctcaatctcgctataaagattagggacgaccccaaaacctcaccaaatgctcaatcatgccttcgcgtatgcaccgaaaactacgacttaatccccgacggcaacgaactcgcgctacgtgccatcggggaacgcaactggagcgatttgagaaaccagctgagcgggggatc

SEQ ID NO: 12319 - DNA, 463 bp, Gossypium hirsutum
  Clone ID: uC-gsflmaxxa043b11b1
ttttcacgcgtccgggaaaaaaaaattctttttgggtcaatctgaataagttcttatttttatgtttttggtcattttctgtctgggatttccagcttttaagtgcagtctcggtttaataatgaaaattcaaacgaaaaaaggaaaaatagggactttgattaattagaaaacacatcttcttccccttccctttcgactttcttttaggggttttaaacaaagaacacgagaatccacacggcaaattatggttgacagaagctatcaatgcaaagatgtgctaatcttagcttatcagagttttggtgtactctttggtgacctaagtatttcaccactttatgcctttaaaagcacattctctgggaatttgagtaattatcaatctgaagatgttatctttggggctctatctttgattttttggactttgacacttctttccttgttcaaacatgtc

SEQ ID NO: 12320 - DNA, 292 bp, Gossypium hirsutum
  Clone ID: uC-gsflmaxxa043c03b1
ggacccggcccgtaattcctttgcgaaccaacccgcccgttattttacactcacaccaaggcacctccggggatgctttaaaaaaaacagagggtcctaaacaaaccctcacatgtaataccatccccctaacattgcatagccctacctcggatcaccatgataaagacctacatcctaaacatggaacggaacccaaaccaccaacagactcttaatttaactgctaaacagattaatgatgccccgacccttgctgacttcacactccagaacgaatccccactccatt

SEQ ID NO: 12321 - DNA, 460 bp, Gossypium hirsutum
  Clone ID: uC-gsflmaxxa043c07b1
ttttcatctcctttttacaaaataaattgcttagcttttggttttgtttcagtcgagaaaacagacagttcattttttttccatgttctatcgatcggtggtgtttccttcaatctcagaaaggaaacggaattcaaacagaagcaaaaccgacactgtaatggcttcttcttcttcttcttcggctttgaaatctcagcctcttcataacttccaattgcatgaccttaaatgggccatgaaccacactagcaaccaccgccttcggaaactctccgattctttgcacaaatctcctcaacgtggagagagtggttctgagtccgacaataaccggaaggtcaatccggtgtgcgaagctcgctcaaagattggacattcttcaggtttttctcctgatcatagaactggaaaatcagagaggaaattcatcgatggttctgatgttctggttgattgt

SEQ ID NO: 12322 - DNA, 459 bp, Gossypium hirsutum
  Clone ID: uC-gsflmaxxa043c09b1
ttttgggattatcaatttgaagccttcttcggggttcctctttcaagatgcagattttcgtcaagaccctcaccgtcaagaccatcacccttgaggtggaaagttctgataccatcgacaatgtaaagaccaagatccaagacaaggaagggatcccaccagaccaacagaggcttatctttgctggtaaacagctggaggatggccgtacccttgctgactacaacatccagaaggaatccacactccatttggtcctccgattgaggggtggtatgcaaatttttgtcaagaccctcaccgggaagaccatcacccttgaggtggaaagttctgataccatcgacaatgtaaaggccaagatccaagacaaagaagggatcccaccagaccagcagaggcttatctttgctggtaaacagctggaggatggccgtacccttgctgactacaacatcc

SEQ ID NO: 12323 - DNA, 399 bp, Gossypium hirsutum
  Clone ID: uC-gsflmaxxa043d02b1
cctctcaattctcacttcctttacctccgttcttttgccgtcgtattttttttccagagatttgttcttttcgcttctttcgttatggggaagatcaagatcggaatcaacggatttggaaggatcgggcgtttggttgccagagttgctctccaaagtgaagatgttgagctcgttgctgttaacgatcctttcatcaccaccgattacatgacctacatgtttaagtatgacagtgttcacggtcaatggaagcaccatgagcttaaggtgaaggactcaaaaacccttctctttggtgaaaagcctgtcactgttttcggcatcagaaaccctgaagaaatcccttggggtgagactggagctgattatgtcggtgagtctactggtgttttcact

SEQ ID NO: 12324 - DNA, 458 bp, Gossypium hirsutum
  unsure (1)..(458): unsure at all n locations
  Clone ID: uC-gsflmaxxa043d03b1
tttaatccccccacccccttttactgcattttctttgcaaccaaccaaaggataagctaagaaacaagagttcaggagggaagaatagggcaccttaaagattgaatcttttcgagatttttgattttgggtctttttattttttaagcaaatggctagtggtggtggaaataataggaatgggactcataggaactctctcaaaggaacgacaacaacatcaacagcatcaacagataagccactctctgtgaattccaacccttcaaagcctgcattcaaaaacaagtcttcgcctttgaccggtgcttcttccgggttaaggaagagtagccccggatcacttggaggtggagctgccaaagatgatgctggagttcctggaagagttcgagtggctgtgagattacgtccacgtaatgcagaagagtcagtagcagatgctgattntgctgatt

SEQ ID NO: 12325 - DNA, 411 bp, Gossypium hirsutum
  Clone ID: uC-gsflmaxxa043d05b1
ttcattttcaacccaaaattttttttaaaaaaaattctaaataagtgatggggtttccggccaatggctcatcggacaaaccattgaagttcctgatctacggtcgaactggttggatcggtggtttattaggcaaactctgcgaatcccagggaatcgattacgagtacggctccggccgtttagagagccggatttcgcttgagtccgacatagccaacgtgaaaccgacccatgtattcaatgccgccggtgtcaccggtcgtccgaacgtcgattggtgcgaatcccataaggtggagaccatcagaaccaatgtggtcgggacccttaccctcgctgacgtctgcagagacaaaggcctcatcttgattaattatgctacaggttgcatctttgagtacgatgagg

SEQ ID NO: 12326 - DNA, 419 bp, Gossypium hirsutum
  Clone ID: uC-gsflmaxxa043e01b1
tttacgcgtccgaaaaaataaataaattaaatgttgatataggtgctctgcttgtgcttctcttatactgagttccaagcaaaaccctttttttgtttttcgcctgattccgctgttatggcttctcaatcttctaagggatcagttcatgatttcactgttaaggatgcaagagggaatgatgttgatttaagtatttacaagggcaaggttttgttgattgtcaatgttgcatcacaatgtggcttgaccaattccaactacactgagctaagtaaattgtatgagcaatataaagatcaaggttttgagattcttgcattcccatgtaaccagtttggaggacaggagccagtgaacaatgagcaaatcttagagtttgcttgcactcgcttaaagctgaataccccatatttgat

SEQ ID NO: 12327 - DNA, 474 bp, Gossypium hirsutum
  Clone ID: uC-gsflmaxxa043e07b1
tattgctggagcattattaggagttgggattgtcaattgtggtgttaagaatgattgcgaccctgcactggctctattgagtgattatattagtaaagaggattcttcagtccgtattggtgcaattatgggtttgggaattgcatatgctggtgcccagaatgagcagattcgtagcagcttgactctgatacttaatgatgcaaaggctccccttgatgtgatagcatttactgcaatttcgttgggcttgatatacgtgggttcctgcaatgaggaggttgcacaggctattatatttgctttaatggaccgaagtgagtcatagttgggggagcccctcactcgtcttctgacacttgctcttggtcttttataccttgggaagcaggaaagagtggaggccactgcagaggtctcaaagacgttcaatgaaaaaataagaaaatcttgtgatatgacactactttcttg
